US007507875B2

(12) United States Patent
Bloksberg et al.

(10) Patent No.: US 7,507,875 B2
(45) Date of Patent: Mar. 24, 2009

(54) TRANSCRIPTION FACTORS

(75) Inventors: Leonard N. Bloksberg, Auckland (NZ); Catherine Bryant, Auckland (NZ); Marie B. Connett, Charleston, SC (US); Sarah Jane Emerson, Auckland (NZ); Michael J. Frost, Auckland (NZ); Richard Llewellyn Sydney Forster, Auckland (NZ); Murray Grigor, Auckland (NZ); Colleen Higgins, Auckland (NZ); Annette Lasham, Auckland (NZ); Steven Troy Lund, Vancouver (CA); Andreas Magusin, Auckland (NZ); Jonathan Phillips, Auckland (NZ); Sathiah Puthigae, Auckland (NZ); Stella Veerakone, Auckland (NZ); Claire Westwood, Auckland (NZ); Katrina Gause, Summerville, SC (US); Marion Wood, Auckland (NZ); Ilkka Havukkala, Auckland (NZ); William H. Rottmann, Summerville, NC (US)

(73) Assignee: Arborgen, LLC, Summerville, SC (US)

( * ) Notice: Subject to any disclaimer, the term of this patent is extended or adjusted under 35 U.S.C. 154(b) by 101 days.

(21) Appl. No.: 10/863,905

(22) Filed: Jun. 7, 2004

(65) Prior Publication Data

US 2007/0039070 A1   Feb. 15, 2007

Related U.S. Application Data

(60) Provisional application No. 60/476,189, filed on Jun. 6, 2003.

(51) Int. Cl.
*C12N 15/29* (2006.01)
*C12N 15/82* (2006.01)
*C12N 5/04* (2006.01)

(52) U.S. Cl. ...................... 800/278; 536/23.6; 800/287; 435/419; 435/320.1

(58) Field of Classification Search ............... 536/23.1, 536/23.6; 800/278, 290, 298, 287; 435/320.1, 435/419
See application file for complete search history.

(56) References Cited

U.S. PATENT DOCUMENTS

| 5,451,514 | A | 9/1995 | Boudet et al. |
| 6,132,970 | A | 10/2000 | Stemmer |
| 6,303,847 | B1 * | 10/2001 | Kawaoka et al. ............ 800/298 |
| 6,506,559 | B1 | 1/2003 | Fire et al. |
| 2002/0100083 | A1 | 7/2002 | Connett-Porceddu et al. |
| 2002/0107644 | A1 | 8/2002 | Meglen et al. |
| 2002/0113212 | A1 | 8/2002 | Meglen et al. |

FOREIGN PATENT DOCUMENTS

| EP | 154 204 B1 | 1/1994 |
| WO | WO 94/23044 | 10/1994 |
| WO | WO 95/11755 | 5/1995 |
| WO | WO 99/32660 | 7/1999 |
| WO | WO 99/61631 | 12/1999 |
| WO | WO 02/015675 A1 | 2/2002 |
| WO | WO 03/002751 A2 | 1/2003 |

OTHER PUBLICATIONS

Yang et al (2001, PNAS 98(20):11438-11443).*
Riechmann et al (2000, Current Opinion in Plant Biology 3:423-434).*
Bowie et al, Science 247:1306-1310, 1990.*
McConnell et al, Nature 411 (6838):709-713, 2001.*
Abelson et al., "Guide to Molecular Cloning Techniques," Methods in Enzymology, 1987, vol. 152, pp. i-xi.
Aharoni et al., "Novel Insight into Vascular, Stress, and Auxin-Dependent and -Independent Gene Expression Programs in Strawberry, a Non-Climacteric Fruit," Plant Physiol., Jul. 2002, pp. 1019-1031, vol. 129.
Albani et al., "DcE2F, a Functional Plant E2F-like Transcriptional Activator from *Daucus carota*," The Journal of Biological Chemistry; 2000, vol. 275, No. 25, Issue of Jun. 23, pp. 19258-19267.
Allona et al., "Analysis of xylem formation in pine by cDNA sequencing," Proc. Nat'l Acad. Sci., Aug. 1998, pp. 9693-9698, vol. 95, The National Academy of Sciences.
Altschul et al., "Basic Local Alignment Search tool," J. Mol. Biol., 1990, vol. 215, pp. 403-410.
An et al., "Organ-Specific and Developmental Regulation of the Nopaline Synthase Promoter in Transgenic Tobacco Plants," Plant Physiol., 1988, vol. 88, pp. 547-552.
Arizmendi et al., "The Transcription Factor CCAAT/Enhancer-binding Protein β Regulates Gluconeogenesis and Phosphoenolpyruvate Carboxykinase (GTP) Gene Transcription during Diabetes," The Journal of Biological Chemistry, 1999, vol. 274, No. 19, Issue of May, pp. 13033-13040.
Audic et al., "The Significance of Digital Gene Expression Profiles," Genome Research, 1997, vol. 7, pp. 986-995.
Baima et al., "The *Arabidopsis* ATHB-8 HD-Zip Protein Acts as a Differentiation-Promoting Transcription Factor of the Vascular Meristems," Plant Physiology, Jun. 2001, vol. 126, pp. 643-655.
Baltz et al., "Characterization of a Pollen-specific cDNA from Sunflower Encoding a Zinc Finger Protein," The Plant Journal, 1992, vol. 2(5), pp. 713-721.
Bastola et al., "Alfin1, a Novel Zinc-Finger Protein in Alfalfa Roots that Binds to Promoter Elements in the Salt-Inducible MsPRP2 Gene," Plant Molecular Biology, 1998, vol. 38, pp. 1123-1135.
Baucher et al., "Red Xylem and Higher Lignig Extractability by Down-Regulating a Cinnamyl Alcohol Dehydrogenase in Poplar," Plant Physiol., 1996, vol. 112, pp. 1479-1490.
Baumann et al., "The DNA Binding site of the Dof Protein NtBBF1 is Essential for Tissue-Specific and Auxin-Regulated Expression of the *rolB* Oncogene in Plants," The Plant Cell, Mar. 1999, vol. 11, pp. 323-333.
Berg et al., "The Galvanization of Biology: A Growing Appreciation for the Roles of Zinc," Science, Feb. 23, 1995, vol. 271, pp. 1081-1085.

(Continued)

*Primary Examiner*—Stuart F. Baum
(74) *Attorney, Agent, or Firm*—Foley & Lardner LLP

(57) ABSTRACT

The invention provides polynucleotide sequences isolated from plants encoding transcription factors. Polypeptides encoded by the polynucleotides are also provided. Products and methods of use are disclosed.

9 Claims, 294 Drawing Sheets

OTHER PUBLICATIONS

Bernhardt et al., "The bHLH Genes GLABRA3 (GL3) and Enhancer of GLABRA3 (EGL3) Specify Epidermal Cell Fate in the *Arabidopsis* Root," Development, 2003, vol. 130, pp. 6431-6439.

Bharti et al., "Isolation and Characterization of HsfA3, a New Heat Stress Transcription Factor of *Lycopersicon peruvianum*," The Plant Journal, 2000, vol. 22(4), pp. 355-366.

Boggon et al., "Implication of Tubby Proteins as Transcription Factors by Structure-Based Functional Analysis," Science, Dec. 10, 1999, vol. 286, pp. 2119-2125.

Bolle, C., "The Role of GRAS Proteins in Plant Signal Transduction and Development," Planta, Mar. 2004, vol. 218, No. 5, pp. 683-692.

Borisov et al., "The *Sym35* Gene Required for Root Nodule Development in Pea is an Ortholog of *Nin* from *Lotus japonicus*[1]," Plant Physiology, Mar. 2003, vol. 131, pp. 1009-1017.

Bowman et al., "*Craws Claw*, a Gene the Regulates Carpel and Nectary Development in *Arabidopsis*, Encodes a Novel Protein with Zinc Finder and helix-loop-helix domains," Development, 1999, vol. 126, pp. 2387-2396.

Brady et al., "The Abscisic Acid Insensitive 3 (ABI3) Gene is Modulated by Farnesylation and is Involved in Auxin Signaling and Lateral Root Development in *Arabidopsis*," The Plant Journal, 2003, vol. 34, pp. 67-75.

Brutlag et al., "Improved Sensitivity of Biological Sequence Database Searches," Computer Applications in the Biosciences, Jul. 1990, vol. 6, No. 3, pp. 237-245.

Calkhoven et al., "Multiple Steps in the Regulation of Transcription-Factor Level and Activity," Biochem. J., 1996, vol. 317, pp. 329-342.

Cao et al., "Regulated Expression of Three C/EBP Isoforms during Adipose Conversion of 3T3-L1 Cells," Genes & Development, 1991, vol. 5, pp. 1538-1552.

Capili et al., "Solution Structure of the PHD Domain from the KAP-1 Corepressor: Structural Determinants for PHD, Ring and LIM Zinc-Binding Domains," The EMBO Journal, 2001, vol. 20 No. 1 & 2, pp. 165-177.

Carabelli et al., "The *Arabidopsis* Athb-2 and -4 Genes are Strongly Induced by Far-Red-Rich Light," The Plant Journal, 1993, vol. 4(3), pp. 469-479.

Cardon et al., "Functional Analysis of the *Arabidopsis thaliana* SBP-Box Gene SPL3: a Novel Gene Involved in the Floral Transition," The Plant Journal, 1997, vol. 12(2), pp. 367-377.

Cardon et al., "Molecular Characterisation of the *Arabidopsis* SBP-box Genes," Gene, 1999, vol. 237, pp. 91-104.

Carroll et al., "Tubby Proteins: The Plot Thickens," Nature Reviews, Jan. 2004, vol. 5, pp. 55-63.

Chang et al., "A Simple and Efficient Method for Isolating RNA from Pine Trees," Plant Molecular Biology Reporter, 1993, vol. 11(2), pp. 113-116.

Chao et al., "Activation of the Ethylene Gas Response Pathway in *Arabidopsis* by the Nuclear Protein Ethylene-Insensitive3 and Related Proteins," Cell, Jun. 27, 1997, vol. 89, pp. 1133-1144.

Chen et al., "A Plant Gene Encoding a Myb-like Protein That Binds Telomeric GGTTTAG Repeats in Vitro," The Journal of Biologica Chemistry, 2001, vol. 276, No. 19, pp. 16511-16519.

Chen, et al., "The Promoter of a $H_2O_2$-inducible, *Arabidopsis* glutathione S-transferase Gene Contains Closely Linked OBF- and OBP1-Binding Sites," The Plant Journal, 1996, vol. 10(6), pp. 955-966.

Cheong et al., "Transcriptional Profiling Reveals Novel Interactions between Wounding, Pathogen, Abiotic Stress, and Hormonal Responses in *Arabidopsis*," Plant Physiol., Jun. 2002, pp. 661-677, vol. 129, American Society of Plant Biologists.

Chrispeels et al., "*AtZFP1*, Encoding *Arabidopsis thaliana* $C_2H_2$ Zinc-Finger Protein 1, is Expressed Downstream of Photomorphogenic Activation," Plant Molecular Biology, 2000, vol. 42, pp. 279-290.

Cubas et al., The TCP Domain: a Motif found in Proteins Regulating Plant Growth and Development, The Plant Journal, 1999, vol. 18(2), pp. 215-222.

Cvitanich et al., "CPP1, a DNA-binding Protein Involved in the Expression of a Soybean Leghemoglobin c3 Gene," PNAS, Jul. 5, 2000, vol. 97, No. 14, pp. 8163-8168.

D'Agostino et al., "Characterization of the Response of the *Arabidopsis* Response Regulator Gene Family to Cytokinin," Plant Physiology, Dec. 2000, vol. 124, pp. 1706-1717.

Dawid et al., LIM Domains: Multiple Roles as Adapters and Functional Modifiers in Protein Interactions, TIG, Apr. 1998, vol. 14 No. 4, pp. 156-162.

Dehesh et al., "Twin Autonomous Bipartite Nuclear Localization Signals Direct Nuclear Import of GT-2," The Plant Journal, 1995, vol. 8(1), pp. 25-36.

Desvoyes et al., "A Novel Plant Homeodomain Protein Interacts in a Functionally Relevant Manner with a Virus Movement Protein," Plant Physiology, Aug. 2002, vol. 129, pp. 1521-1532.

Devereux et al., "A Comprehensive Set of Sequence Analysis Programs for the VAX," Nucleic Acids Research, 1984, vol. 12 No. 1, pp. 387-395.

De Vetten et al., "A Maize Protein Associated with the G-Box Binding Complex Has Homology to Brain Regulatory Proteins," The Plant Cell, Oct. 1992, vol. 4, 1295-1307.

De Vetten et al., "Transcriptional Regulation of Environmentally Inducible Genes in Plants by an Evolutionary Conserved Family of G-Box Binding Factors," Int. J. Biochem., 1994, vol. 26, No. 9, pp. 1055-1068.

De Wildt, et al., "Antibody arrays for high-throughput screening of antibody-antigen interactions," Nature Biotechnology, 2000, pp. 989-994, vol. 18.

Dharmawardhana et al., "cDNA cloning and heterologous expression of coniferin β-glucosidase," Plant Molecular Biology, 1999, vol. 40, pp. 365-372.

Dinneny et al., "The Role of Jagged in Shaping Lateral Organs," 2003, Development, vol. 131(5), pp. 1101-1110.

Drews et al., "Negative Regulation of the *Arabidopsis* Homeotic Gene AGAMOUS by the APETALA2 Product," Cell, Jun. 14, 1991, vol. 65, pp. 991-1002.

Duval et al., "Molecular characterization of *AtNAM*: a Member of the *Arabidopsis* NAC Domain Superfamily," Plant Molecular Biology, 2002, vol. 50, pp. 237-248.

Edwards et al., "Multiple Genes Encoding the Conserved CCAAT-Box Transcription Factor Complex Are Expressed in *Arabidopsis*," Plant Physiol, 1998, vol. 177, pp. 1015-1022.

Egelkrout et al., "Two E2F Elements Regulate the Proliferating Cell Nuclear Antigen Promoter Differently during Leaf Development," The Plant Cell, Dec. 2002, vol. 14, pp. 3225-3236.

Ellis et al., "Stable transformation of picea-glauca by particle-acceleration," Biotechnology, 1993, vol. 11, pp. 84-89. (Abstract Only).

Ernst et al., "Structure of the Conserved Domain of ANAC, a Member of the NAC Family of Transcription Factors," European Molecular Biology Organization Reports, 2004, vol. 5, No. 3, pp. 297-303.

Eulgem et al., "Early Nuclear Events in Plant Defence Signalling: Rapid Gene Activation by WRKY Transcription Factors," The European Molecular Biology Organization Journal, 1999, vol. 18, No. 17, pp. 4689-4699.

Eulgem et al., "The WRKY Superfamily of Plant Transcription Factors," Trends in Plant Science Reviews, May 2000, vol. 5, No. 5, pp. 199-206.

Foster et al., "Plant bZIP Proteins gather at ACGT Elements," The FASEB Journal, Feb. 1994, vol. 8, pp. 192-200.

Franke et al., "Modified Lignin in Tobacco and Poplar Plants overexpressing the *Arabidopsis* Gene encoding Ferulate 5-hydroxylase," The Plant Journal, 2000, vol. 22(3), pp. 223-234.

Fromm et al., "An Octopine Synthase Enhancer Element Directs Tissue-Specific Expression and Binds ASF-1, a Factor from Tobacco Nuclear Extracts," The Plant Cell, Oct. 1989, vol. 1, pp. 977-984.

Fukushima et al., "Extraction and Isolation of Lignin for Utilization as a Standard to Determine Lignin Concentration Using the Acetyl Bromide Spectrophotometric Method," Journal of Agricultural and Food Chemistry, 2001, vol. 49, No. 7, pp. 3133-3139.

Gelinas et al., "G to A Substitution in the Distal CCAAT Box of the $^A\gamma$-globin Gene in Greek Hereditary Persistence of Fetal Haemoglobin," Nature, Jan. 24, 1985, vol. 313, pp. 323-325.

Gleave et al., "A versatile binary vector system with a T-DNA organizational structure conducive to efficient integration of cloned DNA into the plant genome," Plant Mol. Biol., 1992, pp. 1203-1207, vol. 20.

Guevara-Garcia et al., "A 42 bp Fragment of the *pmas*1' Promoter Containing an *ocs*-like Element Confers and Developmental, Wound-and Chemically Inducible Expression Pattern," Plant Molecular Biology, 1998, vol. 38, pp. 743-753.

Guilfoyle et al., "The ARF Family of Transcription Factors and their Role in Plant Hormone-Responsive Transcription," Cellular and Molecular Life Sciences, Jul. 1998, vol. 54, pp. 619-627.

Hahn et al., Yeast HAP2 and HAP3: Transcriptional Activators in a Heteromeric Complex, Science, Apr. 15, 1988, vol. 240, pp. 317-321.

Halbach et al., "Transcriptional Activation by the PHD" Finger is Inhibited Through an Adjacent Leucine Zipper that Binds 14-3-3 Proteins, Nucleic Acids Research, 2000, vol. 28, No. 18, pp. 3542-3550.

Hanas et al., "*Xenopus* Transcription Factor A Requires Zinc for Binding to the 5 S RNA Gene," The Journal of Biological Chemistry, 1983, vol. 258, No. 23, pp. 14120-14125.

Hardtke et al., "Overlapping and Non-Redundant Functions of the *Arabidopsis* Auxin Response Factors Monopteros and Nonphototropic Hypocotyl 4," 2003, Development, vol. 131, pp. 1089-1100.

Harrison et al., "DNA Recognition by Proteins with the Helix-Turn-Helix Motif," Annual Reviews Biochem. 1990, vol. 59, pp. 933-969.

He et al., "A Novel Zinc-Finger Protein with a Proline-Rich Domain Mediates ABA-Regulated Seed Dormancy in *Arabidopsis*," Plant Molecular Biology, 2004, vol. 0, pp. 1-9.

Heisler et al., "Spatula, a Gene that Controls Development of Carpel Margin Tissues in *Arabidopsis*, Encodes a bHLH Protein," Development, 2001, vol. 128, pp. 1089-1098.

Hertzber et al., "A Transcriptional Roadmap to Wood Formation," PNAS, Dec. 4, 2001, vol. 98, No. 25, pp. 14732-14737.

Hertzberg et al., "cDNA Microarray Analysis of Small Plant Tissue Samples Using a cDNA Tag Target Amplification Protocol," The Plant Journal, 2001, vol. 25(5), pp. 585-591.

Hinchee et al., "Production of Transgenic Soybean Plants Using Agrobacterium-Mediated DNA Transfer," Bio/Technology, Aug. 1988, vol. 6, pp. 915-922.

Hobo et al., "A bZIP Factor, TRAB1, Interacts with VP1 and Mediates Abscisic Acid-Induced Transcription," Proc. Natl. Acad. Sci., Dec. 21, 1999, vol. 96, No. 26, pp. 15348-15353.

Horsch et al., "A Simple and General Method for Transferring Genes into Plants," Science, Mar. 8, 1985, vol. 227, pp. 1229-1231.

Hsieh et al., "From Flour to Flower: How Polycomb Group Proteins Influence Multiple Aspects of Plant Development," Review, Sep. 2003, vol. 8, No. 9, pp. 439-445.

Hu et al., "Sequence Requirements for Coiled-Coils: Analysis with λ Repressor-GCN4 Leucine Zipper Fusions," Science, Dec. 7, 1990, vol. 250, No. 4986, pp. 1400-1403.

Huang et al., "Agrobacterium Rhizogenes-Mediated Genetic Transformation and Regeneration of a Conifer: *Larix decidua*," In Vitro Cell. Dev. Rept., Oct. 1991, pp. 201-207.

Hübel et al., A Rabidopsis Heat Shock Factor is Constitutively Active in Drosophila and Human Cells, Mol. Gen. Genet, 1995, vol. 248, pp. 136-141.

Huber et al., "Detection of Single Base Alterations in Genomic DNA by Solid Phase Polymerase Chain Reaction on Oligonucleotide Microarrays," Analytical Biochemistry, 2001, vol. 299, pp. 24-30.

Hughes et al., "Expression Profiling Using Microarrays Fabricated by an Ink-Jet Oligonucleotide Synthesizer," Nature Biotechnology, Apr. 2001, vol. 19, pp. 342-347.

Ingham, P.W., "The Molecular Genetics of Embryonic Pattern Formation in *Drosophila*," Nature, Sep. 1, 1988, vol. 335, pp. 25-34.

Irish et al., "Function of the Apetala-1 Gene During *Arabidopsis* Floral Development," The Plant Cell, Aug. 1990, vol. 2, pp. 741-753.

Iwahara et al., "Solution Structure of the DNA Binding Domain from Dead Ringer, a Sequence-Specific AT-Rich Interaction Domain (ARID)," The European Molecular Biology Organization Journal, 1999, vol. 18, No. 21, pp. 6084-6094.

Izawa et al., "Plant bZIP Protein DNA Binding Specificity," J. Mol. Biol. 1993, vol. 230, pp. 1131-1144.

Jackson et al., "Expression of Maize KNOTTED1 Related Homeobox Genes in the Shoot Apical Meristem Predicts Patterns of Morphogenesis in the Vegetative Shoot," Development, 1994, vol. 120, pp. 405-413.

Jefferson, R.A., "Assaying Chimeric Genes in Plants: The GUS Gene Fusion System," Plant Molecular Biology Reporter, 1987, vol. 5, No. 4, pp. 387-405.

Jofuku et al., "Control of *Arabidopsis* Flower and Seed Development by the Homeotic Gene APETALA2," The Plant Cell, Sep. 1994, vol. 6, pp. 1211-1225.

Johnson et al., "Transparent Tests BL ABRA2, a Trichome and Seed Coat Development Geneof Arabidopsis, Encodes a WRKY Transcription Factor," The Plant Cell, Jun. 2002, vol. 14, pp. 1359-1375.

Kagaya et al., "RAV1, a Novel DNA-Binding Protein, Binds to Bipartite Recognition Sequence Through Two Distinct DNA-Binding Domains Uniquely Found in Higher Plants," Nucleic Acids Research, 1999, vol. 27, No. 2, pp. 470-478.

Kane et al., "Assessment of the Sensitivity and Specificity of Oligonucleotide (50mer) Microarrays," Nucleic Acids Research, 2000, vol. 28, No. 22, pp. 4552-4557.

Kang et al., "Characterization of Salicylic Acid-Responsive, *Arabidopsis* Dof Domain Proteins: Overexpression of OBP3 Leads to Growth Defects," The Plant Journal, 2000, vol. 21(4), pp. 329-339.

Katagiri et al., "Plant Transcription Factors: Present Knowledge and Future Challenges," Reviews, Jan. 1992, vol. 8, No. 1, pp. 22-27.

Kawaoka et al., "Functional Analysis of Tobacco LIM Protein Ntlim1 Involved in Lignin Biosynthesis," The Plant Journal, 2000, vol. 22(4), pp. 289-301.

Kawaoka et al., "Transcriptional Control of Lignin Biosynthesis by Tobacco LIM Protein," Phytochemistry, 2001, vol. 57, pp. 1149-1157.

Kehoe et al., "Two 10-bp Regions Are Critical for Phytochrome Regulation of a Lemna gibba Lhcb Gene Promoter," The Plant Cell, Aug. 1994, vol. 6, pp. 1123-1134.

Kerr et al., "Statistical Design and the Analysis of Gene Expression Microarray Data," Genet. Res., Camb., 2001, vol. 77, pp. 123-128.

Kim et al., "Activation of a Mitogen-Activated Protein Kinase Cascade Induces WRKY Family of Transcription Factors and Defense Genes in Tobacco," The Plant Journal, 2004, vol. 38, pp. 142-151.

Kim et al., "The Dr1/DRAP1 Heterodimer is a Global Repressor of Transcription in vivo," Proc. Natl. Acad. Sci., Feb. 1997, vol. 94, pp. 820-825.

Kirik et al., "A Novel Leaf-Specific *myb*-related Protein with a Single Binding Repeat," Gene, 1996, vol. 183, pp. 109-113.

Kirik et al., "Ectopic Expression of the *Arabidopsis* AtMYB23 Gene Induces Differentiation of Trichome Cells," Developmental Biology, 2001, vol. 235, pp. 366-377.

Kirst et al., Analysis of Microarray Gene Expression Levels as Quantitative Traits: Discovery of Candidate Genes, Regulatory Networks and Mapping of Gene Expression Qtls., International Union of Forestry Research Organizations biennial conference, Jun. 2003.

Kosarev et al., "Evaluation and Classification of Ring-Finger Domains Encoded by the *Arabidopsis* Genome," Genome Biology, 2003, vol. 3(4), pp. 1-12.

Kosugi et al., "Constitutive E2F Expression in Tobacco Plants Exhibits Altered Cell Cycle Control and Morphological Change in a Cell Type-Specific Manner," Plant Physiology, Aug. 2003, vol. 132, pp. 2012-2022.

Kosugi et al., "E2Ls, E2F-like Repressors of *Arabidopsis* That Bind to E2F Sites in a Monomeric Form," The Journal of Biological Chemistry, 2002, vol. 277, No. 19, pp. 16553-16558.

Kozaki et al., "The Maize ID1 Flowering Time Regulator is a Zinc Finger Protein with Novel DNA Binding Properties," Nucleic Acids Research, 2004, vol. 32, No. 5, pp. 1710-1720.

Kranz et al., "c-MYB Oncogene-like Genes Encoding Three MYB Repeats Occur in all Major Plant Lineages," The Plant Journal, 2000, vol. 21(2), pp. 231-235.

Kubo et al., "$Cys_2/His_2$ Zinc-Finger Protein Family of Petunia: Evolution and General Mechanism of Target-Sequence Recognition," Nucleic Acids Research, 1998, vol. 26, No. 2, pp. 608-615.

Kuromori et al., "Cloning of cDNAs from *Arabidopsis thaliana* That Encode Putative Protein Phosphatase 2C and a Human Dr1-like Protein by Transformation of a Fission Yeast Mutant," Nucleic Acids Research, 1994, vol. 22, No. 24, pp. 5296-5301.

Lai et al., Molecular Analyses of the *Arabidopsis* Tubby-Like Protein Gene Family, Plant Physiology, Apr. 2004, vol. 134, pp. 1586-1597.

Landschultz et al., "The Leucine Zipper: A Hypothetical Structure Common to a New Class of DNA Binding Proteins," Science, Jun. 24, 1988, vol. 240, pp. 1759-1764.

Lännenpää et al., "A New SBP-Box Gene BpSPL1 in Silver Birch (*Betula pendula*)," Physiologia Plantarum, 2004, vol. 120, pp. 491-500.

Lee et al., "*Arabidopsis* Leafy Cotyledon1 Represents a Functionally Specialized Subunit of the CCAAT Binding Transcription Factor," Proc. Natl. Acad. Sci., Feb. 18, 2003, vol. 100, No. 4, pp. 2152-2156.

Lee et al., "Three-Dimensional Solution Structure of a Single Zinc Finger DNA-Binding Domain," Science, Aug. 11, 1989, vol. 245, pp. 635-637.

Lévesque-Lemay et al., "Expression of CCAAT-Binding Factor Antisense Transcripts in Reproductive Tissues Affects Plant Fertility," Plant Cell Rep., 2003, vol. 21, pp. 804-808.

Li et al., "Selection of Optimal DNA Oligos for Gene Expression Arrays," Bioinformatics, 2001, vol. 17, No. 11, pp. 1067-1076.

Liljegren et al., "Control of Fruit Patterning in *Arabidopsis* by Indehiscent," Cell, Mar. 19, 2004, vol. 116, pp. 843-853.

Lockhart et al., "Expression Monitoring by Hybridization to High-Density Oligonucleotide Arrays," Nature Biotechnology, Dec. 1996, vol. 14, pp. 1675-1680.

Lotan et al., "*Arabidopsis* Leafy Cotyledon1 Is Sufficient to Induce Embryo Development in Vegetative Cells," Cell, Jun. 26, 1998, vol. 93, pp. 1195-1205.

Lowry et al., "Molecular Evolution of the GATA Family of Transcription Factors: Conservation Within the DNA-Binding Domain," J. Mol. Evol., 2000, vol. 50, pp. 103-115.

Maity et al., "The B Subunit of a Rat Heteromeric CCAAT-Binding Transcription Factor Shows a Striking Sequence Identity with the Yeast Hap2 Transcription Factor," Proc. Natl. Acad. Sci., Jul. 1990, vol. 87, pp. 5378-5382.

Mariconti et al., The E2F Family of Transcription Factors from *Arabidopsis thaliana*, The Journal of Biological Chemistry, 2002, vol. 277, No. 12, pp. 9911-9919.

Marita et al., "NMR Characterization of Lignins from Transgenic Poplars with Suppressed Caffeic Acid O-methyltransferase Activity," J. Chem. Soc., Perkin Trans. 1, 2001, pp. 2939-2945.

Martin et al., "MYB Transcription Factors in Plants," Reviews, Feb. 1997, vol. 13, No. 2, pp. 67-73.

Matsushima et al., "NAI1 Gene Encodes a Basic-Helix-Loop-Helix-Type Putative Transcription Factor That Regulates the Formation of an Endoplasmic Reticulum-Derived Structure, the ER Body," The Plant Cell, 2004, vol. 16, pp. 1536-1549.

McGall et al., "Light-Directed Synthesis of High-Density Oligonucleotide Arrays Using Semiconductor Photoresists," Proc. Natl. Acad. Sci., Nov. 1996, vol. 93, pp. 13555-13560.

McGinnis et al., "Homeobox Genes and Axial Patterning," Cell, Jan. 24, 1992, vol. 68, pp. 283-302.

McKnight, S.L., "Molecular Zippers in Gene Regulation," Scientific American, Apr. 1991, pp. 54-64.

Meiyanto et al., Application of Fluorescently Labeled Poly(dU) for Gene Expression Profiling on cDNA Microarrays, BioTechniques, 2001, vol. 31, No. 2, pp. 406-413.

Menkens et al., "The G-box: a Ubiquitous Regulatory DNA Element in Plants Bound by the GBF Family of bZIP Proteins," Reviews, Dec. 1995, vol. 20, pp. 506-510.

Morena et al., "Liguleless1 Encodes a Nuclear-Localized Protein Required for Induction of Ligules and Auricles during Maize Leaf Organogenesis," Genes & Development, 1997, vol. 11, pp. 616-628.

Moyle et al., "Environmental and Auxin Regulation of Wood Formation Involves Members of the Aux/IAA Gene Family in Hybrid Aspen," The Plant Journal, 2002, vol. 31(6), pp. 675-685.

Murai et al., "WAP1, a Wheat APETALA1 Homolog, Plays a Central Role in the Phase Transition from Vegetative to Reproductive Growth," Plant Cell Physiol., 2003, vol. 44(12), pp. 1255-1265.

Muro et al., "Enteraction of the -170 Cyclic AMP Response Element with the Adjacent CCAAT Box in the Human Fibronectin Gene Promoter," The Journal of Biological Chemistry, 1992, vol. 267, No. 18, pp. 12767-12774.

Myers et al., "Optimal Alignments in Linear Space," Computer Applications in the Biosciences, Mar. 1988, vol. 4, No. 1, pp. 11-17.

Nagano et al., "Trihelix DNA-Binding Protein with Specificities for Two Distinct *cis*-Elements," The Journal of Biological Chemistry, 2001, vol. 276, No. 25, pp. 22238-22243.

Nesi et al., "The *Arabidopsis* TT2 Gene Encodes an R2R3 MYB Domain Protein That Acts as a Key Determinant for Proanthocyanidin Accumulation in Developing Seed," The Plant Cell, Sep. 2001, vol. 13, pp. 2099-2114.

Odell et al., "Identification of DNA Sequences Required for Activity of the Cauliflower Mosaic Virus 35S Promoter," Nature, Feb. 1985, vol. 313, pp. 810-812.

Ohme-Takagi et al., "Ethylene-Inducible DNA Binding Proteins That Interact with an Ethylene-Responsive Element," The Plant Cell, Feb. 1995, vol. 7, pp. 173-182.

Ohno et al., "Modifiers of the *jumonji* Mutation Downregulate *Cyclin* D1 Expression and Cardiac Cell Proliferation," Biochemical and Biophysical Research Communications, 2004, vol. 317, pp. 925-929.

Ohta et al., "Repression Domains of Class II ERF Transcriptional Repressors Share an Essential Motif for Active Repression," email.

Okamuro et al., "The AP2 Domain of APETALA2 Defines a Large New Family of DNA Binding Proteins in *Arabidopsis*," Proc. Natl. Acad. Sci., Jun. 1997, vol. 94, pp. 7076-7081.

O'Shea et al., "Evidence That the Leucine Zipper is a Coiled Coil," Science, Jan. 27, 1989, vol. 243, pp. 538-542.

O'Shea et al., "X-ray Structure of the GCN4 Leucine Zipper, a Two-Stranded, Parallel Coiled Coil," Science, Oct. 25, 1991, vol. 254, pp. 539-544.

Park et al., "Overexpression of the Tobacco *Tsi*1 Gene Encoding an EREBP/AP2-Type Transcription Factor Enhances Resistance against Pathogen Attack and Osmotic Stress in Tobacco," The Plant Cell, May 2001, vol. 13, pp. 1035-1046.

Patzlaff et al., "Characterisation of a Pine MYB That Regulates Lignification," The Plant Journal, 2003, vol. 36, pp. 743-754.

Patzlaff et al., "Characterisation of PtMYB1, an R2R3-MYB from Pine Xylem," Plant Molecular Biology, 2004, vol. 0, pp. 1-12.

Pavletich et al., "Zinc Finger-DNA Recognition: Crystal Structure of a Zif268-DNA Complex at 2.1 Å," Science, May 10, 1991, vol. 252, pp. 809-817.

Pearson et al., "Improved Tools for Biological Sequence Comparison," Proc. Natl. Acad. Sci., Apr. 1988, vol. 85, pp. 2444-2448.

Pearson, William R., "Rapid and Sensitive Sequence Comparison with FASTP and FASTA," Methods in Enzymology, vol. 183, pp. 63-99.

Pettersen et al., "Wood Sugar Analysis by Anion Chromatography," Journal of Wood Chemistry and Technology, 1991, vol. 11(4), pp. 495-501.

Pinkham et al., "Cloning and Molecular Analysis of the *HAP*2 Locus: a Global Regulator of Respiratory Genes in *Saccharomyces cerevisian*," Molecular and Cellular Biology, Dec. 1985, vol. 5, No. 12, pp. 3410-3416.

Potrykus et al., "Direct Gene Transfer to Cells of a *Graminaceous monocot*," Mol. Gen. Genet, 1985, vol. 199, pp. 183-188.

Prashar et al., "Reads: A Method for Display of 3'-End Fragments of Restriction Enzyme-Digested cDNAs for Analysis of Differential Gene Expression," Methods in Enzymology, 1999, vol. 303, pp. 258-272.

Praz et al., "The Eukaryotic Promoter Database, EPD: New Entry Types and Links to Gene Expression Data," Nucleic Acids Research, 2002, vol. 30, No. 1, pp. 322-324.

Putterill et al., "The Constans Gene of *Arabidopsis* Promotes Flowering and Encodes a Protein Showing Similarities to Zinc Finger Transcription Factors," Cell, 1995, pp. 847-857, vol. 80.

Pysh et al., "The Gras Gene Family in *Arabidopsis*: Sequence Characterization and Basic Expression Analysis of the Scarecrow-Like Genes," The Plant Journal, 1999, vol. 18(1), pp. 111-119.

Quattrocchio, et al., "Analysis of bHLH and MYB domain proteins: species-specific regulatory differences are caused by divergent evolution of target anthocyanin genes," The Plant Journal, 1988, pp. 475-488, vol. 13(4).

Ramachandran, et al., "Transcription factors in plant growth and development," Differentiation and gene regulation, 1994, pp. 642-646, vol. 4., No. 5.

Ramirez-Parra, et al., "The cloning of plant E2F, a retinoblastoma-binding protein, reveals unique and conserved features with animal $G_1/S$ regulators," Nucleic Acids Research, 1999, pp. 3527-3533, vol. 27, No. 17.

Ramsay, et al., "Two basic-helix-loop-helix genes (MYC-146 and GL3) from *Arabidopsis* can activate anthocyanin biosynthesis in a white-flowered *Matthiola incana* mutant," Plant Molecular Biology, 2003, pp. 679-688, vol. 52.

Rasmussen, et al., "X-ray scattering indicates that the leucine zipper is a coiled coil," Proc. Natl. Acad. Sci. USA, 1991, pp. 561-564, vol. 88.

Relógio, et al., "Optimization of oligonucleotide-based DNA microarrays," Nucleic Acids Research, 2002, pp. 1-10, vol. 30, No. 11.

Reyes, et al., "Diverse functions of Polycomb group proteins during plant development," Seminars in Cell & Developmental Biology, 2003, pp. 77-84, vol. 14.

Riechmann, et al., "*Arabidopsis* Transcription Factors: Genome-Wide Comparative Analysis Among Eurkaryotes," Science, 2000, pp. 2105-2110, vol. 290.

Riechmann, et al., "MADS Domain Proteins in Plant Development," Biol. Chem., 1997, pp. 1079-1101, vol. 378.

Rieping, et al., Synergistic effect of upstream sequences, CCAAT box elements, and HSE sequences for enhanced expression of chimaeric heat shock genes in transgenic tobacco, Mol. Gen. Genet, 1992, pp. 226-232, vol. 231, No. 2.

Robatzek, et al., "Targets of AtWRKY6 regulation during plant senescence and pathogen defense," Genes & Development, 2002, pp. 1139-1149, vol. 16.

Robson, et al., "Functional importance of conserved domains in the flowering-time gene Constans demonstrated by analysis of mutant alleles and transgenic plants," The Plant Journal, 2001, pp. 619-631, vol. 28, No. 6.

Romero, et al., "More than 80R2R3-MYB regulatory genes in the genome of *Arabidopsis thaliana*," The Plant Journal, 1998, pp. 273-284, vol. 14, No. 3.

Rose, et al., "The tomato I-box binding factor LeMYBI is a member of a novel class of Myb-like proteins," The Plant Journal, 1999, pp. 641-652, vol. 20, No. 6.

Rosinski, et al., "Molecular Evolution of the Myb Family of Transcription Factors: Evidence for Polyphyletic Origin," J. Mol. Evol., 1998, pp. 74-83, vol. 46.

Sagasser, et al., "*A. thaliana* Transparent Testa 1 is involved in seed coat development and defines the WIP subfamily of plant zinc finger proteins," Genes & Development, 2002, pp. 138-149, vol. 16.

Sanmiya, et al., "Mitochondrial small heat-shock protein enhances thermotolerance in tobacco plants," FEBS Letters, 2004, pp. 265-268, vol. 557.

Sawa, et al., "Filamentous Flower, a meristem and organ identity gene of *Arabidopsis*, encodes a protein with a zinc finger and HMG-related domains," Genes & Development, 1999, pp. 1079-1088, vol. 13, No. 9.

Schauser, et al., "A plant regulator controlling development of symbiotic root nodules," Nature, 1999, pp. 191-195, vol. 402.

Schenk, et al., "Coordinated plant defense responses in *Arabidopsis* revealed by microarray analysis," PNAS, 2000, pp. 11655-11660, vol. 97, No. 21.

Schindler, et al., "DNA binding site preferences and transcriptional activation properties of the *Arabidopsis* transcription factor GBF 1," The EMBO Journal, 1992a, pp. 1275-1289, vol. 11.

Schindler, et al., "Heterodimerization between light-regulated and ubiquitously expressed *Arabidopsis* GBF bZIP proteins," The EMBO Journal, 1992b, pp. 1261-1273, vol. 11.

Schreiber, et al., "The MADS Box Transcription Factor ZmMADS2 Is Required for Anther and Pollen Maturation in Maize and Accumulates in Apoptotic Bodies during Anther Dehiscence," Plant Physiology, 2004, pp. 1069-1079, vol. 134.

Sessa, et al., "The Athb-1 and -2 HD-Zip domains homodimerize forming complexes of different DNA binding specificities," The EMBO Journal, 1993, pp. 3507-3517, vol. 12, No. 9.

Shi, et al., "Gibberellin and abscisic acid regulate GAST1 expression at the level of transcription," Plant Molecular Biology, 1998, pp. 1053-1060, vol. 38.

Shikata, et al., "Characterization of *Arabidopsis* ZIM, a member of a novel plant-specific GATA factor gene family," Journal of Experimental Botany, 2004, pp. 631-639, vol. 55, No. 397.

Sibéril, et al., "Plant bZIP G-box binding factors," Eur. J. Biochem, 2001, pp. 5655-5666, vol. 268.

Siegfried, et al., "Members of the *YABBY* gene family specify abaxial cell fate in *Arabidopsis*," Development, 1999, pp. 4117-4128, vol. 126.

Simpson, "Evolution of flowering in response to day length: flipping the *Constans* switch," BioEssays, 2003, pp. 829-832, vol. 25.

Singh, "Transcriptional Regulation in Plants: The Importance of Combinatorial Control," Plant Physiol., 1998, pp. 1111-1120.; vol. 118.

Smalle, et al., "The trihelix DNA-binding motif in higher plants is not restricted to the transcription factors GT-1 and GT-2," Proc. Natl. Acad. Sci., 1998, pp. 3318-3322, vol. 95.

Smith, et al., "Antisense RNA inhibition of polygalacturonase gene expression in transgenic tomatoes," Nature, 1988, pp. 724-726, vol. 334.

Smith, et al., "Inheritance and effect on ripening of antisense polygalacturonas genes in transgenic tomatoes," Plant Molecular Biology, 1990, pp. 369-379, vol. 14.

Solano, et al., "A Single Residue Substitution Causes a Switch from the Dual DNA Binding Specificity of Plant Transcription Factor MYB.Ph3 to the Animal c-MYB Specificity," The Journal of Biological Chemistry, 1997, pp. 2889-2895, vol. 272, No. 5.

Solano, et al., "Nuclear events in ethylene signaling: a transcriptional cascade mediated by Ethylene-Insensitive3 and Ethylene-Response-Factori," Genes & Development, 1998, pp. 3703-3714, vol. 12.

Song, et al., "Functional Dissection of a Rice Dr1/DRAP1 Transcriptional Repression Complex," The Plant Cell, 2002, pp. 181-195, vol. 14.

Song, et al., "Regulation of meristem organization and cell division by *TSO1*, an *Arabidopsis* gene with cysteine-rich repeats," Development, 2000, pp. 2207-2217, vol. 127.

Southerton, et al., "Eucalypt MADS-Box Genes Expressed in Developing Flowers," Plant Physiol., 1998, pp. 365-372, vol. 118.

Sterky, et al., "Gene discovery in the wood-forming tissues of poplar: Analysis of 5,692 expressed sequence tags," Proc. Natl. Acad. Sci., 1998, pp. 13330-13335, vol. 95.

Stevens, et al., "Two E2F Sites in the *Arabidopsis MCM3* Promoter Have Different Roles in Cell Cycle Activation and Meristematic Expression," The Journal of Biological Chemistry, 2002, pp. 32978-32984, vol. 277, No. 36.

Stober-Grässer, et al., The Myb DNA-binding domain is highly conserved in *Dictyostelium discoideum*, Oncogene, 1992, pp. 589-596, vol. 7.

Stock, et al., "Two-Component Signal Transduction," Annu. RFev. Biochem., 2000, pp. 183-215, vol. 69.

Subrahmanyam, et al., "RNA expression patterns change dramatically in human neutrophils exposed to bacteria," Blood, 2001, pp. 2457-2468, vol. 97, No. 8.

Sung, et al., "Physiological and Molecular Assessment of Altered Expression of *Hsc70-1* in *Arabidopsis*, Evidence for Pleiotropic Consequences," Plant Physiology, 2003, pp. 979-987, vol. 132.

Zuzuki, et al. "Maize VP1 Complements *Arabidopsis abi3* and Confers a Novel ABA/auxin Interaction in Roots," The Plant Journal, 2001, pp. 408-418, vol. 28, No. 4.

Tabata, et al., "HBP-1a and HBP-1b: leucine zipper-type transcription factors of wheat," The EMBO Journal, 1991, pp. 1459-1467, vol. 10, No. 6.

Tasanen, et al., "Promoter of the Gene for the Multifunctional Protein Disulfide Isomerase Polypeptide," The Journal of Biological Chemistry, 1992, pp. 11513-11519, vol. 267, No. 15.

Teakle, et al., "*Arabidopsis thaliana* GATA factors: organization, expression and DNA-binding characteristics," Plant Molecular Biology, 2002, pp. 43-57, vol. 50.

Thibaud-Nissen, et al,. "Clustering of Microarray Data Reveals Transcript Patterns Associated with Somatic Embroyogenesis in Soybean[1[w]]," Plant physiology, 2003, pp. 118-136, vol. 132.

Tiwari, et al., "The Roles of Auxin Response Factor Domains in Auxin-Responsive Transcription," The Plant Cell, 2003, pp. 533-543, vol. 15.

Toledo-Ortiz, et al., "The *Arabidopsis* Basic/Helix-Loop-Helix Transcription Factor Family," The Plant Cell, 2003, pp. 1749-1770, vol. 15.

Toyoda, et al., "Jumonji Is a Nuclear Protein That Participates in the Negative Regulation of Cell Growth," Biochemical and Biophysical Research Communications, 2000, pp. 332-336, vol. 274.

Treisman, et al., "The paired box encodes a second DNA-binding domain in the Paired homeo domain protein," Genes & Development, 1991, pp. 594-604, vol. 5.

Trevaskis, et al., "MADS box genes control vernalization-induced flowering in cereals," PNAS, 2003, pp. 13099-13104, vol. 100, No. 22.

Uggla, et al., "Function and Dynamics of Auxin and Carbohydrates during Earlywood/Latewood Transition in Scots Pine," Plant Physiology, 2001, pp. 2029-2039, vol. 125.

Ulmasov, et al., "Activation and repression of transcription by auxin-response factors," Proc. Natl. Acad. Sci., 1999, pp. 5844-5849, vol. 96.

Ulmasov, et al., "Dimerization and DNA binding of auxin response factors," The Plant Journal, 1999, pp. 309-319, vol. 19.

Unte, et al., "SPL8, an SBP-Box Gene That Affects Pollen Sac Development in *Arabidopsis*," The Plant Cel, 2003, pp. 1009-1019, vol. 15.

Valverde, et al., "Photoreceptor Regulation of Constans Protein in Photoperiodic Flowering," Science, 2004, pp. 1003-1006, vol. 303.

Vidal, et al., "Genetic characterization of mammalian protein-protein interaction domain by using a yeast reverse two-hybrid system," Proc. Natl. Acad. Sci., 1996, pp. 10321-10326, vol. 93.

Vinson, et al., "Scissors-Grip Model for DNA Recognition by a Family of Leucine Zipper Proteins," Science, 1989, pp. 911-916, vol. 246.

Vuorio, et al., "Purification and Molecular Cloning of the "A" Chain of a Rat Heteromeric CCAAT-binding Protein," The Journal of Biological Chemistry, 1990, pp. 22480-22486, vol. 265, No. 36.

Wang, et al., "Transcript abundance of *rm*/1, encoding a putative GT1-like factor in rice, is up-regulated by *Magnaporthe grisea* and down-regulated by light," Gene, 2004, pp. 105-115, vol. 324.

Weigel, et al., "*Leafy* Controls Floral Meristem Identity in *Arabidopsis*," Cell, pp. 843-859, vol. 69.

Weissig, et al., "Three novel spermatogenesis-specific zinc finger genes," FEBS Letters, 2003, pp. 61-68, vol. 547.

Whetten, et al., "Functional genomics and cell wall biosynthesis in loblolly pine," Plant Molecular Biology, 2001, pp. 275-291, vol. 47.

Wilsker, et al., "ARID Proteins: A Diverse Family of DNA Binding Proteins Implicated in the Control of Cell Growth, Differentiation, and Development," Cell Growth & Differentiation, 2002, pp. 95-106, vol. 13.

Winicov, "Alfin 1 transcription factor overexpression enhances plant root growth under normal and saline conditions and improves salt tolerance in alfalfa," Planta, 2000, pp. 416-422, vol. 210.

Wyrambik, et al., "Purification and Properties of Isoenzymes of Cinnamyl-Alcohol Dehydrogenase from Soyben-Cell-Suspension Cultures," Eur. J. Biochem. 1975, pp. 9-15, vol. 59.

Xie, et al., "*Arabidopsis* NAC1 transduces auxin signal downstream of TIR1 to promote lateral root development," Genes & Development, 2000, pp. 3024-3036, vol. 14.

Yahiaoui, et al., "Comparative Efficiency of Different Constructs For Down Regulation of Tobacco Cinnamyl Alcohol Dehydrogenase," Phytochemistry, 1998, pp. 295-306, vol. 49, No. 2.

Yamaguchi, et al., "The *YABBY* Gene *Drooping Leaf* Regulates Carpel Specification and Midrib Development in *Oryza sativa*," The Plant Cell, 2004, pp. 500-509, vol. 16.

Yanagisawa, Dof DNA-binding proteins contain a novel zinc finger motif, Elsevier Science Ltd., 1996, pp. 213-214, vol. 1, No. 7.

Yanagisawa, et al., "Diversity and similarity among recognition sequences of Dof transcription factors," The Plant Journal, 1999, pp. 209-214, vol. 17.

Yanagisawa, et al., "Involvement of Maize Dof Zinc Finger Proteins in Tissue-Specific and Light-Regulated Gene Expression," The Plant Cell, 1998, pp. 75-89, vol. 10.

Yanofsky, et al., "The protein encoded by the *Arabidopsis* homeotic gene *agamous* resembles transcription factors," Nature, 1990, pp. 35-39, vol. 346.

Ye, et al., "Determionation of $S_2$ fibril-angle and fiber-wall thickness by microscopic transmission ellipsometry," Tappi journal, 1997, pp. 181-190, vol. 80, No. 6.

Yun, et al., Ectopic Expression of *Superman* Suppresses Development of Petals and Stamens, >> Plant Cell Physiol., 2002, pp. 52-57, vol. 43.

Zhang, et al., "A Rice WRKY Gene Encodes a Transcriptional Repressor of the Gibberellin Signaling Pathway in Aleurone Cells[1[w]]," Plant Physiology, 2004, pp. 1500-1513, vol. 134.

Zeng, Y., et al., "Role of an AB13 homologue in dormancy maintenance of yellow-cedar seeds and in the activation of storage protein and Em gene promoters," *Plant Molecular Biology*, vol. 51, No. 1, Jan. 2003, pp. 39-49.

Sheppard, L.A., et al, "Floral homeotic genes for genetic engineering of reproductive sterility in poplars," *Forestry Sciences* (Dordrecht, Netherlands), vol. 49, 1996, pp. 165-172.

Heuer, S., et al., "The MADS box gene ZrnMADS2 is specifically expressed in maize pollen and during maize pollen tube growth," *Sexual Plant Reproduction*, vol. 13, No. 1, Jul. 2002, pp. 21-27.

Petersen, K., et al., "MADS-box genes from perennial ryegrass differentially expressed during transition from vegetative to productive growth," *J. Plant Physiol.*, vol. 161, No. 4, Apr. 2004, pp. 439-447.

Jack, T., et al., "The homeotic gene APETALA3 of *Arabidopsis-thaliana* encodes a MADS box and is expressed in petals and stamens," *Cell*, vol. 68, No. 4, Feb. 21, 1992, pp. 683-697.

Bereterbide, A., et al, "Inhibition of cell proliferation, cell expansion and differentiation by the *Arabidopsis* Superman gene in transgenic tobacco plants," *Planta*, vol. 214, No. 1, Nov. 2001, pp. 22-29.

Kawaoka, A., et al., "Transcription factor Ntliml suppresses lignin formation in tobacco via binding to the Palbox element," *Brain Techno News*, vol. 73, 1999, pp. 16-18, English abstract.

Southwick, A., et al., "NCBI database for nucleotide sequences," Nat'l Center for Biotechnology Information, National Library of Medicine, NIH (Bethesda, MD., USA) Accession No. AY 062492.

* cited by examiner

Figure 1. Amino acid sequence of SEQ ID NO: 821.The conserved Transcriptional factor B3 domain identified using InterProScan is underlined.

MGSSQKCMNVLCEEKGSTEWKRGWPLRSGQLATLCDKCGSAFEQATFCEVFHSKD
SGWRECASCGKRLHCGCIASRMLLELLDCGGINCATCAKSSGLLPIASDERPSEFGMI
NVRTGELQSSTTDNHFDSDEVDKLKLIRLRSSTDDSGLGQSLLTQYNDTNRSHEPTN
REGVINTPSALEMGGSCYLLSSKASNGATHASQPDILKANIAAKEFDDPHARTDLSM
TIGVPLGKSYPSLRDHSTTPSLSPQGPKSRHVLHKPPKPAFASGFESNASVVSQIRVAR
PPAEGRGRNQLLPRYWPRITDQELQQISGDSNSTIVPLFEKVLSASDAGRIGRLVLPKA
CAEAYFPPISQPEGLPLRIQDVKGKEWVFQFRFWPNNNSRMYVLEGVTPCIQSMQLQ
AGDTVTFSRMDPEAKLIMGFRKASTSMMQDSQLAAVSNGNHSSEALISGGFENVPMI
SGYSSLLHSFKGSTDPQLNALSKHWSSASGDISWQGTEKHGLPRDAFLLPGMSAPER
KRARNIGSKSKRLLIDSQDALELKMTWEELQDLLRPPSVNPSIVTVEDHEFEEYDEPP
VFGKSSIFILRSTGGQEQWVQCDSCGKWRRLPVDVLLPPRWTCAENAWDQSRRLCS
APDGLTPRDLENLLRLTKEFKKRKLATTVRPALEHESSGLDALANAAIVGDDGDPGT
TSVAATTKHPRHRPGCSCIVCIQPPSGKGKHKPTCNCNVCMTVKRRFKTLMMRKKK
RQSEREAEIAQRKQLWGSKDEIEVDSTSAHRSSHHNPSENESRIGNELESQSQTTNSA
NTFAETGKGQINLNCQLDLNCQPDRNEDLKLGSSQTSMMNLLRVASQPLETYLKQN
GLASLVSEQQASPAGHVQLQGATTDNEGQPSEDHCADSEIQEMALEKDDTDEKDST
PDQGEGDP

Figure 2. Amino acid sequence of SEQ ID NO: 822. The conserved Zn-finger-like, PHD finger domain identified using InterProScan is underlined.

MMASSISSSSPRTVEEIFKDYNARRTALVRALTYDVDEFYSLCDPEKENLCLYGHATE
TWEVALPAEEVPPELPEPALGINFARDGMKRKDWLSLVAVHSDCWLLSVAFYFGAR
LNRNERKRLFSLINDLPTLFEVVTERKPIKDKPNMDSGSKSKNSTKRSIDGPTRSTPKP
YEENYGEEEDEHSETLCGSCGGNYSADEFWICCDICERWFHGKCVKITPAKAENIKQ
YKCPSCSSKRSRQ

Figure 3. Amino acid sequence of SEQ ID NO: 823. The conserved Zn-finger-like, PHD finger domain identified using InterProScan is underlined.

MEGIPHPFPRTVEEVFSDFKGRRAGLIKALTADVEKFYQQCDPEKENLCLYGFPNET
WEVNLPVEEVPPELPEPALGINFARDGMQEKDWLSLVAVHSDSWLLAVAFYFGARF
GFGKNERKRLFQMINDLPTIFEVVTGNVKQAKEQSANQNSKSKSSTKMSDPQSKGV
KMSPPPKREEESGEEEEDDEQGATCGACGDSYANDEFWICCDICERWFHGKCVKITP
AKAEHIKQYKCPSCSTKKARV

Figure 4. Amino acid sequence of SEQ ID NO: 3598. The conserved Zn-finger-like, PHD finger domain identified using InterProScan is underlined.

MDGGAQYNPRTVEEVFRDFKGRRAGMIKALTTEVEEFYQQCDPEKENLCLYGFPSE
QWEVNLPAEEVPPELPEPALGINFARDGMQEKDWLSLVAVHSDAWLLSVAFYFGAR
FGFDKADRKRLFNMINDLPTIFEVVTGTAKKQVKEKSSITNNSSSKSKSNPKKVSESQ
TKYTKAVQPKEEEEEGLEEEDEEEHGETLCGACGENYASDEFWICCDICEKWFHGKC
VKITPARAEHIKQYKCPSCSNKRSRP

Figure 5. Amino acid sequence of SEQ ID NO: 825. The conserved Zn-finger-like, PHD finger domain identified using InterProScan is underlined.

MDGGAQYNPRTVEEVFRDFKGRRAGMIKALTTEVEEFYQQCDPEKENLCLYGFPSE
QWEVNLPAEEVPPELPEPALGINFARDGMQEKDWLSLVAVHSDAWLLSVAFYFGAR
FGFDKADRKRLFNMINDLPTIFEVVTGTAKKQVKEKSSITNNSSSKSKSNPKKVSESQ
TKYTKAVQPKEEEEEGLEEEDEEEHGETLCGACGENYASDEFWICCDICEKWFHGKC
VKITPARAEHIKQYKCPSCSNKRSRP

Figure 6. Amino acid sequence of SEQ ID NO: 826. The conserved Zn-finger-like, PHD finger domain identified using InterProScan is underlined.

MEGAQYNPRTVEEVFKDFKGRRAALIKALTTDVEEFYQQCDPGKENLCLYGFPSEQ
WEVNLPAEEVPPELPEPVLGINFARDGMQEKDWISLVAVHSDSWLIAVAFYFGARFG
FDKADRKRLSNMIHDLPTIFEVVTGTAKKERARSSGANHSGSKSKSAYKGRASDSRG
KYTRELPEKEEEEELDEEDEEENGETLCGACGENSAADDFWICCDLCLRWFHGSCVK
ITPARAEHIKQYKCPSCNNKRARTGN

Figure 7. Amino acid sequence of SEQ ID NO: 827. The conserved Zn-finger-like, PHD finger domain identified using InterProScan is underlined.

MEGGSGPYNPRTVEEVFKDFKSRRNGLIKALTTDVEEFYQQCDPDKENLCLYGFPNE
SWEVNLPAEEVPPELPEPALGINFARDGMQEKDWLSLVAVHSDAWLLSVAFYFGAR
FGFDKNDRRRLFHMINDLPTIFESVTGIGKRPTKEKPAVTNNSSSKNKQSGKMRASEP
PMKMSKTPPPRDEDDSLDEEDEDEHGETLCGACGDNYASDEFWICCDMCERWFHG
KCVKITPARAEHIKQYKCPSCTNKRPRT

Figure 8. Amino acid sequence of SEQ ID NO: 828. The conserved AP2 domain identified using InterProScan is underlined.

MESERYDETTEKQRIRRRPHQKPYRGIRMRKWGKWVAEIREPNKRSRIWLGSYATA
VAAARAYDTAVFYLRGPSARLNFPDLILHEGQDSLGEVSAASIRRRAAEVGAQVDA
VQAAAPAESRPCRTPDLNEYPQLEDLGEIDHESVF

Figure 9. Amino acid sequence of SEQ ID NO: 829. The conserved AP2 domain identified using InterProScan is underlined.

MESERYDETTEGQRIKRRPHQQQQQQQQQRRQKPYRGIRMRKWGKWVAEIREPNKR
SRIWLGSYATPVAAARAYDTAVFYLRGPSARLNFPDLIWREGEDSLGEVSANSIRRR
AAEVGAQVDAVQAAAAKSRPCCAPDLNEYPKLEDSEEFHRESVF

Fig. 10. Amino acid sequence of SEQ ID NO: 830. The conserved AP2 domain identified using InterProScan is underlined.

MMVEEEAVSGVAGQESPAAAKKRGLNGR<u>ERPYKGIRMRKWGKWVAEIREPNKRSR
IWLGSYSTPVAAARAYDTAVFYLRGPSARLNFPEFLGAAAAEGGGGGGSCGDMTAA
FIRKKATEVGASVDAALNSGGHGSVLKNGGSGLGHEYKGCGGFLQRVVDLNKVPEP</u>
EDSDGEFEKA

Figure 11. Amino acid sequence of SEQ ID NO: 831. The conserved AP2 domain identified using InterProScan is underlined.

MVPPFPTAELPLNENDSQDMVIYHVLNEAMSQNNSSLPHPNQSGSPSSGGSLEPSRGI
TKK<u>HYRGVRRRPWGKFAAEIRDSLRHGARVWLGTFETAEEAALAYDRAAFRMRGA
KALLNFPPEVVAASMPMERYDPSRSQSPGSANSDTRGQTHRSDSEVGIAGGASRDVA</u>
TEHLEKVLDVF

Fig. 12. Amino acid sequence of SEQ ID NO: 833. The conserved AP2 domain identified using InterProScan is underlined.

MTRT<u>QQRYRGVRQRHWGSWVSEIRHPLLKTRIWLGTFETAEDAARAYDEAARLMC
GPKARTNFPYNPNEPQTSSSKLLSATLAAKLHKCHLASLQVAKKSAKKEIDDSHPGH
FRREGDRTSSQRNGDQRAGGWSEEKPTVVQWHEMNWDSDEGHGDNSVQQFRPLE</u>
DDHIEQMIEELLDYGSIELCSAIQT

Figure 13. Amino acid sequence of SEQ ID NO: 836. The conserved AP2 domain identified using InterProScan is underlined.

MAPRERPNAVTVAVSPRPQGGAKE<u>IRFRGVRKRPWGRYAAEIRDPGKKTRVWLGTF
DTAEEAARAYDTAAREFRGAKAKTNFPTADELVVAVAAAARSPSQSSTVDNASPPP</u>
PPAPPALDLSLGGFPFAAAYAAPAACFPVIPVARPVFFFDVFARGGQVGDSFPRDCKP
LRPAVSEFFPTVGSGGVKSESDSSSVVDSDVTPRSRSFLDLDLNQPPPAEAA

Figure 14. Amino acid sequence of SEQ ID NO: 837. The conserved AP2 domain identified using InterProScan is underlined.

MVTTLTQVMDTTATNTTNLPSSAYSSVESTTTTLVFDSPQPSQNQENSRMT<u>RRHYRG
VRQRPWGKWAAEIRDPIKAARVWLGTFDTAEAAALAYDNAALRFKGTKAKLNFPE</u>
RVQGNTSTSIPRNVYPPRNLSSLSGQSINAMPFNPSVTTTASSHEAYPHLIQYAQLLSS
SDAEFPIITSTLLGQEHFGSPSSMSSPRQDEVARSSSYDFQDAEEYKPGDRSK

Figure 15. Amino acid sequence of SEQ ID NO: 838. The conserved AP2 domain identified using InterProScan is underlined.

MEPLINTKCIEAQTSTSYSSNSPSGSSSSCSKKAGAAGSGSSDSSKQKESSD<u>GPNYRGV
RRRQWGRWVSEIREPRKKSRIWLGTFQTAEMAARAHDVAALTIKGRSAHLNFPELA
ELLPRPASKSAKDIQAAAALAAAISFPGGDGAAAGEAGPSRPHSPNATAESFDTQESA</u>
SSPLDNEDDTFIDLPDLLVGFGNRMEELCMSFAWQDEDGTRFSHGDDPFLWN

Figure 16. Amino acid sequence of SEQ ID NO: 840. The conserved AP2 domain identified using InterProScan is underlined.

MKTVQSK<u>KFRGVRQRHWGSWVSEIRHPLLKRRVWLGTFETAEEAARAYDQAAILM
SGRNAKTNFPTSQTTNGDPAAANSLSSSKHLSEILHAKLKKCSKTPSPSLTCLRLDTE
NSHIGVWQKGAGQRSDSNWVMTVQLGNKNTDSIGESGDHLPLPHPPSTSSSSCCSSS
SSVPSPLLPPQPPPSELMARGTMEEEERIALQMIEELLNRNSATPTFENPEEEDSFFL</u>

Figure 17. Amino acid sequence of SEQ ID NO: 842. The conserved AP2 domain identified using InterProScan is underlined.

MIPSRAAAAPDDVPEVAGSAPKGHVQQQQQPQQQVGA<u>GEPKYRGVRRRRWGKYT
AEISDPVKKARVWLGTFASAEEAARAYDLAAVRFRGSKAKTNFPASLYDRDDAQAQ</u>
APARIRRHAAAREDPQQGRRAFPQRPTCSSLSSTVESFSGPRPPPSAAAAAPQQQPEK
RYRRSPPVEPEDCQSDCDSSSSVVDDCGGGVEEGSSSTSWFRRRGPLPFDLNLPPSSG
GVDLDGEDLRLCL

Figure 18. Amino acid sequence of SEQ ID NO: 844. The conserved AP2 domain identified using InterProScan is underlined.

MAMKEKAGSGGGARLAVR<u>EAHYRGVRKRPWGRYAAEIRDPKKKSRVWLGTFDTA
EEAARAYDSAARDFRGSKAKTNFPLPSERP</u>VLLLAGAAGGAAGAAGGSGGGGKGC
NSRSPSQSSTVESSGHDPAAAAAAPMVDFSAQLDLNLAYHHGGAGAGAGAGGAV
GFRFPHQVAAAGPYGPFYMEAMAARAGAMNNQLYQRIIFDRRAADGSRSDSDSCSV
VVDASDRGQKPAARVLDLDLNEPPPPESA

Figure 19. Amino acid sequence of SEQ ID NO: 846. The conserved AP2 domain identified using InterProScan is underlined.

underline.MSDPSSPKDEAHVVQSSAELDPPPPQPLPSPSPPPPPPLALHALDQTLHSFPA
YAGDAPSPKGKSPSPRHLQRSSPRSNPSGSASSGG<u>KHPFYRGIRSRSGKWVSEIREPR
KTTRVWLGTYPTPEMAAAAYDVAALALKGGDAVLNFPHLVKSYPVPASTAPTDVR</u>
RAAAAAASRKAETSGGTDDTALLGQEGDEGKTRKDHRPDLSSKPPEAEFIDEEALF
DMPNLLVDMAEGMMVSPPRISSPPSDDSPDNSDMESLWSYP Figure 20. Amino acid sequence of SEQ ID NO: 847. The conserved AP2 domain identified using InterProScan is underlined.

MRRLRLPESAGQPPSPPPRRLTHEQELSIMVAALKNVVSGSTPSDPVPYLPPTSASATT
AGDNYYWGSDFVALSDLETCQVCRISGCLGCNFFTPVADQADDRNSSGNSTKKRQS
SSSRVAG<u>KKKYRGVRQRPWGKWAAEIRDPRRAVRVWLGTFNTADEAARAYDKAA
TEFRGARAKLNFPHEDHSLLL</u>PPPPPPPPAPLPQRQDPMASSSDNNSSAMRSNSEENK
GKGKVETEADDFWNTFNNDEMERQWTMWMDMGGDSSDSNGPAVRSFDS

Figure 21. Amino acid sequence of SEQ ID NO: 848. The conserved Transcriptional factor B3 domain identified using InterProScan is underlined.

MSLNHPLSTSDGTPNTLWWTTHPTMFRQHNLLLNFNPTDDDPQDEGSPPPPYVLRG
APPPAEPSPAEKEPMFEKPLTPSDVGKLNRLVIPKQHAEKHFPLVGEATQQLSFEDES
GKWWRFRYSYWSSSQSYVLTKGWSRFVKDKRLDAGDVVLFHRDRADAERLFIGW
RRRGESSPGASAVAAETRVGGGGGGFYAGRPYPGHNDGPSQPGSYTHGQAGGAPA
AGNNPRRVRLFGVNLECQLDGDEESELPGSSHSPTGHGLSSNSSNYTPSHGLHFI

Figure 22. Amino acid sequence of SEQ ID NO: 849. The conserved AP2 domain identified using InterProScan is underlined.

MYAQSFQESDLALLESISRHLLLDDSESRLLSSCPNGAQSWTAGLGGDPCPYVAENY
WGGLPLREDDPDDVVLYRLLNEPASFGWAPPGSQEARLPGFAAQVSVKPEPESFPT
WSPECVATRPPPVAVPATGRHYRGVRRRPWGKFAAEIRDPAKNGARVWLGTYETA
EDAALAYDRAAYRMRGSRALLNFPLRINSGEPEPVRVTVKRSSPKRPSPESSASSSSS
LDNDAGKRRKKAAGPSVAPAAARVATPENETKGFQVGRQVGTSTNGEQLLVSL

Figure 23. Amino acid sequence of SEQ ID NO: 850. The conserved AP2 domain identified using InterProScan is underlined.

MSQSTMLVAEETIFSPPPLYNQRNHPHDGASGLNPFLTQEHWGDLPLQLNDSDDMLI
YNSLHDALHSGWSPFDSVITAVHPEPQPHPLLPAASVPTSFASDDALSLHNAFASYNY
PIEVAGGVVNSERRESDFARDYGFHRSSFCKGRHFRGVRQRPWGKYAAEIRDPAKN
GARVWLGTYETAEEAALAYDRAAYRMRGAKALLNFPHRIGSGEPAPVRVTAKRKD
SEAKGAVAGSAKKPKGTPTAPAAEADGGAGLRREGERLDAFQQGLLRLSEELLVS

Figure 24. Amino acid sequence of SEQ ID NO: 851. The conserved AP2 domain identified using InterProScan is underlined.

MASTQQQSSTLELIRQHLLIDFSSVDTFLTSLDACTSKVAPVPAAAAASSPSSGSNSPQ
TSFSFQPNPAPLPPKPPKPSSSTLSSRRPAIQVAVPAATSFLAAPAVPRAEPSGSAGGD
DDKHYRGVRRRPWGKFAAEIRDPTRKGTRVWLGTFDTAVEAAKAYDRAAFRLRGS
KAILNFPLEAGRDEPTSTEPSLAPADASRKRAREEAAAESAESEMSAGGCYKVVKKE
QHADVASGRDTCPLTPSSWRGFWDIGEGNKESIFSVPPLSPLSPHPCFGYSQLMVI

Figure 25. Amino acid sequence of SEQ ID NO: 852. The conserved AP2 domain identified using InterProScan is underlined.

MNIHTQLPSDVRVPTPAQSSSPSPSQSSQSESSASHAACSDEEPAVALASSRPKRPAGR
KVFKETRHPVYRGVRRRNRGKWVCELREPNKKTRVWLGTYPTAEMAARAHDVAA
LALRGRHGVCLNFADSAWRLPVPASREAAEIRRTAMAAAEAFRPAEAEEAVSSCGE
ASGGSVCPGQVASVHIVHDKKVKQERESDCMEIEESTSFDMKAWLERPLLSPTPHDA
SVRLKQERASGCVKIEEMTSLDMKAWLECPLLSPTPHDAGVPLSCDFDADGDDPDV
SLWSYSL

Figure 26. Amino acid sequence of SEQ ID NO: 853. The conserved AP2 domain identified using InterProScan is underlined.

MCGGAIIAEFIPRNRRRVTSSDLWPDSLFLKPSNGLDDPLPPKQHPCLASGGAQEEKA
PKKPR<u>KNLYRGIRQRPWGKWAAEIRDPRKGVRVWLGTFNTAEEAARAYDREARKIR
GKKAKVNFPNEDDAFSTIPRAHQTQHHHPQVPDYPPLYQPNWNNNGAPAKTLDLAF</u>
AYDLNQTGHFPANGYAPIHAEPVAMSSEEISGSGSEDTHASSTAALLGANYGAAEAK
VKAEGEVGKKKEEDEESEVQKLSEELLAFENYMKFYQIPYLDGQSAAAPPNPAQDS
VVGELWAFDDDNDNASGVTAVAPAAL

Figure 27. Amino acid sequence of SEQ ID NO: 854. The conserved AP2 domain identified using InterProScan is underlined.

MPEPVIQPLDHNNLLKKPRKMTRITVDSRRVRKIRIFCRDPEATDDSSSEDESDHHRK
GDAKLFVREINLPLVSTHRASDLPSESSCQDSNNGFKSLEKKRKASPKGAAGTKRRA
<u>CNSPYKGVRQRKWGKWAAEIRDPRRKGSRIWLGTFDTPQEAAKAYENKRLEFEAA
KAEEASFSHSLNRPSTSEDTESVLSHTSPASVLDLDTTASNSTKEATADANEENMERP</u>
CLELIEEEPLISLDDVAIQDFYPGEDIDSLFKDDFGGFVDDDIWGFGDIPLCGFDKNKLI
ELPDYDFELEDDEFGHWIDEPPPLNIACP

Figure 28. Amino acid sequence of SEQ ID NO: 855. The conserved AP2 domain identified using InterProScan is underlined.

MAVEMFQEPESAFLDSVRRYLLSEDSECRFFEPPPPPTRNFCGAGAPVICGSSSFSSLY
PCLTENWGELPLKEDDPEDMVLYGVLRDALTVGWAPFQPSGPPGPGFGASQVVKRE
LDSLPAPASSPESAAAAAAAAAAAVPQTEKAAQAVPA<u>KGKHYRGVRQRPWGKFAA
EIRDPAKNGARVWLGTYETAEDAALAYDRAAYRMRGSRALLNFPLRVNSGEPDPVR</u>
VTSKRSSPEPSSASPSSSSSSSLSSESETSKRRKKAAVPAGRAAAAQFGSERVGNADA
VNGSLQVGQQVGMWTSGQQLMVSGCRQTVKCETTC

Figure 29. Amino acid sequence of SEQ ID NO: 856. The conserved AP2 domain identified using InterProScan is underlined.

MATTMEFYSSRSALPSYRISNGGDELMEALCPFIGGYGASTSTPSLSSPSSSSSSLFSFE
PVSFSDGCSTSPDPLGFELPGPIGLNHLTPSQINQIQAQIQFQSTNLPSYHGHGYHPSML
LGPKPVSMKISGSAGKPA<u>TKLYRGVRQRHWGKWVAEIRLPKNRTRLWLGTFDTAEE
AALAYDRAAYKLRGDFARLNFPHLKHCAASDVGDGRVSPLHSSVDAKLEAICQTIA</u>
EKKADGAKKPPASGRSRAAAAAAAAAAAAAAAAAAAREVSSPEEASEVTEVTEV
KGSEPESEGSAESSPLSDLTFDDFAEATWECVSLPEASTLMKYPSEIDWDAI

Figure 30. Amino acid sequence of SEQ ID NO: 857. The conserved AP2 domains identified using InterProScan are underlined.

MAKTSLPRQGQEEASDPKKDGGGAKSAAAKAKAKRTRKSVPRDAPQQRSSIYRGVT
RHRWTGRYEAHLWDKHCWNESQNKKGRPVYLGAYDDEEAAAHAYDLAALKYWG
PETVLNFTLSAYEEELKEMEGQSKEEYIGSLRRKSSGFSRGVSKYRGVARHHHNGRW
EARIGRVFGNKYLYLGTYATQEEAAEAYDMAAIEYRGLNAVTNFDLSRYIKWPQPG
APDSSAAELSNSQQSPTAGGGGAAAAVAEVPAAHDPQGGGSASSALSLLLQSSKFKE
MLERTSSAEDQGAGSTTSSESEAPRRSFPDDIQTYFDCHDVSGGLDDDGIFGDLNSFG
SPIFHCELDLSS

Figure 31. Amino acid sequence of SEQ ID NO: 868. The conserved ARID and HMG domains identified using InterProScan are underlined.

MASTSGGNQSPMSPLKEQMQTSGYHPYPPPLAEYDDVVASPSLFMTTLEKLHSTMG
TKFMIPIIGGKELDLHRLFVEVTSRGGIEKIIRERRWKDVTAIFNFPSTATNASFVLRKY
YVSLLHHYEQIYYFKADDFLVLGTLQSPPVPTFLAQQMEAMHPAQETKVPMTLQPR
TTASDLPRAGTTSPANSPVVGVIDGKFESGYLVTVTIGSEKLKGVLYQTPQSAAGKM
PQQFNFSINNNNVAGSSGIQRRRRRKKSEIKRRDPAHPKPNRSGYNFFFAEQHARLKP
LHPGKDREISRMIGELWNKLNESERTVYQDKALKDKERYKMEMESYRERLRMGQV
VSDAVPLQQRLPELDVDMADVDANPEETEEGNSPQTQDNESSTDKSFSEEDDKDTE
KELDVEASPVCAAVLESSNLDVNEAHPQMDVANVEEGREKQDIAIDNVEVAESVRD
GIENVEDVDKEKLGQSSS

Figure 32. Amino acid sequence of SEQ ID NO: 869. The conserved AUX_IAA domain identified using InterProScan is underlined.

MEGSKSNGYGECDQANLKATELRLGLPGTEEEPPLKVESPSFNSRKRALADDAESVL
QDGRKSTSGVPPPSKAPIVGWPPVRSYRKNIYSSPAEVAEGGAGAGYLKVSMDGAP
YLRKVDLKTYKSYQELMESLENMFNITIGDCSDKGSDYAPTYEDKDGDWMLVGDV
PWNMFTSTCKRLRIMRGGSRS

Figure 33. Amino acid sequence of SEQ ID NO: 870. The conserved AUX_IAA domain identified using InterProScan is underlined.

MEFREMERGVGDGVFGKDLLNLEETELRLGLPGTEESGQKKSRTGKRLFSESSDVSG
SSKGSCVAPHHDEDHESAPAPKAQIVGWPPVRSYRKSALQPKKAEAEGPGIYVKVSV
DGAPYLRKIDLKVYGGYPELLKALENMFKLTIGDYSEREGYKGSEYAPTYEDKDGD
WMLVGDVPWEMFILSCKKLRIMKESEARGLGYGV

Figure 34. Amino acid sequence of SEQ ID NO: 871. The conserved AUX_IAA domain identified using InterProScan is underlined.

MGLEKAKESPEVDANPGSSLEEITELRLGLPGENRGKSGTKRGFSKTVDLDESAVGR
DDEANNSPVGGARVKDEVSGAAKPPAAKTQAVGWPPVKAFRKSVMKSCKYVKVA
VDGAPYLRKVDLEAYDSYQQLLAALEKLFSCFSICNYASERKIVDPANGAEFLPTYE
DKDGDWMLVGDVPWKMFVESCKRLRFMKSSEATGLPTTQSACTSSS

Figure 35. Amino acid sequence of SEQ ID NO: 872. The conserved AUX_IAA domain identified using InterProScan is underlined.

MEAPPARGREAAAPKRDSAGEEAELELGLGLSVGGGGGGGERAGAKRGRILTARDF
PSSVGTKRTADESVSQEGGGGSPTSASQVVGWPPIRAYRMNSLVNLAKAPRAEDNM
SPNEKSKSKDGSEDNTRTGGMTDVDGREQKHIGFVKVNMDGIPIGRKVDLNAHACY
ETLAQALEDMFFRPAKTIDLTGAEENRQVKKSSKLLNGCSEFVLTYEDKEGDWMLIG
DVPWGMFLTAVKRLRIMRTSEVNGIAPRFQQKSERQMRKPI

Figure 36. Amino acid sequence of SEQ ID NO: 873. The conserved AUX_IAA domain identified using InterProScan is underlined.

MSAETAERFTIDFEETELRLGLGRPAGVSSNGEGATRSGGKRVFLETVDLKLNFSSKE
DGGSVEKIRASAPAEKKMNSSDGKEKSVAAAAAAAAAPPPPSSSSEVAKPPAKAQV
VGWPPVRSFRKNIMAVQKSGSHEAEKGGSSGNGAATSGAAFVKVSMDGAPYLRKV
DLKLYKSYQDLSDALAKMFSSFTIGNCGSGGMKDFMNESKLIDLLNGSDYVPTYED
KDGDWMLVGDVPWDMFVDSCKRLRIMKGSEAIGLAPRAVEKCKNRS

Figure 37. Amino acid sequence of SEQ ID NO: 874. The conserved AUX_IAA domain identified using InterProScan is underlined.

MMEVGLKMGGKLMQSEERDQKKKHEDAEAEERETELRLGLPGGNNGGSGSDQAP
DLQVVVGARKRGYAETEVDLKLNLNLSSSSSSGSPPPSSGSDPNDQTNSLPGRLDKR
NLLPCPTSDIPVKPPAKAQVVGWPPVRSFRKNMVAAQKSSTEDMSSGGAASFVKVS
MDGAPYLRKVDLKMYKSYQELSEALCKMLSSFTIGRCESQGVKDFMSESKLRDLLN
GSDYVPTYEDKDGDWMLVGDVPWEMFVESCKRLRIMKGTEAVGLAPRAMEKCKS
RS

Figure 38. Amino acid sequence of SEQ ID NO: 875. The conserved AUX_IAA domain identified using InterProScan is underlined.

MERVSRNGEASQLLDFVAKEGEWLMKRLQEQRRGPTPPEDKALELKLGPPGDEDRS
KKDFTMKYKLEKDESLLSLGYFNGGNQAQAQNLAPYLQLSPSIFRTQLPVLAKDKSS
ETVDLQNNNDAAEKKRAFLPASAAATTAVPNSSQKRTAPAPVVGWPPLRMFRKNLT
SSDGHGKPAPKTHQNMLSSKIVSEKPAESSGKGLFVKMNMDGVPIGRKVDLNAYDS
YEKLSAAVDELFRGLLAAQRDSSGCDIKSTQEEEKPITGLLDGRGEYTLVYEDYEGD
RMLVGDVPWHMFISTVKRLRVLKSSEISVLSAGGQKQDKMSSDSAMQ

Figure 39. Amino acid sequence of SEQ ID NO: 876. The conserved AUX_IAA domain identified using InterProScan is underlined.

MSTPLVHDYIGLKEASLMSRSSEKALPSSSAGEDEKKSALNLRETELRLGLPGSLSPE
RKQALGVPLFGKDLESKSGVLGFALSPSKNSVSGAKRVFCDAIDGCPSKWVFSASNG
KSEVDLAKGGPVLSSPRSGKESDNGVNALQSCVPKPAMTEGLGGVPQSPKPEQEERK
NQGAGGSEHGSAPAAKAQVVGWPPIRSFRKNTTASTLAKNCDDAEGKCLYVKVSM
DGAPYLRKVDLRTYGSYSELSTALEKMFSCFTIVSGHCDSRGPLGQESLSESRLADLL
NGSEYVLTYEDKGDWMLVGDVPWEMFTDSCRRLRIMKSSEAIGLAPRATEKCKSR
D

Figure 40. Amino acid sequence of SEQ ID NO: 877. The conserved AUX_IAA domain identified using InterProScan is underlined.

MSPPLLSVGEEECESNVTLLASPSSLGSVCQNAELKERNYMGMGDHPSADGSVIPNA
FDGCKITLNLRATELRLGLPGSQSPERDADFCTISSAKLDEKPFFPLHPSNDGHYSSQK
IVVSGNKRGFADAMGGDSEAKFMANPEANVVLSPRPSPNLGLKNGSGLESFGSRPA
KVKEIPTAQVAPEKPYSTKETQPNNGSRSNNAGSPAPKAQVVGWPPIRSFRKNSLAT
TSKNAEEVDGKLGSGALFIKVSMDGAPYLRKVDLKHYSAYQELSSALEKMFSCFTIG
ALGREMLSESKLKDLLDGAEYVLTYEDKGDWMLVGDVPWEMFLDTCKRLRIMKS
CDAIGLAPRAVEKSKNKN

Figure 41. Amino acid sequence of SEQ ID NO: 878. The conserved AUX_IAA domain identified using InterProScan is underlined.

MSPPLLSVGEEECESNVTLLASPSSLGSVCQNAELKERNYMGMDDHPSADGSVIPNA
FDGCKITLNLRATELRLGLPGSQSPERDADFCTISSAKLDEKPFFPLHPSNDGHYSSQK
IVVSGNKRGFADAMGGDSEAKFMANPEANVVLSPRPSPNLGLKNGSGLESFGSRPA
KVKEIPTAQVAPEKPYSTKETQPNNGSRSNNASSPAPKAQVVGWPPIRSFRKNSLATT
SKNAEEVDGKLGSGALFIKVSMDGAPYLRKVDLKHYSAYQELSSALEKMFSCFTIGE
ICPHGALGREMLSESKLKDLLDGAEYVLTYEDKGDWMLVGDVPWEMFLDTCKRL
RIMKSCDAIGLAPRAVEKSKNKN

Figure 42. Amino acid sequence of SEQ ID NO: 879 and 880. The conserved AUX_IAA domain identified using InterProScan is underlined.

MSPPLLGVEEGGGNTSTVATSPSIDGASHDCLGLKERNYLGLSDCSSVDSSAVSSLSD
ENKSNLNLKATELTLGLPGSQSPEREPKLCLLSSGKLDEKPLFPLLPLKDGICSSSLQK
NIASGNKRGFSDTIDEFSELKSSKYPDGNWMFHATGPAPETAQCGGQGKFPGNAGM
KAMLPSRTSGAQATVPKEALPKPAPECPRALNGAGVSQTRASNNAPAAKAQVVGW
PPIRSYRKNTLATTSKDNDEVDGKPGPGALYVKVSMDGAPYLRKVDLRNYSTYQEL
SSSLEKMFSGFTIGQCGSNGTPGREMLNESKLRDFLHGSEYVLTYEDKGDWMLVG
DVPWEMFIESCKRLKIMKGADAIGLAPRALEKSKARN

Figure 43. Amino acid sequence of SEQ ID NO: 881. The conserved Basic helix-loop-helix dimerization domain bHLH identified using InterProScan is underlined.

MVSPEHTNWIYDCGLIDDIAAVADGDFQVSGSGYTWPVQPLNGSSIFSTEIDGSFGES
DGVKENGSKKRVRTESCGTSSSK<u>ACREKLRRDRLNDKFLELASLLEPGRPPKADKAA
ILIDAVRMVTQLRGEAQKLKDSNSSLQEKIKELKAEKNELRDEKQRLKAEKEKLEHQ</u>
LKATSAQPNFLPPPPAMPAAFATQGQAPGNKLVPFLGYPGVAMWQFMPPAAVDTSQ
DHVLRPPVA

Figure 44. Amino acid sequence of SEQ ID NO: 882. The conserved Basic helix-loop-helix dimerization domain bHLH identified using InterProScan is underlined MDDSDFEVLSDDPRVEPGIRALQRNGSSSYSSLVLDSERGELVEASVSAKRKTPPAER
NVDALKNH<u>SEAERRRRARINAHLDTLRGLVPEAKKMDKAALLAEVVNHLRKLKGN
AEE</u>AMQQYVIPTDADEIKVEQERGEVVDLEFETIKASLCCDYRPGLLSNLRRVLVDL
GLIVLSAEVATLEGRMKSIMELTSHVGDKTLCQVLSSSLRLALCSMVDQFSTSEESPR
PSVSDKRRRA Figure 45. Amino acid sequence of SEQ ID NO: 883. The conserved Basic helix-loop-helix dimerization domain bHLH identified using InterProScan is underlined.

MVSPEQANWIYDCGLIDDIAAAAADGGPFQVSGSGFSWPDQPLNGSSIFSAEIDGSLG
DSDGVKENGSKKRVRSESCSASSSK<u>ACREKLRRDRLNDKFLELASILEPGRPPKTDKA
AILIDVVRMVTQLRGEAQKLKDSNSSLQEKIKELKAEKNELRDEKQRLKAEKEKLEH</u>
QLKAMNAQPSFLPPPPAIPAAFATQGQAPGNKLVPFIGYPGVAMWQFMPPATVDTSQ
DHVLRPPVA

Figure 46. Amino acid sequence of SEQ ID NO: 884. The conserved Basic helix-loop-helix dimerization domain bHLH identified using InterProScan is underlined.

MDNNVEEYQNYWETTMFYQNEELDSWVDEAISGYYDSSSPDGAASTAASKNIVSER
NRRKKLNERLFALRAVVPNISKM<u>DKASIIKDAIDYIQELHDQERRIQAEILELESGKLK</u>
KGSGGYDFDQDLPAYLRSKKKRTDAFYDSGGSRISPIEVLELRITYMGEKTLVVSLTC
SKRTDTMVKLCEVFESLKLKIITANITSFSGRLLKTVFIEADENEKENLKTKIETAIAAL
NDPQSPMSI

Figure 47. Amino acid sequence of SEQ ID NO: 3599. The conserved Basic helix-loop-helix dimerization domain bHLH identified using InterProScan is underlined.

MGGGAWPFLVGGAICLVNSDNDIAAAAADGGPFQVSGSGFSWPDQPLNGSSIFSAEI
DGSLGDSDGVKENGSKKRVRSESCSASSSK<u>ACREKLRRDRLNDKFLELASILEPGRPP
KTDKAAILIDVVRMVTQLRGEAQKLKDSNSSLQEKIKELKAEKNELRDEKQRLKAE
KEKLEHQ</u>LKAMNAQPSFLPPPPAIPAAFATQGQAPGNKLVPFIGPGVAMWQFMPPAT
VDTSQDHVLRPPVA

Figure 48. Amino acid sequence of SEQ ID NO: 886. The conserved Basic helix-loop-helix dimerization domain bHLH identified using InterProScan is underlined.

MVMDISNDDRYLNEEIGGPKDALDDGTQPNN<u>KRKRGRAPKRAMKAEREKLKRDHL
NELFDKLGSLLELSEPNNGKASIINETIRLLKDMI</u>SQIQSLRKENTTLLSESHYVAAETN
ELKDENFALEAQIKNVQRELEDKLGHSKPDLNVTPPECWQAEMGSHFLGNHHPQLP
PTDPSTQQPPILGPMYVIPMNPDYQSVQKADTTSDQPIPVRKPHPRYPTPADSWPLHV
LSKQHHDLARGNGGT

Figure 49. Amino acid sequence of SEQ ID NO: 887. The conserved Basic helix-loop-helix dimerization domain bHLH identified using InterProScan is underlined.

MDLFFHEEVQSDIFWCDQLVEPPPPPPPPLPPANPSAFSPYTNRLPSQDRGFMPNPGN
NMNKRVMEFLRRSWAEPSQIQEF<u>DRERGFRHMLSERMRREKQKRSYSALLSELPHG
TKNDKNSIVQTACMRIKELVK</u>YKQELERQNGELKSGLNEKSGGDKAEGTKIRVKIAN
PTSGIDSMLEVLKCLDNMGLKATAIQTQCSADQLFAVIEVENEIEAADVEKVIQWTL
LEAERKLLPNSYEGKLDWLS

Figure 50. Amino acid sequence of SEQ ID NO: 888. The conserved Basic helix-loop-helix dimerization domain bHLH identified using InterProScan is underlined.

MDNNVEEYQNYWETTMFYQNEELDRSSHQKSLENYGSWVDEAISGYYDSSSPDGA
ASTAASKN<u>IVSERNRRKKLNERLFALRAVVPNISKMDKASIIKDAIDYIQELHDQERRI</u>
QAEILELESGKLKKGSGGYDFDQDLPAYLRSKKKRTDAFYDSGGSRISPIEVLELRITY
MGEKTLVVSLTCSKRTDTMVKLCEVFESLKLKIITANITSFSGRLLKTVFIEADENEKE
NLKTKIETAIAALNDPQSPMSI

Figure 51. Amino acid sequence of SEQ ID NO: 889. The conserved Basic helix-loop-helix dimerization domain bHLH identified using InterProScan is underlined.

MALYSNYCDGLHGSDPHQMFDPLLRANGSAPAMDTPQSLVLDGEKSELVIKAPNRA
AKKNVPEEKALA<u>ALRNHSEAERRRRERINSHLATLRGLVPGEDKMDKATLLAHVIEE
VKELKKTALEASKGLLVPLDADEVKVEPLDDATGNGTFSFKASICCQYRPELLSDLR</u>
QAINALHLKIVKAEISTLESRLRNEFIFLSGKEQFSYNWSLQRQLLASSIRQALCSVLA
KTSISSEYSPRTTLPSKRRRVSFLNSSSPSL

Figure 52. Amino acid sequence of SEQ ID NO: 890. The conserved Basic helix-loop-helix dimerization domain bHLH identified using InterProScan is underlined.

MENLNWLSEWSGEADWVHSDEQLNRGSYPIPSQAAMFNPIQVCDENFPWLIPIGGV
MADDRATSASASASASASVSKSHS<u>QAEKRRRDRINAQLATLRKLIPKSEKMDKAALL
ASVIDHVKDLKRKASE</u>ISKSITILPSEVDEVIIDCEDPELNKGGNDSGAVLIRVSICCDD
RPELLSELTRVIKGLKLTTVKADVASVGGRIKSVLILCGDTADGGGGDRGACLSSL
KQSLKVVVSRIACSSMAASNCRIRSKRQRFFLPCQSPLP

Figure 53. Amino acid sequence of SEQ ID NO: 891. The conserved Basic helix-loop-helix dimerization domain bHLH identified using InterProScan is underlined.
MALEAVVFPDDPFNYYNCKEVQSLLGECWSFDFGDQEQCENSHFLSTLEIQTEDHEC
SGWNDQSNVSSKALIDRPKRCRYKRRKNKKEMES<u>QRMAHIATERNRRKQMNEHLS
VLRSLMPDSHVQKVDQASIIGGAINYVKELEQQLQQLGAHKEMEGQSSKCEDDISSP</u>
PFSEFFTCPQYSASPGQGNDSVPMNEWTSLTQSAIADIEVTMVETHANLKVRSKRRP
KQLLRLVSGLQSVGLTVLHLNVTTAEPFVLYCLSLSLSLSLNSIFSE Figure 54. Amino acid sequence of SEQ ID NO: 892. The conserved Basic helix-loop-helix dimerization domain bHLH identified using InterProScan is underlined.

MDAPLVNASSFSAANPSAYSLAEIWPLGGDTGIVGPGLRAGNLDGSVEESTVTEQSG
SGRRRRRMKDASSEDESSKMVSSSCVVGSDLNNSNGAKRAKIAGSRDENGSSKAEV
EANSVACNKSSAEQSAKPSEPPKQDYIHVRARRGQATDSH<u>SLAERARREKISERMKT
LQDLVPGCNKIIGKALVLDEIINYIQSLQHQVEFLSMKLEAVNSRMDMSPAVEGFVPK</u>
DLMSQHFDGTGMMFASQAARDYLQGSQAQPDWLHMQTGGGFKRET

Figure 55. Amino acid sequence of SEQ ID NO: 893. The conserved Basic helix-loop-helix dimerization domain bHLH identified using InterProScan is underlined.

MDPPAAMINGGGSFPGGDPVPYNLADMWLPPAGGGLGLGRHPGARGIAQFLNGSGP
NLEASGGDPAVSAAEARCGGGSRKRRDAEDESAAGSLSTSNGVPNGADGEKRLKTS
GCKDRSGDSKAEGQPSSAKPTDESKPQPEPSKQDYIHVRARRGQATDSH<u>SLAERARR
EKISERMKILQDIVPGCNKVIGRALVLDEIINYIQSLQHQVEFLSMKLEAVNSRMNPPI</u>
EVFSSKEFGQQPYDTGGMPFGSQAPREYSRGSSPDWLHMQVGGGFDRKI

Figure 56. Amino acid sequence of SEQ ID NO: 894. The conserved Basic helix-loop-helix dimerization domain bHLH identified using InterProScan is underlined.

MDPPIVNESSFSAANPSSYSLAEIWPFNGEPGNGGLGLRMGNLSGFLDGQMNRDGSA
EVSTVTEQSGGGGIGRKRKDVSSEDESSKMVSTSSANDLNMSNGKRIKSLVSRHDNG
GSRAEGESSSAAGDKQAGQIAKPSEPPKKDYIHVRARRGQATDSH<u>SLAERARREKISE
RMKILQDLVPGCNKVIGKALILDEIINYIQSLQNQVEFLSMKLEAVNSRMNINPTIDGF</u>
PAKDLGGQPFDATGVMHASQAARQYSQGSQSEWLHMQLGGGFERPM

Figure 57. Amino acid sequence of SEQ ID NO: 895. The conserved Basic helix-loop-helix dimerization domain bHLH identified using InterProScan is underlined.

MRSGKGSQEYEDFEEEDLNSKRDGPSSNVSNSSNSANPKDKSSDKAHA<u>IRSKHSVTE
QRRRSKINERFQILRDLIPNSDQKRDTASFLLEVIEYVRYLQEKVHKYEDSYQGWSSE</u>
PTKLMPWRNSHWRVQSVVSPPQAMKNGSGPASSYPGKLEDNSTGTTPNMLASSQNT
SEIDPGRDLSSKFMVQQSERPFPDAQPMECTADTASDQQEDLTIEGGTISISSVYSQGL
LNSLTNALQTAGVDLSQARISVQIDLGKRANRGVLATGTSIPMDHGSPNPGNSTMAH
VTDARGEEGLDQVQKRQKT

Figure 58. Amino acid sequence of SEQ ID NO: 897. The conserved Basic helix-loop-helix dimerization domain bHLH identified using InterProScan is underlined.

MAGSNPQEGLGDEFFEQILAVPPGAYSGGSTPMVLQLGSGRGGVEDGGGRGGGGL
RGMGVMMPLGLNLEQGGLFRHEDVENSTSASSTTSAINMEREAGVHHGNNMTSCLF
PAFGQFQTHQSVQPPPPHPPPPQLHPAFLNQPAVGSPNQPAIRPRARARRGQ<u>ATDPHS
IAERLRRERINERMKALQELVPSCNKTDRAAMLDEIVDYVKFLRLQVKVLSMSRLGG</u>
AGAVAQLVADVPLSSAEGEIIEGGNNQPAWEKWLTDGTEQQVAKLMEEDVGAAMQ
FLQSKTLCIMPISLASAIFRTSQPDMPRSIKPESSAPS

Figure 59. Amino acid sequence of SEQ ID NO: 898. The conserved Basic helix-loop-helix dimerization domain bHLH identified using InterProScan is underlined.

MDQWRTDLGASTSVHPQQHQHQHQHHPSSRLHASHDEPRQREEADVRDPVAARKV
QKADREKLRRDRLNEHFLELGSTLDPDRPKN<u>DKATILTDTIQVLKDLTAEVNKLKAE
CAALTEESRELMQEKNELREEKSSLKSEVENLNVQYQQRMRVMYPWAAMDPSIMG</u>
SAYPYPVPIPVTPGPMPMHSQLQPFPFFGNQNASAIPAPCSTFIPYSMPANPTVEQQST
QYASSSHVSNKKDSKSRSSDHQSGSNAEQDEESNDVATDLELKMPGTSSQQDSGEK
KGKQTQRKEISITDGSSSSKFSSSQAFPDSSSNSVSDNPKSSR

Figure 60. Amino acid sequence of SEQ ID NO: 899. The conserved Basic helix-loop-helix dimerization domain bHLH identified using InterProScan is underlined.

MALEAVVFPQNPLSNYTSRELYNLLESNWGSFDFGLDRNEHGEFLDYPTEKDFPCGE
WNNNSCSSDAGNNTAQCHLNNDNSNDGSSSHRAAAVGRTKRRRTKSRKNKEDIES
<u>QRMTHIAVERNRRKQMNEYLSVLRSLMPESYIQRGDQASIIGGAINFVKELEQKLQL</u>
LGVQKEMECLKSDDDHDDKPVSPFSEFFTFHKYNNSNSSNNSSSSPSPSTATTTTAYY
GSTDETAAGNKRLSAIADIEVTMVESHANLRIRTKRRPKQILKVVSGLHSLRLTVLHL
NVTTVDRVVLYSISVKAEDDCKLTAVDEISSSVYQIFVQIHEESI

Figure 61. Amino acid sequence of SEQ ID NO: 904. The conserved Basic helix-loop-helix dimerization domain bHLH identified using InterProScan is underlined.

MATPPSSRLQSMLQSAVQSIKWSYSLFWQICPQQGILIWGDGYYNGPIKTRKTVQPM
EVSAEEASLQRSQQLRELYESLSAGETNQPARRPCAALSPEDLTETEWFYLMCVSFSF
PPGAGLPGKAYARRQHAWLTGANEVDSKTFSRAILAKSARIQTVVCIPLLDGVVEFG
TTERVQEDISLVNHVKTFFVDHHPPHPPKPALSEHSTSNPAATSSGHHRFHSPPVPSY
APADPPAAANQGDEEEEDDDDDDEEGESDSEAETGRQGAAAAAQNPHGAGPANNA
EPSEFEMSEDIRLGSPDDGSNNLDSDFPMLTINSTAADHQRQVDSFRAETTRRWQMM
QDPARSGLQTPPSVPPALDELSQEDTHYSQTVSTILQNQPRWADSTSYVSYSTQSAFS
KWTSRSDHLLHVPAEGTSQWLLKYILFTIPFLHTKYRDENSPKSRDGDSSSRFRKGNP
QDELSANH<u>VLAERRREKLNERFIILRSLVPFVTKMDKASILGDTIEYVKQLRKKIQD</u>
LEARNRQMEADHRTKEGELQRTTSLKDLRSAASSVERSSRASLPGSGSDKRKMRIVE
GGSGAKPKAVESPPPPLPPPTSETSVQVSIIESDALLELQCPHREGLLLDLMQMLRDLR
IETTAVQSSLTNGFFVAELRAKVKENVNGKKASIVEVKRAIQQLIPHTDS

Figure 62. Amino acid sequence of SEQ ID NO: 905. The conserved bZIP domain identified using InterProScan is underlined.

MMSLTQGSSGSDADVRYLGTDEKKRKRMLSNRESARRSRMRKQKHLEDLTREMGA
LERENREIIKAYKEKVHGHLGLQSENEALLAEKAALMNHLNGMESMIGSFNKSGPC
QRFSSAVQEPWQAHSSSQQIVASASMSRI

Figure 63. Amino acid sequence of SEQ ID NO: 906. The conserved Basic-leucine zipper (bZIP) domain identified using InterProScan is underlined.

MASSQPTSSGSECNQRPVAVDERKRKRMESNRESARRSRMRKQKQVGDLLGQVSEL
QNANSQIAQGINATTQKYAEIENANNVLRAQLMELTDRLRSLNSVLQVVEVVSGLAI
DIPEIPDPLMNPWQLPCPMQPITASADMLQL

Figure 64. Amino acid sequence of SEQ ID NO: 907. The conserved Basic-leucine zipper (bZIP) domain identified using InterProScan is underlined.

MGSVRRQASSGSDGDPRLGGVADDERKRKRMESNRESARRSRMRRQKQLGDLVGE
VGQLQQANAQLAVSINAAAQKYAEVELANNVLRAQAMELTERLRSLNSVLEIVEVV
SGLVIDIPEIPDPLMKPWQIPCPIQPIIASADLFEC

Figure 65. Amino acid sequence of SEQ ID NO: 908. The conserved bZIP domain identified using InterProScan is underlined.

MASSSGNSSSTARLQNSGSEGEPQQLRMDQRKRKRMESNRESARRSRMRKQKHLG
DLTCQVTRLAKENNQILTGITVAAQHLTNVESENSILRAQVTELSHRLDSLNEILNSIY
QSSGTADADQGLDLCSPYDGFFTSPVNLGCVSHQIMAASDVFECR

Figure 66. Amino acid sequence of SEQ ID NO: 909. The conserved Basic-leucine zipper (bZIP) transcription factor domain identified using InterProScan is underlined.

MASSSGTSSGSTLIQNSGSEESLQALMDQRKRKRMISNRESARRSRMRKQRHLDDLM
LVVAQLRKDNQQLRDNVNVVNQHYMTLETENSILRVQMNELTNRLESLKDILGILD
AGDGGRPGNGGGSGYNGGGGWGNGGFGSPEEIGGGGGWTDQPIDYFFNPMSCAYA
VNQPILASADMFQY

Figure 67. Amino acid sequence of SEQ ID NO: 910. The conserved Basic-leucine zipper (bZIP) domain identified using InterProScan is underlined.

MSAQRHGDGGKVDVASVQVGMEPTGSSSSSSWRTRQDGNDLTSPSCALKKKNKRE
ENDEDLFTVPDMEARPAVNSTGNSNVHVSEQQEADQAQTAIPGKRRRGRNPVDKEY
KRLKRLLRNRVSAQQARERKKVYVNELESKARELQDNNVKLEEKISTLMNENMML
RKVLMNTRPKVDESADSKQ

Figure 68. Amino acid sequence of SEQ ID NO: 914. The conserved bZIP domain identified using InterProScan is underlined.

MGSQVGGFGGGIGGETAGRPLSRQGSLYGLTLDEVQNQLGGMGKPLGSMNLDELL
KSVWSVEANQGLNMGAAEPESTQSGLFAPLQKQPSFTLSRALSKKTVDEVWKDIQQ
GEIDDGSNKSKKKKKDSGLGDQDAKPSLGEMTLEDFLHKAGVVAESPVINKNGNHV
VDVDSVTSGGPQSAQWMHYQLPSVQPQQNVVPVFIPGHHVVQQPVPIITSPFLDSAF
GDAAQMTVSPSSLLCTLSDTPTPGRKRVAPRDVVEKTVERRQKRMIKNRESAARSR
ARKQAYTQELEIKVLRLEEENERLRRKLEAEKVLPSAPPAEPKNQLRRTSSAPL

Figure 69. Amino acid sequence of SEQ ID NO:3600. The conserved Basic-leucine zipper (bZIP) transcription factor domain identified using InterProScan is underlined.

MGNNEETKSSKSDKSSSPVPPQDQTGVHVYHPDWAAMHAYYGPRVALPPYYNSAV
SSGHGPHPYMWGPPQPMMPPYGPPYAAIYSHGGVYGHPAIPLTPTPLAAETPKKSSA
NSDNGLVKKLKSFEGLAMSIGSGGDADSADDGTDKRSSQRFVSSADSGDSSDEDQS
GADKARRKRSREGTSSNGDGKSEVQGKAAGEVDAASENVSGGAIERPRATGKLAAP
VNSPSMSSSLDLKNSCMDANANPVSILQPGVVPPEAWLNERELKRERRKQSNRESAR
RSRLRKQAETEELAKKVDSLSAENRALKSEISQLTENSDKLRLENATLMERLENAQG
VEKGVESLGKFNDNGLLSDKTENLLSRVNNSGAVDRRSEDEGEIYERKSNSGAKLH
QLLDSKPRTDAVAAG

Figure 70. Amino acid sequence of SEQ ID NO: 920. The conserved Basic-leucine zipper (bZIP) transcription factor domain identified using InterProScan is underlined.

MGNNEETKSSKSDKSSSPVPPQDQTGVHVYHPDWAAMHAYYGPRVALPPYYNSAV
SSGHGPHPYMWGPPQPMMPPYGPPYAAIYSHGGVYGHPAIPLTPTPLAAETPKKSSA
NSDNGLVKKLKSFEGLAMSIGSGGDADSADDGTDKRSSQFVSSADSGDSSDEDQSG
ADKARRKRSREGTSSNGDGKSEVQGKAAGEVDAASENVSGGAIERPRATGKLAAPV
NSPSMSSSLDLKNSCMDANANPVSILQPGVVPPEAWLQNERELKRERRKQSNRESAR
RSRLRKQAETEELAKKVDSLSAENRALKSEISQLTENSDKLRLENATLMERLENAQG
VEKGVESLGKFNDNGLLSDKTENLLSRVNNSGAVDRRSEDEGEIYERKSNSGAKLH
QLLDSKPRTDAVAAG

Figure 71. Amino acid sequence of SEQ ID NO: 925. The conserved Basic-leucine zipper (bZIP) transcription factor domain identified using InterProScan is underlined.

MDRGFSVDEISDHFWSSPRPPPAAALTSSSSSSCRSQPPPSKMNRSESEWAFQRYLQE
ASVSAASSGRGDEGDVVEIKGPRPDRGRDQGPIRKQPPDPNAVNKDASEVSSASPPPP
PPPAPYVDSIAPPPEPLPTNSEEYQAFLKSKLELACAAVALSQAPFVINQDSGTPADNS
QASKASLVGSQAPSIGVGPELSKSQEEDAGGLVGIPSLPAMPKKSGIPVRSTTSGSSRD
LSDDDEIGETATTDHLGPLDAKRVRRMLSNRESARRSRRRKQAHLSELETQVAQLRV
ENSTLLKRLSDISQKYNVAAVDNRVLKADVETLRAKVRFFIGSPSDTSADAAVPVRD
DPKHQFYQTNSSNPASSADDMRTNNGLADIPAAENAQQNGAAKIGRTASMQRVASL
EHLQKRIRGDSSPRGPPYDGEQ

Figure 72. Amino acid sequence of SEQ ID NO: 930. The conserved Zn-finger, Dof type domain identified using InterProScan is underlined.

MANPSHGVQDSKGIKLFGATITLQGFRDQQVKSEAPISTEATTTMTTMTTTTKMATIS
TTNRNQDALAEAMKRPDKIIPCPRCKSMETKFCYFNNYNVNQPRHFCKGCQRYWTA
GGALRNVPVGAGRRKSKPPCRGMDGFPESCSFEGSEVNHHQYYDLDYGVVENWHQ
LVPQGAFQHVVRVKRRNGDQSY

Figure 73. Amino acid sequence of SEQ ID NO: 932. The conserved Zn-finger, CONSTANS type domains identified using InterProScan are underlined.

MKIQCDVCERAPATVICCADEAALCEKCDVEIHAANKLASKHQRLLLNCLSNKLPLC
DICREKAAFIFCVEDRALFCQDCDEPIHSAGSLSANHQRFLATGIKVALRSRCAKDGD
KTHSKPPNQSSQPVKTPHQQLSISTSPWGVDDLLQLTDFESSDKKEQLEFGELEWLA
DMGLFSDHVPQEAAEVPQLPMPQSSNYTSSRTSKFNVSHKKPRIEIPDDDEEHFTVPD
LG

Figure 74. Amino acid sequence of SEQ ID NO: 933. The conserved Zn-finger, Dof type domain identified using InterProScan is underlined.

MPSECADRKPAKAPHGGHLHAAGAGAAAPQPQEQEHLPCPRCDSTNTKFCYYNNY
NFSQPRHFCKSCRRYWTHGGTLRDIPVGGGSRKNAKRSRTGASSSSSSSSAAVVLPG
VAPQEHHLHAASLLLPFAGSHGGPVHLAGGDGDGKPGLNVCGSFTSLLNAHGPPGF
LALGGFGLGLGPGGLDEMAFGLGRGVWPFQGVGDGVGAGVGSNGGPAGIGNAWQ
FEGGDEGGLVGGGGGGGGGGDSCFSWPGLAISTAWSGLK

Figure 75. Amino acid sequence of SEQ ID NO: 934. The conserved Zn-finger, Dof type domain identified using InterProScan is underlined.

MEIASSPRPVSVSLQEIKPTCGTTTTSRPHKDQALNCPRCSSSNTKFCYYNNYSLSQPR
YFCKTCRRYWTEGGSLRNVPVGGGSRKNKRPSSSFSSSPSSKIIKLPDLVVGPSSLPQN
PKTHEAQRDLNLTYPPDTTPTTDQQNPKSSSGIIASSSMGLSLSSFMPHMPVASDSSSN
FYAAGGLNFQHLLGLKPTTSSFGSFSGHGFESGGFLGSLQGLQESGNGDDSNDGAKL
FFPVEDGLKHQVTSTPRVDGQFGLQSRGQGDHSNGYWNGVLGTGGSW

Figure 76. Amino acid sequence of SEQ ID NO: 935. The conserved Zn-finger, CONSTANS type domain identified using InterProScan is underlined.

MKIQCNVCEAAEASVLCCADEAALCWACDEKVHAANKLASKHQRVPLSTSASQMP
KCDICQETAGFFFCLEDRALLCRKCDITIHTANTYVSAHQRFLLTGVTVGLEPTEPHPS
SSSINSRPGEKISEMKSKSSSLSNGGNQLPSHNEYNDIPSVHTDGVGSLINAKLPFSGG
SAASSMPQWHLDELLGFSDFNQSFSFMGNGSSKADSGKLGDSDCSSIMRSSEETVDE
CLGQVPDAYWAVPQMSSPPTASGLYWPKSARRQLDAAVYVPDISSAPENDFLCQRN
DRSIKRRRQS

Figure 77. Amino acid sequence of SEQ ID NO: 937. The conserved Zn-finger, Dof type domain identified using InterProScan is underlined.

MDTAQWPQEIVVKPIEDIVTSTCTAAATPKPSSSSVSERKPRP<u>QKEQALNCPRCNSTN
TKFCYYNNYSLTQPRYFCKTCRRYWTDGGSLRNIPVGGGSRKNKRSSSS</u>ASSSSSSFN
SSSKKLPDLISTPASNPNNKVTLHEGQDLNLAFPNPHHHDFKSISELVQVPSLEASKN
HHISANSSSAGASMAPPQLSALELLSGITSRGSFSSFMSMPVHDPGSVYTPGLFALPDF
KPTLNFSLDGLGSGGYRSLPSVQEGGTNGGRLLFPFEDLKPVSSTSDMEQNRGDQGD
SNGYWSGMLGGGSW

Figure 78. Amino acid sequence of SEQ ID NO: 938. The conserved Zn-finger, Dof type domain identified using InterProScan is underlined.

MDPSSGTNQEMGAHSLESMLISPKPQQDQRKPRP<u>QPEEALHCPRCESTNTKFCYYNN
YSLSQPRYFCKSCRRYWTKGGTLRNVPVGGGCRKNRRSSSSSSS</u>RRAQDQGGPISTLI
NNNDYDTPNPFTTLHSLTYDQSSDHMSLPFLGLHKFPYQLGPHELSHDILSYANRSK
NGHGDMNGGFLDSLKNEFGLLENTQNNVHDSHHRQNLYYGYGSDGMHNNMGDPV
DSGGAPSSCDHEMMSPAGSANEALGATSMKQELLCSDRDGENRVFWGCPWQMNG
DQYRGNGVIGDVNSGRGSWNGLGSSWYGLLNSPLV

Figure 79. Amino acid sequence of SEQ ID NO: 939. The conserved Zn-finger, Dof type domain identified using InterProScan is underlined.

MIQELLGSPALIGERKISMNHGAVILEGMPSPSPCFSPSPTPSPPSSSSSAITKTTAQATA
TATTTGNGTSTTTNS<u>SNPENLRCPRCDSANTKFCYYNNYNLTQPRHFCKTCRRYWT
KGGALRNVPIGGGCRKNKSSA</u>VSSSASKSSASKFKNLSSEIGRSSFVSAFDPEISQSQV
LWASPQSSHILALLRANQNPNPSSLGHQASPFMTLKEETNLIGNHMMPEPGIAESAM
NNARNLGMIDPLIHVPSSCTSFLRGNHQQVPHQLSHHQQNGIILSGEAQNSGIQSLYQ
RLRASTGNNYGYSEHSPAILSSVASTPPLSSSLSSSILESVPATATSELGYWNPAFCVS
DLPNANGSYP

Figure 80. Amino acid sequence of SEQ ID NO: 942. The conserved Zn-finger, Dof type domain identified using InterProScan is underlined.

MQETQDPAIKLFGAKIPVSSAADGAALAAAKPEEREDGGGGGGGGGEEEYDEDEG
GGGGEEQEIEDAEQNASPEKASENMQEDCEPPPNSQELDPSRTSPDAVNPMTPSIQEE
STTSHITETGAQEEHGTPKNSQDKTLK<u>KPDKIIPCPRCNSMDTKFCYYNNYNVNQPR
HFCRACQRYWTAGGTMRNVPVGAGRRKNKNAATR</u>YRPITISEALQAARVDSPNGA
QLPHLRTNGAVLTFGLDSPVCNSQSPIPNISEKKKVLNGYKNGFRDIENGDDSSTSSS
VTISNSMNEKGLNFPQEQGMGNVNGFSTQIPCLPGVPWPYPWNSTIPSPAFCPSGCPP
MSFYPAAFWACGVLPNAWNIPCMSPQSPFCNQKATTSGPNSPTLGKHSRESEPLKSDI
SLEQAEPPRQKNGSILVPKTLRIDDPSEAAKSSIWAALGIKAFEPKSREGKVKDAETLP
HLHANPAALSRSLNFHENT

Figure 81. Amino acid sequence of SEQ ID NO: 943. The conserved Zn-finger, Dof type domain identified using InterProScan is underlined.

MSGEARDPAIKLFGKTISLPDIPPGDAAAAAVDTGQVPSADPPSPAREDIGMAGVDG
GEEEEGEEDEYEEDDDEEGRDDKETQDEKPAIAKLENGAQFMNLEEGTNRDAISVTN
ENPRTPSVDKESTTPRTSKSEEEQSDTSNSQEKVLK<u>KPDKILPCPRCNSMDTKFCYYN
NYNVNQPRHFCKNCQRYWTAGGTMRNVPVGAGRRKNKNSASHYRHLAVPEALQS</u>
VRTDFPNGVHHPPLKPNGTVLTFGSDAPLCESMASVLHLADKAMHNSRKNGFHKPE
GVIMPSPCGSVRSGVETMNGSSATAANSNLAESKNGTKEIVMPNCQGFPPQLPCFPG
APWPYAWNSAPWSPPISPGPQTFCPPGFAVPFYPGPAYWSCSVPGAWNIPWVAQPTS
PNHSATSSAPNSPTLGKHSRDEKIGKPNDSTEEEPKEANPERSLWIPKTLRIDDPGEAA
KSSIWATLGIKNEASNSAGRGVLLKAFQSKSEEKNHVVEASSVLQANPAALSRSRNF
QESS

Figure 82. Amino acid sequence of SEQ ID NO: 944. The conserved Zn-finger, CONSTANS type domain identified using InterProScan is underlined.

MCRGIGRESGPSGLFTKEEVPCKSPPGKAAVA<u>CELCGSRACLYCQADDAYLCRQCD
RWVHEANFLAQRH</u>IRCLLCTSCQRLTQRYVLGPSLVVVLPSMVESCADGEDSSDGQ
DKSSENIRTPFLFL

Figure 83. Amino acid sequence of SEQ ID NO: 945. The conserved Zn-finger, B-box domains identified using InterProScan are underlined.

<u>MRTICDVCENAAAIFFCAADEAALCRACDEKVHLCNKLASRHVRVGLADPSEVQRC
DICENAPAFFYCEIDGSSLCLQCDMLVHVGGKRTHGRYLLLRQRV</u>EFPGDKPGRLES
QTPNQNEVKREKDQPHKLAMKEVQQNHRASPVPVGDAISSGEGKMQDKMIDLNSR
PQRTKGQTSMNEDMDVTNGSNLESAGVVPVGSFDRQPEMKQST

Figure 84. Amino acid sequence of SEQ ID NO:3601. The conserved Zn-finger, CONSTANS type domain identified using InterProScan is underlined.

MKIQ<u>CDVCERAPATMICCADEAALCAKCDVEVHAANKLASKHQRLLLHSLSSKLPV
CDICQEKAAFIFCVEDRALFCKDCDESIHPAGSLSANHQRLLA</u>TGIRVALSSSCTKEAE
KTEPEPPSRNKPHTSVKSPQQEAPSFTSSWGVDDELLQLPDFESSDKKEQLEFGELEW
LADMGLFADQVPQEALAAAEVPQLPLPPSSNCTSYRTVKSQMPHKKPRIEYVDDDD
EFFTVPDLG

Figure 85. Amino acid sequence of SEQ ID NO: 947. The conserved Zn-finger, CONSTANS type domain identified using InterProScan is underlined.

MKIQ<u>CDVCERAPATMICCADEAALCAKCDVEVHAANKLASKHQRLLLHSLSSKLPV
CDICQEKAAFIFCVEDRALFCKDCDESIHPAGSLSANHQRLLA</u>TGIRVALSSSCTKEAE
KTEPEPPSRNKPHTSVKSPQQEAPSFTSSWGVDDELLQLPDFESSDKKEQLEFGELEW
LADMGLFADQVPQEALAAAEVPQLPLPPSSNCTSYRTVKSQMPHKKPRIEYVDDDD
EFFTVPDLG

Figure 86. Amino acid sequence of SEQ ID NO: 948. The conserved Zn-finger, CONSTANS type domain identified using InterProScan is underlined.

MKIL<u>CDVCNKDEASVFCTADEAALCGGCDHRVHHANKLASKHQRFSLLCPSPKEFP
LCDVCQERRAFLFCQQDRAILCRECDLPIHTANEHTQKHSRFLL</u>TGVKLSATSEVYTS
AASSASLSNGCDFVPDFKSEASSSFKKPVSVSAAISGPRKAAASAASAASAAAASAA
AANNKDGNNNGMLASQESGSNGSTSSISEYLIEMLPGWHFEDFLDSCSASFGFKDDG
LLPFTDNDNVSSFSSESLGIWVPQAPTPVPCNQSPYLNGGIIGGFKQTKEPATTRPGKR
WNDDVFAVPEISPSSAGFKRSRPL

Figure 87. Amino acid sequence of SEQ ID NO: 949. The conserved Zn-finger, CONSTANS type domain identified using InterProScan is underlined.

MEKSENCTAGNTKKKKKKKKKKTAGSSRFGLFRSPSGGPTMKPTP<u>CELCKEAASVY
CPSDSAFLCRGCDARVHQANFLVARHVRNPLCSGCGSLSGHRVSGAGVGPRRPALC
LSCSDRPSVDAGPLSGSSSSSAC</u>VSSTESSAVAPKKEGRCSSGGRKLQKTGVSSSLTD
ASGEGSDSPARFGGAAAFSGEVSSGKRSGGTDDRRAGAARFRETTRVDAKTEGVFAI
WCKKLGLSGAEAFAVASRALRVIAGTPTALPLRVAMAASFWVAMRSCKGRGMSTW
QNVKRVEEASGVPAKLILAGEARLVRRARGEKARREERLEEGWAECTA

Figure 88. Amino acid sequence of SEQ ID NO: 951. The conserved Zn-finger, CONSTANS type domain identified using InterProScan is underlined.

MAKGGGGKRP<u>CDYCGGTTALLYCRADTARLCFACDREVHATNPLFAKHNRSLLCD
ACDSASASFFCEAERLLLCQNCDWDRH</u>DGGGGGGGAAAVHNRRPVEVFTGSPSVG
EILGILGVEDLGFKGPPLGGDEGGDDGGGGGGGCGGGGDGGFSDVLLWDTPAFVT
LDDLIVPREDACALRAVDVPPLPKNRNATCGLHMKEMLRQLRLLAKPEYNFNFEEG
EIEPLDDFHLPVLTQALQPANIHTGCEDRDQVGFHKIEATDFQCFSNDGNTRNQAYD
ASSFSGGYKEERPTALDKYPNGSIPSSTNECHEVPSENQINPNPLPLVPLTSQERESAIS
RYKEKRKTRRYDKHIRYESRKVRAESRIRIKGRFAKTDRT

Figure 89. Amino acid sequence of SEQ ID NO: 952. The conserved Zn-finger, CONSTANS type domain identified using InterProScan is underlined.

MGFGGSWSVPAKACDSCKTAAAAVFCRADAAFLCLGCDARVHGAAKLSARHERV
WV<u>CEVCEQAPAAVTCKADAAALCVTCDADIHSANPLARRHERVPVEPFLDAAESIS
RAASAFNFLAVPTKTGSADTCGGGGGGFGGSC</u>QNEELEEAASWLYTNATGASANKI
VEGMDVKVAPGGGGDVFFNDVETFLDFECGNNSMDRFHGSATDSLVPVQTKPAPAP
VVHPSSENCFDIDFCRSKLTSFSYLSHSVSSSSLDVGVVPEGNSMSDISYPFVQSMSGN
STDLSITNSAATTTTANQPTPMSGMDREARVLRYREKRKNRKFEKTIRYASRKAYAE
TRPRIKGRFAKRTEIESEVDNIYGTASAAFMADSRYGVVPTF

Figure 90. Amino acid sequence of SEQ ID NO: 953. The conserved Zn-finger, CONSTANS type domain identified using InterProScan is underlined.

MGYI<u>CEFCGEQRSMVYCRSDAACLCLSCDRNVHSANALSRR</u>HSRTLLCERCNSQPA
CVRCAEERVSLCQNCDWIGHGASTSASTHKRQTLNCYSGCPSAAELSSIWSFVLDFPS
GGESACEKGMGLMSIAEGNENAACIPPKDSSSQDASVCADDEAGNANAWVGSSSLP
ELKSASLNMGQLAASASTATPKACLPITRSPGLFEDDSFYEDFNMDEVDLDLENYDE
LFGVALTNSELLFENGGIDSLFGAKEMSAADSNCQGPVVIQPACSVASAESMMSSKT
EPIICFSTRQPHSNLSFSGHIGENNTGDYQDCGASSMLLMGEPPWCTPGPENSFTSASR
SNAVMRYKEKKKTRKFDKKVRYASRKARADVRRRVKGRFVKAGDAYDYDPLSQT
RSY

Figure 91. Amino acid sequence of SEQ ID NO: 954. The conserved Zn-finger, CONSTANS type and domain identified using InterProScan is underlined.

MGNEREGEKAGLLISSGSRQNHDTKKLKLMIQTKRSMEKV<u>CEFCRALRPVIYCQAD
AAQLCLSCDAKVHSANALSSRHLRSLLCDSCQYRPAYVHCLDHKL</u>YICRNCDRRIHD
GSCQHRTQAIYSYMGSPSANDFAELWDLDLSQLGNLACTGPSDSSSHEFVDLGTITV
DTSGSVYPGECNVGSRNRERAKTSCDGQQNQSSCFIMQQILDLRKLQLNEKKDSLPLI
CDQEQNDFSSSFSHSPRKFNENTDQSLRSCHDLSSERITLLQDLKAENSPSAFSTLGNL
PSSSTSGTPSPWQSESIWQCRSPFQTSQFWTQNMQDLGVCNELACHDDFDIPEVDVTF
QNYEELFGGEQDTIRALLDESKLEYSSLDKDVPLDDSENSHAELFEDISVATSVCFGA
TNVMDGNTVLKNQVNFIRQGTLDPCPSIRESYSTLSPSISRLNSESTGLDSLESRLSPSII
GGEQQCDVREEDIVKRDGRQTDMMNNIDREKPRRHEKRTQNASQRGKADARKRVK
GRLKTGGYDS

Figure 92. Amino acid sequence of SEQ ID NO: 955. The conserved Zn-finger, Dof type domain identified using InterProScan is underlined.

MGLSTKQVSNDGFDWNQSLLQDHHQTLEIPKSLPMKRPLQQQN<u>QLNQPSEPLKCPR
CDSTNTKFCYYNNYNKSQPRHFCKACKRHWTKGGTLRNVPVGGGRKNKRPKPS</u>HP
SSAAANSSSAASRRILTANTTTASDAPVQAREKIIRGLQSEVCDQKDLNEMFYQAFLF
QPPPRENLCSNSNIFLGSSLSTPESANLHFPLLQSSSPLVRNTCSSTPISSFGFSSTVDGQ
TREYKPVLEESSTIITTSVMPTSTCTQPWNFGNIGMEVMNNTSHNWVWDDMDKLVS
TNLSLPDWDNVETKPQ

Figure 93. Amino acid sequence of SEQ ID NO: 956. The conserved Zn-finger, Dof type domain identified using InterProScan is underlined.

MAFTSLQVCMDSSDWLQGTLHDDSGMDTSSPNSGDMLACSRPLMERRLRP<u>QHDQP
LKCPRCESTHTKFCYYNNYSLSQPRYFCKTCRRYWTKGGTLRNIPVGGGCRKNKKA
SN</u>SGSNSNNSASSKKLANNDHQGYGVPSHPGQSSASSSRGDHSTDLHLSFSPEVQLS
HLHGLLGVHGAPFAGPGNNFSGLENPRPIDFLEGKVMSYDSNFMLSGDSPHPHMGV
VGDLGGSTGMAPGFHGFCGPYGMAIDGGHSGNANSFMENCQRLNMLVPYDQGHD
QEQINAMDVKPNPKLLSLEWQDQGCSDASKNGYGYFNGLPSWTGMMNDYNASA
SNPLV

Figure 94. Amino acid sequence of SEQ ID NO: 957. The conserved Zn-finger, Dof type domain identified using InterProScan is underlined.

MQDIHSIPGGRIFGAAAAASSAVGDRRLRPHGHHGHHHQHGHHPNHQALKCPRCDS
LNTKFCYYNNYNLSQPRHFCKSCRRYWTKGGVLRNVPVGGGCRKSKRSSKPKSSPA
AAAAPADPPPAAAAAAAEDPPKEPKTSSHSSSESSSLTATTTAVATEAVSAPSSASHQ
SSLLNISDYKSMMSQGMNANPSDAGYEHPGSAEGGLGLFSDIGSFTSLITSSSDGPLS
YGFSAVMAQQNQDHQAQQNQWHQIAAGAGAGPGDEMKMPELGGGGGFLDQNVL
VDLPTSTSQGNRPGGGGGGGGGGGFGALDWQPGADQGLFDLPNAVDHAYWSQSQ
WSTDGDQDPTGLYLP

Figure 95. Amino acid sequence of SEQ ID NO: 959. The conserved Zn-finger, GATA type domain identified using InterProScan is underlined.

MESLGFMDDLLDFPDLGEVVDEEDDLGKSSCSKAKAAAAAAAAATSLPDSASFDAS
STPSLPEWEEELEWISNKDSFPSLESFVILPEQPGNNFKEDNLIPPLENSSSSSTTTSTHS
SGNRSGTVTIASCCGGPPLPFRRARSKRARERRHGDLSVFAAERLLISRDQEKANKKT
KLGGQGSVKIGRKCLHCGSEKTPQWRAGPQGAKTLCNACGVRFKSGRLVPEYRPAN
SPTFSSELHSNSHRKIIEMRRTKQMGGGGVKGVDIRVK

Figure 96. Amino acid sequence of SEQ ID NO: 960. The conserved Zn-finger, GATA type domain identified using InterProScan is underlined.

MDGSRGGDDGMDVGDPTHDRHPMQPHYRHHHGLQAQPHLSNGNDMNDDHDGGG
GGGGGGEGVEGDVPSDAGNDSDNRGGGDDADQLTLSFQGQVYVFDSVPPQKVQAV
LLLLGAREVTPNPPAIPVATNQNQDLMGTPQRSNVPQRLASLIRFREKKKERNFDKKI
RYAVRKEVALRMQRNKGQFSSSKPNNDESSSAVTTWESNQSWGPESNGSPHQEILC
HHCGISEKSTPMMRRGPEGPRTLCNACGLMWANKGTLRDLSKAAHPGVQVSSLNR
NEMQSANLGAD

Figure 97. Amino acid sequence of SEQ ID NO: 961. The conserved Zn-finger, GATA type domain identified using InterProScan is underlined.

MYAHPHHVNLPKPIAGDEDGSGNSGGDSMEGSHIRYEPQALDDGATAGASMGGMIE
DIPPDAVYVPGSGADMGMAGGEEASQLTLSFRGQVYVFDAVTPKKVHAVLLLLGG
CELSSGTQSMDLALQNQRGVVDFPPRCSLPQRAASLNRFRQKRKERCFDKKVRYSV
RQEVALRMQRNKGQFTSSKKSEGESGWGSAQDSGQDEAPQETCCTHCGTSSKCTPM
MRRGPSGPRSLCNACGLFWANRGTLRDLSKRTQDHPLTSAEQCEGEVNNSDSGTGI
HPNNSLVSFSKADSGALIAER

Figure 98. Amino acid sequence of SEQ ID NO: 962. The conserved Zn-finger, GATA type domain identified using InterProScan is underlined.

MPGQNIMEEIDCGSFFDQIDDLLDFPSDDVEAGLPPIDHDSFPSFWSDQPQSLPGSGSG
VGSVFEAHPGSDLSAHLSVPYEDIVQMEWLSNLMDDSFSSDPLTINDQDPSKAQPVS
HAQFQTSSPISVLDSSSSCTDEKAAPRSPEAINLARCGRARSKRPRPRTFNPRPPVQLIS
PTSSVGENPQPVDSESHVESRPVIKIPRQVNPEQKKKKKIKFTMSTAAAAAASADTSQ
SSATAQ<u>AVRKCMHCEITKTPQWRAGPMGPKTLCNACGVRYKSGRLFPEYRPAASPT
FIPSLHSNSHKKVLEMRSNVGDPEAMASPPELIPNRAVEMEYM</u>

Figure 99. Amino acid sequence of SEQ ID NO: 963. The conserved Zn-finger, GATA type domain identified using InterProScan is underlined.

MASADPEHLQARGPTRAEDDDDDDELENGGGGGGTDDFADKVEEAGRGYVDSVG
DYEHRRRRGSSAGVGAGGGGVAPSRTSELTLSFEGEVYVFPDVSHEKVQAVLLLLG
GRDIPTAVPTFEVPYAQSTMDVVDMSKRSNLSRRIASLVRFREKRKERCFDKKIRYT
VRKEVAQRMHRKNGQFASIKEGSGAGSLDLAQSCHQDGTPPPET<u>VARRCQHCGVSE
NATPAMRRGPAGPRTLCNACGLMWANKGTLRDLSKGGRNLSLDQTELGTPDVKPLI</u>
IDGQHFSSNKDDLSMQGISGETSTSDIKRLSDPSINPGGEVDNQMDFHGTAADLTSTL
PMNIMHSSADDDEQGTLVELANPSDTDIDIPANFD

Figure 100. Amino acid sequence of SEQ ID NO: 964. The conserved Zn-finger, GATA type domain identified using InterProScan is underlined.

MG<u>KQGPCYHCGVTSTPLWRNGPPEKPVLCNACGSRWRTKGTLANYTPLHARAEPG</u>
DYEDHRFGRGKNISININKNKEVKVPKRKQYTDDMVFGGIMSDYNQGFQKFIDDDTS
NRSSSGSAISNSDAQFGSADASDLTGPAQSVVWDSMVPSRKRTCVNRPKPSPVEKLT
RDLHTILHEQQSSCLSGSSEEDLLLESEMPMGSVEIGHGTVLIRHPSGIARDEESEASSL
SVDRKHYKRSEAYSRPASIPLYNNARMVSSPSAKPGMERSKNSSGQGMRVEHLRRDI
SQHEKLQGLGNHNSPLCHINLKELLNFEEFTRLLNDDERRQLLKYLPPVDNSQLPDSL
EYLFDSPIFEENLSSFQKLLSEGVFDRSFLGVKAEDYKTLRRLALSSSMKCKWVECLQ
QLQDSKNTSGESTAGRYHANLARNLINGKRVRDIQSQNFPEAKMMMKSPKGGAWK
GSCENKDLLDNDGSCFSPRSLFALPPDNSTLMLDSFPVIDESNDQDLLVDVPSNGSFA
QAELLHPALSFGSQQASTGSSSGYPNALHP

Figure 101. Amino acid sequence of SEQ ID NO: 973. The conserved Zn-finger, C2H2 type domains identified using InterProScan are underlined.

MVKRDREDTEVEALAVANSLMLLSRVGQSTDSNCKSWPTERMF<u>ACKTCNREFSSFQ
ALGGHRASHKKPKLISGDLLRLGHEADSSPAKPKTHECSICGLDFPIGQALGGHMRR
H</u>RAAMLESLAAAATKPVPVLKKSNSKRVTGLDLNSSPMEDDLTLRLGKVAPPLVLD
LVL

Figure 102. Amino acid sequence of SEQ ID NO: 974. The conserved Zn-finger, C2H2 type domains identified using InterProScan are underlined.

MVKRDREDAGVEALARANCLMLLSQVGESTNSSSPNHKSRPTERMFK<u>CKTCNREFS
SSQALGGHRASH</u>KKPKLISGDLLHLGHAAYSSPAKPKK<u>HECSICGLEFPIGQALGGHV
RRHR</u>AAMLESLAAVATKPVPVLKKSNSKRVMGLDLNSSPMEDDLTLRLGKVAPPLV
LDLVL

Figure 103. Amino acid sequence of SEQ ID NO:3602. The conserved Zn-finger, C2H2 type domains identified using InterProScan are underlined.

MVKRDREDTEVEALARANCLMLLSRVGESTDSASPDRKSRPTERMF<u>ACKTCNREFS
SFQALGGHKASH</u>KKPKLISGDLFHLGHAADSSPAKPK<u>THECSICGLDFPMGQALGGH
MRRHR</u>AAMLESLAAAAAKPVPVLKKSNSKRVTGLDLNSLPMEDDLTLRLGKVAPPL
VLDLVL

Figure 104. Amino acid sequence of SEQ ID NO: 976. The conserved Zn-finger, C2H2 type domain identified using InterProScan is underlined.

MALEALNSPTAAAPFGHDDADGHPWAKRKRSKRPRADPQDQPSEEEYLALCLIMSP
AAAAAPGSSGRL<u>HECSICHKAFPTGQALGGHKRCH</u>YDGGSSSSAARAASSSEAGGPS
HTTVSHREPIDLNLPALPEFWAGADESSNRDRKIQLSGEQEVESPHPAKRPRLFMDQE
DVGSSQR

Figure 105. Amino acid sequence of SEQ ID NO: 977. The conserved Zn-finger, C2H2 type domain identified using InterProScan is underlined.

MIFEKEDQILTIDERQDGLNPSDNYQEENEGDNQEEWLNLSLGTNSASTAGDSESQSR
PASTKVFS<u>CNFCMRKFYSSQALGGHQNAH</u>KRERGAARRYQSQRMITMFGSHTNAPII
RSLGVRPHSLVHKPSRDGTAMVARFSDHNIGHAPGWPSFMFEDALDLMWPGSFRLD
AQQSNPPSEPVKLDLNLRL

Figure 106. Amino acid sequence of SEQ ID NO: 978. The conserved Zn-finger, C2H2 type domain identified using InterProScan is underlined.

MVAQLKNFDAALQELEEKKKNEVDPSSSIGSWMWNPSAAQEDDDSWEVRAFAEDT
SNIMGATWPPRSYT<u>CSFCRREFRSAQALGGHMNVH</u>RRDRAKLHQSQFRPLANQNSP
FASCSSPSSSTLLFPNQEFGYPGGGLCFLYQLPHPTGIFDPVKANAACLESTPAVLSISP
YPPSPSVNFPMQSQGNNSSHHYSSSEAHSSAVVGSYNCRNTSSKCEDPENEEELDLEL
RLGHK

Figure 107. Amino acid sequence of SEQ ID NO: 979. The conserved Zn-finger, C2H2 type domains identified using InterProScan are underlined.

MDLEYPEEFLGGAHDHHSQISKGKRTKRQRPASPSGGGCVGADAGVATGRAGFYV
YE<u>CKTCSRVFPSFQALGGHRASHKKPKSTADPDQKIKPSTVVLGLDAIDDEDEGHSG
KISPPLSAHVASHKGLHQASKPKI<u>HECNICGSEFASGQALGGHMRRHR</u>SAPPPTATSA
DATSPTNPPAAAAITTEKSRNILSLDLNLPAPTEEDHHHQAHRRRENSKFQFATSQQPI
ILASPALVDCHY

Figure 108. Amino acid sequence of SEQ ID NO: 980. The conserved Zn-finger, C2H2 type domain identified using InterProScan is underlined.

MAELDYCQTKSRPGAAATRLKLFGFNVSDEEDSAVSDPITVGANGGGGGGGGKATP
SGSPEGSVPVGGGGERKYE<u>CQYCCREFANSQALGGHQNAHKKERQQLKRAQLHAS
RNAAVSSLVRNPIISAFATPPHLLATVGPVVVTGGAPTSPSWVYVPRGAPPFQVSHGC
VFTTGQGGGGRSPGGLVPYGGGAGDSTGSQVQNQVNGRAVLDGLSLSKFSKGSGG
GGPGFDDALGLDLHLRLAPAAP

Figure 109. Amino acid sequence of SEQ ID NO: 981. The conserved Zn-finger, C2H2 type domain identified using InterProScan is underlined.

MLPRNSDSGTENESSDFSTQVASDACVQEISVDPSKVTSATSLDQDDVSLDLTLFCHS
NAPAEANAVGESNNTEAVDRASVVKLPRVFS<u>CNYCKRKFYSSQALGGHQNAHKRE
RTMAKRAMRMGMFSNRYTSLASLPLHGATFRSLGIEAHSGVHHQNVVAPESRPAVL
RGGAKFEKGCMGLPMFVEEDDVVPLFWPGSFRQLDTRDCTSDPSPSVDYVIKGSNV
NFVQVTKLPQIETPSPDLTLKL

Figure 110. Amino acid sequence of SEQ ID NO: 982. The conserved Zn-finger, C2H2 type domains identified using InterProScan are underlined.

MALEALSSPTAPSAPFQFMKDSSPAAAAAAASSSSSAYDLPLAEPWAKRKRSKRPHN
PPSEDEYLALCLIMLARGGAGRTLPPPPPPAVSSEAAKVAYR<u>CPVCDKGFPSYQALG
GHKASHRKHASSASAAAGGDDQPTTSSTSAATTSSGVSGKVHE<u>CSICHKSFPTGQAL
GGHKRCH</u>YEAPAPIPASFSAPSAAAAPAASGVSVSEGVGSTHTQSQGHREFDLNIPAL
PEFSPRFVVSGGVDDEVESPHPSKKPRFLAPAVKTEAA

Figure 111. Amino acid sequence of SEQ ID NO: 983. The conserved Zn-finger, C2H2 type domain identified using InterProScan is underlined.

MGFRDYLATGKEEPCHQPPTFIEWLKPSISTSSPSSSSSSCLTEPVHLAKPSTFVDSPNS
FHQQQQQEQRFLRETIQCLPLLSKLSETKPLKQEEGDEEEVTVVGEGRERQHGVGEL
RAANVAVGLHIGLPLGGVDCGYGDNLEKSKHGFDELLIKEAVHKRNLLHGYSGFNA
ESRFWIPTPAQILVGPMQFACAICSKTFNRYNNMQMHMWGHGSEYRKGPDSLKGTQ
PAAMLRLPCYCCAQGCKNNINHPRAKPLKDFRTLQTHYKRKHGAKP<u>FMCRKCGKT
FAVKGDWRTHEKNCGKLWYCTCGSDFKHKRSLKDHIRSFGRGHSPHPSLEGFEDEK
ECVTTGSEDELARS

Figure 112. Amino acid sequence of SEQ ID NO: 984. The conserved Zn-finger, C2H2 type domain identified using InterProScan is underlined.

MIGNNAIISNPPSVPPPSDPFPDCLENNGNTTNKRKRRPAGTPDPDAEVVSLSPKTLLE
SDRYV<u>CEICNQGFQRDQNLQMHRRRHK</u>VPWKLLKRETPAVRKRVFVCPEPSCLHHD
PGHALGDLVGIKKHFRRKHSNHKQWVCERCSKGYAVQSDYKAHLKTCGTRGHSCD
CGRVFSRVESFIEHQDSCNMGRLGSDSHHNNLQPPCLSRTASSPSPSSDTNLNTPSWP
TTRALALPKPAKDATIFSNPIVNKPSPKKDHHDDLHNLELQLSTSSNPTETISTNLPKR
DEKYPPHLQLSISSLCTDCACERNSDCSRDQSTNQLRMAMAEKAYADEARQVAKRQ
IEQAERELANAKRMRQQAQAELQKAHALKEHARKKMSSAILQITCQVCKQKLQARE
LLRLAPGHESSLALSYMSSAITEGEVDNDINRVC

Figure 113. Amino acid sequence of SEQ ID NO: 985. The conserved Zn-finger, C2H2 type domain identified using InterProScan is underlined.

MSGNGLFSVRDPVQEPKANPINKRRNLPGTPDPDAEVVALSPKSLMATHRFV<u>CDICK
KGFQRDQNLQLHRRGH</u>NLPWKLKRRTKDREQPRKRVYICPETTCVHHDPSRALGDL
TGVKKHYSRKHGEKKWKCERCTKKYAVKSDWKAHSKICGTREYKCDCGTVFSRK
DSFITHRAFCDALAEESTKFNPSNFRNEPTLAPPPSAATIPDNFRILGPEFAIPHLNSCGF
SGSSSSAFLASVFGSDRPEFVPTVPMSIFGSPSASFLGSGASVLELPQCVKEEEESKSSI
SDAVSSLYGSSDQNHPHQQSQGLMSATALLQKAAMLGATMANPPLLNDMGLGLM
NSSSSYFPNTTNFCSLSQNLNESLLSSLSSTVTCSPGGDHVLVFGDSDSSSPTADTENT
LSNMVMQANGNVSRPRVVQGKLNHALVEGNLTRDFLGVGGKPRTHVNQQGLADF
ASLGSLSADLSPVQFT

Figure 114. Amino acid sequence of SEQ ID NO: 986. The conserved Zn-finger, C2H2 type domain identified using InterProScan is underlined.

MFHNSPPPNSPPSNAACSAVNPPEINAFSNSKRRRRPAGTPGNRRRQATAEKDGPGFT
HQSSLFFSHDTIANQIKNTRSSNDLDLIKYFPLFFFPTDPDAEVVSLSPKTLLESDRYV<u>C
EICNQGFQRDQNLQMHRRRHK</u>VPWKLLKRDRGAADQEQARRKRVYVCPEPSCLHH
DPCHALGDLVGIKKHFRRKHSSHKQWVCERCSKGYAVQSDYKAHLKTCGTRGHSC
DCGRVFSRVESFIEHQDSCTVRRAQPPEMQAAQPACSSQTASSTSPSSEANFGVPLSS
FPGFRMPKPAEILFLNSDMYNPSTPSTHHNLELQLLPSSSLCGTRNLRENFADNLKLSI
GTLSTDVNKDELAFTKRSSTMWDHYYGREPEMSEAASMREFASEQIKLAVAEKAFA
EEARQQAKRQVEIAELELANAKKMRLQAQAELERAQLLREQATKKISSTIMQITCPA
CKRQFQTTSVGAAACDETSLAISYVSSATTEGEGE

Figure 115. Amino acid sequence of SEQ ID NO: 987. The conserved Zn-finger, C2H2 type domain identified using InterProScan is underlined.

MVEMPNPSSQEVSSSDLSAPPAKKKRSLPGMPDPEAEVIALSPKTLLATNRFV<u>CEICN
KGFQRDQNLQLHRRGHNLPWRLRQRDSNAEPPRKKVYVCPEPGCVHHSPARALGD
LTGIKKHFCRKHGEKKWKCERCSKKYAVQSDWKAHMRTCGTREYKCDCGMLFSR
RDSFVTHRAFCDALAEES</u>SRAQNNNSVQDEQNARRSGSAAAAASASSPPPPPLTPSTT
VVSPVLSLQSSDLPENAIELVPSALASSSVAATATAPTGPDSSAVTGSNTAFTCIFPAS
APPLPQASPSSLSLFLSSTASSLFSRPDQNQQHLYALPPQPAPTMSATALLQKAAQMG
TAATNASLLRGLGLAISSPIASSSHEATLVTAGDGSTRWSSQGKVESSSEGAGLGLGL
PSPPTLFGNRPMTVDFLGLGMGPAGGHTGRLSALLTSIDGGLSSDRGFSGGVPGVLF
GGGGGGRERVDDLSRGSWEEFPESKPDGPDGPNGPPHYL

Figure 116. Amino acid sequence of SEQ ID NO: 988. The conserved Zn-finger, C2H2 type domain identified using InterProScan is underlined.

MPTDLDNSSTASGEASVSSSGNQPPPQPPPPPSTTKKKRNLPGMPDPDAEVIALSPTTL
LATNRF<u>VCEICNKGFQRDQNLQLHRRGHNLPWKLRQRSGKEVKKRVYVCPEPSCVH
HDPSRALGDLTGIKKHFCRKHGEKKWKCDKCSKKYAVQSDWKAHSKICGTREYKC
DCGTLFSRRDSFITHRAFCDALAEES</u>AKAQTQGQGPGQGSAPVKPNLQADPKVQKPA
SPPHPHPPPPPPRASAPPTVQSSAAVLSTVLADQAAGMQENPSQILEEPPVTSSLIGSSS
SSTSSSSNSKTSTSVIAGLFASSTPSSSLQPPQQSTPYTDLIRAVAPPDRSDHGPASSVEP
ISLCLSTNHGSSLFGSAGQERRQYAPAPQPALSATALLQKAAQMGATATNASLLRGL
GIVSSSTSAGQQENLQWNPNNVEHENASVAAGLGLALPCDGSSGLKELMMGTPTMF
GPKHPTLDFLGLGMAAGGNPSGGFSGLMNSIGGSLDMAAAAASFGSGDFVGKDIGQ
SS

Figure 117. Amino acid sequence of SEQ ID NO: 989. The conserved Zn-finger, C2H2 type domain identified using InterProScan is underlined.

MASTSSTQFFGLGDESQNQMMLQQQSSTTTSSTGPMQAPPKKKRNQPGTPNPDAEVI
ALSPKTLMATNRFI<u>CEVCNKGFQREQNLQLHRRGHNLPWKLKQKTTKDVKRKVYL
CPEPTCVHHDPSRALGDLTGIKKHYSRKHGEKKWKCEKCSKRYAVQSDWKAHSKIC
GTREYRCDCGTLFSRRDSFITHRAFCDALAQES</u>ARHPSSLNTLGNNLYGNNIGLGLSH
QVGSQLPILQTHNHPPSNMLRLGGASNSSNFSQPPHPMPPPPATFFKPEAADSLHDLP
SHNPLSGLMQLPNLQGNSSASQSNLFNLSFFGNNAAAASDNATTATAAAANFPSQGF
LGQFNGGNNGSNQPSGLFSDDRVGSGFSSLFNASAQNESVVAHMSATALLQKAAQM
GSITSGNSSSLLGGLGSSSGGGGSAVNRQMGSVNFSGGSGSFPDSGGKLPPQMESESH
LRGLISSFAGGSSSIFGGGGGHEHENSFSGFNESNMSLDHHHHHQDQSSASFCNVND
AKLHQNLTTSMGGSDKLTLDFLGVGGMMRKRTDGGFAHREQQQQQHGTINMSSLD
RDRKSEQGSQPFGSSKMH

Figure 118. Amino acid sequence of SEQ ID NO: 990. The conserved Zn-finger, C-x8-C-x5-C-x3-H SEQ ID NO: 3667) type domain identified using InterProScan is underlined.

MMLGEPHRPPNPTIDVPPWPILDDPTDDAVPHSPYSPYTLNAGYGGGCDSSPSAAGP
GHFQDVMAALRRFLPSNRPDTDPDPDMTSSREADFPMDVYSCDNFRMYEFKVRRCA
RGRSHDWTECPYAHPGEKARRRDPRKY<u>HYSGTACPEFRKGSCRKGDACEFAHGVFE</u>
CWLHPARYRTQPCKDGAGCRRRVCFFAHTPEQLRVVTPQQSPRGAATQLPFMASPS
TVSPEDSPPMSPMSAAVTHQSLSRSLGSSSVNEMVMASLRNLQLGKVKSLPSSWNA
NAHVTTAAATTASYGSPLRPGFCSVPTTPTRVPARPGIGYRDFWDQVEEEEEPLMER
VESGRDLRAKMFEKLREESSLDRADPEHPSLGGGGPDVEWVSDLVN

Figure 119. Amino acid sequence of SEQ ID NO: 991. The 3 conserved Zn-finger, C-x8-C-x5-C-x3-H SEQ ID NO: 3667) type domains identified using InterProScan are underlined.

MDFGGGRKRGRLDASSNGNGGPKRSREEAETFSTGIG<u>SKSKPCTKFFSTSGCPFGEGC
HFLHYVPGGFKAVSQMLNLGGNPTLPHASRNAAPSYPEAPSPTA</u><u>VKTRLCNKFNTAE
GCKFGDKCHFAHGE</u>WELGKPTGPSYDDPRGMVPPSGRYGGRNEPPPPGLAAAASFG
ASATAKISIDASLAGPIIGRNGVNSKQICRVTGAKLSIREHDSDPNLRNIELEGTFDQIK
QASAMVHELIANVASASRPAMKNSAAHSAPRSN<u>FKTKLCENFAKGSCNFGERCHFA
HGTEELNKPGL</u>

Figure 120. Amino acid sequence of SEQ ID NO: 992. The conserved Zn-finger, C-x8-C-x5-C-x3-H SEQ ID NO: 3667) type domain identified using InterProScan is underlined.

MMIGESRHHPLHPTTVCIPPPLWPSLDDPADEISPAFDADHLAAVAAASSPYALQDIIA
ALRRHQSDPDSDGPDSPVDLYTSDHFRMYEFKVRRCARGKSHDWTECPYAHPGEKA
RRRDPRRH<u>GYSGAACPDFRSGHCPMGDACELAHGVFE</u>CWLHPSRYRTQPCKDGLN
CSRRVCFFAHTPEQLRVVPGQQQSPRSVESLSSSPPVSPMSLSLSRSPFRADPMGEMV
ASLRNLQLDKVKSMPCGGSTSGSPRASRIRPGFYSMPTTPTQSTPTARGLGCLDSWES
PYEEEPAMERVESGRGLRVKMFEKLSKESSLDTARPESDPDVWWVSDLVK

Figure 121. Amino acid sequence of SEQ ID NO: 993. The conserved Zn-finger, C-x8-C-x5-C-x3-H SEQ ID NO: 3667) type domain identified using InterProScan is underlined.

MADSGEAKQAEPGNLEETGDKQTSEQVCSFFRKPSRNKNIRKRMVEEDDDEDSKTE
SSVLHNQKKPQRTGNKLYFSTGSSKSSVSAESKVDSDKPIFQFESSKEIQVEHDSRAT
ATLETETEFSKDARAIRERVLKQATNEISGKSKGTGDEKLYKGVHGYTDYKAGFRRE
QTISSEKAGGAHGPLRASAHIRVSARFD<u>YQPDICKDYKETGYCGYGDACKFMHDRG</u>
DYKSGWQLEKEWDEAEKARKRNLALGGNDEDEEDVDQTEDEEDDELPFACFICREP
FVDPVVTKCKHYFCEHCALKHHARNKKCFVCNKPTMGTFNVAQEIKKKMAAEGGK

Figure 122. Amino acid sequence of SEQ ID NO: 994. The conserved Zn-finger, C-x8-C-x5-C-x3-H SEQ ID NO: 3667) type domain identified using InterProScan is underlined.

MMMMTMAAGGGDHHARSTPTVQIPPVWDPLDDPATGGCGGPYSPYSPYSPYSGGG
NAGGAAGGGECCNDLTALRRFLPSNHHQDEEDEEDGRAPGEDGVLGCDEFRMYEF
KVRKCARGRSHDWTECPYAHPGEKARRRDPRRFFYSGTACPDFRKGACKKGDSCEF
AHGVFECWLHPERYRTQACKDGQSCRRRVCFFAHSPDQLRVLPAHQQQQQQQQQQ
QHSPKSATDSEFGSPVRPSAAAAAFDSYFTKPWSASFISSPTSILTTSSPPISPPTNSPP
MSPNQRGGCCGSPGSVSELVACMRNMQIAKMKMSPRGQMGGSLFGSPLRPGCHLA
APVTPRAESSPRYGQLGGGGGLFDLWESHRRCEEEPSMERVESGRDLRAKMYAKLS
KENSLDGADLVGTGASPDVGWVFELVM

Figure 123. Amino acid sequence of SEQ ID NO: 995. The 5 conserved Zn-finger, C-x8-C-x5-C-x3-H SEQ ID NO: 3667) type domains identified using InterProScan are underlined.

MAFDAGIPMPRGSVADGPSLSPSDAMWQMTLRSNETIESGPYPERPGEPDCSYYIRT
GLCRFGATCRFNHPSDRKLAIANARMKGEYPERVGQPECQYYLKTGTCKFGATCKF
HHPRDKAGIAGKVALNILGYPFRPNEMECAYYLRTGQCKFGSTCKFHHPQPTNMMV
SLRGSPVYPSVQSPTTPTQQSYPGVTSWSRASFIPSPRWQGPSSYTPLIVPQGMVSIPG
WNAYSGQLGSVSSSDSQLIMMGQSQIFGSSGQSDSVNTGSPGAFSSYQSGSMPVGFY
ALQRDNIFPERPGQPECQFYMKTGDCKFGAVCRFHHPRERLLPAPDCLLSPIGLPLRP
GEPLCIFYSRYGICKFGPSCKFDHPMGILNNLSASSPSGAPVRRMLASSSGTAALVLSE
SGPGNPRRLSLSETRQIPSDDNIDSDE

Figure 124. Amino acid sequence of SEQ ID NO: 996. The 6 conserved Zn-finger, C-x8-C-x5-C-x3-H SEQ ID NO: 3667) type domains identified using InterProScan are underlined.

MANHQLYGTAPPPGAAAKFNLAGLSTSPSTNLLLRKRMEMGSDPDASFLASSAFGG
RSRSQSSADALPYSPADVVGYSSYAGGLGARSSWSHSHLHLHPDDVSPLLSGTKRPS
QALYHQNVLDAQREIGQSEAWYSTNLLSKRPRLESASNLPIYPQRPGEKDCAHYMLT
RTCKFGLNCKFDHPIWVPEGGIPDWKEAPLVTTVESLPQRAGEPDCPFFLKTQTCKFG
LRCKFNHPRDKIIPSGTLDDTLNLPERLTEPPCAFYLKTGNCKFGATCKFHHPKDIKV
AQVLQDTDAGELRDSLAENDRMVREVKLVKPLISLSPASSHNTKGLPIRPGEVDCPF
YLKTGSCKYGATCRYNHPERNAIDLHVGIVPIVGASPARNPNFAAGSAASIYQAVDPI
LSQLMLGAGPTIYPQRPGQIECDYYMKTGVCKFGERCKFHHPIDRSAPTQAMANQSQ
QTVELTLAGLPRRKDAIVCPYYLKTGTCKYGATCKFDHPPPGELIAMAATQGQSASE
GEEAKEK

Figure 125. Amino acid sequence of SEQ ID NO: 997. The conserved Zn-finger, C-x8-C-x5-C-x3-H SEQ ID NO: 3667) type domain identified using InterProScan is underlined.

MCNGSSKGKLFPSSMGMEGEFHNKDGEAPRKCSALLELAASDDLSSFKSEVEEKGC
DVDEASFWYGRRIGSKKMGFEERTPLMISALFGSTKVLKYIIETARADVNRSCGSDK
VAALHCAAAGGSSSSLEIVKLLIEASADINSVDGNGNRPIDVLAPAGKSRCNSRNKFV
RSLLKGENYVVEGDQSFDIEGEEKLVALPKEGGEKKEYPVDVSLPDINNGFYSTDEF
RMYAFKVKPCSRAYSHDWTECPFVHPGENARRRDPRKY<u>PYSCVPCPEFRKGSCVRG
DACEYAHGV</u>FESWLHPAQYRTRLCKDETGCTRKVCFFAHKSEELRPVYASTGSAMP
SPKSFSANALDMTTLSPLSLNSPSLPLPATSTPPMSPLAASSSPKGMNLWHNKINLTPP
SLQLPGSRLKTAMSARDFDFELEFLGLEKQASQRQQLIEEISRLSSPSHMWNSEFGRT
AELKPTNLDDAFGSLDTSLLSPLQGSSMKTSTPTQLQSPTGLKISNLNQLRASYPSSSL
SSSPVRKTSSFGFDSSSAVAAAVMNSRSAAMTKRSQSFIDRGAVGQRSGLIGPANSAP
RMSNLSDWGSPDGKLDWGVQGDELNKLRKSASFGFRNNSMANPNNVASPSADEPD
VSWVGSLVKDVAPPEGYPQYLYIEQEQMVA

Figure 126. Amino acid sequence of SEQ ID NO: 3603. The conserved Zn-finger, C-x8-C-x5-C-x3-H type SEQ ID NO: 3667) domain identified using InterProScan is underlined.

MEGESYFEKDEKHSNCSILLELSASDDLPAFESKAKAKGCNIDGASFWYGRRIGSRK
MGLEERTPLMVASLFGSSRVVKYILESGKVDVNRACGSDKVTALHCAVASGSASAV
EVVKLLLHASADANCIDGNGKKPIDVIALPLKSRGDSRRKLMELLLKGDNSDGEFES
HEEKPIAAPQASKEGSEKKEYQFPVDISLPDINVGIYSTDEFRMYAFKVKPCSRAYSH
DWTECPFVHPGENARRRDPRKY<u>PYSCVPCPEFRKGSCQKGDSCEYAHGV</u>FESWLHP
AQYRTRLCKDETGCARKVCFFAHKPEELRPVYASTGSAMPSPKSYSSSGLDMSTLSP
LSISSPSASLPVTSTAPMSPLAASSSPMSVNMWQSKANKLSPPMLQLSGSRLKTALSA
RDLDLEMELRGLESQMATQQHQLMEEISRLSSPSSCFSSRIGEVKPTNLDDVFGSPDP
ALLPQLQGLSRPSTPSQLQSPTGLQMRQNATQFRGAYQSNANALSSPAMKQAPSYGF
DSSSAVAAAVMNSRSAAFAKRSQSFIDRGMASPGIANSSPMMSSAMSSWSSPHGKL
DWGVQGDELNRLRKAASFKMRSSTGAGANTVSAAAMADEPDISWVSSLVKDVPSA
EDAMFAAEKGQRTYGKDIRERJTPWVEQLYREVPRMAM

Figure 127. Amino acid sequence of SEQ ID NO: 999. The conserved Zn-finger, C-x8-C-x5-C-x3-H SEQ ID NO: 3667) type domain identified using InterProScan is underlined.

MSARQFSILLELSAADDLTNFKKAVEEDGYDIDESSLWYGRRIGSKKIGLEERTPLMI
AAMFGSMSVLDYIIKSGRANVNKACGSDGATALHCAAAGGSVQSPEVVKLLLDSSA
NANSIDANGKRAGDLISEVSGSPFNSRRKTLDVMLTGGGTVEFVEETYNLPENLGSQI
EGNEQRESPTARASKDGSEKKEYPVDLSLPDINNGIYSTDEFRMYSFKVKPCSRAYSH
DWTECPFVHPGENARRRDPRKYH<u>YSCVPCPEFRKGSCRQGDGCEYAHGIFECWLHP
AQYRTRLCKDEIGCTRKVCFFAHKHEELRPLY</u>ASTGSALPSPRSFSPVAASLDMGSLS
PLSLGSSSVRIPPTSTPPMTPSGASSPLGGSMWKSQINSTPPGLQLPGSRLRSALSARD
MDLDVDLIDLENNYRLQKQLLEHFPDLSSPRGWNNSSSTTSAFPEYSGDMTGEISRL
GVKPNNLEDSFRSLDLTLLSQLQGLSLDGAISQLQSPTGMKIRQNMTQQLYSNYTDK
LSSSPRAMPSFGTDPSRASAAATLSSRSLAFAKRSHSFIERSTVNSQSGYSAGAASPTA
RMSSQNDWGSPDGKLDWGIQGEELNKLRKSASFGLRSSSNRFHASADSATATVGDP
DMPWIQSLAKEAPSQNPGNFGAEHQQQQQQQQQQQYHLNSGGTELLPAWVEQLYA
DQEQMVA

Figure 128. Amino acid sequence of SEQ ID NO: 1000. The conserved Zn-finger, C-x8-C-x5-C-x3-H SEQ ID NO: 3667) type domain identified using InterProScan is underlined.

MDAYEATRIVFSRIQSLDPENASKIMGLLLIQDHGEKEMIRLALGPETLLHSVVLKAR
KDIILPSNSPSTPSTPSSPSPFMSTNPISISSRPKGSNFSPSSLSNIPSPSSWGGGGGGGS
FSDLSSGDDLINSSSCLYGNGGSDTMIDELQLQDQLSFLNDNSPPLGPNSNPDMFCPQ
QDLLSSPTAVYGGAAAGWGAPVHRRSCSVSDVCSGSSEDPSCG<u>VGWRPCLYYARG
YCKNGISCRFLHSGGLGDAASVVGSPDGSASAVVGSPSKVDMMGQCHEAVLRSKSA
QQQRLAAASQLIGSATFPYTPKSMNLLLHHQQNDAHRAAAAAALMMGDDFYKYGR
SRLERSDFSVNGCVNPASRQIYLTFPADSTFKEEDVSNYFSNFGPVQDVRIPYQQKRM
FGFVTFVYPETVKLILAKGNPHFVCDARVLVKPYKEKGKVPDKFRKQSQLVERGDFS
PCGTPTGLDSRGGPFDLNLGARPFYNSQDMLWRRRFEEQADLQQALEYQSQRLMSL
QLLDVKKHHHQRALSTGSPIPSPAQSPTLFNNPTFLNIPSVRSLGVTEENGSSPGLSDS
QPLNYQSVIVSAGKDLTGSDKSNGNDKESSHTEDKGLAESLEHNLPDSPFASPTKAS
AEHFSSLTNVVSEAEKDGVGSASSSPNSNNPVSSPLIPGTSAMDMASFTSFNCQIPAIG
MYAGAGGPTCPVGI

Figure 129. Amino acid sequence of SEQ ID NO: 1001. The conserved Transcription factor CBF/NF-Y/archaeal histone domain identified using InterProScan is underlined.

MDNAQQQPQPNSYPPPPPPQAVASGGPGAPPATPFHHLLQQQQQQLQMFWSIQRQEI
EQANDFKN<u>HQLPLARIKKIMKADEDVRMISAEAPVLFAKACELFILELTIRSWLHAEE
NKRRTLQKNDIAAAITRT</u>DIFDFLVDIVPRDELKDEAAGLGAAAAMVGPPASGVPYY
YPPMGQPAAPGMMIGRPALDPAGGVYVQQPPPSQAWQSVWQTAAPDDGAYGKP
GDLDGPGY

Figure 130. Amino acid sequence of SEQ ID NO: 1002. The conserved Transcription factor CBF/NF-Y/archaeal histone domain identified using InterProScan is underlined.

MDQQGHGQPPPIGVVPAAGQLPYGTMPYQPGQMIGPSSFPHIQPTSQPQPPGSQLAH
NQLAYQQIHQQQQQQLQQQLQSFWANQYQEIDRVADFKNHSLPLARIKKIMKADED
VRMISAEAPIVFARACEMFILELTLRSWNHTEENKRRTLQKNDIAAAITRTDVFDFLV
DIVPREELKEEGLGTVPGGVLPASGPVDGLPYCYVPPQQVCQAGPPGMFVGKGVVD
PAMYPYMAQQMCPETSEQQQSPSDHQ

Figure 131. Amino acid sequence of SEQ ID NO: 1003. The conserved CCAAT-binding transcription factor, subunit B domain identified using InterProScan is underlined.

MLVMPGRAENIDPQLEQGTQSILHSSLYVQPWWHGARNSMSVTTEDGSNRQEEKHA
KSVVSSMTLSTGEHLGVNSPRELVGHSIVLTSSLYSDPQFGGPLTSFYGPQAMVPHLY
GVHGRMPLPLEMAEEPVYVNAKQYHGILRRRRIRAKAELDRKAVKGRKPYLHESRH
RHAMRRPRGSGGRFLNTKRLDSDDSSFAAEKAVNSSVDLPTQFVKTSTAQGFQTRS
MRADSTGSNGNASANGLSYQGISCLGAEKETLQLYEGPNGAYK

Figure 132. Amino acid sequence of SEQ ID NO: 1004. The conserved CCAAT-binding transcription factor, subunit B domain identified using InterProScan is underlined.

MQPKSKISNGVDAHPHSIQTSAVFTEPWWRGYNTISPADPGRNETHAPLGCINGGSES
NGGQSQSNEERVEEDDDDDNVKGSGNPACSGAVGNQGQGPQNGHGAPTIITMRDD
GLAQPPQLELVGHTIACASNPYQDPYYGGLMAQYGHQSMAYPFVGIPHARMPLPLD
LAQEPVYVNAKQFQGILRRRQARAKAELEKKLIKVRKPYLHESRHQHAMRRARGTG
GRFAKKSETDASNDAAEEKGTNSGPALSSQSASSSGSEPLAPDSSETWNSSSNHVAG
RSQVHGTHRGHDYVNGNSQYKNHGHFQASAYSNERERDRFGQQPRERLL

Figure 133. Amino acid sequence of SEQ ID NO: 1005. The conserved Transcription factor CBF/NF-Y/archaeal histone domain identified using InterProScan is underlined.

MDPMDIVGKSKEDASLPKATMTKIIKEMLPPDVRVARDAQDLLIECCVEFINLVSSES
NDVGNREEKRTIAPEHVLKALEVLGFGEYIEEVYAAYEQHKHETMQDSLKGGKWSN
GAEMTEEALLAEQQRMFAEARARMNGGAAVPKQADVDSNVES

Figure 134. Amino acid sequence of SEQ ID NO: 1006. The conserved CCAAT-binding transcription factor, subunit B domain identified using InterProScan is underlined.

MTSSVHDISENGEADEQQKHSEQHESSPATGVPHPGVSLPNVQYATPPQLGAGHAM
TPPAYPYPDPYYRSIFAPYDAQSYPQQPYGAQPMVHLQLMGIQQAGVPLPSDAVEEP
VFVNAKQYHGILRRRQSRAKAELENKALKSRKPYLHESRHLHALRRARGCGGRFLN
AKKDENQQSEVSSADKSQGNINLNSDKSDRSS

Figure 135. Amino acid sequence of SEQ ID NO: 1007. The conserved CCAAT-binding transcription factor, subunit B domain identified using InterProScan is underlined.

MTSSVHDISENGEADEQQKHSEQHESSPATGVPHPGVSLPNVQYATPPQLGAGHAM
TPPAYPYPDPYYRSIFAPYDAQSYPQQPYGAQPMVHLQLMGIQQAGVPLPSDAVEEP
VFVNAKQYHGILRRRQSRAKAELENKALKSRKPYLHESRHLHALRRARGCGGRFLN
AKKDENQQSEVSSADKSQGNINLNSDKSDRSS

Figure 136. Amino acid sequence of SEQ ID NO: 1009. The conserved Tesmin/TSO1-like CXC domains identified using InterProScan are underlined.

MDTPEKTQIAAPPVSAHEDSPVFNFIRSLSPIKPVKSTHIAQTFTSLPFTALPSVFTSPHA
NFHKDPSFLRRHQSLDPSNPDCSSENHNIVCRNGDFINGISQRSKSSDKKVSVEVHAE
PCKEHSDFATEFPQTSRCGFYNPEGNMTTCSAGAEAAVETAGMLTPIIPVAMKSSGK
PLPEGEGQQQKEWPIDASDLFIFSSPNDVEAFRELVHRSPDFGTACLSSLMSRFTPDD
VSGFERSQQVDLPSREQQQIEPPYPTDEAYGQKEAIKNLDYHNLDKFLDKYMSIQLD
KNSHNDAGTCVPFDYTPVPNFHRGLRRRCLDFEIAELRKLSGDDSDYSHIALSQHDE
NTLVNDGQLPVESEGDPLRCTLPGIGLHLNALATTSNDYQSVEHGNLLSENQLMNTQ
ISSSSLNLPNSHQSLHESLTSVASEDIGSADNGVLVVQDGSQSCAYPDSEELDHNSPQ
KKRRKAEHSEDTACKRCNCKKSKCLKLYCECFAAGVYCIEPCACLDCLNKPIHEDTV
LATRKQIESRNPLAFAPKVIRASDSFPDTGDDSNKTPASARHKRGCNCKKSGCLKKY
CECYQGGVGCSFNCRCEGCKNSFGRKDGSTLNGVEAEIIDEGKENIGKSVGNQRSLE
VAKQRDPIQATPSAYYGPSIQTTYSAKNEPPRSTSLVTTSSSSVLHAGQNQGTHKHVA
PQPEFEKHYDNDNNNSSNAGGKMPEVLRSNDTPNAVIKTASPNGKRVSSPHSDFGSS
PPLRSGRRLILKSIPSFPSLTQH

Figure 137. Amino acid sequence of SEQ ID NO: 1010. The conserved Tesmin/TSO1-like CXC domains identified using InterProScan are underlined.

MDTPERNQIAAPISKFEDSPVFNYINSLSPIKPVKSIRITQAFSSLTFGSLPSIFTSPHVSS
SHKESRFLRSHQDSDPSNIGTSCKDENKIPTAERDVSDVAQLAENESELQENFDILVPI
GESSVEPLDEHQEFALDLPQSLKYDCGSPNSDPTPCSTAADCTVSKSDAPVVEKNSQI
DLPDGRSHQEGTSQQKNDTGCGWESLALESTDLLIFSSPNDAAAFRGLIQRSPDVEV
GYFTSMVSNFPENEVSEELKKQLLYQLTFNEQHEAEEPSCQPVDPSEQKDTNTLPNG
VAISNLDNHTGTYLSVNMDNEVGAHIPFANKPISDLPRGMRRRCLDFEMVGTQQKSL
DSGSGGISSPLLKSDENDIPKNKQLVVVKGGGDSSRCIVPGIGLHLNALTSTTKDSRIV
KHESLLSDVQALNVHMSTTSLQSPLTNQESLHKSLTLSNAEEMDHDNGLQVAEEVS
QAPTDLNYEENGQTSPRKKRRRMENGGESETCKRCNCKKSKCLKLYCECFAAGVYC
IEPCACQDCFNKPIHEDTVLATRKQIESRNPLAFAPKVIRSSESASEYGEDSSKTPASA
RHKRGCNCKKSSCLKKYCECYQGGVGCSINCRCEGCKNAFGTKDGSALRGPDCEEE
EETEKCEKNKAEKIPWKMENENNDELNLASALPSTPSGFRRPLVQLAFPSKLKQPRSS
FVTIGSSYALHSSQKMGKPDLLLPPPPKFEKLPLTNMEDEIPEILCSSSTPTASIKSTSPN
SKRVSPPHSDFGTSPNLRSGRRLILQSIPSFPSLTPQH

Figure 138. Amino acid sequence of SEQ ID NO: 1011. The conserved Transcription factor E2F/dimerisation partner (TDP) domain identified using InterProScan is underlined.

MVIGSSSSNHNHQEDVERNPVAAAGATAGAAVPRSGGGGGSRSWGTTVSGQSVSTS
GSMGSPSSRSEQAMATPASESTFLRMNHLDIQGDDAGSQGDVGGKKKKRGQRAAA
GDKSGR<u>GLRQFSMKVCEKVESKGRTTYNEVADELVAEFADPGNSAATPDQQQYDE
KNIRRRVYDALNVLMAMDIISKDKKEIQWKGLPRTSLNDIEELKTERHGLRNRIEKK
AAYLQELEEQYVGLQNLIQRNEQLFSTGNAPNGGIALPFILVQTRPHATVEVEISEDM
QLVHFDFNSTPFELHDDNYVLKAMKFCETPGNDEMVPVFPSDGGEGSSMSGMYQPQ
PPYPPMSSAAGRPAASPPLPGILKARVKHEH</u>

Figure 139. Amino acid sequence of SEQ ID NO: 1016. The conserved Hpt domain identified using InterProScan is underlined.

MDVAQLKRQLFEYTTLLFHEGFLDEQFTQLQQLQDENNPDF<u>VVEVVSLFFDDSQRLL
NELAKALDQQNIDFKKVDAHVHQLKGSSSSIGAQRVQRVCIAFRNYCQDKNVEGCL
KCLQQVKQEYSLLKNKLETLFNLEKQILAAGGSAPM</u>

Figure 140. Amino acid sequence of SEQ ID NO: 1017. The conserved Hpt domain identified using InterProScan is underlined.

MEVGQMQRRLVEFTKSLFMEGFLDGQFLQLQQLQDESNPDF<u>VVEVVSLFFQDSEKL
LNDLTSALEQQNVDFKKVDAHVHQLKGSSSSIGAQRVKNACVVFRSFCEEQNLEGC
MRCLQQVKQEFYLAKNKFETLFTLEQQIVAAGGSIPAMEITSF</u>

Figure 141. Amino acid sequence of SEQ ID NO: 1018. The conserved Hpt domain identified using InterProScan is underlined.

MEVGQMQRRLVEFTKSLFRKGFLDGQFLQLQQLQDESNPDF<u>VVEVVSLFFQDSEKL
LNDLTSALEQQNVDFKKVDAHVHQLKGSSSSIGAQRVKNACVVFRSFCEEQNLEGC
MRCLQQVKQEFYLAKNKFETLFTLEQQILAAGGSIPATEITSF</u>

Figure 142. Amino acid sequence of SEQ ID NO: 1019. The conserved Response regulator receiver domain identified using InterProScan is underlined.

MGVTAASQ<u>FHVLAVDDSLIDRKLIERLLKTSSYQVTAVDSGSKALEFLGLNEQQPRN
ANATSVSPSYHHQEIEVNLIITDYFMPEMTGYDLLRKIKESNSYKDVPVVIMSSENVP
SRISQCLEDGAEEFFLKPVQLADVNKLKPHLLRGRSKEHHPNSENRKDREEILSPERT
RTRYDVPEVI</u>

Figure 143. Amino acid sequence of SEQ ID NO: 1020. The conserved Response regulator receiver domain identified using InterProScan is underlined.

MGMAAAESR<u>FHVLAVDDNIIDRKLIERLLKTSSYQVTTVDSGSKALEFLGLHEDDRS
NSGSPSILTNNHHQELEVNLIITDYCMPGMTGYDLLKKIKESSSLRDIPVVIMSSENVP
ARISRCLEEGAEEFFLKPVRKSDLNRLRPHVMKAVSKDQKQEKHEEEEEEKQEEKE</u>
IKSQKHQEQQQQQHQQQLSPRPSGNSKRKAMEENLSPDRTRPRYSDIAAVV

Figure 144. Amino acid sequence of SEQ ID NO: 1021. The conserved Response regulator receiver domain identified using InterProScan is underlined.

MTMAGEILRRQSPAEVDLCGGSGQEL<u>HVLAVDDSLVDRKVIEKLLKRLSCKVTAVD
SGLRALQFLGLDGEKSSVGLDDLKVNLIMTDYSMPGMTGYELLKKIKESSAFRETPV
VIMSSERILARINRCLEEGAEEFLAKPVQLSDVQRLKNFVMGGGEVCPDRRINKRRLE</u>
ENNDNDDNENHAPSPVSPLCSRDWAVCSSSSSDSSSPSIAVSSSKRLKIHHQA

Figure 145. Amino acid sequence of SEQ ID NO: 1022. The conserved Response regulator receiver domain identified using InterProScan is underlined.

MARNGVASWRRRSSDQFDDPSPCGSED<u>HVLAVDDSIVDRKVIEHLLKISSCKVTAV
DSGIRALQFLGLGEEKAAGDFNGLKVDLIITDYCMPGMTGYELLKKIKESSALREIPV
VIMSSENVLARIDRCLEEGAEDFIVKPVKLSDVKRLRDFMTRDVGDRVRSDREGTTH</u>
KRKLPESSDVSSSSPSVSSASSSSSSSLPTTPSRSPSPSPSVSLSEPSSPSPSTGSSGPCSPS
SLESPTRRLKMTSCCD

Figure 146. Amino acid sequence of SEQ ID NO: 1032. The conserved Response regulator receiver domain identified using InterProScan is underlined.

MVCTASDLQEWKDFPKGLK<u>VLLLDQDSDSASEIRSKLELMDYVVFTFCNEDEALSAI
ASKPDSFHIAMVEVSTSSNGSFEFLEAARDLPTIMMSNNHCLSTIMKCIALGAVEFLH
KPLCEDKLRNIWQHVAHKAFNAGVSEVSESLKLVKETSVSMLQHQLKNEEQNNDES</u>
REMRKLSVHETDQEMSAASDKYPAPSTPQLKGGARLLDDGDCQDQTNGTVEKESG
EQDGESKFVETTCDDSMSENIQEAQGQRDRDVLVKEEDDSANNSKCESMISPLSENK
DRSHDVHGCNDNQSKASSLHNSARTRVNRKKMKVDWTPELHKKFVQAVEQLGVD
QAIPSCILDLMKVEGLTRHNVASHLQKYRMHRRHILPKEDERRWPHSRDGVTRSYYP
HRPIMAYPTHHPGHPLPPGAAYPVWGAPPSNHPAGMQMWGPPGYPPWPSPENWHW
KTAYPAMQADVWGCPVMPSSHHGPSFAFPQNAPVCHPPDGLENSFAGNSFDYHPDE
EVIDNIVKEAISKPWLPLPLGLKPPSTDCVLAELSRQGIPSIPPHADQLGPC

Figure 147. Amino acid sequence of SEQ ID NO: 1033. The conserved Response regulator receiver domain identified using InterProScan is underlined.

MSTLTSSCSWKAGDGVSDQFPAGL<u>RVLVVDDDPTCLRILEKMLKTCQYQVTTCSRS
DVALSTLRDNKNGFDIVLSDVHMPDMDGFKLLEHIGLEMDLPVIMMSADDGKQVV
MKGVTHGACDYLIKPIRIEALKNIWQHVVRKRKNEWKELEQCGSVEDGDRPQKHLE</u>
DVDYSSTANEGSWKSGKRRKEEEDDAEERDDSSTLKKPRVVWSVELHQQFVSAVN
QLGIDKAVPKKILELMNVPGLTRENVASHLQKYRLYLRRLSGVPQHQAGVNSSFIGT
QDAGFGAISSLNGYEIQALAATGQLAPQSLATLQAAGLGRSAGKSGISIPMLDQRNLF
SFDNPKLRFGEGQSQQNLGTNSKQANLLHGIPTTMEPKQLVNLQQSAQSFGSMSMP
VHTHGAQSSSLLMPMGQPQARRHVISESGSSRPPVLQANMGQSIMSTGLVGQALGRS
GTAENGRGLGHNTILQTSSAMNFPMNQVSDAPVSSFPIQSTFPTSKGGYPEDVNSSIIK
GPGGGMPSYDILHDLQQIRSNDWEFQNVGVTFDTSQPGNSVQGNIDTSGLLLVHQGL
SSGQSSNGHNRNISAAGKSLLSADGNRQVTTPNVGQPPTSLVDNPVQIKTEGFPDMS
YQAVLYPEHYSQEDIMSAFLKQQQGIGPPDSEFEFDGFSVNNIPV

Figure 148. Amino acid sequence of SEQ ID NO: 1038. The conserved GRAS family transcription factor domain identified using InterProScan is underlined.

MKRDHRDACSGGYGGGGGGEASGASKGEPPSSSSTHSLPGSGKAKMVMWGEDDQ
DPSGGGGGGMDELLAVLGYKVRSSDMAEVAQKLEQLEMVMGSAQEDGISHLSYDA
VHYNPSDLSSWVQSMLFELNPPPPPQQVADAVLAAAESSSTIAQHHRSHLGSRSQTQ
TRTLSQTSAPTQTQSQVIFNDDSEYDLRAIPGVAAFPQGDSDFESAARKKMKTLNGG
SNSLSSSSSSS<u>AAGAAPSESTRPVVLVDTQETGVRLVHTLMACAEAVQQENLKLADA
LVKHIGLLAASQNGAMRKVATYFAEALARRIYRIYPNDGSLDSSCNDILQMHFYETC
PYLKFAHFTANQAILEAFATASRVHVIDFGLKQGMQWPALMQALALRPGGPPAFRL
TGIGPPQPNNTDALQQVGWKLAQLADTIGVEFEFRGFVANSLADLEPAMLDIRPPEV
ETVAVNSVFELHPLLARPGAIDKVLSSIKAMRPKIVTMVEQEANHNGPGFVDRFTEA
LHYYSSLFDSLEGSGVAPPNQDLVMSEVYLGRQICNVVACEGPDRVERHETLVQWQ
ARMGSAGFDPVHLGSNAFKQASMLLALFAGGEGYRVEENDGCLMLGWHTRPLIAT
SAWQLAAATQ</u>

Figure 149. Amino acid sequence of SEQ ID NO: 1039. The conserved GRAS family transcription factor domain identified using InterProScan is underlined.

MLAGCSSSTLLSPRHRLRSEPSAVAQFQACHFQLPSMSTQRLDLPCSFSRKENSRPQS
LRPVSLSVEKTSIEATTTTCSLKQHIRLPPLATTSQGSIEGRREVKGEFWERGKSLKRF
ADRSSVDESYVSRAKRKRHGNSNEKPDYVGEGGENLSLGQLSGGSFWFQPSFSASPI
PFSITCSQDDEERVCFVPSEVVSSPMPLSNNPWVESIVTKITDLGEKDVEISHGPVKED
SGSSASSDSQSLALRLNENMSEHEAGNGSG<u>NPYPHEGFSLEASEENHHGEHHEFELV
SLLTACVEAIGSKNIPVINHFIAKLGDHASPRGSTISRVIAYYTEALALRVTRLWPHVF
HITTPREVDRVDEDSGMALRLLNQVSPIPKFIHFTSNEILLRAFEGKDRVHIIDFDIKQG
LQWPSLFQSLASRSNPPSHVRITGIGESKQELVETGDRLAVFAGSFNLPFEFHPVVDRL
EDVRLWMLHVKEGESVAVNCVCQLHKTLYDGSGGALRDFLRLIRSTNPVVLLMAE
QEAHHNTSSLEVRVINSLRYYSALFDSIHSSLPLESAARVKIEELFAREIRNIVACEGSD
RLERHQSFDEWRKLMEQGAFRCLETTERERIQSQMLLKMYDVDEDFIVSERGQDQA</u>
ALTLSWQDQPLYTVSAWVPADVAGSSSSFSQPN

Figure 150. Amino acid sequence of SEQ ID NO: 1040. The conserved HMG1/2 (high mobility group) box domain identified using InterProScan is underlined.

MKGGNSKSQSRNAALSVNKRKVTKKEKKVKDPNK<u>PKRPASAFFVFMEEFRKQYKE
KHPNNKSVAAVGKAGGDKWKSLSDDEKAPYIAKAEKRKVEYEKTMKAYNKRQAE</u>
GTKADEEESEKSMSEVNNEEEDEDGSEEDEDDD

Figure 151. Amino acid sequence of SEQ ID NO: 1041. The conserved HMG1/2 (high mobility group) box domain identified using InterProScan is underlined.

MKGGNSKSQSRNAALSVNKRKVTKKEKKVKDPNK<u>PKRPASAFFVFMEEFRKQYKE
KHPNNKSVAAVGKAGGDKWKSLSDDEKAPYIAKAEKRKVEYEKTMKAYNKRQAE</u>
GTKADEEESEKSMSEVNNEEEDEDGSEEDEDDD

Figure 152. Amino acid sequence of SEQ ID NO: 1042. The conserved HMG1/2 (high mobility group) box domain identified using InterProScan is underlined.

MKGGKAKAETTRVDASLKRKGAGTQRAGKKTAKKEKAVKDPNKPKRPASAFFIFM
EDFRVQYKQKHPNNKSVAAVGKAGGDKWKSMSEAEKAPFAAKAEKRKDEYNKK
MNAYNKKSAEGTNGADDEESDKSKSEVNDEDDEDGDDSAEEDEDDD

Figure 153. Amino acid sequence of SEQ ID NO: 1043. The conserved HMG1/2 (high mobility group) box domain identified using InterProScan is underlined.

MKGGKSKSDTKSARLSVNKKSTAKAGKKSGKAAKDPNKPKRPASAFFVFMEEFREL
YKKDHPKNKSVAAVGKAGGDKWKSLSEAEKAPYIAKADKRKAEYEKNMKAYNKR
QAEGPKEEDLESEKSVSEVNDDDDDEEEEEEGSGEEEDDEYEDSAGRIA

Figure 154. Amino acid sequence of SEQ ID NO: 1044. The conserved HMG1/2 (high mobility group) box domain identified using InterProScan is underlined.

MKPTRSRAAARKGNKEAVKPVDDRIIGKRKAAIRADKSNNKRAKNVTSAKKDPNKP
KKPPTAFFVFLEEFRIIYKQEHPKVKAVSAVGKAGGEKWKSMSHAEKAPYEAKAAK
RKSDYEKVMAAYKKKQESTDDDEEAESETSKSQVNDKDDEESEEDDEEEEDDD

Figure 155. Amino acid sequence of SEQ ID NO: 1045. The conserved HMG1/2 (high mobility group) box domain identified using InterProScan is underlined.

MKTTKGKGPARSSREALKPADDRMVGKRKAAARPESKRKVKKDKQAKKDPNKPK
RPPSAFFVFLEEFRKTFKKENPNIKAVSAVGKAGGEKWKSMSQAEKAPYEAKAAKK
KTEYEKLMNAYNKKQESVDEDGDEESERSKSEVNDEDEASAEEAQEDEEEEEDDD
DDDDED

Figure 156. Amino acid sequence of SEQ ID NO: 1047. The conserved HMG-I and HMG-Y DNA-binding (A+T-hook) domains identified using InterProScan are underlined.

MDSRDAPPPPGMVGVVGSTGSYPTGGPQQAPTQQQQQQQQPPQHLINPNSSAVMM
QHRFPFNSMVASGPHPPPPPQQQQQQQQQHQQHQQAAQQEGGMDALGNAGGIYDG
SSQSGLRPGGFSIEPAKKKRGRPRKYTPEGNIALGLGPASVHSSSGGDHHHHHHHGG
GGGGGTSGGGGDGNLTGSSEPQSKKHRGRPPGMGKKQMDALGAGGVGFTPHVIHV
DAGEDVASKIMAFSLQGPRTICILSASGAICNVTLKQPAMNGGTVTYEGRFEIICLSGS
FLCPENESGRSRAGALSVSLAGPDGRVLGGGVAGLLIAATPVQVIVGSFLANSKKASS
SALKSDASPTPQGPQSHMLNFGTAGTAVSPPSDGASADSSDENGNSPINHRPTGIYNN
TSQPIHNMQMYHHLWAGQTPH

Figure 157. Amino acid sequence of SEQ ID NO: 3604. The conserved Homeobox domain identified using InterProScan is underlined.

MGIDDLCNTGLVLSLGLETPFKIEAQRQAKQRLNFEPSLTLCLSGTTKATRDEQPPAD
HLYRQASPHSHNSLSAVSSFSSPRVKRERDLSSEEAEVETRVSSKASDEDDDGANAR
KKLRLTKEQSALLEESFKQHSTLNPKQKQA<u>LARQLNLRPRQVEVWFQNRRARTKLK</u>
QTEVDCEFLKKCCETLTDENRRLQKELQELKALKLAQPFYMHMPAATLTMCPSCERI
GAGPSVDGAAPTKGPFSMTTKSHLYSHHFTNPSAAC

Figure 158. Amino acid sequence of SEQ ID NO: 1054. The conserved Homeobox domain identified using InterProScan is underlined.

MGIDDLCNTGLVLSLGLETPFKIEAQRQAKQRLNFEPSLTLCLSGTTKATRDEQPPAD
HLYRQASPHSHNSLSAVSSFSSPRVKRERDLSSEEAEVETRVSSKASDEDDDGANAR
KKLRLTKEQSALLEESFKQHSTLNPKQKQA<u>LARQLNLRPRQVEVWFQNRRARTKLK</u>
QTEVDCEFLKKCCETLTDENRRLQKELQELKALKLAQPFYMHMPAATLTMCPSCERI
GAGPSVDGAAPTKGPFSMTTKSHLYSHHFTNPSAAC

Figure 159. Amino acid sequence of SEQ ID NO: 1056. The conserved Homeobox domain identified using InterProScan is underlined.

MEAGRFLFDPPALQGNILFLDKGSRSMMGMEESPKRRRFFCSPDELFDEEYYDEQMP
<u>EKKRRLTPEQVLLLEKSFEEENKLEPERKTQLAKKLGLQPRQVAVWFQNRRARWKT</u>
<u>KQLERDYDYLKSS</u>YDSLLSDYDSILKENEKLKLEVYSLTEKLQGKEVDGAPMTGPSE
PAPLEEADVQAVQFSAKVEDRLSTRSGGSAVIDEEGPQLVDSGNSYLLCENYPGCVA
QSEDDGSDDGQSYFPGVFAAATEQPHHEEEEPMDWWVWS

Figure 160. Amino acid sequence of SEQ ID NO: 1057. The conserved Homeobox domain identified using InterProScan is underlined.

MEAGRFLFDPPALQGNILFLDKGSRSMMGMEESPKRRRFFCSPDELFDEEYYDEQMP
<u>EKKRRLTPEQVLLLEKSFEEENKLEPERKTQLAKKLGLQPRQVAVWFQNRRARWKT</u>
<u>KQLERDYDYLKSS</u>YDSLLSDYDSILKENEKLKLEVYSLTEKLQGKEVDGAPMTGPSE
PAPLEEADVQAVQFSAKVEDRLSTRSGGSAVIDEEGPQLVDSGNSYLLCENYPGCVA
QSEDDGSDDGQSYFPGVFAAATEQPHHEEEEPMDWWVWS

Figure 161. Amino acid sequence of SEQ ID NO: 1058. The conserved Homeobox domain identified using InterProScan is underlined.

MKRLSSSDSSDVWISMCSGKEEKVLKKSQGYSIEFQAMLDSLDQEDHSGEEAGLITE
<u>KKRRLSANQVKALEKNFEIENKLEPERKARLAEELSLQPRQVAIWFQNRRARWKTK</u>
<u>QLERDFGHLKASYDSL</u>KLDFDSLEQEKESLAAELTELKVKLRRETSESSNHCAVKHE
SPLSESSEDGKPGSCSGSVKEDPNPTPELPPSSAAPPLPLRYGSCSTSPPPPPPPPPSSS
RGTTAGRGYYHQVRMEENHPSGFISEESCNFFSVDQPPTLHWYFP

Figure 162. Amino acid sequence of SEQ ID NO: 1059. The conserved Homeobox domain identified using InterProScan is underlined.

MMVEREDLGLSLSLSFSDSSRPSQLSASPFGFNLYKPSHRDCETFASLDRISEADARPS
LRGIDVNRPPPSAADCEEQEEAGVSSPNSTISSVSGKRGEREMVSGGEDNEAERDCSR
GGSDEEDGENSRKKLRLSKDQSAVLEESFREHNTLNPKQKLALAKQLGLRPRQVEV
WFQNRRARTKLKQTEIDCEFLKRCCENLTEENRRLQKEVQELRALKLSPQFYMHMP
PPTTLTVCPNCERVGAAAPPLPSAGGGGRPAHHREPVPMIPWAARPGPVSHGALRPR
T

Figure 163. Amino acid sequence of SEQ ID NO: 1060. The conserved Homeobox domain identified using InterProScan is underlined.

MAFFSPNFMLQSPHDQDHEHPHHQHQHQILSSCTPQDFHGVASLLGKRSMSFTGIDV
GDDPNINNGNVNGEEDLSEDDGSQPGGEKKRRLNMEQVKTLEKNFELGNKLEPERK
MQLARALNLQPRQIAIWFQNRRARWKTKQLEKDYDLLKRQFDAVKADNETLQAQN
QKLQTEILALKNTREPAESINLNKETDQGSCSNRSENSSEIRLDMTRTPPVESPVSGHA
LPAAGRQLFPASMRPAASGGSVAQLFQNPSRPDLPMIVKEESSITNMFCGIEDHSGFW
PWLEQQHY

Figure 164. Amino acid sequence of SEQ ID NO: 3605. The conserved Homeobox domain identified using InterProScan is underlined.

MAGGASASASAITTLLQNQRVPPPPPSDAFFLSGSSPFLGSRAMVSFEDAHRGNRLNR
PFFRSIDPDENGEDDLEDYFHQPEKKRRLTVEQVQFLEKSFEVENKLEPDRKIQLAKD
LGLQPRQVAIWFQNRRARWKTKQLEKDYETLQASFNTLKSDYDTLIKERNDLKAEV
LNLTDKLLHKGNEKESSESSSKSSQGLFQNPIADSVSEDEVSRVPIPTWPEDICSVKSD
MFDSESPHYTDAAHSSLLEPGDSSYAFEPDHSDLSQDEEDNLSKSLLSTRNYPKLENS
DYAILPPNSCNFGFHAEDPAFWPWSY

Figure 165. Amino acid sequence of SEQ ID NO: 1068. The conserved Homeobox domain identified using InterProScan is underlined.

MELGDQEQEREMPSSLGYTPPHKDSSSKFSAANRRDQTLDQPNHLYPQNHHPPNPH
QLANKPRREYQETDQDPFAVASPSPIAVATGGTSVSIKPHTEPPSPPQGQLTQSPTPQP
QSVTALISTSSIRYRECLRNHAASMGGHIIDGCGEFMPSGEEGTPGYFRCAACECHRN
FHRKEVDGEPQYTPSLYYSSNKTNGQRAALPPPQHHAIPQPNPINLHHRFSYCISSAA
TTTTTMALNQPVMMAFGGGVPEESSSEDLTMIQHSDAMLRSTQLASSKKRFRTKFT
QQQKDKMMECAEKLGWRIQKQDEQEVTQFCAEAGVTRKAFKVWMHNNKQAMKK
QQR

Figure 166. Amino acid sequence of SEQ ID NO: 1069. The conserved Homeobox domain identified using InterProScan is underlined.

MKRLGSSDSLGALMSICPPSEELQHSPRNGNPIYHSRDLQSMLELGLDEEGCVEDQSA
GGGGHVGGE<u>KKRRLSIDQVKALEKNFEVENKLEPERKVKLAQELGLQPRQVAVWF
QNRRARWKTKQLERDYGVLKSSYEALKLSYDALKHDNEALHKEIKELKSKLREEDD</u>
NPESNLSVKEEVIIPGHDVSDKIRAADDGDDDTKRSPPPPITAPPRELSFNNGGLKDGS
SDSDSSAIVNEENAATSSSSPNPAVQSHGGFLKFMGSSSSSASPPPPPPASFGGCFSFQF
QRAYQPQPQPPHHHHHHSPYVKMEEHNFLGGEEDCNFFSDEQAPTLHWYCPDQWN

Figure 167. Amino acid sequence of SEQ ID NO: 1070. The conserved Homeobox domain identified using InterProScan is underlined.

MKRLGSSDSLGALMSICPPSEELQHSPRNGNPIYHSRDLQSMLELGLDEEGCVEDQSA
GGGGHVGGE<u>KKRRLSIDQVKALEKNFEVENKLEPERKVKLAQELGLQPRQVAVWF
QNRRARWKTKQLERDYGVLKSSYEALKLSYDALKHDNEALHKEIKELKSKLREEDD</u>
NPESNLSVKEEVIIPGHDVSDKIRAADDGDDDTKRSPPPPITAPPRELSFNNGGLKDGS
SDSDSSAIVNEENAATSSSSPNPAVQSHGGFLKFMGSSSSSASPPPPPPASFGGCFSFQF
QRAYQPQPQPPHHHHHHSPYVKMEEHNFLGGEEDCNFFSDEQAPTLHWYCPDQWN

Figure 168. Amino acid sequence of SEQ ID NO: 1073. The conserved Homeobox domain identified using InterProScan is underlined.

MAFHNHLSHQDLSSLHHFAADQQPPPPQHQQQQQHLPDSSSSVHHQLHHAAGPNW
LNTALLRSDAAAAAAAAGGNSFLNLHTSSDSAASPQAQQQPPATSASAAAGHHQ
WLSRQHSSLLQRNHSEVIDADSIIDSADLKESVSKGDGGGGGAAESNWENAKYKAEI
LAHPLYEQLLSAHVACLRIATPVDQLPRIDAQLAQSQHVVAKYSAMSQGLVADDKE
LDQFMTHYVLLLCSFKEQLQQHVRVHAMEAVMACWEIEQSLQSLTGVSPGEGTGA
TMSDDEDDQVDSDANLFDGSLDGTDSLGFGPLIPTETERSLMERVRQELKHELKQGY
KEKIIDIREEI<u>LRKRRAGKLPGDTTSVLKQWWQTHSKWPYPTEEDKARLVQETGLQL
KQINNWFINQRKRNWHSNPSTSTVLKSKRKR</u>

Figure 169. Amino acid sequence of SEQ ID NO: 1077. The conserved Homeobox domain identified using InterProScan is underlined.

MMAVTSACKDKMGIDNG<u>KYVRYTPEQVEALERLYHECPKPSSLRRQQLIEKCPILSN</u>
<u>IEPKQIKVWFQNRRCREKQRK</u>EASRLQAVNRKLTAMNKLLMEENDRLQKQVSQLV
YENSYFRQQTQNATLATTDTSCESVVTSGQHHLTPQHPPRDASPAGLLSIAEETLTEF
LSKATGTAVEWVQLPGMKPGPDSIGIIAISHGCTGVAARACGLVGLEPSRVAEILKDR
PSWYRDCRAVDVANVLSSGNGGTVELLYMQLYAPTTLAPARDFWLLRYTSVMEDG
SLVVCERSINNTQNGPSMPPVQHFVRAEMLPSGYLIRPCEGGGSIIHIVDHMDLEPWS
VPEVLRPLYESSTLLAQRTTMAALRNLRQISQEVSQPNVTGWGRRPAALRALGQRLS
KGFNEAVNGFMDDGWSMLESDGVDDVTLLINSSPAKMAGVNISYASGFPSMTSAVL
CAKASMLLQNVPPAILLRFLREHRSEWADSSIDAYSAAAIKASPCNMPGTRIGGFGSQ
VILPLAHTIEHEEFMEVVKLENMGHYRDDMIMPSDIFLLQLCNGVDENAVGTCAELL
FAPIDASFSDDAPIIPSGFRIIPLDPGSDASSPNRTLDLASALDVGPTGNKAVGDNSGHS
GNTKSVMTIAFQFAFELHLQENVASMARQYLRSIIASVQRVALALSPTNLGCHASLRP
PPGSPEAHTLARWICQSYRSFLGVALLKNEAADSLLKNLWHHSDAILCCSLRAAPVF
TFANQAGLDMLETTLIALQDITLEKIFDDNGRKTLCSEFPQIMQQGFMCLQGGICLSS
MGRPISYERAVAWKVLNEEETAHCICFMFVNWSFV

Figure 170. Amino acid sequence of SEQ ID NO: 3606. The conserved Homeobox domain identified using InterProScan is underlined.

MMAVTSACKDKMGIDNG<u>KYVRYTPEQVEALERLYHECPKPSSLRRQQLIRECPILSN</u>
<u>IEPKQIKVWFQNRRCREKQRK</u>EASRLQAVNRKLTAMNKLLMEENDRLQKQVSQLV
YENSYFRQQTQNATLATTDTSCESVVTSGQHHLTPQHPPRDASPAGLLSIAEETLTEF
LSKATGTAVEWVQLPGMKPGPDSIGIIAISHGCTGVAARACGLVGLEPSRVAEILKDR
PSWYRDCRAVDVANVLSSGNGGTVELLYMQLYAPTTLAPARDFWLLRYTSVMEDG
SLVVCERSINNTQNGPSMPPVQHFVRAEMLPSGYLIRPCEGGGSIIHIVDHMDLEPWS
VPEVLRPLYESSTLLAQRTTMAALRNLRQISQEVSQPNVTGWGRRPAALRALGQRLS
KGFNEAVNGFMDDGWSMLESDGVDDVTLLINSSPAKMAGVNISYASGFPSMTSAVL
CAKASMLLQNVPPAILLRFLREHRSEWADSSIDAYSAAAIKASPCNMPGTRIGGFGSQ
VILPLAHTIEHEEFMEVVKLENMGHYRDDMIMPSDIFLLQLCNGVDENAVGTCAELI
FAPIDASFSDDAPIIPSGFRIIPLDPGSDASSPNRTLDLASALDVGPTGNKAVGDNSGHS
GNTKSVMTIAFQFAFELHLQENVASMARQYLRSIIASVQRVALALSPTNLGCHASLRP
PPGSPEAHTLARWICQSYRSFLGVALLKNEAADSLLKNLWHHSDAILCCSLRAAPVF
TFANQAGLDMLETTLIALQDITLEKIFDDNGRKTLCSEFPQIMQQGFMCLQGGICLSS
MGRPISYERAVAWKVLNEEETAHCICFMFVNWSFV

Figure 171. Amino acid sequence of SEQ ID NO: 1081. The conserved Heat shock factor (HSF)-type DNA-binding domain identified using InterProScan is underlined.

MYTSVHGMEAAAAAANGDAIA<u>PFVMKTYQMVSDPATDNLIAWGKANNSFIVVQPL</u>
<u>DFSQRLLPAYFKHNNFSSFVRQLNTYGFRKVDPDRWEFANQWFLRGQKHLLRNIVR</u>
<u>RKHSKGAYSQSKGGG</u>DADMDEEELASEIARLRQEQRALEEEIRGMSKRLEATERRPQ
QMMAFLYKVIEDPELLPRMMGERDRNKRLAVASGDKRQRLMISSAAVSSSSSSGMG
VSSSIKSEDDEEGTNFGVMSSPEVEGNLDISRFCDFAAVPASSSSASIDGGIGRNMAFS
PPYNDVGGYGGVANNQFGYFTEMAVAGGEASPPTPPYPFSLLGGGF

Figure 172. Amino acid sequence of SEQ ID NO: 1082. The conserved Heat shock factor (HSF)-type DNA-binding domain identified using InterProScan is underlined.

MPGEQTGDSPVAGDSQRSLP<u>TPFLTKTYQLVDDPGVDDLISWNEDGATFIVWRPAEF
ARDLLPKYFKHNNFSSFVRQLNTYGFRKVVPDRWEFANDCFRKGEKALLRDIQRRKI
SPTAAAAGAAAVTVAAVGVAGLTVSPANSGDEQVISSSSPPVALATAAVAAASPSV</u>
VHRSPSCTTAPELLEENERLKKENMQMSQELSQLRGLCNNILSLMANYVSRQSDSSS
AAPEGQALELMPARQAEAAEDCAGPPSAAALEEDDDEEAATVAPRLFGVSIGGKRQ
RIEENSSNGGDEEMREADQAAPVPPDEREPGGEVKSEPLDGSRDHHGGEDPSWLELG
K

Figure 173. Amino acid sequence of SEQ ID NO: 1086. The conserved Heat shock factor (HSF)-type DNA-binding domain identified using InterProScan is underlined.

MDAAPPGGGGGGGGPAP<u>FLLKTYEMVDDAGTDEIVAWSSGKTSFVVWNPPEFARL
LLPTYFKHNNFSSFIRQLNTYGFRKIDPERWEFANEEFVKDKKHLLKNIHRRKPIHSHS
QPQGSMVDSERAAYEEELEKLNRDKSALEAKIVRLKQQQSIGKLHMGELFQRVGGM
ERRQEDLLAFLEKNLQNPNFVEHLTRKVKSLDLSAYKKKRRLPHTDHGRPGAENSL</u>
DTHSSSRLELGNIFQQDFSNKLRLELSPAVSDINLVSNSTHSSYEDGGSPRRITSESDPK
DAPMGTESLLSAPEAVELSDTGTSFTFKMDSSMQRKPPVDESPRMHPLPMNLTTEEG
DNNVSCQLNLSLASSLLQVDHSQQFNRLNVLGSETSKSPDARSNASITESGFGVLQK
NKNSDEERTNSSLPEAQNNNQPIAPASGRINDVFWEQFLTERPGALENEEACSSYREN
SYDVHGDQRPGPGMSRNSKSMERLTL

Figure 174. Amino acid sequence of SEQ ID NO: 1087. The conserved Heat shock factor (HSF)-type DNA-binding domain identified using InterProScan is underlined.

MALACRFPKPSSKNQVLSWKRQKPFAKSREEIASVAVLDGGDHGEIGSQSPLYLNLT
RTDSPRSQSKPRAGELGCCGSLSHSGHLPEVAIGDGKIGAGSCLHSCLTRPEPCSALA
VKAAKIKEEVEEEEVPTIADPRDATILLPSCSWQAVADGVAKPMEGLGEAGPT<u>PFLR
KTYEMVSDPGTDPLVSWGLRRDSFVVWDEQEFSKQVLPRYFKHSNFSSFIRQLNTYG
FRKIDPDRWEFANRGFHKGKKHLLKNJKRRRRSNEHRETSSSTVTSDYQKAENEVEL
KTLKKDQEALKTRILKLREERENFQREIEHVTERVRHAECRNQQIFLFLTKAAKRPNF</u>
VQHLIQKKRQKRDLETCESSKKSKLLGPDAEATKCLNEAMDHMIQSPNVDCLRISDD
LAQMEHWPNRVMPEDFDTIQMPNPWPSMDVEDFRVSLGQTPDQMARAGPSDLSSV
FHEMSEKLLREDVVAGDDADNIEVEDHLTVNDMGIYLELEGLTDGLGTRVN

Figure 175. Amino acid sequence of SEQ ID NO: 3607. The conserved Transcription factor jumonji, jmjC domain identified using InterProScan is underlined.

MKADDALPDHLRCNRTDGRQWRCNRPVMEDKKLCEIHYLQGKHRQHKEKVPESLK
IQRRTGKSEGKVPALHNLKIRAQKIEKPGRRAVRMRRKNLARELVRIVVKREAEKRR
EVEGSGGEDMMRRLPNGVMVISQSAARRQQQQSGGANDNVGSQCDVKVGVDANV
APRRRFRSKNLEPLPIGAVQVMPYKRNVEKVGRKKCHWCKSSGATSLIKCSSCRKH
HFCLECIEGRYFDTQEEVKMECPVCRKTCRCKACLAYKYKDSACQELSSDHSRADKI
LHSHHLISVLLPVLKEINEERSIELEVEAKVKGTEVSQLQVHQAECGFNKQYCCNNCR
TSILDLHRSCSSCSYNLCLSCYWDFYRGILPKGVKLPNNKYDRKRKASVQGHKQLSA
KSISKLEQKYGGKSLTVSMPLATSKACNGDDVSCPPWEFGCCDNARFNLQSFFPINW
SKELEKKAEEVVCSYDLRENSDGSLCCPLCHGDNHEAVNTQLQQAATRRTSNDNFL
YYPTALEVHADKCEHFQKHWVRGHPVIVRDILWRTSDLNWDPVAMFCTHLDGSIA
KCENEKEASKASPCLEWSEVEISMRQSFIGFRGKARESIRHEKLEIKSWLSSRYFREQF
PAHYAEILSALPLQDYMNPDLGRLNLATMLPLENMSAEIGPYVYISYCSPNEHPSEHF
GSKLCYDLCDVMMFRRTKLIESKLMRKRQAQDKKESTGAPNGELLGSDIENSSEVL
DVSIEEMQIRKKMAKVTWLATASEESPCLIAQDNKQKQDHNSTSMEDIQQNLYENQ
TESHSHYMKKVGKSCGAQWDVFRREDVPKLEEYFRRYSAEFMQPCGSQKHVVHPIL
DQCYFLDEYHKLRLKEEFEIEPWTFEQHVGEAVLIPAGCPYQIRNPKSSVNVILHFISP
ESAAECIHLIDELRLLPEGHEARLDKLEVKKMAVSSLTRAIDEIRELTSVKDNAEA

Figure 176. Amino acid sequence of SEQ ID NO: 1089. The conserved Zn-binding protein, LIM domain identified using InterProScan is underlined.

MPFVPAENPKCPACGKSVYAAEEKVAGGYKFHKMCFKCSMCNKLLDSTNCAEHEK
ELFCKQCHGRKYGPKGYGFGGGAGCLSMDAGEHLGK

Figure 177. Amino acid sequence of SEQ ID NO: 1090. The conserved Zn-binding LIM domain identified using InterProScan is underlined.

MPFKPADNPKCPKCGKSVYAAEERVAGGLKWHKMCFKCGLCQKLLDSTNCTEHDG
EIYCKNCHGRKFGPKGYGFGGGAGCLSMDSGDHFKEAN

Figure 178. Amino acid sequence of SEQ ID NO: 1091. The conserved Zn-binding protein, LIM domains identified using InterProScan are underlined.

MAFAGTTQKCMACEKTVYLVDKLTADNRIYHKACFRCHHCKGTLKLGNYNSFEGV
LYCRPHFDQLFKRTGSLEKSFEGTPKIAKPEKPVDGERPAATKASSMFGGTRDKCVG
CKSTVYPTEKVTVNGTPYHKSCFKCTHGGCVISPSNYVAHEGKLYCRHHHTQLIKEK
GNLSQLEGDHERETMAPES

Figure 179. Amino acid sequence of SEQ ID NO: 1092. The conserved Zn-binding protein, LIM domains identified using InterProScan are underlined.

MAFAGTTQKCMACEKTVYLVDKLTADNRIYHKACFRCHHCKGTLKLGNYNSFEGV
LYCRPHFDQLFKRTGSLEKSFEGTPKIAKPEKPVDGERPAATKASSMFGGTRDKCVG
CKSTVYPTEKVTVNGTPYHKSCFKCTHGGCVISPSNYVAHEGKLYCRHHHTQLIKEK
GNLSQLEGDHERETMAPES

Figure 180. Amino acid sequence of SEQ ID NO: 3608. The conserved Zn-binding protein, LIM domains identified using InterProScan are underlined.

MAFAGTTQKCMACEKTVYLVDKLTADNRIYHKACFRCHHCKGTLKLGNYNSFEGV
LYCRPHFDQLFKRTGSLEKSFEGTPKIAKPEKPVDGERPAATKASSMFGGTRDKCVG
CKSTVYPTEKVTVNGTPYHKSCFKCTHGGCVISPSNYVAHEGKLYCRHHHTQLIKEK
GNLSQLEGDHERETMAPES

Figure 181. Amino acid sequence of SEQ ID NO: 1094. The conserved Zn-binding LIM domains identified using InterProScan are underlined.

MAFAGTTQKCMACDKTVYLVDKLTADNRIYHKACFRCHHCKGTLKLSNYNSFEGV
LYCRPHFDQLFKRTGSLEKSFEGIPKIVKPERPLGSELLKQKPAAAKVSGMFAGTREK
CFGCKNTVYPTEKVSVNGTPYHKSCFKCTHGGCTISPSNYIAHEGKLFCKHHHAQLI
REKGNLSQLEGDHAGNEKVATREIAV

Figure 182. Amino acid sequence of SEQ ID NO: 1095. The conserved Zn-binding protein, LIM domains identified using InterProScan are underlined.

MAFTGTVDKCKVCDKTVHVVDMMTLEGIPYHKTCFRCSHCNGTLVMSNYSSMDG
VLYCKTHFEQLFKESGDFRKNFHSAKSDKPNEMTRTPSKLSSMFSGTLDKCSSCNKT
VYPLEKVTMEGECYHKTCFRCAHGGCPLTHSSYAALDGVLYCRHHFARLFMEKGD
FKHVLDSATHRRNASSGTPPPEPAELVTETDTEMMQEVSPSA

Figure 183. Amino acid sequence of SEQ ID NO: 1096. The conserved Transcrition factor, MADS-box SEQ ID NO: 3668) domain and K-box domain identified using InterProScan are underlined.

MVRGKTQMKRIENDTSRQVTFSKRRNGLLKKAFELSVLCDAEVALIIFSPRGKLYEFS
SSSLSKTIEKYQKRAKDMEAKTAEISMQPSKGNTLDMEKKIEHFEISRRRLLGEGLDS
CSVEELQQTENQLERSLTKIRARKNHLIREHIERLKAEERKLLEEKRKLLQEIECGKGL
TPVSSKPPREEIRAETMDVVTELFIG PPKR

Figure 184. Amino acid sequence of SEQ ID NO: 1098. The conserved Transcrition factor, MADS-box SEQ ID NO: 3668) domain identified using InterProScan is underlined.

<u>MAKEKIKIKKIDNLTARQVTFSKRRRGLIKKAEELSVLCDADVSLIVFSATGKLYDFS
SSR</u>MEDTLTRYYGFHSNKVEKSVQPCLALEIENTNREMLHEEVYDRAHKLRQMKGE
DLEGLNVEELDQLEKKLEAGLSLVIKNKEEKTWNEINKLQRKEAQLIKQNKQLKHE
MKMILHQEKSVTVNSESVKDVYISRNSMPPLDGDSPNPSS

Figure 185. Amino acid sequence of SEQ ID NO: 1099. The conserved Transcrition factor, MADS-box SEQ ID NO: 3668) domain identified using InterProScan is underlined.

<u>MAKEKIKIKKIDNLTARQVTFSKRRRGLIKKAEELSVLCDADVSLIVFSATGKLYDFS
SSR</u>MEDTLTRYYGFHSNKVEKSVQPCLALEIENTNREMLHEEVYDRAHKLRQMKGE
DLEGLNVEELDQLEKKLEAGLSLVIKNKEEKTWNEINKLQRKEAQLIKQNKQLKHE
MKMILHQEKSVTVNSESVKDVYISRNSMPPLDGDSPNPSS

Figure 186. Amino acid sequence of SEQ ID NO: 1100. The conservedTranscription factor, MADS box (SEQ ID NO: 3668) domain identified using InterProScan is underlined, as supported by Table 1.

MVRGKIQLRRIENTTSRQVTFSKRRNGLLKKAYELSVLCDAEVAVIIFSQKGRLYEFS
SNSEIQKTIDRYRRSTYDMDTYKTNLDQCILHLKQETTDMERKIELLEVSLRKLSGEC
LGSCSIDEIQMIGDQLERSLSSIRARKAQLFDDQIQHLQAKERSLKEENAKLLAKCLA
NPGQSTAHPRAAALHSRSSRSTDVETGL
FIG LPELN

Figure 187. Amino acid sequence of SEQ ID NO: 1101. The conserved Transcrition factor, MADS-box SEQ ID NO: 3668) domain and K-box domain identified using InterProScan are underlined.

<u>MARGKIQMKRIENATSRQATFSKRRNGLMKKAFELSVLCDAEVAVIIFSQRGRLYEF
SSSNMQKTIERYHQYAKEDTGKKASMEQYMLHLKHEAADMSRKIELLEASKRKFLG
QGLESCSVDELQEISVQLERSLSTIRVKKDQLFKEQIEQLKAKEVFLIEENSRLCEKYG
E</u>KGMPWQSTSSVQPKEARIHSLSSGSTDVETELFIG LPEMRC

Figure 188. Amino acid sequence of SEQ ID NO: 1102. The conserved Transcrition factor, MADS-box SEQ ID NO: 3668) domain and K-box domain identified using InterProScan are underlined.

<u>MARGKIQMKRIENATSRQATFSKRRNGLMKKAFELSVLCDAEVAVIIFSQRGRLYEF
SSSNMQKTIERYHQYAKEDTGKKASMEQYMLHLKHEAADMSRKIELLEASKRKFLG
QGLESCSVDELQEISVQLERSLSTIRVKKDQLFKEQIEQLKAKEVFLIEENSRLCEKYG
E</u>KGMPWQSTSSVQPKEARIHSLSSGSTDVETELFIG LPEMRC

Figure 189. Amino acid sequence of SEQ ID NO: 1103. The conserved Transcrition factor, MADS-box SEQ ID NO: 3668) domain identified using InterProScan is underlined.

MV<u>RGKTLMRRIENATSRQVTFSKRRNGLLKKAFELSVLCDAEVALIIFSPRGKLYEFA
SSSMNETIERYHRHTKDTRTGNKSVEENMQHLKDEAANMMKKIELLEDSRRKLLGE
GLGSCSIEELQQIEQQLERSVISIRARKTQVFKEQIDKLKEKEKMLTAENAILTEKCGI
KPPQRANECRDSPLLRESSPSSEVETGLFIG</u> PPETRSRRLPFQN

Figure 190. Amino acid sequence of SEQ ID NO: 1104. The conserved Transcrition factor, MADS-box SEQ ID NO: 3668) domain identified using InterProScan is underlined.

MV<u>RGKTLMRRIENATSRQVTFSKRRNGLLKKAFELSVLCDAEVALIIFSPRGKLYEFA
SSSMNETIERYHRHTKDTRTGNKSVEENMQHLKDEAANMMKKIELLEDSRRKLLGE
GLGSCSIEELQQIEQQLERSVISIRARKTQVFKEQIDKLKEKEKMLTAENAILTEKCGI
KPPQRANECRDSPLLRESSPSSEVETGLFIG</u> PPETRSRRLPFQN

Figure 191. Amino acid sequence of SEQ ID NO: 1105. The conserved Transcrition factor, MADS-box SEQ ID NO: 3668) domain identified using InterProScan is underlined.

MA<u>REKIKIKKIDNVTARQVTFSKRRRGLFKKAGELSVLCDAEVAVVIFSATGKLFEYS</u>
SSSMKDTLERYTLHHNNLENMDQPSLELQLEHSNNMRLSKEVAEKSHRLRQLRGED
LQGLNIEELQQLEKMLEAGLNRVLVTKEERIRTEITDLETKGAELIEENKMLKQTMTT
LTKGKRHIVTEPDVALPEEGVSSESATNVCSCNSGPPLEDDGSDTSLKLG

Figure 192. Amino acid sequence of SEQ ID NO: 3609. The conserved Transcrition factor, MADS-box SEQ ID NO: 3668) domain identified using InterProScan is underlined.

MG<u>RGKIEIKRIENTTNRQVTFCKRRNGLLKKAYELSVLCDAEVALIVFSSRGRLYEYS</u>
NNSIRSTIERYKKANSDSSNTSTVTEINAQYYQQESAKLRQQIQMLQNSRHLMGDS
LSSLSVKELKQLENRLERGITRIRSKKHEMLLTEIEYLQKKEIELENESVFLRTKIAEVD
RIQQGNMVAGPQVNVMEALASRNFFPSNMVEGGTVYSHSDKKVLHLG

Figure 193. Amino acid sequence of SEQ ID NO: 3610. The conserved MADS-box SEQ ID NO: 3668) domain identified using InterProScan is underlined.

MV<u>RGKTQMRRIENKTSRQVTFSKRRNGLLKKAFELSVLCDAEVAAIIFSPTGKLYEFS</u>
TSSMSSIIERYQRKTKDPGCSEKTTEIDLQNMKGNSLDMAKMIELLNVSNSRLSGELS
DTCSVEELQSTQNLLERSLSKIRARKNLLFKEQIMLLKQEEKKLLDENKKLRSKNEVR
GPLKFVTEHPEVPRGQGLDVETELSIGCPQRHRLNIHPHEEGLSIHWL

Figure 194. Amino acid sequence of SEQ ID NO: 1108. The conserved MADS-box SEQ ID NO: 3668) domain identified using InterProScan is underlined.

MV<u>RGKTQMRRIENKTSRQVTFSKRRNGLLKKAFELSVLCDAEVAAIIFSPTGKLYEFS</u>
TSSMSSIIERYQRKTKDPGCSEKTTEIDLQNMKGSSLDMAKMIELLNVSNSRLSGELS
DTCSVEELQSTQNLLERSLSKIRARKNLLFKEQIMLLKQEEKKLLDENKKLRSKNEVR
GPLKFVTEHPEVPRGQGLDVETELSIGCPQRHRLNIHPHEEGLSIHWL

Figure 195. Amino acid sequence of SEQ ID NO: 1109. The conserved Transcrition factor, MADS-box SEQ ID NO: 3668) domain identified using InterProScan is underlined.

MA<u>REKIKIKKIDNVTARQVTFSKRRRGLFKKAGELSVLCDAEVAVVIFSATGKLFEYS</u>
SSSMKDTLERYTLHHNNLENMDQPSLELQLEHSNNMRLSKEVAEKSHRLRQLRGED
LQGLNIEELQQLEKMLEAGLNRVLVTKEERIRTEITDLETKGAELIEENKMLKQTMTT
LTKGKRHIVTEPDVALPEEGVSSESATNVCSCNSGPPLEDDGSDTSLKLGLPF

Figure 196. Amino acid sequence of SEQ ID NO: 1110. The conserved Transcrition factor, MADS-box SEQ ID NO: 3668) domain identified using InterProScan is underlined.

MG<u>RGKIEIQKIENDTNRQVTYSKRRNGIFKKAHELTVLCDARVSILMLSGNKKLHEYI</u>
SPTTTTKRMIDDYQKALGIDLWTTHYDRMQEELRKLKEVNNNFRKEIRQILGHDLNE
LSYAELHSLEQTIESSVNSVRQRKYHVLKTQTDTHKKKVKALEHRYTELLLESGATY
EDLQYGLSEDIEGDYESAVTNLSNHTGASAMYALRLHPSDHDLSSEGHFVPDLSLN

Figure 197. Amino acid sequence of SEQ ID NO: 3611. The conserved Transcrition factor, MADS-box SEQ ID NO: 3668) domain identified using InterProScan is underlined.

MVFPTQATPEESPQRKMG<u>RGKIEIKRIENTTNRQVTFCKRRNGLLKKAYELSVLCEA</u>
<u>EVALIVFSSRGRLYEY</u>ANDSVKATIERYKKACSDSSSSGSVSEANVQFYQQESAKLQ
QQINNMQNNNRQLVGDSIAGMNMKDMKTTEQKLEKAIAKIRAKKNELLFAEIEYM
QKREIDLHNNNQVLRAKIAESERTQHADMNLMPGGANYDFMQPSSSQPFDSRNYFQ
VNV

Figure 198. Amino acid sequence of SEQ ID NO: 1112. The conserved MADS-box domain identified using InterProScan is underlined.

MA<u>RGKIQIKLIENTTNRQVTYSKRRNGLFKKANELTVLCDAKVSIIMISSTGKLHEYIS</u>
PSTSTKKMYDQYQQALEVDLWSSHYEKMQENLRKLKEVNKKLQLEVRRRFGEGLN
GMSLSELCGLEQDMDNAVSLIRERKYKTLGNQIDTARKKKNAEEINKSLLQDWTN
LIKHLREDDPHFGMVDNGRDYEAVIGYTDAAAAARLYTLRLQPDQPNLTSGGGSEIT
TYPLLE

Figure 199. Amino acid sequence of SEQ ID NO: 3612. The conserved MADS-box SEQ ID NO: 3668) domain identified using InterProScan is underlined.

MA<u>RGKIQIKLIENTTNRQVTYSKRRNGLFKKANELTVLCDAKVSIIMISSTGKLHEYIS</u>
PSTSTKKMYDQYQQALEVDLWSSHYEKMQENLRKLKEVNKKLQLEVRRRFGEGLN
GMSLSELCGLEQDMDNAVSLIRERKYKTLGNQIDTARKKKNAEEINKSLLQDWTN
LIKHLREDDPHFGMVDNGRDYEAVIGYTDAAAAARLYTLRLQPDQPNLTSGGGSEIT
TYPLLE

Figure 200. Amino acid sequence of SEQ ID NO: 1114. The conserved Transcrition factor, MADS-box SEQ ID NO: 3668) domain and K-box domain identified using InterProScan are underlined.

MGRGKIVIRRIDNTTSRQVTFSKRRNGLLKKARELAILCDAEVGVVIFSSTGKLYDFA
SSSMSKVIERYDKLKEETDQSASPMAELKYWQREAAILRQQLQHLQENHRQMMGEE
LSGLSIKELRNLENQLEMSLRGVRTKKDQVLMEEVRELNRKGNLLHQENLELHKKE
NLFKQENMELYKKVYGTRDANNINGAHASLLPNKPSNDEDAQVPIHLQLSQPHHQN
CETSSRTTNLGLQLH

Figure 201. Amino acid sequence of SEQ ID NO: 1115. The conserved MADS-box SEQ ID NO: 3668) domain identified using InterProScan is underlined.

MGRGKVELKRIENKINRQVTFAKRRNGLLKKAYELSVLCDAEVALIIFSNRGKLYEF
CSSSSMMKTIEKYQKCSYGSLETNCSINEMQNSYQDYLKLKTRVEVLQRSQRNLLGE
ELGPLNSKELEQLEHQLENSLKQIRSAKTQFMFDQLAHLQHKEQMLVEANRELRKK
LEESNTRIPLRLGWEAEDHNNISYSRLPMQSQGLIFQPLGGNPTLQIGYNPAGSNELN
VSAADQHPNGFIPGWML

Figure 202. Amino acid sequence of SEQ ID NO: 1116. The conserved MADS-box SEQ ID NO: 3668) domain identified using InterProScan is underlined.

MGRGKVELKRIENKINRQVTFAKRRNGLLKKAYELSVLCDAEVALIIFSNRGKLYEF
CSSSSMMKTIEKYQKCSYGSLETNCSINEMQNSYQDYLKLKTRVEVLQRSQRNLLGE
ELGPLNSKELEQLEHQLENSLKQIRSAKTQFMFDQLAHLQHKEQMLVEANRELRKK
LEESNTRIPLRLGWEAEDHNNISYSRLPMQSQGLIFQPLGGNPTLQIGYNPAGSNELN
VSAADQHPNGFIPGWML

Figure 203. Amino acid sequence of SEQ ID NO: 1117. The conserved MADS-box SEQ ID NO: 3668) domain identified using InterProScan is underlined.

MGRGRVQLKRIENKINRQVTFSKRRCGLLKKAHEISVLCDADVALIVFSTKGKLFEY
ATDCCMERILERYERYSYAESQVLTNNAETNGNWTLEHAKLKARMEILQKNQKNL
MGEELDSLSLKELQNLEHQLDTALKHIRSRKNQLMYESISELQRKDKALQEQNNML
AKKVKEKEKALAQQTQWDNPQDDGLTSSSVILSQSLQPVNIGGPYHPSGIEEGAALG
PPQHRNATLLPSWMLSHLQE

Figure 204. Amino acid sequence of SEQ ID NO: 1118. The conserved Transcrition factor, MADS-box SEQ ID NO: 3668) domain identified using InterProScan is underlined.

MGRGRVELKRIENKINRQVTFSKRRNGLLKKAYELSVLCDVEVALLIFSSRGKLYEF
GSAGPSGINKTLERYQRDNFTPQDNVAEHETQNWFQEISKLKAKYESLQQTQRHLLG
EDLGQLNVKELQNLEKQLEQALAQARRRKTQLMLEQMDDLRKKERQLGDLNKKL
KSQLEAEGLNLKAIQALWTSTSDAAGTSSFHVHHSQRIPLDCEPQPVLQIGYQYAQA
EGSSVTKSGTGETNFIQGWVL

Figure 205. Amino acid sequence of SEQ ID NO: 3613. The conserved Transcrition factor, MADS-box SEQ ID NO: 3668) domain identified using InterProScan is underlined.

MGRGRVELKRIENKINRQVTFSKRRNGLLKKAYELSVLCDVEVALLIFSSRGKLYEF
GSAGPSGINKTLERYQRDNFTPQDNVAEHETQQNWFQEISKLKAKYESLQQTQRHLL
GEDLGQLNVKELQNLEKQLEQALAQARRRKTQLMLEQMDDLRKKERQLGDLNKK
LKSQLEAEGLNLKAIQALWTSTSDAAGTSSFHVHHSQRIPLDCEPQPVLQIGYQYAQ
AEGSSVTKSGTGETNFIQGWV

Figure 206. Amino acid sequence of SEQ ID NO: 3614. The conserved Transcrition factor, MADS-box SEQ ID NO: 3668) domain identified using InterProScan is underlined.

MEFPSEFSEASSQKRIGGRGKIEIKRIENTTNRQVTFCKRRNGLLKKAYELSVLCDAE
VALIVFSSRGRLYEYANNSVRGTIERYKKASSDSSHPQSVSEVNTQFYQQEASKLRRQ
IREIQVSNRHILGEGISDLSFKDLKNLESKLEKSISRVRSKKNEMLFAEIEYMQKREIEL
QNDNMYLRAKIAENEGAQQQQQQGSDHHFNMPGSSSVYEALPSQPAYDRNFLQVN
VLEPNHQSYSRSDHTALQLV

Figure 207. Amino acid sequence of SEQ ID NO: 3615. The conserved Transcrition factor, MADS-box SEQ ID NO: 3668) domain identified using InterProScan is underlined.

MGRGRLQLKRIENKINRQVTFSKRRAGLLKKAHEISVLCDAEVALIIFSAKGKLFEYS
TDSCMERILERYERYSYSEHQVLASETESIGSWTLEHAKLKARLEVLHRNYRHFMGE
DLDSLSLKDLQNLEQQLESALKHIRSRKNQLMHESISVLQKKDRALQEQNNLLTRKV
KEKERALAQQAQWEQQDHALDSPVVLPHYLPSLDINGSYQARHNGHDDGENLTQP
RAGTLLPPWMLPRLN

Figure 208. Amino acid sequence of SEQ ID NO: 1126. The conserved Myb DNA-binding domain identified using InterProScan is underlined.

MASNSLTSSSWTPKQNKMFEKALAQYDKDTPDRWQKIAKAVGGKSADEVKRHYEI
LIEDVKHIESGRVPFPNYRSSNNSG

Figure 209. Amino acid sequence of SEQ ID NO: 1127. The conserved Myb DNA-binding domain identified using InterProScan is underlined.

MADSGLSSSHAATTSADFRGDGSRDSKLPHFSEDEETLIARMYTLVGRRWSLIAGRIP
GRSAEEIEKYWTSRYIRMVNEQRN

Figure 210. Amino acid sequence of SEQ ID NO: 3616. The conserved Myb DNA-binding domain identified using InterProScan is underlined.

MYIPRTATDKAPRICKSSSHYSLMADSEHSSSDDTYVDSREETSEESKLDFSEDEETL
VIRMYNLVGERWSLIAGRIPGRTAEEIEKYWNSRYSTSQ

Figure 211. Amino acid sequence of SEQ ID NO: 1129. The conserved Myb DNA-binding domain identified using InterProScan is underlined.

MRKPCCDKQDTNKGAWSKQEDQKLIDYIRKHGEGCWRTLPKAAR<u>WSLIAGRLPGR
TDNEVKNYWNSHL</u>RRKLINMGIDPNNHRLNQTPPRLESSNNVSVSANSSGLKTRQSP
RPKSCGGDKDQVSDAGSCLEDEPSRLPDLNLDLTINIPSPSPAKIEKEQKPCSYKHDM
LRDSDIATSPALVLFR

Figure 212. Amino acid sequence of SEQ ID NO: 3617. The conserved Myb DNA-binding domain identified using InterProScan is underlined.

MDKKPDDDSGKSQDVEVRKGPWTMEEDLILINYIANHGEGSWNSLAKAAGLKRTG
KSCRLRWLNYLRPDVRRGNITTEEQLLIMELHAKWGNR<u>WSKIAKHLPGRTDNEIKNF
WRTRI</u>QKHIKQAEAFSGQSSEMSDQASTSHMSSMPEPMETYDSPPSFQGNNNMEPLP
VNLSVESNEAYWSMDDLWSMQLLNGD

Figure 213. Amino acid sequence of SEQ ID NO: 1131. The conserved Myb DNA-binding domain identified using InterProScan is underlined.

MPTTPTRSRCSKRDANRGAWTAEEDQKLAQVIETHGPRRWKLVAAKAGLNRCGKS
CRLRWLNYLRPNIKRGNISDQEEDLILRLHKLLGNR<u>WSLIAGRLPGRTDNEIKNYWN
SRL</u>SKKIKQKESQSKFLEPDQSQDPRNNPSAMHSVADNDGGTSKREEEMKSDVSRD
DFLDNFNEGPLNLEWMSKFLEVDESWF

Figure 214. Amino acid sequence of SEQ ID NO: 1132. The conserved Myb DNA-binding domains identified using InterProScan are underlined.

MYGR<u>AAEWSRYEDKVFEHALVAVAEDSPDRWQLIGNRLNRSASQVFEHYQRL</u>VED
IDAIESGRVEPPSYRDDHPASCGQIAFETKPRIKEAEKKK<u>GNPWTEEEHRLFLLGLQT
YGKGDWRSISRHFVLTRTPTQVASHAQKF</u>YMRQMSLGKKERKRNSIHDITTVDTPPV
PASVNDSFNPPQAGNAQDDPSYDYPKANNFQQMQPCQPAPFMNQLLDQGGGSIGYE
NLSYFL

Figure 215. Amino acid sequence of SEQ ID NO: 1133. The conserved Myb DNA-binding domain identified using InterProScan is underlined.

MARTPCCEKMGMKKGPWTPEEDQILISHIHQFGHSNWRALPRQAGLLRCGKSCRLR
WINYLRPDVKRGNFTDDERDTIIELHQVLGNR<u>WSAIASRLPGRTDNEIKNFWHTHLK
KR</u>VPHSLPNSTPFTINPTRCTTLDPSFQKPTSAPPTQKFQEPLTTSESESGPSIAVRANIE
SSSQAVPSSRASQKLEKTKKDLIAGSAPAFPIAAGSQCGGQGVLSTKGDKDMEFWYS
LLVRAGDGHHQVGNAAGTL

Figure 216. Amino acid sequence of SEQ ID NO: 1134. The conserved Myb DNA-binding domains identified using InterProScan are underlined.

MC*TRGHWRPTEDEKLRELVERYGPHNWNAIAEKLQGRSGKSCRLRWFNQLDPRINR*
*SPFTEEEEEKLLASHRIHGNRWSVIARLFPGRTDNAVKNHWHVIMARRSRERSRLYA*
KRAAQTLMEERTRYSSPSLANKQQDVQMMNMMMSASATANYQLASSFVDNFSGL
GQCAFAHAGLPLTKQFHTDHQISPDIPVREDKLQPTEFYDFLQVNTDSNKSEVIDVVH
ARRDDEEVDQEAANDSADNQAKGGSVPFFDFLSVRSSC

Figure 217. Amino acid sequence of SEQ ID NO: 1136. The conserved Myb DNA-binding domain identified using InterProScan is underlined.

MSWVAMTGNFGWGSNSM*EEAWRKGPWTAEEDKLLIEYVKLHGEGRWNSVARLTG*
*LKRNGKSCRLRWVNYLRPDLKRGQITPQEESVILELHARWGNRWSTIARSLPGRTDN*
*EIKNYWRTHFKNKAK*ASPTNPERSKAARLLRRQQFHHHQQQQQQQHQQMQQQQQ
QQLPQLQQHPQLTQVDMKSIWSLLEENDHHRVPYTPQIRPEIAGAYPNSSGYDQCLF
YSVFNANNASLPEASSSTSTDEDVLWDGLWTMEDVHGINCGAPYATSKASMHNLV
APFC

Figure 218. Amino acid sequence of SEQ ID NO: 1137. The conserved Myb DNA-binding domains identified using InterProScan are underlined.

METLYSPSCMSNSAWL*STSWTKEENKRFESALAIHDTDTPDRWDKIAAIVGKSVRDV*
*ANKYRELEEDVCEIEAGRDPIHGYLCSSFALESFDERDFDACRKKSSAGRGADHERK*
*KGVPWTQEEHRRFLMGLLKYGKGDWRNISRNFVVSKTPTQVASHAQKYFMRQVSG*
VKDKRRPSIHDITTVNLTDPASSSENNRVSSLDQLNALSSQQKLIGAPELALDHSLPN
YGGFMFFDSSHGHLLMPDAYGFGLNGKRWQEKDNPDGVYPGAGFRSSLIGIHSSRH
QIQG

Figure 219. Amino acid sequence of SEQ ID NO: 1138. The conserved Myb DNA-binding domain identified using InterProScan is underlined.

MSSDARAASGATAAGAGEFMLFGVRVVVVDPMRKSVSLNNLSEYEQPQDAAPGGG
GVGKDDAGAAASGYASADEAVAHGSKGGAG*RERKRGVPWTEDEHRLFLLGLQKV*
*GKGDWRGISKNFVKTRTPTQVASHAQKYFLRRSNLNRRRRRTSLFDITTDTVTAGTM*
MEEQAPPVDVATESYPAPPTPTVPLESSNISGFSMMPPTVHVVLPVPAENPVENLSFG
PGGQFDNSPAKLVRPVPILPAPAVHDLNLSLASPSDQSEPSRRPSAFQMTPSFGKGDN
MISVA

Figure 220. Amino acid sequence of SEQ ID NO: 1140. The conserved Myb DNA-binding domain identified using InterProScan is underlined.

MGRKCSRCGNIGHNSRTCTTFMGAASACGLKLFGVQLDLSSSSPPSSSASSGSAHPYS
LVIKKSLSMDRLSSSSASSSSPSSSLSSPRVLADEHCNKTSLGYLSDGLAARS<u>QEKRKG
VPWTEEEHRTFLMGLEKMGKGDWRGISRNYVTTRTPTQVASHAQKFFLRQASLNK
KKRRSSLFDMMGRCSTFREQSEPPRLIRTESSLRYEV</u>VPLLAMSTFKPGDEESDREPH
DSISRPPSLCDLANPLELKPSPVNPIKNPSLSHAAPDLELTLAAPMPLDQNETSPSSLFV
GSISVT

Figure 221. Amino acid sequence of SEQ ID NO: 1142. The conserved Myb DNA-binding domains identified using InterProScan are underlined.

MTVDEAVSPSC<u>SSWSKEQDKAFENALATHFEVSPDWWEKVASDVPGKTLEEIKLHY
EDLVEDVNRIEAGRVPLPSYSSACSDG</u>SASNLGEEESRKKGGGGSGESNQGGKGSRS
D<u>QERRKGIAWTEEEHRLFLLGLDKYGKGDWRSISRNFVVTRTPTQVASHAQKYFIRL
SSVNKDRRRSSIHDITT</u>VGSGDLSAPQGPITGQNQTDGSAGGVSSGKSNKQSPQSPAV
TSGVAVSGPPPSIGQPVGGPFVSAVGTPVNLSTAPHMAYGVRGQVQGTVVPGAPINM
GSVTYPMPHASAHR

Figure 222. Amino acid sequence of SEQ ID NO: 1144. The conserved Myb DNA-binding domain identified using InterProScan is underlined.

MGA<u>PKQKWTAEEEAALKAGVIKHGAGKWRTILKDPEFSSVLYLRSNVDLKDKWRN
MSVM</u>ANGWGSRDKAKLTVKRVHHVPRQEESSAAARNAVQSDEEMVDMKDLSISG
DALHIDGPKRSIVRLENLIIDAINSLKEPSGSNKTAIATFIEEQYWAPPNFKRLLSAKLK
YLMSIGKLVKVKRKYRIAPGPGSLARRRTSSMFLSDGWKLPPKVDRNDDDDDVLTA
AQVDLELAKMRTMTPEEAAAAAARAVAEAEAAIAAAEEAAKEAEAAEADAEAAQ
AFAEAAMKTMKGRNVPKVMIRV

Figure 223. Amino acid sequence of SEQ ID NO: 3618. The conserved Myb DNA-binding domains identified using InterProScan are underlined.

MGRSPCCEKAHTNKGA<u>WTKEEDQRL</u>IDYIRLHGEGCWRSLPKSAGLLRCGKSCRLR
WINYLRPDLKRGNFTEEEDELIIKLHSLLGNK<u>WSLIAGRLPGRTDNEIKNYWNTHIKR</u>
KLVSRGIDPQTHRPLNSAAPGVPPAATSPPSLPVTEISLISSSLHRRPHSNDYYGREKLE
PKAEPLREDNHCTTSSGTTTDEELKAPRNRQQAQGGSELNLELSIGLAPSCRELNRNA
SSVTANTAESKLQEVPYPLLTVPTPAAAAAAAAAAAVCLCCQLGSRSGGMCGNCQS
NGGSFGYYAQLGS

Figure 224. Amino acid sequence of SEQ ID NO: 1146. The conserved Myb DNA-binding domains identified using InterProScan are underlined.

MKWETGVPLPPCASSANWFF<u>NEEGRTAKWTPAENKMFEKALAVHDQDTPDRWDR
VASMIPGKTVEDVVKHYQDLE</u>VDVSNIEAGLIPIPGYSTTAPFTLEWANGHGYDGFK
QSYGLGGKRSSSIRPPE<u>QERKKGVPWTEEEHKLFLMGLKKYGKGDWRNISRNFVITR
TPTQVASHAQKYF</u>IRQLSGGKDKRRASIHDITTVNLTETRTPSPDDKRPPSPDPSSMV
ARHPTPVTAPRTPFLWNQPSNGGSMTFHATQGDMSMCPHFGVNSFGLKFQGQNTHR
GTFIQNPVFHMQAGQSYPHG

Figure 225. Amino acid sequence of SEQ ID NO: 1148. The conserved Myb DNA-binding domains identified using InterProScan are underlined.

MGHHSCCNQQKV<u>KRGLWSPEEDEKLIRYITTHGYGCWSEVPEKAGLQRCGKSCRLR
WINYLRPDIRR</u>GRFTPEEEKLIISLHGVVGNRWAHIASHLPGRTDNEIKNYWNSWIKK
KIRKPSPASLTNVPPSTSSEHSLLSNSSNQLSCAMPDLMAAKMPVQETLFSSPCPLFMF
DTASLEGLAESNEQQELFTEAVTVNSAGTWNLNHQQFHTTLLPPPPPYTSGSADANY
LPPLIENVENMLNIGAQSSNIDEEGDRIALECFQRQELNEWVESHQCPNFLLWDNVEG
PFGGEDIVPASSTAGASTMSSFPSSL

Figure 226. Amino acid sequence of SEQ ID NO: 1150. The conserved Myb DNA-binding domain identified using InterProScan is underlined.

MQEFEGERGRERALNMGRSPRCDKDGLNKGAWTAAEDQILMDYVKLHGEGKWSR
LSRETGLRRCGKSCRLRWMNYLRPDIKRGNISPDEEELIIRLHKLLGNR<u>WSLIAGRLP
GRTDNEIKNYWNTNLAKKPEALRSIQF</u>HHLHREPMVEPPATSQQELEQQRVPESNIR
GVANPEPQVAQRNAANGEMRSSPDGNYLLKQMLSDSDMSDGSLSFNSEEESPDFMI
DFNVDDISQFLDSDFYKLGPDQNGYSHDGERGSKCPPYLNQQLVPPEEAGKDLDNSL
RIRDDSVSAFQSLASLFESDDEKWTGGGDKADFALPGKNG

Figure 227. Amino acid sequence of SEQ ID NO: 3619. The conserved Myb DNA-binding domain identified using InterProScan is underlined.

MGRSPCCESEHMNKGAWSKEEDERLIAYIKRHGEGCWRSLPKAAGLLRCGKSCRLR
WINYLRPDLKRGNFSDEEDELIITLHSLLGNK<u>WSLIAARLPGRTDNEIKNYWNTHIKR</u>
KLHARGIDPQTHRPLDYTSTAGAGAAATHTICSNANNSGNKATPHSTTCEELSSSSTP
PPLRAAKKRLNSLASAVVTVREEEESTNNSMSSDVTTTTTTTAEEVQVQLINNKNGI
NMDEDGDANADLDLSLCLSVHRPKTIIRNNSTSSTASTELLRSPPPLPAHGHREVFLSL
GFHPDARHACSGTSCSAPTATTLDLLSDPSSHPISGASSYWF

Figure 228. Amino acid sequence of SEQ ID NO: 1154. The conserved Myb DNA-binding domain identified using InterProScan is underlined.

MARSSCNQKLRKGLWSPEEDEKLFNYISRHGLGCWSSVPKLAGLQRCGKSCRLRWI
NYLRPDLKRGMFSQQEEDLIITLHAALGNR<u>WAQIATQLPGRTDNEIKNFWNSYVRKK</u>
LTKQGIDPVTHKPLRELNSMSENCVEIEAAQALQEFKGSRDISSLRAKEPAFPIDGMH
GGPMESPVGEVFLNRALFDPSSSLEFHNAINPVLHGAKSRLVDPGYFEMNAAPFSSVS
SSMEIDHENKNTSGNLVSRMSCLFFHEAKKYCSNSSNNISNNTEFQLNSAAENKDLP
WADDEELDPLHQFQVNVTGSEDLKSISWQEEHLLAHAAVDFHGNHPSMSLSDDQIL
QAHFNIF

Figure 229. Amino acid sequence of SEQ ID NO: 3620. The conserved Myb DNA-binding domain identified using InterProScan is underlined.

<u>MKERQRWRAEEDALLRAYVKQYGPREWHLVSQRMNTPLNRDAKSCLERWKNYLK
PGIKKGSLSEEEQRLVIQLQAKHGNKWKKIAAEIPGRTAKRLGKWWEVFKEKQQRE</u>
QKENKGALPIDEGKYDHILENFAEKLVKERSTPALLMATANGGFIHTDSPALAPTLLP
PWLSNSNGTPTLRPPSPSVTLSLSPATVPASQPIPWLQADRGLDSGSLSLTGLPNHGPL
PTSGENILMSELAECCKELEEGHRAWAAHKKEAAWRLKRLELQLESEKACRRREKM
EEIEAKINTLREEQKASLDKIETEYREQLAGLRKDAESKEQKLAEQWTAKHVQLSKLI
EQIGFRPRIADHDRQ

Figure 230. Amino acid sequence of SEQ ID NO: 1156. The conserved Myb DNA-binding domain identified using InterProScan is underlined.

MTRRCSHCSHNGHNSRTCPARGGGGGGGGGGVRLFGVRLTDGSIIKKSASTSSLSSH
HLLPPSSSPSPSPSPSPSPAAGSPPSGDHHYDHHHHQQRDPDGYLSDDPAQGACASDR
RGERKKGVPWTEEEHRLFLIGLQKLGKGDWRGIARNYVTSRTPTQVASHAQKYFIR
QTTAGRKKRRSSLFDMAPEMATDRPLIPKETTLPPFARDSDQPDSMPSLDLSLASESK
PMETSSHETVKDVAKTAMVSDVFPCTIPGHFPTYYEQVPLSIWPSTITSVENKTAEISR
HQVLKPIPLLHKEPVNVDELCGMSQLSLLESENGFKDRPVLSLNLLGEPLRQSAFHAN
AAPVASPDISNSKNSPIKAV

Figure 231. Amino acid sequence of SEQ ID NO: 1158. The conserved Myb DNA-binding domain identified using InterProScan is underlined.

MTRRCSHCCNKGHNSRTC<u>PVRGGGGGGGDGGGAAAAPSSSSPSTSSSGAAAAAAAS
ASGGGVKLFGVRLTDGSIMKKSASVGCLSAAHYHSSSSAAASPNPGSSPIDGSDGYLS
DDPAPGSRSSNRRVERKKGNPWTEEEHRRFLIGLQKLGKGDWRGIARDFVTTRTPTQ
VASHAQKYYIRQSNAGRRKRRSSLFDMAPDMATADQPSHPEETFLPPLVRLNDDTNS</u>
TTSTSMGLDLERTPMETSHPETSEGGGDVAMESIDQVPLVPCYFPYYLPLPFPMWPP
NMAPPEDGRVVETSHHRVLKPIPVIPKEPLNIDQIVGMSQLSLAENEPAPLSLKFLGET
SRQSAFIKAPSSVNESDLDNCKDGATQAA

Figure 232. Amino acid sequence of SEQ ID NO: 1159. The conserved Myb DNA-binding domain identified using InterProScan is underlined.

MGRHSCCHKQKLRKGLWSPEEDEKLLNYIAKFGLGCWSSVPKLAGLQRCGKSCRLR
WINYLRPDLKRGAFSQQEESLIIELHAVLGNR<u>WSQIAAHLPGRTDNEIKNLWNSGLK</u>
KKLRQNGIDPNTHKPLSLFENSDQQKFHAIYEASVASTKPNLSQASSTSSSQNLRVTP
SPELSFKRPGIVDDGSFITCFPPAGMVGELCFQHLKCSGTMGLLASSDTALHHDWNW
SSSDISPTEVHSAPKPNRPSDSYYCNIDGGNSSHWSGIAPLQNVHTFENSPNSWLLAD
CGRVDKETETHPSVFDAEVAKWFEYLHRTPFVFNLSPSGASQLEHSDVTPSAGTCSV
TGGGLVSNCPHDQILQASPGSDMYGKTLQVIAVSSGQNSPSSLEPVKNKFQDKKV

Figure 233. Amino acid sequence of SEQ ID NO: 1160. The conserved Myb DNA-binding domain identified using InterProScan is underlined.

MDTYSSGEDLIVKTRKPYTITK<u>QRERWTEDEHNRFLEALKLHGRAWQRIEEHIGTKT
AVQIRSHAQKFFSK</u>LEKEAIVKGVPVGQTLDIKIPPPRPKRKPSNPYPRKTGASTPTLS
VGAKDGGILSVSPSNCEKLDSETASFLERASGGEKLANSKENQDDNCSEVFNLPQEA
HCSSISSTNRSVVPTPVGIQNSCTFRMFVPSLKEGVQDNGPRKVSNSENSDRSHEKSV
QCRMDGYDGPPADEMQTAHNFPRHVPVHVLDANHTKCTQAPLQDVSFQDSAFDPT
GEVKARLNLFPNQTPSAAGENQKEAPRMDHQSFPAFHPPFTPVHHNEDDYRSFLHLS
STFSSLIVSTLLQNPAAHVAASFAASLWPYPNVENSVVDSAVCTQGTFPCRPSSSPPS
MAALAAATVAAATAWWAAHGLLPLCAPLHTGFTCNPTSATAVHSLNTSQTPGVEK
ERRECTFENPCSQEHLDPEHSEALQAQNSASKSPLGALSDSEDSGGARLDTRSKAAD
HEKAAVETDSQQNQSKGGKPVDRSSCGSNTPSSSEVETDALEKQEKGNETLKDPDPN
QSILEYFNRRCRSTSNVTDSWKEVSEEGRLAFQALFSRNVLPQSFSPPRDMKNKGQQ
KENVEEGEQNNGEVDKDVSTLDLNRNMCISCSFHQGPERSGVINGGEEGLLTIGLGQ
GKLRTHRTGFKPYKRCSVEAKETRAANVGSQSEEQGPKRIRLEGEPSM

Figure 234. Amino acid sequence of SEQ ID NO: 3621. The conserved Myb DNA-binding domain identified using InterProScan is underlined.

MDKKPCYRTQDPQVRKGPWTLEEDLILMDYIANHGEGVWNSLAKAAGLQRTGKSC
RLRWLNYLRPDVRRGNITPEEQLLIIHLQSMWGNR<u>WSEIAKHLPGRTDNEIKNYWRT
KIQKHIIKQSETEINDLT</u>IPPSSANACTDHRGVSAANTIEIACSPPSDQGGSGETMLSAL
PPAQEPNDSACWSVEDLWPIQSLISGMGDDAQYYSV

Figure 235. Amino acid sequence of SEQ ID NO: 1162. The conserved Myb DNA-binding domain identified using InterProScan is underlined.

MRKPCCDKQDTNKGAWSKQEDQKLIDYIRKHGEGCWRTLPKAAGLLRCGKSCRLR
WINYLRPDLKRGNFAEDEEDLIIKLHALLGNR<u>WSLIAGRLPGRTDNEVKNYWNSHLR</u>
RKLINMGIDPNNHRLNQTPPRLESSNNVSVSANSSGLKTRQSPRPKSCGGDKDQVSD
AGSCLEDEPSRLPDLNLDLTISIPSPSPAKIEKEQKPCSYKHDMLRDSDIATSPALVLFR

Figure 236. Amino acid sequence of SEQ ID NO: 1163. The conserved Myb DNA-binding domain identified using InterProScan is underlined.

MRKPCCDKRDTNKGAWSKQEDQKLIDYIQKHGEGSWRTLPQAAGLLRCGKSCRLR
WINYLRPDLKRGNFAEDEEDLIIKLHALLGNR<u>WSLIAGRLPGRTDNEVKNYWNSHLR</u>
RKLLKMGIDPNNHRLNQNLPRSQTPDASGSTSSSSMKTNMTLADKSSRSAGDHPEVF
DAENVSGDIPRDLPDLNLDLTISVPSSSLTKVEEEEQNPYASKVATKVARDIENAESPT
LLLFA

Figure 237. Amino acid sequence of SEQ ID NO: 1164. The conserved Myb DNA-binding domain identified using InterProScan is underlined.

MARFPRVDKSNSKKTVKKGAWSAEEDQKLVAYIKRYGIWNWTHMAEPAGLARTG
KSCRLRWMNYLRPNIKHGNITQEEEEIIINLHRVLGNR<u>WASIASRLSGRTDNEIKNYW
NTRLKKRFLMENLQMPTAWDVKVNSSHNDPLSCQDSSIALIDATKAQNLGSACGID</u>
RVDETLVNGLVSPGNKIDKVEENIWEQLVALKDLCILEDFEGTCSNSGAKSPASECM
YSEPMYFGESYEDFLIDLWGN

Figure 238. Amino acid sequence of SEQ ID NO: 1165. The conserved Myb DNA-binding domains identified using InterProScan are underlined.

MGRSPCCEKAHTNKGA<u>WTKEEDERLI</u>AYIRAHGEGCWRSLPKAAGLLRCGKSCRLR
WINYLRPDLKRGNFTEEEDELIIKLHSLLGNK<u>WSLIAGRLPGRTDNEIKNYWNTHIRR</u>
KLLNRGIDPATHRPLNEPAQDATTISFAAAPSKQEPRDDAIAAALGYKNENNPTTTAA
TVQEKCPDLNLELRISPPCQQQHQPDASMGMVEGNHCFACSLGLQNSKECSCRRGA
SGGSSAHGGYDFLGLKTSVLDFRTLEMK

Figure 239. Amino acid sequence of SEQ ID NO: 1167. The conserved Myb DNA-binding domain identified using InterProScan is underlined.

MGRQPCCDKLGVKKGPWTAEEDRKLVNFILTHGQCCWRAVPKLAGLRRCGKSCRL
RWTNYLRPDLKRGLLNEAEESLVIDLHATLGNR<u>WSKIAARLPGRTDNEIKNHWNTHI</u>
KKKLIRMGIDPVTHKPLQEQANEQVPSKANEQAKFEVSNHETPVYPCDGSSDNFSSPI
IDNFSTGKSPSFDPNISSFDDPWMNHVRWETFLGNPSSWNFMFEGDRQEDYGEFGVC
PSAGGDPSWLFNRESTGVESFAQSGFGDIDMSEFARSANVRS

Figure 240. Amino acid sequence of SEQ ID NO: 1168. The conserved Myb DNA-binding domain identified using InterProScan is underlined.

<u>MGNQKLKWTKEEEEALLAGIAKHGAGKWKNILKDPEFAPALVNRSNIDLKDKWRN
LS</u>VGTSGQGSRDKQRLSKVKSLMAAPQSSTVPLNPQAHAASTDVALVNSSNSFQDG
KNYSLDNTLIFDALSSPKGPNGSDIGAIVSFIEQRQEVPPNFKRLLSSKLRRLVSQGKL
EKVEKYYKISRQAPLGTKTSVPEQKVVRSLPSQQLALSSHETMKEVAMAAAYNVVE
AENKSFLAAEAVKEAERVSKMADDAVMTLQLVQEIYEQCLQGEFVLMT

Figure 241. Amino acid sequence of SEQ ID NO: 3622. The conserved Myb DNA-binding domain identified using InterProScan is underlined.

MNSNASSNPQSMATSTTSATTPAAGGDGGKKVRKPY<u>TITKSRESWTEEEHDKFLEAL
QLFDRDWKKIEDFVGSKTVIQIRSHAQKYFL</u>KVQKNGAVAHVPPPRPKRKAAHPYP
QKASKNVLVPLQASMAQPSSTNPAFTITPGNVSWDDASVLINNASSNNMLSQDEFSN
FQADIGSKGSSRVSCSTAAGVRSSSRTPSSLEISKQKRQTPVMHGIPDFSEVYGFIGFD
PNAKGHVQKLKEMDPINFETVLLLMRNLTFNLSSPDFVPVRKVLSSYDVNTKTVGAP
LENVVQSDLTC

Figure 242. Amino acid sequence of SEQ ID NO: 3623. The conserved Myb DNA-binding domains identified using InterProScan are underlined.

MGRSPCCEKAHTNKGA<u>WTKEEDQRL</u>IDYIRLHGEGCWRSLPKSAGLLRCGKSCRLR
WINYLRPDLKRGNFTEEEDELIIKLHSLLGNK<u>WSLIAGRLPGRTDNEIKNYWNTHIKR</u>
KLVSRGIDPQTHRPLNSAAPGVPPAATSPPSLPVTEISLISSSLDRRPHGNGYYGREKL
EPKAEPLREDNHCTTSSGTTTDEELKAPRNRQQAQGGSELNLELSIGLAPSCRELNRN
ASSVTANTAESKLQEVPYPLLTVPTPAAAAAAAAAAAVCLCCQLGSRSGGMCGNCQ
SNDGSFGYYAQLGS

Figure 243. Amino acid sequence of SEQ ID NO: 1174. The conserved Myb DNA-binding domain identified using InterProScan is underlined.

MPGFTRARKMSMSGEEEGDLRRGPWTREEDNLLIHSITCHGEGRWNMLAKSAGLKR
TGKSCRLRWLNYLRPDIKRGNLTPQEQLMILELHHKWGNR<u>WSKIAQYLPGRTDNEI
KNYWRTRV</u>QKQARQLNIESDSERFLDAVRHIWMPRLLQKMEQASSSDQTTRTSDMS
MNCSVSASPVHYPPSTSSPSKLTQNSNSSMEVSSYTMADADISPNFPITGQTPEIPEAF
SNADVVGFGNSTAYNPLLAGDGYFGDGTSYDVNDYATMSALSACNGFPLQGHVEG
GNWAVDDVADACWTVDDIWKFRD

Figure 244. Amino acid sequence of SEQ ID NO: 1175. The conserved Myb DNA-binding domain identified using InterProScan is underlined.

MPPPRAATPDVAGDESSGADAGAGEIMLFGVRVVVDSMRKCVSLNNLSQYQHPQD
ANPPNASGGSGGNKEEAAKGYASADDAAHNPGGG<u>RERKRGVPWTEEEHRLFLLGL
QKVGKGDWRAISRNFVKTRTPTQVASHAQKYFLRRSNLNRRRRRSSLFDITTDSVTA</u>
SMMETEHVPHQDNTYQMNPLPRHPLLQDTCNPNGYVAMAPFAMPIGPAAFPIPVQN
QVPNLTLMQGGGLSDSKSKLVQPTPLVPIPHAPLTSDQSANSKSTMEPLSLSLNLSLPS
DQGDSPSSRTSFQAMSGFRGGESIISVA

Figure 245. Amino acid sequence of SEQ ID NO: 1176. The conserved Myb DNA-binding domain identified using InterProScan is underlined.

MGRSPCCSKEGLNRGAWTAQEDRILTNYIKAHGEGRWRNLPKKAGLQRCGKSCRL
RWLNYLRPDIKRGNISPDEEELIIRLHKLLGNRWSLIAGRLPGRTDNEIKNYWNTNLG
RKVQSNTPTNSQSRSGHVDQLSPNHQRDDDRPRKVKSPRHSETSKMSTDDNSASESP
SSKPDARSVKTNAFKCSKVLIDPPPEQELHRNEDPINTDFAASAAVDPAPTGVLPPFT
GNIPADLSMDDFEIGDICLSEFLNPDTSSIANQGQFNSNNSITISDDLFADDSQVQGLG
WAALSSDSVPDNHQANAGPNFHQAFASFLDYNGGDQWL

Figure 246. Amino acid sequence of SEQ ID NO: 3624. The conserved Myb DNA-binding domain identified using InterProScan is underlined.

MVSVNPNPAQGFYFFDPANTRIHGVNAGSAAEGGGAAPPYAEDPSKKVRKPYTITKS
RESWTEQEHDKFLEALHLFDRDWKKIEAFVGSKTVIQIRSHAQKYFLKVQKNGTSEH
VPPPRPKRKAAHPYPQKAPKAPVVSQVNGPFQVSSAFLEPGHIVRPDGSALLGNSRTS
VALSSWSHNSVPAMSASQGTKDVGISGPPVPSNCCNSSSNDSTPRSWPNAQAIEPLD
QQKHLRVMPDFAQVYRFIGVFDPDAGGHLQRLKQMDPINLETVVLLMKNLSANLTS
PEFEKYQHGLFASYEGGPEKSKSGGSFKLLPEKSGSLILSA

Figure 247. Amino acid sequence of SEQ ID NO: 1178. The conserved Myb DNA-binding domain identified using InterProScan is underlined.

MRKPDASGKNSSNSNANKLRKGLWSPEEDDKLMNYMLNNGQGCWSDVARNAGLQ
RCGKSCRLRWINYLRPDLKRGAFSPQEEELIIHLHSILGNRWSQIAARLPGRTDNEIKN
FWNSTIKKRLKNSSSSSCRHSPNTSDSSLSSDVKDVMGGLISLQEQGLMPLYMDSLSS
VQALALNQVIDPLLPSLNQGLDLPGLSGYCDANSNYCAVQGGVSGEFGRFGGVVGC
GSNGDQLYVPPLESISIENVKTENTYDSEHNSSNDLSNFNYTTDDVVDNIGNFNDYGR
IESMAGLGNLWNGGEEMKVGEWDLEELMKDVSSFSSADFQVIQ

Figure 248. Amino acid sequence of SEQ ID NO: 1180. The conserved Myb DNA-binding domain identified using InterProScan is underlined.

MASRKEVDRIKGPWSPEEDEALRLLVQKHGPRNWSLISKSIPGRSGKSCRLRWCNQL
SPQVEHRAFTPEEDDIIVRAHARFGNKWATIARLLSGRTDNAIKNHWNSTLKRKCSPP
LSPLAEEGNNRAFDAAAGYDGDLSPRERPAKRSASAGPCLSPGSPSGSGMSDSSVHF
VYRPVAKTGPVVPPPVEATAAAVSSTEDPPTSLSLSLPGAADACEVSTRVPAEPTQPA
TRPISLLPMASDPAPTPACAPPQAVALPEYPRYSGNNNSSSIFPYPPPSPRVGADFSPFK
AEFMAVMQEMIRAEVRNYMAGMCSQAAAADIRNAVVKRIGIGKIE

Figure 249. Amino acid sequence of SEQ ID NO: 1181. The conserved Myb DNA-binding domain identified using InterProScan is underlined.

MASSSSVASARKDADRIKGPWSPEEDEALQRLVQSYGPRNWSLISKSIPGRSGKSCRL
RWCNQLSPQVEHRPFTPEEDEAIVRAHARFGNK<u>WATIARLLNGRTDNAVKNHWNST
LKRKCSSACSAGGDDADALAEQQPLKRSASLGTPTGGNNAVSDLFFSPSSPSGSDLS</u>
DSGLPVGMPSPRVFRPVARTGPIMPALSGQHADASSSTTTDPPTLLSLSLPGSDMAEV
SNHGSASGSVPTPDSRPSPTLFSARTQTMQATPPPPPPVPPQPPIHHLGHYGDRMEA
AAGYEKQFFNADFMAVMQEMIRKEVRSYMSGIEQGEAVRNVTVKRIGVSKID

Figure 250. Amino acid sequence of SEQ ID NO: 1182. The conserved Myb DNA-binding domain identified using InterProScan is underlined.

MDAKGMIRGAHHSGSGGDSDSQEDDQQAIMEDLRRGPWTVEEDLTLVNYIANHGE
GRWNSLARSAGLKRTGKSCRLRWLNYLRPDVRRGNITLEEQLLILELHSRWGNR<u>WS
KIAQHLPGRTDNEIKNYWRTRVQKHAKQLKCDVNSKQFKDAMKYLWMPRLVERIQ</u>
AASASVSTATVAAAAMAAPPTMATTAASNIGGMAFPPALAGMGGDFRGGRLNVAP
SYSTPENSCTTASSDSFGAQVSPVSDLTDLTEYYPIPAGDNPNPDYYQPNNNGQGCY
QESSLTSPCAYFNNYGMDFQACMDQNNNQWLDDGGTSDNLWNLADDWYSQQQQ
QPHAASIINNNF

Figure 251. Amino acid sequence of SEQ ID NO: 1183. The conserved Myb DNA-binding domain identified using InterProScan is underlined.

<u>MKERQRWRAEEDALLRAYVKQYGPREWHLVSQRMNTPLNRDAKSCLERWKNYLK
PGIKKGSLSEEEQRLVIQLQAKHGNKWKKIAAEIPGRTAKRLGKWWEVFKEKQQRE</u>
QKENKGALPIDEGKYDHILENFAEKLVKERSTPALLMATANGGFIHTDSPALAPTLLP
PWLSNSNGTPTLRPPSPSVTLSLSPATVPASQPIPWLQADRGLDSGSLSLTGLPNHGPL
PTSGENILMSELAECCKELEEGHRAWAAHKKEAAWRLKRLELQLESEKACRRREKM
EEIEAKINTLREEQKASLDKIETEYREQLAGLRKDAESKEQKLAEQWTAKHVQLSKLI
EQIGFRPRIADHDRQ

Figure 252. Amino acid sequence of SEQ ID NO: 1184. The conserved Myb DNA-binding domain identified using InterProScan is underlined.

<u>MKERQRWRAEEDALLRAYVKQYGPREWHLVSQRMNTPLNRDAKSCLERWKNYLK
PGIKKGSLSEEEQRLVIQLQAKHGNKWKKIAAEIPGRTAKRLGKWWEVFKEKQQRE</u>
QKENKGALPIDEGKYDHILENFAEKLVKERSTPALLMATANGGFIHTDSPALAPTLLP
PWLSNSNGTPTLRPPSPSVTLSLSPATVPASQPIPWLQADRGLDSGSLSLTGLPNHGPL
PTSGENILMSELAECCKELEEGHRAWAAHKKEAAWRLKRLELQLESEKACRRREKM
EEIEAKINTLREEQKASLDKIETEYREQLAGLRKDAESKEQKLAEQWTAKHVQLSKLI
EQIGFRPRIADHDRQ

Figure 253. Amino acid sequence of SEQ ID NO: 3625. The conserved Myb DNA-binding domain identified using InterProScan is underlined.

MTRRCSHCCNKGHNSRTCPVRGGGGDGGGAAAAPSSSSPSTSSSGAAAAAAASASG
GGVKLFGVRLTDGSIMKKSASVGCLSAAHYHSSSSAAASPNPGSSPIDGSDGYLSDDP
APGSRSSNRR<u>VERKKGNPWTEEEHRRFLIGLQKLGKGDWRGIARDFVTTRTPTQVAS
HAQKYY</u>IRQSNAGRRKRRSSLFDMAPDMATADQPSHPEETFLPPLVRLNDDTNSTTS
TSMGLDLERTPMETSHPETSEGGGDVAMESIDQVPLVPCYFPYYLPLPFPMWPPNMA
PPEDGRVVETSHHRVLKPIPVIPKEPLNIDQIVGMSQLSLAENEPAPLSLKFLGETSRQS
AFIKAPSSVNESDLDNCKDGATQAA

Figure 254. Amino acid sequence of SEQ ID NO: 3626. The conserved Myb DNA-binding domain identified using InterProScan is underlined.

MGRHSCCYKQKLRKGLWSPEEDEKLLRHISQYGHGCWSSVPKQAGLQRCGKSCRL
RWINYLRPDLKRGAFSQDEEDLIIELHAALGNK<u>WSQIAANLPGRTDNEIKNLWNSCL
KKKLRQRGIDPVSHRPLSEVENSDDKDATSGQTQDKVSRGSVELLSQLNPQFSSSTTA
RSSKNSNLMAPTLSKDTVADGFVSNHQENSMMNSCISDFVDNFSLQQLNYSSSDSRF
SNLCFTQTGRAHGNTIFSDFNSNVISAISPPSSNSLFPTASMGFNFKPSNAVPSANSTSS
ASTGTADFHNSGSYFGNSLVSWGLLADCGSPDKEGSTSIHPLEVHQPGDFKWAAEYL
QNPLFMAAALQNQAQEQSNLYNQIKPETQFPPDHSTTSMWDHLQGHESLDNSLNTC
GKDIQRLTALLGHN

Figure 255. Amino acid sequence of SEQ ID NO: 1189. The conserved Myb DNA-binding domain identified using InterProScan is underlined.

MGRHSCCYKQKLRKGLWSPEEDEKLLRYITQYGHGCWSSVPKLAGLQRCGKSCRL
RWINYLRPDLKRGTFSQEEEDLIIELHAVLGNR<u>WSQIAAQLPGRTDNEIKNLWNSCLK
KKLRQKGIDPATHKPLSEVEHGGDDKSTTPKSHERAAFSGSSNGLSQTQQAPNSENT
LLEHCSSSNANNSSKISNLMNSGLDKDCFPNGLLSSTSSCQPSDDLVGHFPLQPLGNY
ASISRLSEAISNHSPWFGQSGKSFSINTEFGCSTMPAILPHSNISFHHDPVGFRPAMTVP
NDNYCFKPFTVDESRYWEVNAPTSSGAANAELLGSGSYFENSMLSWGLENCSTMGK
EADMNNPPGGHIGDIKLPDYFHDPLLIGATSQHQAPQSLYNEIKPDTHFDTNYSSSAM
WLQNQQDQGLLPSSDTSSCPKNIQRLTALFGHI

Figure 256. Amino acid sequence of SEQ ID NO: 1190. The conserved Myb DNA-binding domain identified using InterProScan is underlined.

MQDMKMTTDTEDSKKKERHIVTWSQEEDDILREQIGIHGTENWSIIASKFKDKTTRQ
CRRRWYTYL<u>NSDFKKGGWSPEEDVLLCEAQKIFGNRWTEIAKVVSGRTDNAVKNRF
TTLCKKRARYEALAKENNTTFITPNSKRIISHNPSSVDRPAESAALAKRMRRAHIQNI</u>
AGDCNLKDRLHIQSGITYSQQQRAPFSTLAQNFRTSNSPPQQSESNQKEATDDAHGT
NVQGTFLKKDDPKVTALIQQAELLSSLALKVNADNMDQSLENAWKVLQEFLSHKK
DDDILQDCITDTDLQFEDFKVMVEDLRSSNEGSQTSWRPPDLCEESPASSEYSTASTIS
THPVYDKAEEPQAEEVALHKVIETELQTNHSDEQGVVHNCCKGILSSSVTHGGTFQS
CDEHVTATGVVSVSSNTECSSPVHVTPLFRSLAAGIPTPKFSESERHFLLKTFGMDSLS
TSPPTNSAYQPPCKRALLQSL

Figure 257. Amino acid sequence of SEQ ID NO: 1192. The conserved No apical meristem (NAM) protein domain identified using InterProScan is underlined.

MICCNRKSFI<u>SVHCRQLKLDFECTGKALSNGSHYFYFSRMMNNRITENGYWKYLDM
EEPVFGEAGEIIGMKKSLTFHIGEAPTGQETNWVMQEYHL</u>VSFHELANSTQEPGSLVL
SRVHESKTSHGQSLCSGGDEDSETDLSYMDEMFMLLDEDLDDISSGD

Figure 258. Amino acid sequence of SEQ ID NO: 1193. The conserved No apical meristem (NAM) protein domain identified using InterProScan is underlined.

MGDNNVNLPPGFRFYPTDEELVVHFLQRKAALLPCHPDVIPDLELYPYDPWELEGKA
LSEGNKWYFFSRKTPDRITGNGYWKPMGDEPVFTSSSKRVGMKQSLVYYLGEAPGG
<u>TRTNWIMHEYRLSNGTNSGSSSSRSSKRKGYPKIDYSKWVVCRVYEHGDDDNDDNG</u>
AELSCLDEVFLSLDDLDEISTPN

Figure 259. Amino acid sequence of SEQ ID NO: 1194. The conserved No apical meristem (NAM) protein domain identified using InterProScan is underlined.

MRDVKEKEEKDDGKMLK<u>LPPGFRFSPTDEELVLHFLHPKKQQASLSPLYAHLVPDL
KSHHHDPWDLHGKALSNGSHYFYFSRMMNNRITENGYWKDLDMEEPVFGEAGEIIG
MKKSLTFHIGEAPTGQETNWVMQEYHL</u>VSFHGLANSTQEPGSLVLSRVHESKTSHG
QSLCSGGDEDSETDLSYMDEMFMLLDEDLDDISSGD

Figure 260. Amino acid sequence of SEQ ID NO: 1195. The conserved No apical meristem (NAM) protein domain identified using InterProScan is underlined.

MEE<u>YPTGFRFYPTEEELISFYLHNQLHGLQQDKIHRVIPVLHIFDTEPWNLPQLAGELC
REDREQWFFFAPMQEREARGGRPSRSMTTGYWKATGSPGYIYSSDNKVIGVKKSMV
FYVGKAPKGRKTQWKLNEYRAIELSPTNPNSSSSNISI</u>TKLKRELTLCRVYVVSGTSR
AFDRRPLEAVVGETTIQGGGCATSSGGIGGGSGDISSSGIVAGDVGSSNQWETASLEE
PTWDWDQLDWL

Figure 261. Amino acid sequence of SEQ ID NO: 3627. The conserved No apical meristem (NAM) protein domain identified using InterProScan is underlined.

MEVPRFFASAAGIK<u>LPIGFRFRPTDEELVVHYLRRKVLAVPLPAAVIPELDVFGTDPG
GLPGNLRERRYFFSRRNRSSGGRECIRVAAGFGYWKYKTKSKQILASDGTGNQVIGM
RKTLVFCEGKRSACDAAGARWILHEFTIAGTRENSKSTSMARAGDENWAVYRLFQK</u>
KMRPKRSDNGNGDFSHRKRKKSSSVIDLRSEAIAGDSPDTPPPPSSPCSSSITDNGSSC
KALDQEDISSSSR

Figure 262. Amino acid sequence of SEQ ID NO: 1197. The conserved No apical meristem (NAM) protein domain identified using InterProScan is underlined.

MDKLNFVKNGVLR<u>LPPGFRFHPTDEELVLQYLRRKVYSFPLPASIIPEVEVCKSDPWD
LPGDLDQERYFFSTREAKYPNGNRSNRATVSGYWKATGIDRQIVSSRGSQSQVVGM
KKTLVFYRGKPPSGSKTDWIMHEYRLVNPEASVPPKIMNLNQTPVEPMESWVLCRIF</u>
LKRRSSKNEGETPVPCQNLKEAPKSRKNKPVFYDFMTRDLNLAPSSSSSGSSGVTEVS
SHNNTDEHEESSCNSLRKALKH

Figure 263. Amino acid sequence of SEQ ID NO: 1198. The conserved No apical meristem (NAM) protein domain identified using InterProScan is underlined.

M<u>NHELPPGFRFHPTDEELIVYYLQNQVMSRPCPVSIISELDIYKFDPWQLTENAKLGE
KEWYFFTLRSRKYLNGARPNRAAVSGYWKATGSDKAIYSGSKHVGVKKSLVFYKG
RPPKGLKTDWIMHEYRLADSRTNVQHRSMKLDWVLCRIYKKQRSSKSLDRKVEDF</u>
HGQSNRTMTNEASDKQVMRLPNFCSLTPDLLQLDYFGPISQFLIGSSYHPTFDGQNII
VDGEAYGAEKKLQLHGNKVSCLYADQGKL

Figure 264. Amino acid sequence of SEQ ID NO: 1199. The conserved No apical meristem (NAM) protein domain identified using InterProScan is underlined.

MED<u>LPPGFRFFPTEEELVSFYLRSKLKGTRGALHGLIDRVIPVLDIYEFNPSDLPQFAG
DLCRRDPEQWFFFIPRQESEYRGGRPRRLTTTGYWKATGSPGFVYSNNHIVGVKRTM
VFYTGRAPNGGKTEWKMNEYRAIEGEATSPQDISVLQATQEFSVCRVYKKTKTLRSF</u>
DRRPIGDIIGSSSHTFQQNTMPNDGRHPQDMTSSRRGSPPPTERASSSADSSSASGDHG
TIPSQAGGLGSGIDIEMLPGESELSLQDWEQFWSGPN

Figure 265. Amino acid sequence of SEQ ID NO: 3628. The conserved No apical meristem (NAM) protein domain identified using InterProScan is underlined.

MKGLSVSSGSG<u>LPPGFRFHPTDEELIMHYLRNQATSRPCPVDIIPEVDIYKFDPWQLPD
KAEFWENEWYFFTPRDRKYPNGVRPNRATVSGYWKATGTDKAIYSASKYVGVKKA
LVFYKGRPPKGIKTDWIMHEYRMTEVKGQAKKRSGSMRLDDWVLCRIYKKRATGK</u>
TLEPRIEESNHNVQATDKAYANLDATDPTMLKFPRTFSLTHLLEMDYLAPFSHILSDN
PYSAIFDYQNTISSNNSANDSADQKPHGGHFPHHVAVQNSALNQNMVINPIFDLQ

Figure 266. Amino acid sequence of SEQ ID NO: 1201. The conserved No apical meristem (NAM) protein domain identified using InterProScan is underlined.

MGLRDIGA TLPPGFRFYPSDEELVCHYLYRKIANEEVLKGSLVEVDLHTCEPWQLPE
VAKLNATEWYFFSFRDRKYATGYRTNRATISGYWKATGKDRVVHDPSTQEVVGMR
KTLVFYRNRAPNGIKTGWIMHEFRLESPHMPPKEDWVLCRVFYKSKEDNAINTLPSP
HYTFKEATAASSAPSANFDTSHYISSPNQAFSCGMMTYPQVASLSSTSSSLLSHKPHS
TPNLPHQSKGASTKLIDDGYGFMWDMNFGDNSLVGDALPSNLDDMSIDMDGGSVF
L

Figure 267. Amino acid sequence of SEQ ID NO: 1203. The conserved No apical meristem (NAM) protein domain identified using InterProScan is underlined.

MKAELNLPAGFRFHPTDDELVNHYLLPKCASQAIGVPIIAEIDLYKFDPWQLPDMAL
YGEKEWYFFSPRDRKYPNGSRPNRAAGTGYWKATGADKPIGRPKPLGIKKALVFYA
GKAPKGVKTNWIMHEYRLANVDRSASKKNKNLRLDDWVLCRIYNKKGQIEKHYVS
DQKPVPFPEMEDKKPEPWMLNQSACSPLSQLVQSPMTNDLLHMDTSESVPRLHTESS
CSEHTLSPDFMYEKEVQSSPRWNELDKSFEFINSYFLDEPFAAQVQYQPVQVSPLQDI
FMKPF

Figure 268. Amino acid sequence of SEQ ID NO: 1204. The conserved No apical meristem (NAM) protein domain identified using InterProScan is underlined.

MKRAQLELPAGFRFHPTDDELVNDYLIRKCASHAISVPFIAEIDLYKFDPWVLPEMAL
YGEKEWYFFSPRDRKYPNGSRPNRAAGTGYWKATGADKPIGRPKTLGIKKALVFYA
GKAPRGVKTNWIMHEYRLANIDRSAGKKKNSRLDDWVLCRIHNKKGTIEKHSPSTL
NETADFPEVEIKPQIVMPAALNPYTSPQYADSPMTTDHMYTDSSEFLPKLHTDSSCSE
HAASPGSACEKEVQSEVKWDDWEKALDFQFGSMDDFLDDALVQGQFQLDQFSPLE
DMSMYLQQSF

Figure 269. Amino acid sequence of SEQ ID NO: 1205. The conserved No apical meristem (NAM) protein domain identified using InterProScan is underlined.

MKKAQMELPAGFRFHPTDEELVSDYLIRKCASLPISAPIIAEIDLYKFDPWDLPEMAL
YGEKEWYFFSPRDRKYPNGSRPNRAAGTGYWKATGADKPIGRPKTLGIKKALVFYA
GKAPKGVKTNWIMHEYRLANVDRSAGKKNNSRVDDGVLCRIYNKKGTIEKHFPSA
HDKPAEFPEMETKPQIVMPAAMNPYNTPPQYGSLMTMDHTYMDSSESMPRLHTDSS
CCSEHVVSPDSACEKEVQSEVKLEGWEKALDFQFESMDDFLDEAFAQGQYQLDLFS
PLQDASTYLQKPF

Figure 270. Amino acid sequence of SEQ ID NO: 1206. The conserved No apical meristem (NAM) protein domain identified using InterProScan is underlined.

MTWCNNDNKSDEQRNESATSPPPSNNKAGVVAKRPPVFRTCPSCGHEFEIQDQTGIQ
ELPGLPAGVKFDPTDQELLEHLEGKVRPDARKLHRLIDQFIPTLQGENGICYTHPEKL
PGVSKNGMIRHFFHRPSKAYTTGNRKRRKVHTDEEGGETRWHKTGKTRPVFMKGE
LKGYKKILVLYTNYGKQRKPEKTNWVMHQYHLGNNEEEKEGELVVSKVFYQTQPR
QCGSLMKDSSSLKLNGPSGHENANLKNNPALVEYYNSSYISFDQGSQNRASSQHQMI
PRHFAVHGGSSFVS

Figure 271. Amino acid sequence of SEQ ID NO: 1209. The conserved No apical meristem (NAM) protein domain identified using InterProScan is underlined.

MMSGTMIFEGDEQMELPPGFRFHPTDEELITHYLTPKVLDGSFRARAMGEVDLNKCE
PWDLPGQAKMGEKEWYFFCVRDRKYPTGMRTNRATEAGYWKATGKDKEIRRMKK
VVGMKKTLVFYRRRAPNGQKTNWVMHEFRLGDGYYQHHLSNSQKNDWVICRIFEK
RPDGKKADQPETLPGGLERLSSFDNEPKASLLPLPPLVESSPFTTTSFSDRPEDRNVQK
TSLFSSPSSSELDQSLGPTPSFGWSDTVFMHEQAILRMLLENSASNAKAEYADFSQAR
RQDREATMPTSFQCDVDCLWRN

Figure 272. Amino acid sequence of SEQ ID NO: 1210. The conserved No apical meristem (NAM) protein domain identified using InterProScan is underlined.

MTWCNNSDPEGKAIQIVAGDASRGNCIIDPQGSAVRTVTCPSCGHNIELLDQGMIHD
LPGLPSGVKFDPNDQEILEHLEAKAAADARKIHPLIDEFIPTLEGENGICYTHPEKLPG
VSKDGQVRHFFHRPSKAYTTGTRKRRKVHGDTDGGETRWHKTGKTRPVLIGGAVR
GFKKILVLYTNYGRQRKPEKTNWVMHQYHLGDNEEEKDGELVMSKVFYQTQPRQC
GASVRDPSLDKRYTKEHQVLHGTSVVDYYNYSNPNFISNYDQVNPNRESPPQLIPNL
VVQGDGSSFIQFTPDASKGKLVRNRDGGGG

Figure 273. Amino acid sequence of SEQ ID NO: 1211. The conserved No apical meristem (NAM) protein domain identified using InterProScan is underlined.

MELESCVPPGFRFHPTEEELVGYYLSRKINSIKMDIDVIAELDLYKMEPWDIEGRCKL
GYEEQNEWYFFSHKDKKYPTGTRTNRATTAGFWKATGRDKAVLSKNKIIGMRKTL
VFYRGRAPNGRKSDWIMHEYRLQTSEHAPPQDEGWVVCRAFKKPCPSQRQGFEAW
NHAYYVRDYMNPRPPPSLLPDASQAVSFSRHQFAPCQEPVSNHQSLWDSQLSELPQL
DSPTLSTSLTTTNNYVSTHEEYDDGRSKNINNDGVQFINEWTSLDSLLTSHVNSSGND
YTTRLTEPSMHMQSSSLGFARETESQVGHFLGCFPDS

Figure 274. Amino acid sequence of SEQ ID NO: 1213. The conserved No apical meristem (NAM) protein domain identified using InterProScan is underlined.

METMESC<u>VPPGFRFHPTDEELVGYYLRKKVASQKIDLDVIRDIDLYRIEPWDLQERC
RIGYEEQNEWYFFSHKDKKYPTGTRTNRATIAGFWKATGRDKAVYDKAKLIGMRK
TLVFYRGRAPNGQKSDWIMHEYRLES</u>DENGPPQEEGWVVCRAFKKRTTGLTKSTLE
GWDTSYFYDEQSGTSSVIDPAECISRPVLGYMPNSSFVCKKEIEVAENLKLFNPDDSY
FLQLPQLESPSLPLTKRPMSSVSLVSEINNNNHNSNNNEHLEEHNDDDSNKRVTDWR
ALDKFVASQLSQEERYEGDGITASFDQHDSSDMALMLLENARECEATKLSSFLTSGA
GCDAGGICLFEKL

Figure 275. Amino acid sequence of SEQ ID NO: 1214. The conserved No apical meristem (NAM) protein identified using InterProScan is underlined.

MEDEIVELPPGFRFHPTDEEIITHYLTKKVLNPNFNSCAIGEADLNKSEPWDLPKKAH
MGEKERYFFNQKDRKYPTGMRTNRATESGYWKATGKDKEIFRGKSNLVGMKKTLV
FYKGRAPKGEKTNWVMHEYRLEGKFSYYNLPKVSKDEWVVSRIFHKSTGIKKNESG
LIPGLFPIDPSGDDELPNPSPSPSLPPLMDDSYFARPISSFPKSENDFPGMTSASAPRSAE
GNYGDEMNGFHRFNPSNTNYQTDPSSSAFSSMFSGQLSFPISPYDGIDNPDFFLGFGY
GGSDNTQAIIRGMAASQHETRGLEQTLIKGEQFAMSNNKSMVSHSQDTGLSTDANA
ETSSSAISKHEAGNFSDFLWE

Figure 276. Amino acid sequence of SEQ ID NO: 1215. The conserved No apical meristem (NAM) protein domain identified using InterProScan is underlined.

MGDQQFREMENMARLGKEDDQIE<u>LPPGFRFHPTDEELITHYLQKKVGDTGFSAKAIG
EVDLNKSEPWDLPWKAKMGEKEWYFFCLRDRKYPTGLRTNRATESGYWKATGKD
KEIYRGKSLVGMKKTLVFYRGRAPKGEKTNWVMHEYRLEGKLSLNYLPRASKNEW
VICRVFQKSSGGKKIHISSL</u>VAAGSLENEMSSGLPPLTDSSPHDSKTESNPGSAYVPCF
SSPTEFERNKENTNNYFNNPMFPISSNPTNTTPKISLLSPVYPHQAIPVPANWQHLGGS
VFMPEHSVLRALLEGTGLNARQSARAEREAISISQETALTNDLNTEISSVMQDFEMGR
RQFEDQQQVPSTLAGPMDVDLLWNYSS

Figure 277. Amino acid sequence of SEQ ID NO: 1217. The conserved No apical meristem (NAM) protein domain identified using InterProScan is underlined.

<u>MDMNLSINGQSQIPPGFRFHPTEEELLHYYLRKKMSNKKIDLDVIRDVDLNKLEPWD
IQERCKIGSGPQSDWYFFSHKDKKYPTGTRTNRATAVGFWKATGRDKIIYGGSSRIGL
RKTLVFYKGRAPHGQKSDWIMHEYRLDEGSNSSVGPSLVCESSPEDGWVVCRVFRK</u>
KSHQRTLESPKSTSTSSMDTEMLMNASADSSVLDQILSYMGRTNCESPENYQAPINIS
SMQTQLIHGKFLHLPRLDDSSHLGQETGLRTFYQKFDEIRIPGSDDPSSKHTSSDYEPK
AGTAGINDWVALDRLVASQLNGQLEISAASKQSPYPGAPNPVLAGPAPGDHQVGQL
SPLQLNRPNQIYSSESSFDWSFGKSSSVTPSNPLHHLSV

Figure 278. Amino acid sequence of SEQ ID NO: 1219. The conserved No apical meristem (NAM) protein domain identified using InterProScan is underlined.

MESRISPMNQQPAEKVVTEIALLLQQAIVGYRFHPTDEELINYLKSKVTGCRETFCIIP
TLENIYEINPWDLPAKFDENSIVRSKDQEWWFICPQTQNQRISRKTPCGFSWKITGKHI
DIKAKNDDKKIGSKITLVFIDGRNSKGTRSNWVLHEFHPHPDDTGFVIYCLKMKQYE
KADTHAAVATNGDFSSTPQFQNHEVSFSELNEVIGKLSDEVYGQSDGSYQNRTKSLA
LIQEDNHYSSPNQERLEGTKDPSSTENSSGRGLAVPDPTNDELNFPHPFPNVDFCSAN
EAEKETINQLVAELFRSMEEEVDEMSGEQADKSCDSMDCDNPEQLPSAEHRVQEIQN
QLRRLITNESSSSTEISSGSCHTVPANGVGLGPGCPLLVMLCFLMVTFFV

Figure 279. Amino acid sequence of SEQ ID NO: 1220. The conserved No apical meristem (NAM) protein domain identified using InterProScan is underlined.

NLSINGQSQVPPGFRFHPTEEELLHYYLRKKVAYEKIDLDVIREVDLNKLEPWDIQEK
CRIGSTPQNDWYFFSHKDKKYPTGTRTNRATAAGFWKATGRDKIIYSGFKRIGLRKT
LVFYKGRAPHGQKSDWIMHEYRLDESTHDPNALSPAGDASPEEGWVVCRVFKKKN
YQKTLDSPKSPSSSTSMDSKAMQQMLAATANDGVLDQILSYMGRTCKVESETPTKL
NLSHNNYNHNNNIKYPVSNTDLLHGKFMHLPRLESPILPLIPVASPPFDHQDCSFKLS
YHSLDEMLAETSGHQGIGRSPTPDWVAMDRLVASQLNGQVAETPKQLSSCFSDDPG
SDVGGLSMDDEVQFSHTKLSNKPSGQQSLEMYGCESNDLWSFTKTSTSSSDPLRHLS
V

Figure 280. Amino acid sequence of SEQ ID NO: 1221. The conserved No apical meristem (NAM) protein domain identified using InterProScan is underlined.

MEEEGMVVNQGREHQELMDLPPGFRFHPTDEEIITHYLTPKVLNSSFSASAVSEVDL
NKCEPWDLPTKAKMGEKEWYFFCQKDRKYPTGTRTNRATESGYWKATGKDKEIYR
GRGRLVGMKKTLVFYMGRAPKGEKTNWVMHEYRLEGKLAYYNLSRAAKDEWVV
SRVFHKSTGVKKDPSPGLLTRINSYVDDFLDMSSPPPPLIDAPSSSRPSSSFTDGENEL
KGVINSGPRALDGNGSYFYFPADSTDNQNQVLLQEQGDRMNYCHVMNPSIDASHCP
PQLSNHPPLFPSHGSTNPEEYLHQGPSDVGSSFGGTGFSCGSTDPALLRAIRANFGASN
PQNNNQCKVEQFSSNHSMVSLSQDTGLSTDVNNEISSVPISKQEVGSCDAFEDLEGLS
SVGPIQDFGFWDY

Figure 281. Amino acid sequence of SEQ ID NO: 1222. The conserved No apical meristem (NAM) protein domain identified using InterProScan is underlined.

MGPETSTPSTSEISAPPSAQKTSSTALAPGFRFHPTDEELVIYYLKRKMCGKSFRFDVI
ADVDIYKTEPWDLAGKSKLKTRDQEWYFFSALDRKYANGARMNRATSSGYWKAT
GNDRNVQHESRVVGLKKTLVFHSGRAPEGKRTNWVMHEYRLVEEELEKCGNYKD
AYVLCRIFHKANLGPPTGHRYAPFVEEEWDGKDNVVPSVETREEAVPQRNGMLQE
MPSHVPPVCRNELPTKTQCLLAVCKSETMGETIDDPSAICPTNRETAPLLHYKRRRDI
DLNSIDSTGSENSPKKTEGPSSSTITTARSAMNLTCGLSTLVEYSLMESLEIKEKPHLPL
STFAPANLNTTAPPECLDFIHSLREEIYKVSIERETLRLEMLSIRSMANVLQSKVEHLT
KENEELKRKVQDA

Figure 282. Amino acid sequence of SEQ ID NO: 1224. The conserved No apical meristem (NAM) protein domain identified using InterProScan is underlined.

MAGPSWLVDSHRIATKIRSASGASDPEKVKWKSNPTRACPNCQHVIDNSDVAKQWP
GLPTGVKFDPSDSEIMHHLLAKAGFEGLKSHPFIEEFIPTVDEDDGICYTHPRNLPGVK
QDGSVAHFFHRAIKAYNTGTRKRRKILGDDFGDVRWHKTGKTKPVMVDGVQKGW
KKIMVLYTNLVRGGKSEKTNWKMHQYHLGTEEDEKDGEFVISKIFYDHQQQQLDQ
GEKNEQNNRERVDATTMKADPVSPKSATPNPPRTERRSCDSDPVQDSACGGPLAQH
VETQCADLDGPLEIENPQHREQTISAPEMMVDGDQQAEEESKWWDSESQNLLDSQQ
LVEGLSLCDEFLQSQSPNRDDINHHVESKKRILLSDYAKLGPEDLKKDLEECHNLAL
DPANIELDTPPDFRLSQLEFGSQDSFLAWGGSKVVD

Figure 283. Amino acid sequence of SEQ ID NO: 1226. The conserved No apical meristem (NAM) protein domain identified using InterProScan is underlined.

MAMGSLGPGFRFHPNDDELVLYYLKKKVLGKRFLNEAIAEVDIYNFPPWDLRAHAR
LTRELKWYFFCPRERKYANGARTKRSTDYGFWKTTGKDKPVINNGKTVGMKRSLV
FQRLGGEKKTERTDWMMHEYRLVEDLKLKGVAQDTFVICVIFEKDGPGPRNGAQY
GAPFVEEEWEDDDNGEADVPSASGFTQEFILPDMQQHSERYCVGSTSNACPAGPSQ
MAPSVVNVPPPAPVNDVVMEDFQNPCDEYLHSNGIFVDDIPATSSENARVENFDNIN
LDGDHNAENKKDDTYEGLEDLSPYRCADDFSFINSDANICHPFEPFMELYDIAAPLTS
TDGLGLSGHNNSEGFDHIIAAQGPWTSVSADDENCHGMGVKDLETAINCDSEAGQS
NGVYFDSSISNLGGNNDLVTPGIISNPPIFAQPFCGSEVTCNAEDFPQFKWRPQSQGFE
GCVDMHREGYGVECTNQEIVRYDAVAANSSINNPDLGCAHACENQGREHVGIF

Figure 284. Amino acid sequence of SEQ ID NO: 1227. The conserved No apical meristem (NAM) protein domain identified using InterProScan is underlined.

MAMRSLAPGFRFHPTDAELVLYYLKRKVLGKRLHIEAIAEVDIYNFPPWALQGHARL
SRDLKWYFFCPRERKYATGGRTKRSTAYGFWKTTGKDKSVINNGKTVGMRRSLVF
QRLGGEKKTERTDWVMHEYRLVEDEDLKTKGAAQDTFVLCEIYKKDGCGPRNGAQ
YGAPFNEEEWDDDDVEADVPSASGFTQEFILPNMEQHSERYCKGSTSTACPAGPSQI
VPSDVNVPPPAPANDITMEDTQNPFDEYLRSNGIFGDDIPPTSSEDDRVENFDNINLDG
DHNAENKKDDTYEGLEDLSPYRRTNDFSFIHSDENICHPFEPFMELYDFAAPLTSADG
PGLSGHNNSEGFDHFIAAQGPWTSVSADDENCHGMGLKDLETAINCDSEAGQSNGV
YFDSSISNLGGNNDLVTPGIISNPPIFAQPFRGSEVTCDAEDFPQFKWRPQSQGFEGCV
DMHREGYGVECTNQEIVNYDAVAANSSINNPDLGCAHACENQGREETIFCCMVRF
LEYPSYPSSAVERPAPCIGAKRSDGHALFLLYGYSSFHIKAEVTLGGGGRGCTNDALS
CGLEGFPFVTDREENGSGSGKGAANYGCGISSTLFLLTLRSPCCPPWGDVYYWRLTS
WLSFLAAAWLIVHISVWFQLISTNSSV

Figure 285. Amino acid sequence of SEQ ID NO: 1228. The conserved No apical meristem (NAM) protein domain identified using InterProScan is underlined.

MGVLEMEA<u>LPLGFRFRPTDEELINHYLRLKINGRHSEVKVILEIDVCKWEPWDLPDLS
VIKTDDPEWFFFCPRDRKYPNGHRSNRATDAGYWKATGKDRTIKSRKSGGATASLIG
MKKTLVFYRGRAPKGERTHWIMHEYRA</u>TEQDLDGTGPGQAAYVLCRLFRKAEEKP
EVVKYDEVEQTGLSPTAKSSPDEALSDVVPETPVSNVQVKSQSDGIKRWLTDESDK
MTPSTQMPVESCSNSYIASDVEDGNTDGTPLEVNPLLESGPKFYDLPCDPTDHKGLFP
EQTQLKTGQAPYMDSPFACDFGNDLEGLLFHDAGEHEITLSDLLDEVFNNQDDSCEE
STSQKNSVGSEIPFDPPFNLSQPVLGVKDNVWYDDLVDNNNWMDALPLWGPSGAV
ASNNMAESTGESFNSNGGTPIKIRTRDSQVLPHSSDYGAQGTAPRRLRLAVDRANQL
PRSVKLEGADEGMRGTGSNAEEEVQSTAEESSVNHNDNTIVGTNIKIRTRQPRHQPG
SENSIVQGIAPRRIRLQMNSQSGSTRDDEVKTSSFDEEVQSAPTKVKEETDNISDHNEP
ERDGQLPAHDKMTEIVEEPCTNLTLGSKTRWGIAQSCDGSSIFGNTFSTPCFSFPLIFTF
RSRHVSCHSPGRSFLWWGTEIHQTGHCVEKEPFSIPSLHMA

Figure 286. Amino acid sequence of SEQ ID NO: 1229. The conserved No apical meristem (NAM) protein domain identified using InterProScan is underlined.

MGAVIIPRN<u>PPVGYGFRPTDEELVDHYLKLKVLGITGDVCIIPEVDICKWDPWELPKK
FEEQSIIPPDDKVQEWWFFYLQTPRIQRSTPLGYWKKTGVDRTIKAGDRNRAIGTKKT
LVFYKRHGSEGVKTNWVIHEYYLL</u>TNNLNELFPHALTKSYVVCHLKHKGNEESDFS
ALQLNGGAISLMDLDSGLHQPAQNNSFPEPWSEAVGNSSISLADLDSNLHQPEHENL
FPEPWIQAVENPSISLVDLQSDLRQPEPENSCPEPWILVDSATEPSLQQDNQVQVITSIL
PQTSFQSEIVDSQTDLHVRNFGSPSFADLPLDDDLVVYFDESNQLQVGYIDRDQIQTQ
YGPKCSPDDEHAVLRKSQRAKMIKSLHGVVSLDEKKGFIEHKFNGLHISSPKHMEPP
KKPEIARTYSTDEESRVEKVEKLELAARNIKPECVTLDELEAKAKYGQTSSSRNAHA
MVENWQTPTIETLHGQTSSSRNKNATEKTGQTLAIELPHGCREVPPEEKKSFDGNES
NCSNVFPPKRMDPLEEPATVRIYSKGEKMRFLEVKKQELAAKNIKPNCALLDDLATK
AKSHNEHVVRIGTVEPLNGVAPLHKKKGFDKNKFDSLHVSSTKHTELLEKLRKEDL
ATRNSKSVYIPLDESIAIAKHDQASRFHKGSILEENWLASTKKSLDGVLKGKKGFTES
ELDGWEIVSAKQTEHPKKAGNAGISCKYKDPRLEKLKMPEFSAREISNQKVHLWLN
QKPDQR

Figure 287. Amino acid sequence of SEQ ID NO: 1230. The conserved Plant regulator RWP-RK domain SEQ ID NO: 3669) identified using InterProScan is underlined.

MEDVAFTPNFTSESLLDSAMDLDLMDQLLLEGCWLETTDASNYPFRGIFQEEAGKDF
AESPPSTCPRIEERLEMEQKNINPFEATASSSQSEGFQIEGTEVGRRCWIAPTANPGPSS
SMKQRLMMVLGRLKECTKDKDVLVQIWVPVKKGGRNVLTTIDQPYVHNPNSKSLE
SYRNVSKTYQFLADEETKESVGLPGRVFLGKLPEWTPDVRFFSSEEYPRRDYAQQYD
VRGSLALPVFERGSGTCLGVVEIITTSQKINYRPELETVCKALEAVDLRSSQTFRPPSA
KACNQSHQAALPQILEVLTSVCRQYRLPLALTWASCLRKEACSEHHLLRGQGIVGRA
FTINQPCFAADITAFSRKEYPLAHHARMLGLCCATAIPLASIHTGSVDFVLEFFLPRDC
RDAEEQKQMINSLSSFVCQTLQNSQKEQKETLVSSTRYTGVNTSDKRIQVEETDKLL
PSLNKRHPQEVSWIANMVEAQKNSKGISVPFEVQKEPKEEFTVTTKWEETEIGLQHG
QFHPEFHRVQQNLENKPNVEGGDTLGQFPSIGGRKSGQRTRTK<u>TEKTISLDVLRQYF
AGSLKDAARSIGVCPTTLKRICRQHGITRWPSRKIKKVGHSLKKLESIINSVQGAEGTI</u>
RIRSFYESFPELNSPRHSEKGTFSSANLGNPLEQLNPQTENGLFSSGATTSNSPSSSCSQ
SSGSTTSFSTGTKQCFTAITALSSGDPVMSNNPSEVLKRTRSDAELHISTHEEPKPLIRS
QSHKSLDEWGSLENVATLPKTNSPRITRDLGIYRIKAILGEEKIRFSLKPSWGLRDLQR
EVANRFNIEDIGTIDLKYLDDDQEWVLLTCDADLEECIDVYRMSRNHTIRISIHQSSH
QNLRSLGGSSGEAQHRGHIHL

Figure 288. Amino acid sequence of SEQ ID NO: 1231. The conserved AP2 domain identified using InterProScan is underlined.

MDGISCTDESTTSSDSPSFSPPPAKPSPPPPGSLWRVGSAASTVLDPAPDGGAEAESHK
KLPSS<u>KYKGVVPQPNGRWGAQIYEKHQRVWLGTFNEEEDAARAYDIAAQRFRGRD
AVTNFKPDGAMDPAEADFLAKHSKPEIVDMLRKHTYRDELEQSKRSYRGSAAERAG</u>
RGGFGPGRTEWSAAAREQLFEKAVTPSDVGKLNRLVIPKQHAEKHFPLPGGPAATM
KGVLLNFEDVGGKVWRFRYSYWNSSQSYVLTKGWSRFVKEKSLKAGDTVCFQRST
GPDKQLYIDFKPRGQPPAGPAAPPPPVQMVRLFGVNIMEVPYCGGGKRMRDVDLL
SFECRKKQQMVVGAL

Figure 289. Amino acid sequence of SEQ ID NO: 1232. The conserved SBP plant protein domain identified using InterProScan is underlined.

MEKGKHRAFLEEKLKAEPAAECEDGPGGGDGEDDDDSKRKKVPPSSGSRRGSGATS
<u>RNCQAEKCTADLTEARQYHRRHKVCEQHAKAPAVVVGGLYQRFCQQCSRFHELLE
FDENKRSCRRRLAGHNERRRKNPAEPHIEGSSGKAGGSTQMKELVCGQVDNRGRIQ</u>
ENATYKHFQIR

Figure 290. Amino acid sequence of SEQ ID NO: 3629. The conserved SBP plant protein domain identified using InterProScan is underlined.

MDWNLKAPWDLTEFGQETLPGSHGADGPNSYGIPSAKGEFSVDLKLGQMSNTVNEP
VNMWKDSGVSKMASSPSGSSKRARSASSGGQA<u>VHCLVDGCNADLSNCREYHRRHK</u>
<u>VCEVHSKTPEVTINGRKQRFCQQCSRFHSLEEFDEGKRSCRKRLDGHNRRRRKPQPD</u>
PLSRSADIFSSFRGPQLVPLSNSQVYPTTAVGNPTWAGVVNPEQEAALYARHQHLYG
SSSSIYGGGKQIKFLQGNNPVLSSQMSAESSVCQQLPRTIVSSDSGGLGRNMFYDRLV
SESDCALSLLSSPQMQTSGTNFSHLAHQNSHRGNHSSEPLDSVRISSGSGRNTNSQGL
FHLGSEGRQRNEASQVIPFHWD

Figure 291. Amino acid sequence of SEQ ID NO: 1234. The conserved SBP plant protein domain identified using InterProScan is underlined.

MDSRRPLNHSASSSSSSPPTSASTDGPEIHFGDVGPGVQAKPGGSTSSRSGSQGTPPKK
ARGADGGSGGGGAHQPP<u>RCQVEGCNVDLSEVKTYYLRHKVCGTHSKAATVVVRGL</u>
<u>EQRFCQQCSRFHQLNEFDQGKRSCRRRLAGHNERRRKPPPGS</u>AHYSRHSRFSSSIFDN
STGSAGLVMDFSAYPGPPPREAWIAPQASNRGPGNQTLGREKLQLHPPWQSSPESHQ
YNLFLQGPSPSVGGTSFPGPGIPPGESFNPSCALSLLSNQQPDSASQASGRALNSDVLS
RQASVGAQVINPLDAAVGNFSSASWALKVNEAGGSTPDIAPDLGLGHVSQPLNGPFS
SGLEFSLQSRRQNTDQDHSQDYNSTQQRHWSL

Figure 292. Amino acid sequence of SEQ ID NO: 1235. The conserved SBP plant protein domain identified using InterProScan is underlined.

MDVGSGSWTTESGSSSPPPLESLNGLKFGQKIYFQNNNSSNNAAAPKHGSGSGSGSSS
AAAPAPGSGTPPKKVRASAGGGGCGAIQGGQPP<u>RCQVEGCRVDLSDAKAYYSRHK</u>
<u>VCGMHSKSATVIVAGIEQRFCQQCSRFHQLTEFDQGKRSCRRRLAGHNERRRKPPPG</u>
SLLSSRYGRLQSSIFENTTRVGSFLMDFTAYPKHAWSAPRFSERTTPGDLVPGPGKVY
PHPWQSSPENPPSDLFLQCSSGGTTAFPAPGIPPGECFTGVADSSCALSLLSNQPWGST
NQPSPLGTNHMVHPQGSTLAQSMPPHSSAIHFTGPGSAWAFKGNDAGGSSIGLAADL
GLGQFSQPLNNQFSGDMELSQHSRRQFMELDPSRAYDSTHQTHWSL

Figure 293. Amino acid sequence of SEQ ID NO: 1236. The conserved TCP family transcription factor domain identified using InterProScan is underlined.

MGSIVSPQDFPSSDQNSPPNLAAAAVEAPPP<u>KPHRQVALSRKSTAAPARDRHTKVNG</u>
<u>RGRRIRIPALCAARIFQLTRELGHRSDGETIEWLLRCAEPSIIAATGYGSMPADPITTTV</u>
<u>GALPPSSTPASAPCPAQPLALAPPAAGHGAFPISPPPDCRLDLSQPNGFDFSAGGCATN</u>
<u>GYRH</u>MPFTALLLQPTATEEAEERQQREILG

Figure 294. Amino acid sequence of SEQ ID NO: 1243. The conserved Tubby domain identified using InterProScan is underlined.

MSLKNFVRELRREMKDGIGNVSRRGSEGRRWCSRTRSHIAPDHAAPPSMSVEQGRW
ANLPPELLLDIIQRVEESETLWPSRAVVVACASVCKSWREITKEIVKTPEQCGKLTFPI
SLKQPGPRECPIQCFIKRDRATSTYLLYFGLVPSEDEKDKMLLAARKIRRATCTDFVIS
LVADDFSRASSTYVGKLRSNFLGTKFTIYDTQPPCEAAIQSNSRLNRRFNSKQVSPRV
SACNYSVGTVSYELNVLRTRGPRRMHCEMDSIPISCLQEGGSVPTPSLFTHSFDEPSSL
SPASKGKDKVTEFSSTSLLDIPVPVPGAGDPLVLKNKAPRWHEQLQCWCLNFRGRVT
VASVKNFQLVAAVDPSHKISAAEQEKVILQFGKIGKDIFTMDYRYPLSALQAFAICLS
SFDTKPACE

Figure 295. Amino acid sequence of SEQ ID NO: 1245. The conserved Tubby domain identified using InterProScan is underlined.

MSFRSIVRDVRDGFGSLSRRSFDVRLLGHNRGKSQGSVHELHDQPLLVQSSRWASLP
PELLHDVIRRLEASESTWPARKHVVSCAAVCRSWREMCKEIVKSPELSGKITFPVSLK
QPGPRDGTIQCFIKRDKSNLTYHLFLCLSQALLVENGKFLLSAKRTRRTTCTEYVISM
DADNISRSSSTYIGKLRSNFLGTKFIIYDTQPPYNNAQLSPPGRSRRFYSKKVSPKVPT
GSYNIAQVAYELNVLGTRGPRRMHCAMHSIPAAALEPGGTVPGQAELLPRSLEDSFR
SISFSKSIDTSTEFSSSRFSDIIGPRDEEDDGKDRYLVLKNKAPRWHEQLQCWCLNFRG
RVTVASVKNFQLIAANQPSAGAPTPSQPAQSDHDKIILQFGKVGKDMFTMDYRYPLS
AFQAFAICLSSFDTKLACE

Figure 296. Amino acid sequence of SEQ ID NO: 1246. The conserved Tubby domain identified using InterProScan is underlined.

MSFRSIVRDVRDGFGSLSRRSFDVRLLGHNRGKSQGSVHELHDQPLLVQSSRWASLP
PELLHDVIRRLEASESTWPARKHVVSCAAVCRSWREMCKEIVKSPELSGKITFPVSLK
QPGPRDGTIQCFIKRDKSNLTYHLFLCLSQALLVENGKFLLSAKRTRRTTCTEYVISM
DADNISRSSSTYIGKLRSNFLGTKFIIYDTQPPYNNAQLSPPGRSRRFYSKKVSPKVPT
GSYNIAQVAYELNVLGTRGPRRMHCAMHSIPAAALEPGGTVPGQAELLPRSLEDSFR
SISFSKSIDTSTEFSSSRFSDIIGPRDEEDDGKDRYLVLKNKAPRWHEQLQCWCLNFRG
RVTVASVKNFQLIAANQPSAGAPTPSQPAQSDHDKIILQFGKVGKDMFTMDYRYPLS
AFQAFAICLSSFDTKLACE

Figure 297. Amino acid sequence of SEQ ID NO: 1247. The conserved Tubby domain identified using InterProScan is underlined.

MSFRSIVRDVRDGFGSLSRRSFDVRLLGHNRGKSQGSVHELHDQPLLVQSSRWASLP
PELLHDVIRRLEASESTWPARKHVVSCAAVCRSWREMCKEIVKSPELSGKITFPVSLK
QPGPRDGTIQCFIKRDKSNLTYHLFLCLSQALLVENGKFLLSAKRTRRTTCTEYVISM
DADNISRSSSTYIGKLRSNFLGTKFIIYDTQPPYNNAQLSPPGRSRRFYSKKVSPKVPT
GSYNIAQVAYELNVLGTRGPRRMHCAMHSIPAAALEPGGTVPGQAELLPRSLEDSFR
SISFSKSIDTSTEFSSSRFSDIIGPRDEEDDGKDRYLVLKNKAPRWHEQLQCWCLNFRG
RVTVASVKNFQLIAANQPSAGAPTPSQPAQSDHDKIILQFGKVGKDMFTMDYRYPLS
AFQAFAICLSSFDTKLACE

Figure 298. Amino acid sequence of SEQ ID NO: 1248. The conserved DNA-binding WRKY domain SEQ ID NO: 3670) identified using InterProScan is underlined.

MENLSYSSSLLPCPPSPPLSSSSPSFLSLNPRLTGLGAYNAEFKGHGDNNIEQSGYLGL
DMSNSSSLDHRRVPEAPAAVDENDAENALKAVKKKGGKKVRKPKYAFQTRSQVDI
LDDGYRWRKYGQKAVKNNKFPRSYYRCTFHGCNVKKQVQRLTKDEGMVVTTYEG
MHSHPIEKSTENFEHILSQLQIYGASL

Figure 299. Amino acid sequence of SEQ ID NO: 1249. The conserved DNA-binding WRKY domain SEQ ID NO: 3670) identified using InterProScan is underlined.

MEGERGSSSSSVPNYDLQVTFSGASHGIHEIGFVPFEDQNQVLGFLTPAPPLIAAGEG
ATAAATTTTSRVGLGHHNGLVARSSWNNDQVGAHDPKAVSDENCSANPSEGNNSW
WRSSTAAAEKGKMKVRRKLREPRFCFQTRSEVDVLDDGYKWRKYGQKVVKNSLH
PRSYYRCTHSNCRVKKRVERLSEDCRMVITTYEGRHNHSPCDDSNSSEHEGFNSFYY
CPKTEPKKHCPGEFGGR

Figure 300. Amino acid sequence of SEQ ID NO: 1250. The conserved DNA-binding WRKY domain SEQ ID NO: 3670) identified using InterProScan is underlined.

MDRRFYTNPFVHDQEEDPEPEQGPDSPSSGEDSKVNASEPSQKRRKSVKKRVVSVPI
AGDPEGSKSKGEAYPPSDSWAWRKYGQKPIKGSPYPRGYYRCSSSKGCPARKQVER
SRLDPTTLLVTYSSDHNHAVPSSSSSKNHHHLRAAAVSDSSASASASASASASAADP
DDCISAMFEPDELAGFIGGATLLDPGFDWLADVASTSSFLQRPVYEGGGAEAAPVHR
MRDEEEGEDPLFADLGELPECSLVFRRTKLLEPEGESRRRGLSAVPCVGNVV

Figure 301. Amino acid sequence of SEQ ID NO: 1251. The conserved DNA-binding WRKY domain SEQ ID NO: 3670) identified using InterProScan is underlined.

MAVDCVKMVDNERAIQEAAAAGLKSMQHLISFLSSPPQPSSNPDPHHHHHLQQPSDS
AAHLTDFTVSKFKQVISLLNRTGHARFRRAPQPPLPLDLVLESKPDPPKPATKPLSQA
HPSLCQSQSLSLSPSQDFFSMSQPMSSATSSFLSTITGDGSVSNGKQGLSPPTMSAGKP
PLASTHRKKCAEEALSAGRCHCSKKKKHRVKRVVRVAAETAADQYTWRKYGQKPI
KGSPFPRGYYRCSSVRGCPARKHVERAQDDPRLLVVTYEGEHRHSVSNAISYGSMPD
A

Figure 302. Amino acid sequence of SEQ ID NO: 1252. The conserved DNA-binding WRKY domain SEQ ID NO: 3670) identified using InterProScan is underlined.

MAADSVAPKLDMDDPEGAKPEGQASKRRKLVHKTVVRVKIEANVVKQKNEGPPSD
FWSWRKYGQKPIKGSPYPRGYYRCSTSKGCSAKKQVERCKTDASVLVVTYTSTHNH
PGPDIHSLNPTVQPSEADDDPEETAVAVAVSPAVSAQEEVPEQDQDQEDQDQEQHLD
LGDKQDRDRHTHVGIDEADRAREDNFHYLRSPTNCSSQDLVMEQDDTLAPQLQVYE
EPLVSCSREDPSGVGAAPVPPEPEPEPKEGHDFFDELEELPVFSYFANLNRINHFIDDRI
PVVPS

Figure 303. Amino acid sequence of SEQ ID NO: 1253. The conserved DNA-binding WRKY domain SEQ ID NO: 3670) identified using InterProScan is underlined.

MHGSFQSGSFMTEHDDNGSSPENSIGESPPWPSRYGDTMKTGPTATSPKRSRRGMQK
RVVSIPIKDVEGSRLKGEGAPPP<u>SDSWAWRKYGQKPIKGSPYPRGYYRCSSSKGCPA
RKQVERSREDPTMLLITYSCEHNHPWP</u>AAKNNHHHLNHQNSSAVTSAVEEKPKMLA
NLPNPEAEPEPKPEPELEPDPEPEEKFPDMSDESVLMCATDEFSWFMDMPTTSSTILES
PIFTESGNNSASKGAAIDADMAMFFPMREEDESLFADLGELPECSVVLRHGRSGGVS
TQVQIC

Figure 304. Amino acid sequence of SEQ ID NO: 1254. The conserved DNA-binding WRKY domain SEQ ID NO: 3670) identified using InterProScan is underlined.

MGSNWIVDTSLELNTSYPKKEIVLENDNSRRGRPEEPVIKHEAGALMEEYRRVSHEN
RKLTEMLTLMHDSYNTLQNQLIVLENKTSDGELGASRKRKHEANIAAESCSYEEDRI
CKKPKDIFKPMITKLHFQTDVSDMSLVV<u>KDGYQWRKYGQKVTRDNPSPRAYYRCSF
APTCPVKKKVQRSVHDPSVLVATYEGEHNHLSPSQPAIPLGSDKQGLNQGTRPIPSPS</u>
KSRSSSPRSTPDLIRLGCDTLSAKTGQEEEVTAAFQQFLVQQMASSLKTDPNFTAALA
AAISGKLVDQARIGKW

Figure 305. Amino acid sequence of SEQ ID NO: 1255. The conserved DNA-binding WRKY domain SEQ ID NO: 3670) identified using InterProScan is underlined.

MDSSSWITSSLDLSIRPLQVSEEPPTKVVESDFMELGRTGSGNKDESGALHEELNRLA
AENKKLSQMLMTVCENYNALRNHVIEIVSKNAEREVSPSKKRKSESSTNDNGNEMV
VNRASESSSTDDDDLYKKPREETIKAKITRVYYRTEGP<u>GTSLIVKDGHQWRKYGQKI
TRDNPCPRAYFKCAHAPSCLVKKKVQRSAEDQSVIVATYEGEHNHPSSSLLEATCGS</u>
NARATLDSVPRSASLSSSGPTVTLDLMKPKQETDVKSSQPKVDSPELRQFLIEQMASS
LTKDPSFTTALAAAISGKMVGPYPTEKWI

Figure 306. Amino acid sequence of SEQ ID NO: 1256. The conserved DNA-binding WRKY domain SEQ ID NO: 3670) identified using InterProScan is underlined.

METFWLERSLSTNSSSKRRAIEELVDGRESAMRLKTLLRKPSGNNGSQPADELVVKIL
RSFTESISALSSCEESEVREVMSPQIGGFGAGCDDQGSEHSGESRKRPGLKDGRGCYK
RRKESETRTTISPT<u>KDDGHAWRKYGQKDILNSKYPRCYFRCTHKNDQGCRATKQVQ
KMEDDPKMYQITYIGNHTCREITRAPQMITDSDPWESS</u>YTPSRNNSDTKPLTNSQQSF
VLCSANNSIKKEEELAPVKEDTTTTSSDLTDNLSSFDSLLPPELMGFESSDPTAMYLSG
VDDSPQSFLDMDTMGRFGFDGEFPFYENLQFS

Figure 307. Amino acid sequence of SEQ ID NO: 1257. The conserved DNA-binding WRKY domain SEQ ID NO: 3670) identified using InterProScan is underlined.

MKERAKMENTDGSASLLFADHGHGGLSDFVFSEFDRSMMAGSSGFMELLGFHQDSS
GPSLFDVPLQPPTSNAMESSSEVVNPPATPNSSSISSASNNDGLNNNNEEEEQQVKAK
VEDEGVETQEQEEHQKTKKQLKAKKTNEKRQRQPRVAFMTKSEVDH<u>LEDGYRWR</u>
<u>KYGQKAVKNSPFPRSYYRCTSASCNVKKRVERSVTDPSIVMTTYEGQHNHMSP</u>VMP
RSILAGVTHPPAGAAATAFSVPAMPGASLTQHHALHYQLQSYANNWSMSNNSAVVP
SSGSTNAAVLLNKRRFCSPGPYNFLADNGLFQDMVPFHVLKEEE

Figure 308. Amino acid sequence of SEQ ID NO: 1258. The conserved DNA-binding WRKY domain SEQ ID NO: 3670) identified using InterProScan is underlined.

MEKVISWEQHNLISELVQGKDLAKQLRNHLVSPSSSRE
THEYFVEKILSCYQKSLAMLNCDALAEEHRPAFSIGTSGSPKDEGDACKKRKTMPRW
TEQVQLNSEAGLEGH<u>HEDGYSWRKYGQKEILGARFPRAYYRCTHRNAQGCLATKQ</u>
<u>VQRSDQDPTVVEVKYRGRHTCIQ</u>ARSSAISPDPIIKEEPPKATAIRQEQPKPSLDTLLSF
KWGLNVKAENARQDDVFPLFTFSSPAVETENGERDYFADALMDDGFMDTFSSPATS
GSNYFSLSLDHMANFCPPISVQTPESGLTEIVSAPTSVTNSPMGDAAFSAFSLGKDDF
NLDCSFDGSEFLL

Figure 309. Amino acid sequence of SEQ ID NO: 1260. The conserved DNA-binding WRKY domain SEQ ID NO: 3670) identified using InterProScan is underlined.

MDYSSCISTSLDLNIRPLRPHDEAPKREPQETDFMDLGLNTSAKEETGALVEELNRVS
AENKKLTQMLTVMCENYNHIEKPGDGLHEQDIAEKELSPSKKRKCDSNNNIGENNN
NILANGASESSSTDEDSSKKPREEKITAKISRLYVRTEASDTGL<u>IVKDGYQWRKYGQK</u>
<u>VTRDNPCPRAYFKCSFAPSCPVKKKVQRSVEDQAVLVATYEGEHNHPTQ</u>MEETQGS
SRCMAIGSVPCSTSLNSSGPTITLDLTKSKSPIVSPSSNNNNDNNNNNNNNNNSNS
NSNNSNKITLKPKTESPEIQRFLVEQMASSLTKDPSFTAALAAAISGKIFHQNPTGKW

Figure 310. Amino acid sequence of SEQ ID NO: 1261. The conserved DNA-binding WRKY domain SEQ ID NO: 3670) identified using InterProScan is underlined.

MDGGWSFEQKTLISELIQGMEFAKELRGHLTSAPSTEARDVLMQGILSSYEKALLILQ
WGGPMPQSQPVVAVSGIPESPLSVNGSPRSDEFEKGIGDHQQNRDISKKRKLMPKWT
DQVRISSENGLEGP<u>HDDGYSWRKYGQKDILGATYPRSYYRCTYRNTQNCWATKQV</u>
<u>QRSDEDPTVFEITYRGTHTCGN</u>SGPSVPSPASSEKQEQKQINHQSNHHQHLQQQQSQ
EMLSKFRAGLRVDTNNLDNNEKAYHPFSFPSASVGLLQIEHCSSSTLTNVNSSLFGSF
SSTFFSPSTPESCYFSMHQANDLGQAHNMQHLESDHNEIISTNTSSTNSPIMDLEFSLD
QVGIDPNFPFDTSFFP

Figure 311. Amino acid sequence of SEQ ID NO: 1262. The conserved DNA-binding WRKY domain SEQ ID NO: 3670) identified using InterProScan is underlined.

MCSFSSRSRERGMAVELMMGYGSGGDGGVGFAVKKEETALREAASAGIQSVENLIK
MLSSSPSPSPSGGGAGGGRRAGQDSPSPSSSSSGGPSPAVDIEAATDAAVNKFRKVISL
LDRARTGHARFRRAPVADPLPENREAFTPVRPAENPVGSARLQSAEPVSAFKVYCPT
PIQRLPPLPHNHHHHHNHNHHHHHHHQVQQNPIPVVPKVERKESATPTTINFSTSPPIS
AANSSFLSSLTGETDSVQRSFSSAGFQMTHHLSQVSSADKPPLSYSLKRKCSSMDDA
ALKCGSSSGKCHCSKKRKSRLKRVVRVPAVSSKMADIPPDDFSWRKYGQKPIKGSPH
PRGYYKCSSVRGCPARKHVERALDDPGMLIVTYEGEHNHSQSVADVKAPLVLESS

Figure 312. Amino acid sequence of SEQ ID NO: 1263. The conserved DNA-binding WRKY domains SEQ ID NO: 3670) identified using InterProScan are underlined.

MAIEESAPNETGPEGVKPENSPQNGGDTPQPDQKSNSKESPGCGVGLQGVQSKEPLA
SELTPESVKHGSQSGQEGSTPSISYEKSSEDGYNWRKYGQKNVKGNEFVRSYYRCTH
PNCPVKKQVERSRSGRITDNIYLGEHNHASPQKHLPVAVSFAVSIVEEKPEKPSPISTQ
DKSSEVKREASHQVDDKKPPQLSVPTPADVKPVVPAIVKVQDEIATDEDSPGSKRRK
KDSCNPDIPSGDKPTTEARVIVHTVSEVDIVNDGYRWRKYGQKMVKGNPNPRSYYR
CSSAGCPAKKHVERASHDTKLVMTTYEGQHDHSVPPSRTIMPNPGGFNGHATTQSG
DVNIKSPDGETVSHSVGENASSASGSKSTDQSNGKAEETSGTGDEVGDRTVLNNDLG
PEDRISEQKEDLSSTKSGDRDPVHLDSVVNVMENSHPPQQPSNAAAVQS

Figure 313. Amino acid sequence of SEQ ID NO: 1264. The conserved DNA-binding WRKY domains SEQ ID NO: 3670) identified using InterProScan are underlined.
METKETDRVVIAKPVASRPTSSNFQSFSELLAGAINSSPPNACTESAVATIRPKTVRFK
PVPNRAPTAVNSSQAEVSGTATGNSNDKALKSDEKPTVIYKPLAKLVSRSTVSLLAN
MGSFNMAHHQTLSVAEARVKSQLQDKNNSRSQPIGNLHRSVSSQADMDGTSEPLRL
ASQNMEEDTRTSPALNMDRPSYDGYNWRKYGQKQVKGSEYPRSYYKCTHPNCPVK
KKVERSFDGRIAEIVYKGEHSHPKPQPPKRSLSGTQGLGNVLEGSGLDSTNNRLNER
DECSEDRVENKNLALTTYHGKGPLAYDPIANVASNAGGATPDNSCGISCEYDDGSKE
LEVEDDEPKNKRRKSDNQLNEPGISGEGIQEARAVQNSTDSEIVGDGFRWRKYGQK
VVKGNPYPRSYYRCTSVKCNVRKHVERASEDPRAFITTYEGKHNHEMPLRSTNTAG
SESDLQAASSKDKP Figure 314. Amino acid sequence of SEQ ID NO: 1265. The conserved DNA-binding WRKY domains SEQ ID NO: 3670) identified using InterProScan are underlined.

MAGKQPPPPLRPTISVPPRPPAAAMFGPCASPGPLTLVSSFFAESDGGSFSELLAGAM
YSPLAVNAAGPSSFLWDYPRENPSREGEPRDGQAGLPVGAVKSPLFTVPPGLSPSGLL
LSPGFFSPKSPFGMSHQQALAQVTAQAHVALARSHEHSQLEINPPSEASKEPLPDEPS
LMPNEDSHQLSPSEATTSMAESSDFVSSSHKWEALPMVLEKP<u>TEDGYNWRKYGQKQ
VKGCGFPRSYYKCSHLNCSVKKKVEHSLDGRITEITYRGQHQHEMP</u>QAKRTSKDGN
NLNRSTNSLAKSQAVLQGQSGRQSAPAMLRSGQDEESSQAIASNTSGLSNYVELDDA
KSKGDGSDVDNDDVDAGDDKSNPKQKIVPIPSSKYVTEPKIVLQTRSEVDL<u>LDDGFK
WRKYGQKVVKGSSYPRSYYKCTYAGCNVRKHIERAALDPKSVITTYEGKHNHT</u>APS
AGKRGRTVEATEFGDAQRPSVLRLKEEQVAA

Figure 315. Amino acid sequence of SEQ ID NO: 1266. The conserved DNA-binding WRKY domains SEQ ID NO: 3670) identified using InterProScan are underlined.

MGSPPAPDFEPHEFQFRSAADPSPGGPFSDSDAGPLAGGGGGGGCGGGGGGARYKL
LSPAKLPISRSACITIPPGLSPTSFLESPVLLSNVKVEPSPTTGSLIKPHMMNGLIGSNSD
TRLANSGCPDNFDEGRSGIFEFKPLATSSMVPTEAKHQGSEQAVKVSGQRHSQPFAS
LSSVQSDLAVSSKELCLSVPTQAVRSGASPLAEADPDGLLGRKEQPNNVMQVTQLD
NKGNGPSVMTERL<u>SDDGYNWRKYGQKHVKGCEFPRSYYKCTYPNCEVKKLFERAP
DGHITEIIYKGTHDHPKP</u>QPSRRFTGGATMPIQEERSDRFSFIPAVESTSTVYGETSYN
VETDGTPELSPVAENDETIEGAASLSNRIQNEVDDGDDDDPFLKRRRLDIGGEDVTPV
VKPIREPRVVVQTLSEVDI<u>LDDGYRWRKYGQKVVRGNPNPRSYYKCTNAGCPVRKH
VERASHDPKAVITTYEGKHNHD</u>VPTAKSSSHDTAAPSALSGLPRTRSEGETVSLDLG
VGRSAASEMASAEKQQILRPNPVQSRIHYASSALDAVQATPVTAYHGFLNGGINQFG
YRENLTEGHSKSTEFLQNMGRILTGP

Figure 316. Amino acid sequence of SEQ ID NO: 1267. The conserved DNA-binding WRKY domains SEQ ID NO: 3670) identified using InterProScan are underlined.

MSGADDNVAVIGDWVPPSPSPRTFFTAMLGDDIGLRSGLEASGNNKTGGLFLGSQER
VTMGNFENKDTKRVGPSGGDHSSESRLAVEQKGYSRGCLGERLAARAGFNAPRLNT
EGIRSADLSSNPDVRSPYLTIPPGLSPTTLLDSPVFLSNTLAQPSPTTGKFPFIHNNNSRS
SGLMLDANTSKDNPFEENSSSSFAFKPLGEASSSFFGAGSKMNQATFPQQSYHRIEVS
VQSENSVQSRNVEATKLQSQNGSGFQFQGDFSRSSAENVAGHDGVPSDQRNFSTVT
GDPEHSPPLDEQQDDEGDQRISGDSLVGVNGGSP<u>SEDGYNWRKYGQKQVKGSEYPR
SYYKCTHPSCQVKKKVERSHEGHITEIIYKGAHNHPKPP</u>PNRRSVIGGANPFGDMQL
DNPEQMGLQNATDTDPAWANMQKTAGMGGSEWRQDNLEVTSSPSDGPEFSNAPTS
LQAQNGGNQLESGDQVDASSTFSNDECDDEQQTHGSVSLAYDGEEDESDSKRRKIE
AYATDMSGASRAIREPRVVVQTTSEVDI<u>LDDGYRWRKYGQKVVKGNPNRSYYKC
TSPGCTVRKHVERASHDLKSVITTYEGKHNHD</u>VPAARNSSHVNSGASSAIPTQCTTS
AIQTQVHRPEPSQVHSMMGRYEGPGSLGSFSLPGRQQLGPGPGFSFAMNPPRLANFA
MAGMGPGQGNLPMLPVHPFLAQQHQVHEMGFMLPKGEPKAEPMSEPGPNLSNNSS
VYQHIMSRLPLGPQM

Figure 317. Amino acid sequence of SEQ ID NO: 1268. The conserved Zn-finger-like, PHD finger domain identified using InterProScan is underlined.

MAKSKSVAKKVLQSYSIKGTNKLVKAGDCVLMRAQDPEKPPYVARIESIEIDGKKK
NVNVNVRWYYRPEESIGGRRQFHGVKELFLSDHYDVQSADTIEGYCKCEMPYNPDD
LMVQCEACKDWFHPACLNMTINQLKTIEHFICQDCSDDSKRKPRNGAKDSSSLETKP
ETKRRRR

Figure 318. Amino acid sequence of SEQ ID NO: 1269. The conserved Zn-finger-like, PHD finger domain identified using InterProScan is underlined.

MAKTRPAKKSLDAYTIKGTNKVVRAGDCVLMRPSDSDKPPYVARVEKIESDIRNNV
KVKVRWYYRPEESIGGRRQFHGAKELFLSDHFDVQSADTIEGKCTVHSFKNYTKLES
VGADDYFCRFEYKSATGGFTPDRVAVYCKCEMPYNPDDLMVQCEGCKDWFHPAC
MNMTPEQAKKVDHFFCPSCSSEDEDKKTRNSHVASPLAEAKLESKRRKR

Figure 319. Amino acid sequence of SEQ ID NO: 1270. The conserved Zn-finger-like, PHD finger domain identified using InterProScan is underlined.

MEGGGFVRRTVDDVFKDFKARRAGLIKALTTDVEEFYQQCDPEEVPPELPEPALGIN
FARDGMQEKDWLSLVAVHSDSWLLAVSVYFGARFGFDKNDRKRLFNLMNELPTIY
EVVTGTAKKQVKERSTVTNNSSSKNKSGGKVRSSESQPKMSKLPLSKDEEDILDEEE
DDEHGETLCGACGGVYSSATAEFWIACDMCENWFHGKCVKITPARAEHIKQYKCPS
CSNKRARV

Figure 320. Amino acid sequence of SEQ ID NO: 1271. The conserved Zn-finger-like, PHD finger domain identified using InterProScan is underlined.

METAASISSNPRTVEEVFRDYRGRRTAIVRALTTEVERFYSLCDPEKENLCLYGYASE
AWEVTLPAEEVPPELPEPALGINFARDGMQRKDWLSLVAVHSDAWLLAVAFYHGA
RFNRTERKRLFSMINDLPTVFEVVGDRKQTKEKTNSDNSGSKSKPSGKRVGDGQSKN
LIKPKEEDDETYDDEEGEHSDTICGICEETYSNDEFWIGCDSCERWYHGKCVKISVAK
AQSIRQYKCPLCNNKKVR

Figure 321. Amino acid sequence of SEQ ID NO: 1272. The conserved Zn-finger-like, PHD finger domain identified using InterProScan is underlined.

MEGGGFVRRTVDDVFKDFKARRAGLIKALTTDVEEFYQQCDPDKDNLCLYGFSNES
WEVNLPAEEVPPELPEPALGINFARDGMQEKDWLSLVAVHSDSWLLAVSVYFGARF
GFDKNDRKRLFNLMNELPTIYEVVTGTAKKQVKERSTVTNNSSSKNKSGGKVRSSES
QPKMSKLPLSKDEEDILDEEEDDEHGETLCGACGGVYSSATAEFWIACDMCENWFH
GKCVKITPARAEHIKQYKCPSCSNKRARV

Figure 322. Amino acid sequence of SEQ ID NO: 1273. The conserved Zn-finger-like, PHD finger domain identified using InterProScan is underlined.

MEGGSGPYNPRTVEEVFKDFKSRRNGLIKALTTDVEEFYQQCDPDKENLCLYGFPNE
SWEVNLPAEEVPPELPEPALGINFARDGMQEKDWLSLVAVHSDAWLLSVAFYFGAR
FGFDKNDRRRLFHMINDLPTIFESVTGIGKRPTKEKPAVTNNSSSKNKQSGKMRASEP
PMKMSKTPPPRDEDDSLDEEDEDEHGET<u>LCGACGDNYASDEFWICCDMCERWFHG
KCVKITPARAEHIKQYKCPSCTNKRPRT</u>

Figure 323. Amino acid sequence of SEQ ID NO: 1274. The conserved Zn-finger-like, PHD finger domain identified using InterProScan is underlined.

MEGAAGPYNGRTVEEVFKDFKGRRAGMIKALTTDVEEFYQQCDPEKENLCLYGLPS
ETWEVNLPAEEVPPELPEPALGINFARDGMQEKDWLSLVAVHSDAWLLAVAFYFGA
RFGFEKNERRRLFNMINELPTIFEVVTGTVKKQTKEKPNVTNHNGNKSKPNAKVQRV
SESQTKVPKLQPPHKEEDDTLDEEDEEEHGDT<u>LCGACGENYASDEFWICCDMCEIWF
HGKCVKITPARAEHIKQYKCPSCSSSTKRARV</u>

Figure 324. Amino acid sequence of SEQ ID NO: 1275. The conserved Zn-finger-like, PHD finger domain identified using InterProScan is underlined.

MEGGYIKSMEGGSGPYNPRTVEEVFKDFKGRRAGMIKALTNDVEEFYQQCDPEKEN
LCLYGLPNESWEVNLPAEEVPPELPEPALGINFARDGMQEKDWLSLVAVHSDAWLL
AVSFYFGARFGFDKNERKRLFIMINELPTIFEVVTGAAKKQSKEKSTVTNNSSSKNKS
GIKPRASESQTKPSKLLPPKDEDDTLDEEEDDEHGDT<u>LCGACGDNYASDEFWICCDM
CEKWFHGKCVKITPARAEHIKHYKCPTCSNKRPRV</u>

Figure 325. Amino acid sequence of SEQ ID NO: 1277. The conserved AP2 domain identified using InterProScan is underlined.

MVKPLPKQSSPVRPENQSLMS<u>RQFKGIQLRKWGKWVSEIRMPNSRAKIWLGSYDSPE
KAARAYDFAAYCLRGSKAKFNFPDTPPEIPYGSSLSPLQIQSAASRFAAEEFRLPSRND
AGSSNSCSDAESSIDGQQISAEQGASFWDSLVLQDLDSAKMITL

Figure 326. Amino acid sequence of SEQ ID NO: 1278. The conserved AP2 domain identified using InterProScan is underlined.

MATPSNQNGRMEPESHSQG<u>TRRFRGTRMRKWGKWVSEIRMPNSTGRIWLGSYDTPE
KAARAYDFAAYYLRGSKAKLNFPDCPPRIPANYSLSPEQIQATAGKFAAEESRLPSED
GAACSSSNSEAICHIDDRQIKAEQSPEFWDSLSLEDLDSYNSVSVDDFPGIF

Figure 327. Amino acid sequence of SEQ ID NO: 1280. The conserved AP2 domain identified using InterProScan is underlined.

MAKSSQNQNPRNRRENRLRKSRQ<u>FKGIRMRKWGKWVSEIRMPNSTGRIWLGSYDTP
EMAARAYDFAVYCVRGSKGKFNFPHSLPEIS</u>CASSLSPPQIQAAAAKYAAGEFLLPSE
DAAFSISHTEVECRNDGQEMLAFWDSVPEDMDNGESLTLEDFPPLDVPMDDFEVLFP
MMENWGSGAF

Figure 328. Amino acid sequence of SEQ ID NO: 1282. The conserved AP2 domain identified using InterProScan is underlined.

MVKPLPKQSSPSGSENCQIKSRQ<u>FKGIQLRKWGKWVSEIRMPNSRAKIWLGSYDSPE
KAARAYDFAVYCLRGSKAKFNFPDSPPEIPCPSSL</u>SPPQIQAAAARFATEDFRLPSEED
AATSSSEAESGIDSQQISAEQRPTFWDSLLLEDLDSGESLNLEDFPPLDFSMDDFGFLF
EQTKDWGLF

Figure 329. Amino acid sequence of SEQ ID NO: 1283. The conserved AP2 domain identified using InterProScan is underlined.

MTKPSRNQSCRSNPKSCSLKSRH<u>FKGIRMRKWGKWVSEVRIPNSSGRIWLGSYDTPE
KAARAYDFAVYCLRGTKAKLNFPHSPPKIS</u>CASFLSPQQIQTAAAKFAAEECRLLSEN
GEASSSYGLEEECDINSEQIIWEEGATFGDSVAFESMENGGSFNVEDIPPLEGLMEDFG
IPFQMPEDWELGIF

Figure 330. Amino acid sequence of SEQ ID NO: 1285. The conserved AP2 domain identified using InterProScan is underlined.

MTKPWQNQNRHNGTKSCAPK<u>SRQFRGVRQRKWGKWVSEIRMPNSNGRIWLGSYD
TQEKAARAYDFAVYCLRGSKVKLNFPDSPPEIPNGSFLSPEQ</u>IQAAAAKFAAEEFRPL
SERGAASSSSCLNAECGIDGQQTTAEQSSAFRVSVPLERLASSESLNVEDIPLLDVSVE
DFGVFFQHSKTNGQGVSNYF

Figure 331. Amino acid sequence of SEQ ID NO: 1286. The conserved AP2 domain identified using InterProScan is underlined.

MAVETMRRARVGIGGHENESRALK<u>ETHFRGVRKRPWGRFAAEIRDPWKKARVWLG
TFDTAEDAARAYDDAARALRGAKAKTNFALAADDNASAALARARNPRWVRTLHP</u>
QQQWPHDLKASALASFPSVPTLESSKRRKAGLASNCRPEFESRNNSPCSALSEQKTSS
SPRRKTPFLLDLNFPPSAEQDNENESAAL

Figure 332. Amino acid sequence of SEQ ID NO: 1287. The conserved AP2 domain identified using InterProScan is underlined.

MENFPEREPDNAISLPHEDRGSRQ<u>FKGIRLRKWGSWVSEIRMPRSRKKIWLGSYTTPE
QAARAYDAAVYCLRGRNAEFNFSVPDIP</u>TASPLSREQIQHAAAEYALGQAPSSFPSFV
ASPRHSSSVSEMELAGDNFQIYEERQDLALWWSMLAGSDGAGIPNLEIFPSTDEVSTL
DFLPTEEEQRYILTDLWNFQDV

Figure 333. Amino acid sequence of SEQ ID NO: 1288. The conserved AP2 domain identified using InterProScan is underlined.

MEIRLQQENDQDIAPPHEDRVSR<u>QFKGVRPRKWGIWVSEIRMPRSRQKIWLGSYKKP
EKAARAYDAAVYCLRGSNAKFNFPNSVPDI</u>PSASSLSRQQIQLAAAKYALDQSPSSPP
SLNNNKEEPASPSQSSSISETDLSRDNPRISEERQDLAVWRSLFAASDGAALPNLEKM
PSIDDVSMLDLVRISQQQQEEGYILTDLWNFQDV

Figure 334. Amino acid sequence of SEQ ID NO: 1289. The conserved AP2 domain identified using InterProScan is underlined.

MARPQR<u>YRGVRQRHWGSWVSEIRHPLLKTRIWLGTFETAEDAARAYDEAARMMCG
PRARTNFPFNPNAPPSPSSK</u>VLSSTLTAKLHRCYLASIQGPRSGSSKKDAMARADKNN
NIHSSNQSLTCLRLDNERSNNIGIWQKKAGSKQSESNWVMKLELDHDQHGNSTLKR
ETDDDIAQMIEELLDCGSLEICSPMASADSSISSAESMLN

Figure 335. Amino acid sequence of SEQ ID NO: 1291. The conserved AP2 domain identified using InterProScan is underlined.

MAPSNNRRDDN<u>GARGVHFRGVRKRPWGRYAAEIRDPWKKVRLWLGTFDTAEEAA
RAYDTAAISLRGPKAKTNFA</u>YSSPSSSSSLHNNQSSSQNSSTVESWPSAAPVTRSGDL
ELPASFLPRLGVSTGRRVLNGGNPRSGRRRSLSEKNSGRKAEGAEARTTLSDSDSSSS
AVLDGETQALPPPPPPAAKKPFLLDLNLPPPLDDDEEPQQIGS

Figure 336. Amino acid sequence of SEQ ID NO: 1292. The conserved AP2 domain identified using InterProScan is underlined.

MEDLDDHAHAPEEEVRGQKCR<u>QFKGIRLRKWGSWVAEIRMPKSREKLWLGSYKKP
EQAARAYDAAVYCLRGPNAKFNLPNSLPDI</u>PSASCLSRRQIQLAAAKYALDQFPSSA
PPLQNFNNKAMDEAASPSRPDPVSETELSSDSHQISEEGQLDLWESPIEVSGGNYEGR
MNLNLQRMPSIEEVSALELIYSISQQHEEEEHINLFLDPTELWNF

Figure 337. Amino acid sequence of SEQ ID NO: 1294. The conserved AP2 domain identified using InterProScan is underlined.

MCAEVSQSAMAVHTMQMARMEMKREIGVCE<u>QEASSAVKETHFRGVRKRPWGRFA
AEIRDPLKKTRVWLGTFDTAEEAARAYDNAARNLRGAKAKTNFGPSPLHDGKPLFN
NG</u>FSAQKRDSLRRPGLCPKQEPGVPVLPSPDVQASTCVNIGNLSPNPAVEKQTVSNK
KPMVLFGTHLSVSPRNLLLQQQQKEEICRSQGRRQAPLWLDLNLPPVANDLELLI

Figure 338. Amino acid sequence of SEQ ID NO: 1296. The conserved AP2 domain identified using InterProScan is underlined.

MAVDTIQMARVGVKMKIGGGGCEEE<u>ASSAVKETHFRGVRKRPWGRFAAEIRDPLK
KTRVWLGTFDTAEEAARAYDNAARNLRGAKAKTNFLLSPHNDISTKGSSSAALSSNS
TTSAASGQIQNQWPLRPYFYSNQGPAIVSFSCAPAASLSPIDNNQGGGSSCVTRGSAS
RNSAEENQTVYNKRGKFLFGIDLMISCDSQQQEDDAEICSSARQKAPFLLDLNLPPAA
NDVE</u>

Figure 339. Amino acid sequence of SEQ ID NO: 1298. The conserved AP2 domain identified using InterProScan is underlined.

MVKPSQKQNIHVNGKPESRSLMSR<u>QFKGIRLRKWGKWVSEIRMPNCRAKIWLGSYE
SPEKAARAYDFAAYCLRGSKARFNFPDSPPEIPCASSLSPSQIQAGAARFAAEEFQMP</u>
SDDDTASSSCGSEAESDLPPEIPCASSVSPPPIQAAAPRFAAEEFRLPSDEDTASSSCGS
VTESNIDSQQISAEQGSAFWDSLFLEDLDNGESLNLEDFPPIDLTMDDLGFLLQPSED
WGIF

Figure 340. Amino acid sequence of SEQ ID NO: 1299. The conserved AP2 domain identified using InterProScan is underlined.

MENLPNQQPDLEIAQTHEDPGSR<u>QFKGIRLRKWGRWVSEIRIPKSREKIWLGSYTTPE
QAARAYDAAVYCLKGPNAKFNFPETVHDIPSVTSVSRQEIQHAALKYALGQPPPSLQ</u>
SLEGHAALKYALGQPPPSLQSLEGHAALKYALGQPPPSLQSLQGHASPSQSSTVSEIE
LSGEQQKISEECPDIALWRSLLGVSDDTGIPNSEKFPSIDEYFSATLQEQREEDYISTNL
WNFQDQDV

Figure 341. Amino acid sequence of SEQ ID NO: 1300. The conserved AP2 domain identified using InterProScan is underlined.

MVCRSKESECHQKVLVGSQQHSERRECQVSSKRRSRGSGQ<u>PRQYRGIRMRSWGSW
VSEIRAPHQKTRIWLGSYPTAEAAARAYDAAVLCLKGSSAPLNFPESATTIHLPQSCQ</u>
SPLMSPRSIQNVAAAAYGYPSATIDLAGSSGVGCAAESLQDSFASNVKTAVGTETM
PSTGHNNDNVGAVREENSWLEQLLESPSSVDNYGYDDEMICCAWLSSDLTPLSNWV
DESYGPDHSQDFCSLWSFP

Figure 342. Amino acid sequence of SEQ ID NO: 1301. The conserved AP2 domain identified using InterProScan is underlined.

MAASCQLTPSQIHFQLLQRQVDEIEQLQWFPSAIADPKPELAQRSSTMDHLGRRPWP
MKHPAKRGLKPCSNQPTK<u>LYRGVRQRHWGKWVAEIRLPRNRNRLWLGTYDTAED
AALAYDRAAYRLRGEYARLNFPGLKHQLQLSHDTDRPTPSSTSNQDSITAISNQSGQF</u>
SAQQTSVDAKLQAICERLSASNKPSHGEMLGHNFLNQKTITVTLSKENSLIEVKSESP
DICNCEGNKTSVITALNSNSEMPC

Figure 343. Amino acid sequence of SEQ ID NO: 1302. The conserved AP2 domain identified using InterProScan is underlined.

MCGDEADIIPLNRSRRVTPRDFDTFADLFINGGAVSESFKKSCSFDDEDKQKIEPGAV
SESFNKSGSFDDEDKQKIEPSKSIFNFKHEFSSGGENEAIPSLKDFKIPPLKGFERSSAK
GTGRKR<u>TTLYRGIRQRPRGKWAAEIRDPRKGTMVWLGTFNTAEEAAKAYDAEAKKI
RGKKAKLNFADHSCS</u>VKMDTSKKMSRKKVNSCTENPDLLLGLNINSKVKPLYSRKP
DLSGGLISVPKTQCFISNASTEQSMASCSLNFPKNYLRSNHTLG

Figure 344. Amino acid sequence of SEQ ID NO: 1303. The conserved AP2 domain identified using InterProScan is underlined.

MAPRDELQNCGRGV<u>GQTTAKEVHFRGVRRRPWGRFAAEIRDPWKKTRVWLGTFDT
AEEAARAYDNAARTLRGAKAKTNFATPRDNQSSSQTSTVESWSSPKNVIVARSGPPS</u>
DASWRNFYSAKYLDAARVTGNANGNPCFKEAAAAAAWKTIYVNRGVESRAIDLNIS
ALDFGRVDDAATINARAHESINGAVALRCPAVNPFDCPSQVALPGKLLLFDGIASRPE
KRQKTCVRSGDEKLSLGQQWSVLNKSAGVGEEVETRNVQSDCDSSSSVVVDTEAPT
EAKKTIPFLDLNLPASAEDDA

Figure 345. Amino acid sequence of SEQ ID NO: 1306. The conserved AP2 domain identified using InterProScan is underlined.

MEHECSTSEPHGSGGGGGMKRSSTGAGGGGGVGGGGGGKGSP<u>YRGVRMRKWGK
WVSEVREPNKRSRIWLGSYSTPEAAARAYDTAVFYLRGPSATLNFPEEARKEQQSDL</u>
RLSQLGELSPSSIQRRAAEVGAAVDHAMQAGPVPAQTLREINQENDMKNALSSKLSE
GNNFKIEAKNNMRQQGLSSKSSDNIFKFDEKNNTMLQGLSSKPSDNIFKFDEKNNTR
LQGLNLKPSECDIFPFEEKSNKRLPGFISRSIKKSDVCKVEGITEEADEEKSDQMRLNL
RERDWFKIKDPVSGIGTALNLGQFAIHNVQGIADHGGEHTTLGLSVYRPEKRV

Figure 346. Amino acid sequence of SEQ ID NO: 1309. The conserved AP2 domains identified using InterProScan are underlined.

MVSLEAWGKMEGGQVAGMGVADEVKEQQLKEGNESDLLKGMKKARRERGSTAK
ERISKMPPCAA<u>GKRSSIYRGVTRHRWTGRYEAHLWDKSTWNQNQNKKGKQVYLGA
YDEEEAAARAYDLAALKYWGPGTLINFPVSDYARDIEEMQSISREDFLASLRRKSSG
FSRGMSKYRGLAKQSQTGKWEASFGRVLGNRYFSMGSCSTSEEAAAAYEMSQGEY</u>
RGFGVVRNIDLSSYIRWWQPNKSLEVEPSAPRHMDESHSISEERHTQGEEPETPQWPG
QACEPYQLPSLGVPNNGKHNPSPVTALSVLHQSSSFKQMLEKASAKKGKSDQDINA
NDNPENIQLEKGKGKIFLAEDTTGSKEFAYQPSGQTSTIFPFAQVQPVPPIQDCNTTVP
ASDSLWTNFVPATGGVALANAVSIC

Figure 347. Amino acid sequence of SEQ ID NO: 1310. The conserved AP2 domain identified using InterProScan is underlined.

MDRQRSDFSKQGQRFDLCTNMVGKMDLITDPQKSEGPDRQGFRFPSLVSNQNLGIFN
ASVQDVFEDSASSSSSPSNGDARLEGLDACQNLRMPEASLVSGNSEVLCSSSSFFPNL
PSNGFGHSDGLVWRPSFQGQNQYSGESIESAMVLYELLHVQQIQQIQQQQFQLQQQQ
IAAAASIHHMGRNPLGPRAQPMKLHGSSL<u>SKPAKLYRGVRQRHWGKWVAEIRLPRN
RTRLWLGTFDTAEEAAMAYDKAAYRLRGDYARLNFPHLKHHLEANSFAPWTGNSV</u>
LPSSVDAKLQAICQSLKQPLESMSKTEESEEISCAYENSGSLGSVRDEDAKKNDVVSV
KSETCDSDSSDDSTITALNSAGESESRSASKSETQAETETDTLCSMPSFSASSIWAELD
DYLLSIPPLDMDINWDVLS

Figure 348. Amino acid sequence of SEQ ID NO: 1312. The conserved AP2 domain identified using InterProScan is underlined.

MCGGAIIKEFIPANRSRRVTARELWPDFDTFAEFINGGATQETFNKPGKLDEGCKQKS
KPSKGSVKTQQEFCSGFEGGRSEVIPPLEDVEGSTPT<u>IGGRKRKNVYRGIRQRPWGK
WAAEIRDPSKGVRVWLGTFNTAEEAAKAYDAAAKRIRGKKAKLNFADNSCSVKND</u>
TSKKVSGKKGKLCSKHPALLLEGFNASCKVKPSYSANPDLLGGYNINRKVKASLSGV
GKSDLTICGYDDMEYGDSGFSKPSAPFQNNSNACTVQFSEHSNLTQTSKKSCSCEICS
HSYSEMSNVMPPAYGNAVNFEPVQTSNPGGYFDSDHSSMSFEGAHFPWAQEIKTPE
VSSICDDANESAFVDIKPVDNVVKAKPVDTPIEVDGGTDDCYKTQDGDGQFDKQLS
ALESYLGLSENSIAKANLCIEDAGRSAGSFPDEQCFLEQWFLDDLPNSGLRYPSSLGS
RI

Figure 349. Amino acid sequence of SEQ ID NO: 1313. The conserved AP2-domain identified using InterProScan is underlined.

MCGGAIISDFIPAKRSRRVTPRDLWPDFDIFADLFINGVALSESFNKSGSFDEAYKQKN
TPSKNFFKSKHEFSSDDVSEAISAFKDFENPPFKDSKKCSAKSNKRKR<u>RNLYRGIRQR
PWGKWAAEIRDPRKGVKVWLGTFKTAEEAAKAYDAEAKKIRGKKAKLNFADHSCS</u>
VKMDSRKKMSGKKVKPCTKDNNLLFGLNMNSEVKSSYSPKPDLLEDCSLQMDVRR
SDLPIYGYDDMEYGDSEFINLPAPFQSNSNASAVQSSEHSHASQTSQKSCSCELCILNY
LEVKSPYAVGYFDSDHCSDSSYGAHFPWSHEAKTAEISCVYDDGHESVFIDIKPPVH
GVVEDRPAETSIEVNGGTGSFAVETFMEINNGTECLAVDIPVEVNGGTECYKTKDSIA
QLEFCKGLSALESYLGLSESPNLNAPMDESIEAANKTPSSFPYDDCFLNPWIYDDLLIS
GSVY

Figure 350. Amino acid sequence of SEQ ID NO: 1315. The conserved AP2-domain identified using InterProScan is underlined.

MTTRTGSLMDLDGCCKGQGKRSAALRESEIDSPNVALSLACSPSQKIVSSAATAIHVL
GSQDQFARDESVELRTNEEMKNGCYTEDNQEDEMSSAMTEEFNCSVMGVSENGTQ
PKQETVAFKDLCSARSVEKNLHGLERMGSGISVLSVSGGESEGFEDPRRYSMSTEQA
GKLLSSQYKGVVPQPNGRWGAQIYEKHQRVWLGTFNREEDAARAYDRAALKFRGR
DAMTNFSPVGDGDPEVRFMSGHTKREIVDMLRKHTYDEELDHHGKRIKILAAQSAA
VNNAEASGGVAAHVCQENQGQLEGNGNVASSSSADAGRAGLPHEHLFDKAVTPSD
VGKLNRLVIPKQYAEKYFPLDVNSSEKGLLLNFEDNTGKVWRFRYSYWNSSQSYVL
TKGWSRFVKDKKLEAGDIVSFHRGSVQSDHLYISWRRRPPGQPRLGVGSQSLQSKGP
GVVYPLKEPPSMNPFNTVPHAAVVYDAQWMPIFWPSSSHPDAFAQFNSHFVSPVVN
KVDSLWSQSAATPLNSTLPFYFSASPTNQTIQSKFYDINSASCQPTELYLNYRNSLNR
GDEISTNLKPLHPFLNPARASEESETPEHKPSSTLDPATKKGVRLFGVTLPEAQRLSSQ
HH

Figure 351. Amino acid sequence of SEQ ID NO: 1317. The conserved Transcriptional factor B3 domain identified using InterProScan is underlined.

MPVPCTMNGPRITSMDSAHGYGLVMQRGADDGNPGLDSQLWHACAGGMVQMPSV
NARIYYFPQGQAEHSATNVEFSANLRVKPAILCRVLNVKFMADTETDEVYSRIRLVPI
KPNEAAMEDCSEDNDNAAANEKPVSFAKTLTQSDANNGGGFSVPRYCAETIFPRLD
YTSDPPVQTVLAKDVHGEVWKFRHIYRGTPRRHLLTTGWSTFVNQKKLVAGDSIVF
LRSLNGELCVGIRRSTRSTGGGDSSAWHLAGQQQQHGSCMSPYRSSSRWEVKGGDN
FSAAFFGGGDKSSANGNSNGFARNKGKVSAKSVIESATLAANGQPFEVVYYPRASTP
EFCVKANAVDAALRMKWTAGMRFKMAFETEDSSRISWFMGTISLVQCADPIHWPTS
PWRLLQVTWDEPDLLQNVKRVSPWLVEVVSNVPPIQLSPFTLPKKKLRVSQHPEFQF
EGHGIMGGLQMATLTNNVLGQINPWHGLSENVPAGMQGARHGHIYGVPLSDFHSN
KLQSGLSLDSFHQLEQGALSSTPVSTDLNIGCFSQLERSSVQDNLSCVLTMGNSSQSE
QKATKGRSTSSTTKSAPFLLFGKPIHTEQSPKSEQQQQSGVSSSDGPGFHVVNDSGSP
GLTSNSSTDGNPEVVDRLQRAMAGRSDTSKLSENYGLRLYCGETLESTVNNGGGNL
SWFKDRQVSLQTLENGSGGKTSEDGVVHCKAFLESEDVGRTLDLSLFSSYEELHNKL
AKMFGIEDSDLSNRVLYKDAAGVGRHTGEQPYGDFMKTVRRLTILSDSSSDNMGR

Figure 352. Amino acid sequence of SEQ ID NO: 1319. The conserved AUX/IAA domain identified using InterProScan is underlined.

MSCSVGNMAMVLEKSGGNAQHEKRDSLDFAETELKLGLPGVAAGARQRICGKRSFS
EAMESRNYTIPDEDITNTSTHEDLDKFKGPIVKEKQMALSANDPPRMGPPPPSKAQV
VGWPPVRDFRKVRTVAASNSLYVKVSMDGAPYLRKVDLKLYSTYHELTSALEKMF
SCLIIMGKCGSLALNESNLMDLPNGSEYVPTYEDKDGDWMLIGDVPWQMFVDSCQR
MRIMTASEAIGLAPRAMENCKNRNRVHP

Figure 353. Amino acid sequence of SEQ ID NO: 1320. The conserved AUX/IAA domain identified using InterProScan is underlined.

MSCSVVGSMGMALEKSGGNAQHEKRDSLDFAETELKLGLPGVAADESRAHQKSCG
KRSFSEAMESRSYTITDDDITRTGTPEDADKFHGPIVKEKQMALPANDPATTGSRPPP
KAQIVGWPPVKDFRKVRTISTCDSLYVKVSMDGAPYLRKVNLKIYSTYHDLSSALEN
MFSCLLTMGKSRSHGLNESSLMDMPNGSYVPTYEDKDGDWMLVGDVPWQMFVD
SCQRMRIMKASEAIGLAPRTMEKCKKRN

Figure 354. Amino acid sequence of SEQ ID NO: 1321. The conserved AUX/IAA domain identified using InterProScan is underlined.

MERFANDGDEHSLKETELRLGLPGVCESDTGLGQTRNGKRAFSEVMDSTKASSFND
NKWIFPSVKCQPPTSAITETAEACKGSQPGLFSATPGQKIMMQGGCGAPQSWAGDN
GLSRSTAPKDELHPKTPRDGPTEKTNATSQSQAATDPAKAPAPKAQVVGWPPIRSFR
KNTLAANSKPNDEGSSSNALYVKVSMDGAPYLRKVDLKMYSTYHELSSALEKMFSC
FTMGQCGSPGLSESKLIDLLNGSEYVPTYEDKDGDWMLVGDVPWEMFVDSCKRLRI
TKASEAIGLAPRAMEKSRSKN

Figure 355. Amino acid sequence of SEQ ID NO: 1323. The conserved AUX/IAA domain identified using InterProScan is underlined.

MGCLREDDDEHSFKETELKLGLPGVTEGSDEHRTGKRTFSKAFMESRNDEKWMSSS
SVKSTATAFEMSKSNEQGMLAATPPLSQLQRSFPPLSWKTGIQTDPSRVAVPAKEKQ
SGNSANGSEMPPPKAQVIGWPPVRSFMKNSLTFNSKTTEEGSSSSSGLYAKPTQTQTT
PDTTMAPAPKAQVVGWPPVRSFRKNTLAVNSKPTENGPSGSALYVKVSMDGAPYLR
KVDLKMYSTYHHLSFALDNMFGCFSMGKCGSQGLNEKKVMDLLNGSEYVPTYEDK
DGDWMLLGDVPWEMFVDSCKRMRIMKVSEAIGLARSMEKCKNKI

Figure 356. Amino acid sequence of SEQ ID NO: 3630. The conserved AUX/IAA domain identified using InterProScan is underlined.

MKMEVSMDKSLGSSSMSEESQEMTCKNAEKSLQLHDYIGLSEVSSHSMTNPPLPMP
CDPNSHLGEAELRLGLSLAASEWALGDNSGPEPNFAGALQNQAQAMDDGTKCGYG
LAMATGSKRGFNQAFGNRSEKQVGKGLLKLQMYEPSHPSGMAAQQYSSKPPQPSSL
PDEQSGVADSSSTSPKSPVVGWPPIRSYRKNTLAAQPMSFEDGDEEEQWEGVVETPA
SSVQSQGNSISLFVKVNMEGVPIGRKIDLNTHNGYKSLALALEDMFHRPPNFQENGFF
GPSKKSWLVEDCSDYLLTYEDKERDWMLVGDVPWGMFVSTVKRLRIVKTSEGNGL
GEGNGLGPNCSEKMNCRKTKAA

Figure 357. Amino acid sequence of SEQ ID NO: 1325. The conserved AUX/IAA protein domain identified using InterProScan is underlined.

MKSGVGSSRSNASSVTASTLTEHDYIGLSEVSSSSHTSEYTNTNNNGSNEKQTQESDG
SLGDAELNLGLSLSYKKEPLNAAAGFNGSEKAFQKWVSHEEYQRPRSTSVSQQGVW
AKAGFEHRISQEKGASSSSMFAGVQVLRSWEGARILTAEDLQAPPAPHTAVVHDVG
ERVRPGYGFSNSGRVIMPPPTAAPAAISGTKRIHNESDGSDGIQDSSEVSKGQAVVGW
PPIGTYRSKTRATTQPRSPLYVKVNMDGVPIGRKVDLNAHDSYETLALALEDMFQRP
NNGNGQSGSHIPMERGHVGANDPKHPRLLDSSSDFVLTYEDKERDWMLVGDVPWR
MFVNTVKRLRIMKTSDANGLAPSCPEKIDGQKSKAV

Figure 358. Amino acid sequence of SEQ ID NO: 1326. The conserved AUX/IAA domain identified using InterProScan is underlined.

MSSSAGVGSSLKVVDSSSSSSTERKYQSKFGSEGTGIYKEVSHSVSCSTESQVRMEIE
QNLKETELRLGLPGVLSPVREHTKCPASNEESSSSSELGALPAESSAPGDGKEAVSRG
KVGEHGSGEIPLLALAAPAAEWISVRRDVKSSGGAKRGFAEAMEGRKVFSGGKWVF
PVVTPGSSEVEASKAKFLQQQGQLASPKASVVQGAGSMWQQQQGDQYLTNSTGVS
NLNGNCKSIVMNDGGCSSSIGKEAAGQSKVAVQERSSQHGSSKNQGSAAAEVPPAS
KAQVVGWPPIRSFRKNTLAANSKSSDESEGKPGSNALYVKVSMDGAPYLRKVDLKL
YNRYQELSSALEKMFSGFTIGQYGSHGLPGRDGLSESKLMDLLHGSEYVLTYEDKD
GDWMLVGDVPWEMFVDSCKRLRIMKGSDAIGLAPRAMEKCKSRS

Figure 359. Amino acid sequence of SEQ ID NO: 1327. The conserved AUX/IAA domain identified using InterProScan is underlined.
MSSNINVYIEEGLSKAPTPASSTIADGSSQNNPGGLKEHDYIGLSEVSSSIESSVVSCDG
EENNMNLKETELRLGLPGSLSPARDSSELNLLSPLNIRTEVEEKNLFPVEKQQHSTKD
GVAEEKNGQDKYIIQPSGMGRNMMTVSPKNIVTGSKRGFSEAMESRNCFPDSRNNG
FSAEGKWVFPAQVGGVIVAGSEVELPKTTTQGKFLPQGLASAPGASTMMQGPTSWH
TGGLDHSGSSFMCSRSSNGTNLNGKSIKDGVASTGVKDIAQSKMPQERSRTESQHGT
NQKQVPSANNPGMAPAAKAQVVGWPPIRSFRKNSLAAPKSNDEDDVKSGSSALYV
KVSMDGAPYLRKIDLKLYNCYLELSSALEKMFSCFTIGQCGSHGVPGRDGLSESKLM
DLLHGSEYVLTYEDRDGDWMLVGDVPWEMFTDSCKRLRIMKGSEAIGLAPRAMEK
CKNRN Figure 360. Amino acid sequence of SEQ ID NO: 1328. The conserved Basic helix-loop-helix dimerization domain bHLH identified using InterProScan is underlined.

MMGSLQCNKWMSFLEDNLLEDVGQPANSFVWPGQAINVHPDCRPREESCDKHGLK
ACREKMRRDRLNDRFMELSILLEPGRPPKMDKSAILSDALSLVNQLREKAGELKDSN
ERLRQSNKELKTEKNELRDEKTRLKAEKERLDQQMKVMMTSSPGFMPHLAVAHAF
SAQSQAANNKTLPIPGFPGMAMWQWMPPAAVDTSQDHALRPPVA

Figure 361. Amino acid sequence of SEQ ID NO: 1329. The conserved Basic helix-loop-helix dimerization domain bHLH identified using InterProScan is underlined.

MMGSLQCNKWMSFLEDNLLEDVGQPANSFVWPGQAINVHPDCSDSKNDKEDREK
MCPRKRPREESCDKHGLK<u>ACREKMRRDRLNDRFMELSILLEPGRPPKMDKSAILSDA
LSLVNQLREKAGELKDSNERLRQSNKELKTEKNELRDEKTRLKAEKERLDQQMKV</u>
MMTSSPGFMPHLAVAHAFSAQSQAANNKTLPIPGFPGMAMWQWMPPAAVDTSQD
HALRPPVA

Figure 362. Amino acid sequence of SEQ ID NO: 1330. The conserved Basic helix-loop-helix dimerization domain bHLH identified using InterProScan is underlined.

MSSPQSNKWLSYFDEPLLDDVGVGQPANPFFWCGQGINDQPDVSVEIDGPNKDMDE
QDKLCPRK<u>RSREESSGGPGSKACREKMRRDRLNDRFMELSSVLEPGRPPKTADKATI
LSDAARVMTQLRTEAQNLKAENERLQEAIKDLKAEKNELRDEKLRMKAEKEKLEQ</u>
QVKAMALPTGFVPHPAAFHAAAAFAAQSQAAANKTMPVPGYPGMAMWQWMPPA
VVDTSQDHVLRPPVA

Figure 363. Amino acid sequence of SEQ ID NO: 1332. The conserved Basic helix-loop-helix dimerization domain bHLH identified using InterProScan is underlined.

MDTRLQYAGEIFKSDYYEDQNNKQWLDNIDEIAGQLDWDDSDPEMMGGSKPAGKI
NYLQAASKN<u>LYTERKRRKKLNDTLYTLRSVVPKISKMDKQSIIGDAISYVLDLQKTIR
EIESEIEGLRSSSKGDHTQTIPQTVNHLANAELVKRSVESSDTKKSMDKLKHAKVLQV
EICNGGEGGIYHVRIEGKKETGGLVKLTRALESLPLQIMNSNICCFDEAIHYSLTVNV</u>
KSLGNVNTAKLEDMIRKTTTSDCFE

Figure 364. Amino acid sequence of SEQ ID NO: 1333. The conserved Basic helix-loop-helix dimerization domain bHLH identified using InterProScan is underlined.

MLARENRSGDTEHDDLQGTLLTSYTGPQGGQTVLPRTPGAQSHQQNLSTQTIQSGEG
TSLQQYGNHSAVSQLQSGAGGGNAANGAARPRVRARRGQATDPHS<u>IAERLRRERIA
ERMKSLQELVPNSNKTDKASMLDEIIEYVKFLQLQVKVLSMSRLGGAGAVAPLIADV</u>
PSQGSGGVMSTALGQASGPLTLSQDGLAFEQEVARLMESNMTSAMQYLQNKGLCL
MPIALATAISSSSGKPVLATVPGTGVDSSEKQNSDMQSIVLPFSSSSTTMGLRATASGS
DAPINENSMNKASIEKVVAEKSNGISPGLSSDVPKVGSQSREELLKRAQ

Figure 365. Amino acid sequence of SEQ ID NO: 1334. The conserved Basic helix-loop-helix dimerization domain bHLH identified using InterProScan is underlined.

MEIMEEMIEIPRLNDNIGLNIPWLHGGLFRKRLTSSPLHNEPAGKQANMMPNMENYF
TRLVQGFEPGESCVTALSDLKPGGNNIDTFNAVQSHSETAEDGISDTTQEDQQNAISM
AVPAADAGKGRKRKRQKVSKNSEEVLS<u>QRITHIEVERNRRKQMNAHLDVLRSLIPQS
YIQRGDQASIIGGAIDLVKELEQVLQSLQFQKIKRENVDRTDPTNCLSILPPHQSSARC</u>
NSKCVVDTSSSQVRALEDKSSIADIEVTLIETHGSLKILSKKKHGQLLKIITALESFHMT
ILHLNITSMDETVVFSFNVKVEDECQLTSADEIASSLHRILRIVHAC

Figure 366. Amino acid sequence of SEQ ID NO: 1338. The conserved Basic helix-loop-helix dimerization domain bHLH identified using InterProScan is underlined.

MDSDFGVERQTFEAVPDSKSLASLHSSLSCSLNTMDTIFCDESRYSQKYAGEFGEIAT
QNAFGGATDSIISNVDGAFYADPSFAAKYLRKSSFSPVMAKESSNADGSGGIGVHNV
PILANSVQFHTAGVKNGVNATGWRNLDASHLGSEVSKFSIGSVPVPSALVQFPSDPG
FVEQAPKFSSFNNMDRNSSENVGCGASNLRPVVGAVQQGGETMSVFSEPNKRVDDG
IGKKRRAKSLTSVDNGKEQEEAKAKRCRLGENSEIDDDDNNEETSDSNSKKGKEKNP
KVAQKDDNYIHVRARRGQATDSH<u>SLAERVRREKINQRMKFLQDLVPTCNKVTGKA
VMLDEIINYVQSLQHQVEFL</u>SMKLATVNPKLDFNIDNFFAKEMSGSFSSKGMSPTYF
HLDQLKQASLQTVPSPGSDIPSTMSSVDSAEMFDGANFQRQEGWDSELQNMYNMGL
LQSRLQQHHQRPL

Figure 367. Amino acid sequence of SEQ ID NO: 1339. The conserved Basic helix-loop-helix dimerization domain bHLH identified using InterProScan is underlined.

MGSDAVSASRFWNEEDKATVNSLLGPNAFEHLMVSYVSSEGLVSGINDCALQQKLQ
NLVESSSFNWTYAIFWQLSRSKTGEVVLGWGDGSFKGPREGQEADQARGFDHRFAE
TDQQLKKKVLQKLQSFFGGGGEEENNFVSGLDNVSDTEMFYLASMYYSFPRGIGVP
GQALASGKCIWLNEPSKLPSNLCSRAYLAKTGGIQTLVCLPMEHGVVEVGSVEMIRE
SKHAIDKVRSSFNENACDGNRGQQAVKGSLVVPFPPNPMRVNAVNAKAAPPLKPSH
DWKIFGQELSKSTEAVVTKVEDRDRHYQPVFRPPYAHAASYVTNEQRIPYSTVNQN
GLQPPNWSHISNGEAGEIYNTRDLIKPSTILPLGVAGPSLNAVTARPSIMESEEHSDVE
ASERRPVVVEERRPRKRGRKPANGREEPLNH<u>VEAERQRREKLNQRFYALRAVVPNIS
KMDKASLLGDAISYIQELQSKVKD</u>METEREKQQQPQPQQAKSNIQDGRIVDPISDIDV
QMTTGEATVRVSCAKESHPVGRVMLALQRLQLDVHHANISAANENILHTFVIKLGG
TQTLTKDQLLEAISGWSPR

Figure 368. Amino acid sequence of SEQ ID NO: 1340. The conserved Basic helix-loop-helix dimerization domain bHLH identified using InterProScan is underlined.

MGSDGKEEFGFSMNYKTSGSPPSSNWQSAVANAAMNNVQESSLRVPTSSESLSSSFF
SLNWEPLIEQSIPFQSSLSPMVSPSPPATSLPSDSIAIRELIGRLGGNLCGVSGPLGSTMD
TVLNMGTAWNPLNSSPNLNLAVDPSKGGLSIQGAKHTPPNSLAQFSSDPGFAERAAR
FSCFGNRNYPELATPFNFPEGEPSYRSAAADNSKIPRVQSNQSLKSGLPINLPNLAETK
ESNASETPNEGSEADPRFTDRKISRLSRSSTPVSTDDMKQRLATSGNESDEAELSTGR
EESSCSDQIAGREPGSKTSNEINGRKRRVLSKAKAKDTPSVVACSGARETKSLEADES
PTKRYKVAEAGSNEKDDAKSKAEQSTIVSTGESSPKQTKDIVKTPEPPKDYIHVRARR
GQATDSH<u>SLAERVRREKISERMKFLQDLVPGCSKVTGKAVMLDEIINYVQSLQRQVE
F</u>LSMKLATVNPRLDFNMDGIIAKDMLQSHSSSPRMLFATDPTAAFPQLLPPQQGPVQ
VGVTCGTEGHRMGHPVEGALRRTMNPQPPCIDGYGDSIPQVANVWDEDLQSVVQM
GFGQNRQSPFTSQGFHGSVPTNHMKIEL

Figure 369. Amino acid sequence of SEQ ID NO: 1341. The conserved Basic helix-loop-helix dimerization domain bHLH identified using InterProScan is underlined.

MGNEGAASMRLWGDDNNSMIEAFMGNLDYSYSTFWNGIDANPSSLPSPAHFPSSAA
SVAIATPFNQDTLQQRLLAFVEGAAECWTYAIFWQLSSDASGGSELVWGDGYYKGP
REMTEEERETKKAASVAATAADQELRKKVLRDLHALINPNATGEADPAEFPGDDAT
VDGEVTDAEWFYLVSMMKSFGNGLGVPGQAFCGGMPIWIIGSEKLQSYNCERARQA
QQFGIQTMVCIPTPNGVVELGSTDLNPQNWDLIQKARNSFTFTFPDNLWEENHTQND
PDPALWLTEPPADPKTEPEKKQQQIPNVETEALHSFFPHELGFSDLGFLNGEGENTAQ
KVGIEEFGQKEDKSSSQGFTGSQVLYQQDWQAQTTCKTEVVEIPAFQPGKRGNTNGI
TLSFENPYGTQGLVSWGDEKMKRPVRNGNEDGSAVLCFSSEVAAASASASGTAVAA
SLPVNGAAGVRSSVDSEHSDIEASFKEAECSQAIVERRPRKRGRKPANGREEPLNH<u>VE
AERQRREKLNQRFYALRAVVPNVSKMDKASLLGDAISYINELRSKVQDSESHKKDM</u>
QAQLEALKKELVARESAASGFSGSNFGLLKNPAADPSNLDVKGFGSKNQCPNIELEV
RILGREAMVRVQCPKQNHPVARMMVAFKELELEVHHASVSTVKELMIQTVILNMTG
IVYAQEQLHAALLRKVADPGLR

Figure 370. Amino acid sequence of SEQ ID NO: 1342. The conserved Basic helix-loop-helix dimerization domain bHLH identified using InterProScan is underlined.

MAVMASANNSVIRKQLESVVQSIQWTYAIFWQLSNQQGVLEWSEGYYNGDIKTRKT
VQPMELSNEELCLQRTLQLRELYESLSAGESNQPARRPCAALSPEDLTDTEWYYLVC
MSYTFAPGVGLPGRTLANGRLIWLCQANEADSKVFPRALLAKSASIQTVVCIPLADG
VLEFGTTEVEREDPGLVQRTISFFLEYPKPICSEQSTSSPQCSDRDEKDQVGMVTIMSS
DSIACLARNQIGASTITDCGQYLPTSHEDLDIPIQTFELKDKISVTEDPQQHGLNESMQ
VDICEDYKASGSPEDQCCNGDPGSHEFPLLSAENDCLPNGHVNINSAGFEGWPYMED
NTSHGLQASGECVTQSIVDPSPQLCTYSERDMNMNMNMNMNMSVLLGLEQGSNAL
ETILESAPQTLDEDGHYSRTLSTILERQQASNLTESTGFISTKLGKDWRSRHSKQGSGF
IHWKNNGNCVVGIKAVASPQRILKKVLFNLARLHNKYKEDPGYSPKLGEEEIGSKLV
GRKIGQED<u>LSVSHVLAERKRREKLNEKFIVLRSLVPFVTKMDKASILGDAIEYLKQLQ</u>
RRVEELEASSKLMEAEIKKTQNRNLPKRSGSTENMRMTRHGVNHVDSCLQSSCLDG
ELGWTLTDTKQPPSKMPRLESKRKLNDFHKKGSCTLAAAAADLDVSVSVIEDDAVL
VEIQCPCKHGVLLDIMQRLSSLHLDTYSVQSSTADKIFAAVLKAKVQEKFRGKRPSIA
EVKEAVELVASKC

Figure 371. Amino acid sequence of SEQ ID NO: 1344. The conserved Basic-leucine zipper (bZIP) transcription factor domain identified using InterProScan is underlined.

MSPPPSYSMFPNSGMGLNPSVTSSEPSSQVSGSIPHQYSGSEEDPKL<u>TIDERKQKRMLS
NRESARRSRMRKQQHLDELRAEAAHLRAENSHMLTKFNIASQKYMQLEEENSLLRS</u>
YAMDLSLKLQSLTMAMQWAGVLNDVDLGSSTGFIDTTDIKSCYLPSISHPLASTEIYH

Figure 372. Amino acid sequence of SEQ ID NO: 1346. The conserved Basic-leucine zipper (bZIP) transcription factor domain identified using InterProScan is underlined.

MADTSPRTDDTSTDVDTDEKMNQQMDLVRHGGDSSDRTKDKNGDQKTL<u>RRLAQN
REAARKSRLRKKAYVQQLESSRLKLTQLEQELQRARQQGIFIGGSCVGGDQSHSMSG</u>
NGALAFDMEYARWLDEHHRQINELRSAVNSHVGDNELRVLVEGVMGHYDEIFRLK
TVASKADVFHLVSGMWKTPAERCFMWMGGFRPSELLKILVTHLEPLTEHQFMGINN
LQHSSQQAEDALSQGMDALQQSLAETLASGSLGPPGTSGNVANYMGQMAMAMGK
LGTLEGFVHQADNLRQQTLQQMHRILTTRQAARALLAISDYFSRLRALSSLWLARPR
D

Figure 373. Amino acid sequence of SEQ ID NO: 1348. The conserved Basic-leucine zipper (bZIP) transcription factor domain identified using InterProScan is underlined.

MGSRTMLSSNGGRTPQFQPLVRQNSLYNLTLEEVQNQLGDASKPLSSMNMDELLKN
IWTQEESQAISMAIGNGPMNGVPPNSAPASGGLQRQGSLTIPRTLSRKTVDEVWRDIQ
QSQGKSNEEKKPQQRQSTFGEMTLEDFLVKAGVVREDNNGNSNNNNGSAVTVGIAE
SPQPVSVCGVPTAGIGMDAMAAAQNLQQQAEWYQYQLNTAQQQQQQQQQQQQQ
QQNMMVAYGNKRPVPPNGPLGIPGNPLLEGGYGDNQLALSSPLMGCTSSDSQTPGR
KRGAPESIIEKTVERRQ<u>KRMIKNRESAARSRARKQAYTNELENEVMQLKEENERLKK
QQFLEKLLPSVPPPQPKHTLRRTGSAPF</u>

Figure 374. Amino acid sequence of SEQ ID NO: 1351. The conserved Basic-leucine zipper (bZIP) transcription factor domain identified using InterProScan is underlined.

MDHQFSFSPADDVEGNSMAVITEEEEEESPVVSGRMSRSASEWAFQKFLSFDGSKIPS
EDGEGEQKPLGVKDPLLHGHMDNVPAALSPLFAEVKDEVLLPTDPRDYEAFLKRRL
NLACAAVAFTRVTGISSPGPGPSTVDANQSQNTLGSERAASLVSQSSATDARALYVG
AASSTASGPIGIPALPPQPKSGNIQVRTTSGSSREQSDDDDQEVGPSEQSMDPSHVKRE
RRMLSNRESARRSRRRKQAHLTDLEIQVAQLRVENSSLFNRFTEINQKYNEASVDNR
VLKSDVEALRAKVKMAESMVPKAVAAATAGFPPQNSSQVQSAVGLRYRTGIFDSPA
TNVLQGEDGLYMNIAQSTGTGGSSLTCAISDMNQQTKELQIQPPGSKMGRTPSMQR
VASLEHLQKRIRGGMTCGSIPWGGAWDVDGSQVIEPSEH

Figure 375. Amino acid sequence of SEQ ID NO: 1352. The conserved Basic-leucine zipper (bZIP) transcription factor domain identified using InterProScan is underlined.

MGTGEEATPTKPAAKPSSSSQETPTTPVYPDWAAAFQAYYGPGATPPPPAFFASTVG
SAPTPHPYMWGGQPLMPPYGTPLPYPAMYPHGGIYAHPSMPPGALPYGHYGMPSPG
NAEVTTTLALPNAEAEAKSSEGKERNTMKRSKGSLGSLGMITGKGGEGGKATSGSA
NEAMSQSGDSGSDGSSEGSEEDNTQTESQVARKRSFDQMIVDGANAQSTNIQSYNSQ
AGEPYVTSGGHAMGNPISQAVAAVPLGSVTGKPATSGPITNLNIGMDYWNATPPGAI
TTVKGRGSTAGISTAIVPATAQLMPSGRDGVPPELWIQDERELKRQRRKQSNRESAR
RSRLRKQAECEELATKVETLTVENMALRNELNRMAEECKKLTAENASIMEQLKLNG
QDMTTITEENGSTKISLQSVKPEGNGHFHDISRGINSNSTERNEQRQSETCDSNGKVH
TLLDANARSDTG

Figure 376. Amino acid sequence of SEQ ID NO: 3631. The conserved Basic-leucine zipper (bZIP) transcription factor domain identified using InterProScan is underlined.

MGTGEEATPTKPAAKPSSSSQETPTTPVYPDWAAAFQAYYGPGATPPPPAFFASTVG
SAPTPHPYMWGGQPLMPPYGTPLPYPAMYPHGGIYAHPSMPPGALPYGHYGMPSPG
NAEVTTTLALPNAEAEAKSSEGKERNTMKRSKGSLGSLGMITGKGGEGGKATSGSA
NEAMSQSGDSGSDGSSEGSEEDNTQTESQVARKRSFDQMIVDGANAQSTNIQSYNSQ
AGEPYVTSGGHAMGNPISQAVAAVPLGSVTGKPATSGPITNLNIGMDYWNATPPGAI
TTVKGRGSTAGISTAIVPATAQLMPSGRDGVPPELWIQDERELKRQRRKQSNRESAR
RSRLRKQAECEELATKVETLTVENMALRNELNRMAEECKKLTAENASIMEQLKLNG
QDMTTITEENGSTKISLQSVKPEGNGHFHDISRGINSNSTERNEQRQSETCDSNGKVH
TLLDANARSDTG

Figure 377. Amino acid sequence of SEQ ID NO: 1355. The conserved Basic-leucine zipper (bZIP) transcription factor domain identified using InterProScan is underlined.

MEEMDSSYGDLMQRLQSSIGTSSSFIPKQQLNKSEPSSPAVSQTRPPFTSNIQNFNPGS
KRQGIPPSHPHFPPTSPHSQAFYSQMPVLQSSVQQNSQNQQHSNASPNSLHTRSMSQP
HIFNLDNLPPLNPCSYRDPSSPSLSDPVSGDVSMEDQEGSSAVPSISPHNPPSLFSGSRR
SQNHMSDGLPPRKGHRRARSDNPFTFMSGSQSLSGDIQQGFGSSLETASVKGTAQMD
HLNQYVSSLEREKPKAQAVKTELNQERNSIQNVEGTGEGETGKGGGEDMVSACIDV
EKINNLNKSRPASGELPDNLNGAQEDSGGSSVKQKNLKDGDQFTSSDEADSEVNEFN
IMKRSNSGVGYEDNKRSGGQGDGNQYRSRHSRSISMDSIMSKMHNFSEDLEQEPSQ
GRNVRHSHSNSMDGSTNFNVEFGNGEFSASEMKKIMASEKLAELATVDPKRVKRIL
ANRQSAARSKERKMRYISELERKVQTLQTEATTLSAQLTLLQRDSAGLGSQNHELKL
RLQAMEQQAQLRDALNEALGEEVQRLKLATGQLGAGQSGSLAQQMSMNSSLFQLQ
QQGPHHPLYQMQQQQQQQQQHQVQYSQQPPGKQTNRNEILQTSYTSLPGPVGSSSK
PDNSNMSASQGSDCSF

Figure 378. Amino acid sequence of SEQ ID NO: 1357. The conserved Zn-finger, CONSTANS type domain identified using InterProScan is underlined.

MPKPCNVCRIASASLYCRADAAYLCSGCDVKVHGANKLASRHERVWLCEVCEQAP
AAVTCKADAASLCVSCDADIHSANPLARRHERVPIVPFYECVSVAKAFLPPLPQTSSL
QDSDAPGTLDYDDDEEDDEIYAAEAASWLLPNPKASAEGTKNCDDGVSCFGVDAGP
NKAAGGYFSVVDLFSDVDPYLDLDYASSFEATGGTDSVVPVQSNGSSHDGAVSTPS
DCFETDKAVYSYTTTTSFSHSVSSSSLDVGVVPDAMLSDISRPLNGGAALELANPGA
VHVGVQYVQADREARVLRYKEKRKNRRFEKTIRYASRKAYAETRPRIKGRFAKRTN
ADVVQMYTSAEFGYGLVPSF

Figure 379. Amino acid sequence of SEQ ID NO: 1358. The conserved Zn-finger, B-box domain identified using InterProScan is underlined.

MRTLCDSCEAAAAQFFCAADEAALCAKCDEKVHGCNKLASRHVRLQLRESWSIPRC
DICETAAAFLHCSIDGSSLCLQCDMDVHVGGKRTHVRYLLLGQRVELPNGNNMQLT
NGSHIRDEHGNPKTMETARAWQKKYCQEHYRNGDPSHNNISNGNIHNVASCNKEN
VQSNGQKD

Figure 380. Amino acid sequence of SEQ ID NO: 1360. The conserved Zn-finger, CONSTANS type domain identified using InterProScan is underlined.

MRIQCDACEQAAASVICCADEAALCRECDIKVHKANKLASKHKRLPLVGTSPKLSRC
DICQDRAAIVFCLEDRAMLCQDCDESVHSRDTLAAKHQRFLATGIRVGLNALSSESP
GSSEFDKQPSSISNPTAPTHATPRMGSTHSSSAKSIPLGEPCWSMDELLPISDFESKGDP
EGLGEFDWEVDGLDHLGLFEQQQEQEEALACRVPELVPPDLQEGGPTFTVKGKSKA
EIPTVPDFDEACIVPDIGSLD THE FYPTPQLKRARRSSFEAW

Figure 381. Amino acid sequence of SEQ ID NO: 1361. The conserved Zn-finger, CONSTANS type domains identified using InterProScan are underlined.

MKMKVQCDVCEKAEATFLCCADEAALCSACDNNVHAANKLASKHQRVSLINPSSQ
SPKCDICQEKTGIFFCLEDRALLCRQCDVSIHSLNNLVAAHQRFLVTGVKVGLEPSNT
ISPSTKTSTQSSDITNKKSQTLRNGPTEVSASLHQGVQKGIGGGGISRRGTVSEYFSDL
LPLWRMDEFLNLPELDNGYGFGEAGSSRADNANFVEEWPANSFSTEEDNSENCLAQ
VPEMASPPTASGLYWPRKIICQPKEGKRREDLTIFGFDDASLVPDIGCRSSPPDSPLSK
RRRLHA

Figure 382. Amino acid sequence of SEQ ID NO: 1362. The conserved Zn-finger, CONSTANS type domains identified using InterProScan are underlined.

MKVQCDACQSAEASVFCCADEAALCMKCDSKVHDANKLASKHRRLSLLEPSSSSSS
DSLICDICQERRAFFFCQADRAVLCRDCDLSIHSANELTAKHNRFLVPGTRVSLKPIET
LAAPEKAVATATVTKALIPPVQKMPDHAQPSMDLPVETVTASTSNSEFSQYLSEVEQ
FLTSASPERLDWGGSAEAHAIGKYMESAWAPNLGLLPEGFYGDSLAEVPHLPSPTTD
SGFCMYGQFGITMKPKAKQQVQNVPYFLAGFETGDDNFTVPDIVLPPSAKRMRMSN
TTLHDQQFFIL

Figure 383. Amino acid sequence of SEQ ID NO: 1364. The conserved Zn-finger, CONSTANS type domains identified using InterProScan are underlined.

MVKEEDKDWHNVEGWDRGSHVDHKEFLRGIGGWRMSMPKLCDVCQVSSSVIYCR
AHTAQLCLVCDAKIHGGSKASLCHERVWVCEVCEQAPAVVTCKADAAALCVACDT
DIHSANPLASRHERAPVIPFYECPNMPTNNTVTHANNDNLDCNVLLNEDGGGDDPLK
HDYVDDDYDDYDDDENDQNNLLNNQEDNNDAEICCAEEAATASWLIPEANRNNLT
IINGGNSEGEDKMVKDKLKFKAYMQSMDFLQDVDNYADLEYLGTTTITTPINPTAN
MGADSMVPVHTPEVIEHSSTKVSIDTAGSMDVDAASKCNHVYRTTSLNHCVSSSPID
VGIVPDSNITSDISTPYHDPRGVFEIPPRVVHPGGQGEVMGREARVLRYREKRKNRRF
EKTIRYASRKAYAETRPRIKGRFAKRTEVEVEQIYSSSLLPDQGYGVVPSY

Figure 384. Amino acid sequence of SEQ ID NO: 1365. The conserved Zn-finger, CONSTANS type domain identified using InterProScan is underlined.

MDEAAPAKAPLPCDYCGEANAVLYCRADSAKLCLPCDHHVHSANALSKKHVRSQL
CDSCKDEPVIVYCAADDAVLCQECDWDTHGGASTGHHQRHSIEGFTGCPSAEILATK
WGFDLSDKSLNNSASPLGLTDPQCGNSLVWGTLDDSLDCIVSGRMKADPVDSWLCT
PSSALQDVLVPNPNLGSVVFPTPGKQQNHPLCGKQKQLIFEQLLELMKREGSTENPE
DDEEEGKPISRPGTPNQHQPIHPALEVNDAGNQNPSQGEQRSVEAIRPIPSSSLLILQQ
NGSDRATEQDIIWNRSSGNQASQGWDLNAHNATNCEGHNVDRYNVADIDFSNFKSY
SDLLENACNDSVISLENISTMKCSPKHATGPSLQYFASHDACAIQPTGKWLSNLPGSV
GQVPGSPRVPIETACLGRSAGELNGNDAKPPTKVDDSGLASTTAKLGKDTISPDCDH
NVSSLFKGDPGRNTTKLDSEALAQARGNAMLRYKEKKKTRRYEKHIRYESRKARAD
VRKRVKGRFVKADKECDQDALGSSN

Figure 385. Amino acid sequence of SEQ ID NO: 1366. The conserved Zn-finger, CONSTANS type domain identified using InterProScan is underlined.

MGTM<u>CDFCGEIRSTVYCKADAASLCLPCDGQIHGANALSKRHLRTLLCDGCSVEPA</u>
<u>AFSCNNHKLSFCHNCDRQSHSNAPQHKRKSISYYTGCPSPAELAELWNCELDRQGG</u>
DDKQGSSVPGTRWGNSGKEDVSLETLLASGIDVGFTQKFGPWMEPSVSSKVGLPPSS
QRNSNVNTRIFDSEGSEGTMKTCEEQQQQSKQKHAVVQQLLDLQKSQHLALTEVQN
HQEVQAYVPPQVQGEVQSMESSLSRSLEDDFQIQSQHLQRQQKDQQQMKQNFQEQ
KMQGVSLVIPESEPLKSDTNMEMAIQGDSFWRCSAASQTNQLWDQNMQDLGICAD
DDCCDALNMSDVNLIFENYEDIFGGPQVESSSMFEDLEAACSSMDKVVSVADPSECN
NHNLKASSAPAGCYAVLSSQGAGKEGETSRPITGRTVQGAPGPNVPSNIRHYVQPAP
ACLPHSLSSYSGDGDVADYHDCGVSTMFLKGEPPWGSTNTDSAFLNARGNAMIRYK
EKKKARMYDKKIRYASRKARADVRKRVKGRFVKAGEAYDYDPLATTGFY

Figure 386. Amino acid sequence of SEQ ID NO: 1368. The conserved Zn-finger, Dof type domain identified using InterProScan is underlined.

MMKDQEEMGGMEGTADMMDSYPPRQLLDRRLKPQ<u>ADQEILKCPRCESTNTKFCYY</u>
<u>NNYSLTQPRHFCKTCRRYWTKGGSLRSVPVGGGCRKNSKRNNSNNNNGKRSSGEA</u>
CSSATGSDQLSPSLAGVSNDCKYYNGDGEELIGINYVNSLRQVDHEAAFAGCSINSG
VYGIQANDHQSSQSFQPYHLPTALQSLQGSLILGSDQAPNGFNQAANRGDLGLVQQQ
AAGAVPYDREAYHPYINMSLDQSDGHSRAPQQHKGNNIIEHPPQGIVYEGGYWNSG
VWPDLSAYGLSNINPNSM

Figure 387. Amino acid sequence of SEQ ID NO: 1369. The conserved Zn-finger, Dof type domain identified using InterProScan is underlined.

MMLSPVQVCMDSTDWSQGMMQERGFRPSGEDLLSCSRPLLERRLKP<u>QPEQALKCPR</u>
<u>CESTNTKFCYYNNYSLSQPRHFCKTCRRYWTKGGTLRTVPVGGGCRKNKRAKRSV</u>
AADQPVFSTQSEPSTSGAPSASALPIGLDHQADLNPATNSSSYFNLAANNTPASTEAN
LAFARMQQAARQGGRSVLPNCSNSDFLGLSCGSSTQSSFGPQNSLNNLNPISSLTNLS
ALSALNSLKFSFAGLEDFHGNSNRSDQGSLAVPSEWQLPSETTLFEQAGDSTNYWSG
GAWGDLTSYGSSVSPQI

Figure 388. Amino acid sequence of SEQ ID NO: 1370. The conserved Zn-finger, Dof type domain identified using InterProScan is underlined.

MNLALAPEMQVSSSSFEGIPDMAVAVQNLGGRRSKP<u>HPTQVQKCPRCDSLNTKFCY</u>
<u>YNNYNLSQPRYFCKNCRRYWTKGGALRNVPVGGGCRKNKRSNKRNSDKRPAASSA</u>
PPASAADNQAAGGASAASSSSSLVNGSDRSSIGFESDCNNTTTSTTTTNTGGATGTPA
GVSSGQLFDGMNPINPPPPSLDPQARGALLNSGNNLSSILDPSAYENAQFSCMDPVISS
TPDWSRGLSMPWKQQQTLTSLLTDGIRTSLDGFLSQPPPLLEDINSLAEAATRSVFGV
KTSAATVPWPSLQDDDNIKAQSLQGLEWQTANGNSTSDAGLLEIQSDLGPWGAGSW
PDLGNYGPGSSLP

Figure 389. Amino acid sequence of SEQ ID NO: 1371. The conserved Zn-finger, Dof type domain identified using InterProScan is underlined.

MVLSSVEVCMDSADWTQSFLQNSALKLPEDLMPCPRAPPMMERRIKP<u>QTEQALKCP</u>
<u>RCDSTNTKFCYYNNYNLSQPRHFCKTCRRYWTKGGALRNVPVGGGCRKNKRAKRA</u>
VDHPVSAQNEASTSAAPGNEVPDRSPFEPPSSKSIYYGGENMNLTGLPFSRIQQDRAA
LAHCNSSSFLGMSCGTQSASLEPHLSALNTFNSFKSNNPGLDFPSLSTDQNSLFETSQP
QLSRAMASALFSMPMAPGLEDPADFHWKLQQQQQKLSFPFGDGQIENGPGSEGHDF
LTYEDSSKDDQKPEVVTKLPSSSVKVEEDQNALATDWQVPASEPLFAGDSNSYWNG
GSWPDIASYGLSVCPLI

Figure 390. Amino acid sequence of SEQ ID NO: 1372. The conserved Zn-finger, Dof type domain identified using InterProScan is underlined.

MSKDCVVVCLSGNDRIHGHADEKGFDPGFKLFGKTIPVRAAEEIKQEEPVSGQQPGS
HKEQSLEGEEEVQQETGSSSEDGKDESMNEGKSEGQKTVLK<u>KPDKLLPCPRCQSMD</u>
<u>TKFCYYNNYNVNQPRHFCKNCQRYWTAGGTLRNVPVGAGRRKNKHSV</u>AASTVSSH
YRQVISAASECGLGVRTDDQDSGVDQVMIPCAALPASCVRPLKVAGSRIQVVPVDVL
ESGASTGTVLNFGSEARNKTQRGGDNDPSIEKSTMESSSGFGKEATAHINQAAPRPQ
MDPSPNWANGAAGAAFFGGAWSYGWNFPNPAWNAAAAALTPGWPGLSWPMVPG
SYFPPPPPPAGWGPAPWVSGPWAAAAATTASNSPAVADSGSPTLGKRPQSEDGCL
WVPKTLRIDDPGEAAKSSIWTTLGLGDKPESAITSGGIFKAFQPKTQGAKDSRKASQA
LQANPAAFSRSLSFHESS

Figure 391. Amino acid sequence of SEQ ID NO: 1373. The conserved Zn-finger, Dof type domain identified using InterProScan is underlined.
MVAVNAEIMPKFEGKSAKSLDSTFKLFGRTIAVKNPCDSSSNGIHVDGIPAEAVNSAV
PKASETHHHDEKQKQNEDSEKVGK<u>KPTKLVPCPRCESMDTKFCYFNNYNVNQPRH</u>
<u>YCRRCQRYWTAGGSLRNVPVGAGRRKNKPCFG</u>INHRQIMDDTETGWNDVQGQASR
GNSDKLVKVEPFYPEFEKFREGLNEAATPKEGNSKPQSIIQSQFDDYSHPSTVNLARE
KVGKEVLFGSGNQVGAMGWPGNSTHLAKEPENSTHVANEPGNFTHMAKELESVQK
PSCSSEKTQTSATKADSAEPVDDLTSDSNLKSEPKNMSPDGSSSSSSSMNYTGSPWPV
YYNGCWGSFPPGVEGSEKNRVPWYTPSTGFLPTGLNWPVPSGVMWGLPWMAGND
NSESKTLGKHQREETPQAVPENKNRSLWAPKTLRMDDPEEAARSSFLTNLGLENKK
EGSIKSGEILKGFQLKMDNKDDKRTTSVQVLCANPAALSISSSFLESS Figure 392. Amino acid sequence of SEQ ID NO: 1374. The conserved Zn-finger, GATA type domain identified using InterProScan is underlined.

MLSDMGMDIARNNSSFVGFPGLECPIEWGEAAKSFDFSSIGDVFRIEDLSEFSNEDIAG
PIPSGSLSSLSSPGSSQNMAKHTVCASFLNEGDFICPPYEDGIGLEWLSDFVEDSFAAT
GSSNSGSLADLSKDKIDDNREKKKQNPTDEAIIPEIPPIKETPRSQRAVPGRARSKRRR
SSGAPIRGWSTSEDYALQNEGGMKTVTGADAINHYQSSAPQQQ<u>PRRCTHCLSQRTPQ</u>
<u>WRLGPLGPKTLCNACGVRFKSGRLFPEYRPAKSPTFIRYIHSNSHKKVLEMRNEETN</u>
DLEGLVFDPHLSDSKHQDQGLLKVKIKLAGLDNLSSQSN

Figure 393. Amino acid sequence of SEQ ID NO: 1375. The conserved Zn-finger, GATA type domain identified using InterProScan is underlined.

MDFQTAPLYCPDTSEAWGAVGEAFHIDDRLDFSNDDIGAPIQNDEENSSESTEVSAGS
AEANYSSVTQVTEELPAAELCVPMDTLADLEWLSTFVEDSFMPELPSACGPTSEQVP
LTDGNKTASDDNDEPKPRSCQASFLAACNKWIPVKARSKRSRTGGRVWSFNGPPVR
RVSSFNGPLLPPNPSVESDGVVFTQSSDSSCSESSQPRPAKKYKKTHSKKAQDGSQPR
RCSHCLVQKTPQWRAGPLGPKTLCNACGVRFKSGRLVPEYRPAISPTFLSEVHSNSH
RKILEMRRQKEEEQQRPELTSQTCSSGANESFSDNSLPSEESLLV

Figure 394. Amino acid sequence of SEQ ID NO: 1376. The conserved Zn-finger, GATA type domain identified using InterProScan is underlined.

MSDTDNLDPESRVIHNNHQHHSFYPDRQAPIHAVNAHAHVAAHHAPMHGILMQGQ
NEGDPHRHQGAQFQGVDSGHMHIHYMHSDEHGHPLHHSNDNGAGEEQDEGDGDN
NCMEEADIQSDGDNLAEPQSVVPVRSQGTNQLTLSYQGEVYVFDMVAPEKVQQVLL
LLGGREIPNSMAGMPIATLHHQKGLSDVSHRLNQPQRLASLTRFREKRKERCFDKKI
RYTVRKEVAQRMQRNKGQFTSYKSDSKDLVSAGHKWDSAEGWAPNTNGTQQEAV
CLHCGTGERSTPMMRRGPVGPRTLCNACGLVWANKGVLRDLSKSSTSLGSQEQSQS
SHEQNDGGPGSQETELGE

Figure 395. Amino acid sequence of SEQ ID NO: 1377. The conserved Zn-finger, GATA type domain identified using InterProScan is underlined.

MEAADYLYGTNYGTPFLDGKKSSGKFTELKNGVQLQDFFHIDDLLDFSNEEIAGPIG
DDDNNWASCTTTTAAAAVATDSSTITLAETVSCNSSLDGKSFRAYNVLETDANNNG
HLCVPCDDLAELEWLSNFVEDSFSTEQAPKPIFPPNFGDVRTDKEEEKPHIANPIRSTS
PLSGLDTSSSSWKTPSFSPETPVPGRARSKRSRAPACNWSSRIVSPASSASALENGPTS
SVLSSDSEFFAESYFPAKKPAKMSQGNKKREQDQQTQIRKCMHCDTTKTPQWRTGP
MGPKTLCNACGVRYKSGRLVPEYRPAASPTFVVSKHSNSHRKVIEMRRQKEMQDAL
QQASKLYPNDKEGNEDGDEYEEDEDGSDGQYPHFGSDDDTYLVHTNQDYRHFI

Figure 396. Amino acid sequence of SEQ ID NO: 1378. The conserved Zn-finger, GATA type domain identified using InterProScan is underlined.

MGKQGPCCHCGISTTPLWRNGPPEKPVLCNACGSRWRTKGTLANYMPMHSGGCGA
NGSLDYKWPRGKKVSQKFKEQRSHKRKEPCDIHQDMEFTVANSNQHHGIFLDEDAS
TRSSSVSGLSYSEGCMQHPGAFEKYSTVAWDSPVPSKKRTSMFRQRPSSLENLTKSV
QVSHGQDLSYLSSSSEHDLLYECKDQIITPEIGLGGVFIRQPHSATREEESEASSLLIDN
KGYSKFDVSNQAYSGVGDTRVQIWGDDITRSERWMEMKELKKLLQSCHSPLISIELE
DVVNFDTFMELLKEDEQRHLVKYLSSVDHSGLPESLKCMFNSGQFKGALSNFQHLL
SEGMFGTYGSRLSPQVERLFQQLLIVTDLTNSQWIERYSKLHKDVDSKCVNFSEIPEY
KESTKTKDFGLPAYSVSKPWKHATHKAFMSSPGQLSSQVITGSEKSTRNTDNMQIGG
PNTVNPVTPAWASCNMEGICHESIDTGSTSKDAAGFEIKPKGSPSLGASSLFSSPSKRC
SSFVFDSLGDFADEDSDSVLLFDVPSNLSFPQAELLHTPVLKCKAPKDIVSDASNLEN
SNSGGPVVNSEESPDWGSLLWNSS
FIG SGQTLSGGTVLNPDKTHL

Figure 397. Amino acid sequence of SEQ ID NO: 1382. The conserved Zn-finger, C2H2 type domain identified using InterProScan is underlined.

MMNIMKNCSIDLEGSESYFSEESVISQQLSASNVSAGLESSLFSQQQHQPHYMFQVQE
NVPKSGEKSSTEDFKLEETSEVSLNLTIGYDDEGGGTVREGKDLQTSNFIDYFGQSNH
TEEAENEHDASVDTKGPLESSNEVGHPTTYPESSSLSAQGSEPRVFS<u>CNYCQRKFYSS
QALGGHQNAHKRERTLAKRGQRIGAFQHRYISMASLPLHGSTESATGQMNRSLGIK</u>
AHSLIHKPPYAEPSLPLSHHGWSRPPIEQHPAVGKYVMEDMGSSRMIVGNRGGVARF
ENNNFGAGRILGANPFLHEEPASFCWPGSFRRMQQQSQEGGSYHTQNHETSSNAFYL
KPQDDISKLDLSLRL

Figure 398. Amino acid sequence of SEQ ID NO: 1383. The conserved Zn-finger, C2H2 type domain identified using InterProScan is underlined.

MVNANRYLAARGFKSANKMNTKSDNLHQYTSLGTVAAAAGAANSVSFTESNKPLE
APINSISSPSCVPLAIPCTDSFVGHQVPRSHAANDVNINDQNRVFFQQLQQPPKEYGGS
PPLREELPLLLSLSPPREKRSGEERFRSDPEETAMVSLHIGPPNSLCEKSEPSLKSTDSS
DADKESVIVQGRSEGRTRFSESQYWIPTPSQILIGATQ<u>FSCPVCAKTFNRYNNMQMH
MWGHGSQYRKGPESLRGTQPTAILLRLPCYCCTQGCRNNIDHPRAKPLKDFRTLQTH
YKRKHGIKPFMCCKCNKSFAVRGDWR</u> THE
KNCGKLWYCSCGSDFKHKRSLKDHIRAFGQGHAPIAPDSFEDEEDLGSEDEVSVLSH

Figure 399. Amino acid sequence of SEQ ID NO: 1384. The conserved Zn-finger, C2H2 type domain identified using InterProScan is underlined.

MAATTYLAEEEEGEDYFFQFRSPDMDREPPHFVSSISSAIKGKRSKRSRHGLPPLPKSE
FTAQQEQEQEQEPDQDQDQDQYQDQEEEDEQEMAARCLMMLLADGSDRHSHSLTT
TSSSESPAPSTLHPIRRRIKKPKRYDAGNADFPYSQEWDDGFKPEMMIRSYACKSCNK
KFPSFQALGGHRASCQLKDSKSSFPKLLVHNQSDEGFKEAASASASLPRPPVETYKQS
LSNEIKKVRVHE<u>CPVCHRNFPSGQALGGHKRTHSSPPATSTNNSSSLSITEQQHLSAM</u>
RSTPELDLNRPAEDENDCTQVQPSSAVSVSLGGDFLNSTDWPPYGYKFMSYKSPQP
WWMESHQPGVVKEDEADSQFMSNTGFARGRDLGCKQTGLPLITTVN

Figure 400. Amino acid sequence of SEQ ID NO: 1385. The conserved Zn-finger, C2H2 type domain identified using InterProScan is underlined.

MQKPEEYGLAVLSQREFSYLETMNMRRYHADIGGSPAPMTAHPSISFTEWLKPKPSS
GMLAASDLPMAIPCMETFDPRSNLTTYIPPSALYSAHSYTPQTLDQCPPQLPERCDSPP
LREALPLLTLSPSRNPTDHNLERHDRKDEEDHHDHDEELNDNVTVALHIGPPSTNSY
NYDNNSGAAVSFKADHQSGSNYSYDHAADKEKLRAGRVPEGQYWIPTSAQILIGPT
Q<u>FSCPVCGKTFNRYNNMQMHMWGHGSQYRKGPESLRGTQPTAMLRLPCYCCAQG
CKNNIDHPRAKPLKDFRTLQTHYKRKHGMKPFMCRKCSKSFAVRGDWR</u> THE
KNCGKLWFCTCGSDFKHKRSLKDHIRAFGHGHAPQGEADNYSFEDEEDQGSEDDEL
SGGSQ

Figure 401. Amino acid sequence of SEQ ID NO: 1386. The conserved Zn-finger, C2H2 type domain identified using InterProScan is underlined.

MPGLTCNACNAEFNEEAAQKFHYKSEWHRYNLRRKVAGVPGVTEALFQARQQALA
EEQKRLESNRMLYS<u>CSLCGKEYRSVEAHAQHLKSKAH</u>IQRASETPASRSAGITVIKPL
PERAANRSSFVSKPSSSLNEDKSEESEGSEEWEEVETYDMVSVASESMKSLDVNESSL
GNAGGSFQSIAEKLEWDASCCFICDFRPDGTIESCVEHMHKMHGFFVPDAEYLKDLR
GLLSYLGLKVTNDFMCLYCNEKRKPFPSLEAVRKHMISKNHCKLHYGDGDEEEDSD
LDDFYDYSSSYADESGMQIVPTEENLNVNIELGFGGAELVIQRKSENGTTCKMLGSR
EFLRYYRQRPRPTVERDVALSRALVSRYRSMGLATVQSKEKILRRNALKKIQRSGVE
AMRTKVGLKNNVIRNLPNNVPY

Figure 402. Amino acid sequence of SEQ ID NO: 1387. The conserved Zn-finger, C2H2 type domain identified using InterProScan is underlined.
MPSKRQRPEGEALIHCNKAASASASASPLYTDACQDRDAGTSTRACILKEGEKKENI
GAALFLNSGYPNENLASLQYPTETSMGEEVAQEECSNHLGSTSMEIKNKKETVTVTN
PKPLQRSFSTTQRDYHQQKDQCSEEVTDEAAEGRCKREKSMKLFGFELRQKKVEAE
NRSSGSAHHDDDNKVNEEDVEGEDRSSAAQAAESGSNSASDSRKYE<u>CQYCCREFAN
SQALGGHQNAHKKERQQAKRAQIQASRSAAVAAAHAASANRAGNAGAAAVAVPG
FYGMHRLAGSALLTPHSGRMTVLGGEIPPPSPAPRFPAPVIASTVPHYLDYQNHQQPA
GMGFGSALRPASVRPSWFYVPQTGQYGFSSMSYGDFGCSNMYSVNPQFPTATAMPS
IQSRHCSTDNRYLMLQPQPQPQPQPQPQPQPAISEFEAPGRSVSRPLSQIGVSRIEA
GNSSSVHHESSTGVEDSSLDLKLGLGPTRS Figure 403. Amino acid sequence of SEQ ID NO: 1388. The conserved Zn-finger, C2H2 type domain identified using InterProScan is underlined.

MSSLASPSVDASASSSNRGDGNSVQQQLASNADPNSGVQAVPVKRKRNLPGNPDPD
AEVIALSPKTLMATNRFV<u>CEICNKGFQRDQNLQLHRRGHNL</u>PWKLRQRTSKEIRKRV
YICPENTCVHHDPTRALGDLTGIKKHFCRKHGEKKWKCEKCSKKYAVQSDWKAHS
KTCGTREYRCDCGTLFSRRDSFITHRAFCDALAEESARVSGGITLGGHGQLLGVHSSD
SLGQRGAPLPVMGTSNSSHHLVKELPQSLHSTISSRLAFSESSEPASSNAAGALKPRLP
LWLAPGRGPPGGHSQVNTMEAAASEFLDAQSPKSMLQVMPPPPKYDYSQGQKPLSG
LLPLTSSNTGSGNLYSMLFATGSGQDQAMSSSGNIERSSVTGATDFGPRGTDWTDRG
SAGLTSNSSGNTNGNKVDSLPSLPYLYGQHSNSGTGTAQMSATALLQKAAQMGATV
SSSSLLRGCGSDSTPFGLGLCWQGSSQEKQREDQMSGMASSFVNSHALLKGHPDVT
AQSNSFAAGNTRFSENAALQQVISSLSEGFMGSLYERDFNTIHHSTFGENIGTIRRSPQ
QSVMQGTHPLISATMRNLNARTEDGSDGLTRDFLGVGGVNPMITAATEGSCMGRSS
LLNICSGMDSYSNHGENLTSIRTDVSQSPAKSWDAS

Figure 404. Amino acid sequence of SEQ ID NO: 1389. The conserved Zn-finger, C2H2 type domain identified using InterProScan is underlined.

MGTENSQKKKDSIFDLPAHYFDSASLLRLPHDTANSATASHKVSLDLDLGVSSLDTPI
PNETEYGENEEEKQSMGTGMGVSMNRWS<u>CKTCTAEFSSLEEQRSHFKSDFHRFNVK</u>
RRIIGRGPLNEDEFEEVAQGTFLKDDDISSISGSDEELDDPITCGWQPRTESVNRSMSM
KNQILISLQSGEIVSIWKSLLLGDREDLLPEHNNSMVKENDAKSLALADKEVIGRLQS
LVKESRDQKNLRVVLLASGGHFAGCVFDGNNILSHKTYHRYVVRAKAGGRQSSKDS
TGRMPKSGGASLRRYNEMALKKEILELLAAWKCHLDSALCIYIYSPSINGQVFFGGE
NPPLVYHDNRVRRMSFTVRRPTLKEAKRIYHQLTSVYTAVRPEIHFPNELGEPPLNSK
KGKEDATEVNKTKIKSKNKTEKASVPETCSDLDHQESSVTETSDIGNKATVNQSSPL
HEAARSGNAARILELLEQESNPCVKDDKGRTPYVLAADRETRNVFRRFMAANPNKW
DWHAANVPSPLTEEMEASQAAKQAEKDAKRKAKAKEMKKIRKSKQKAQAQSTSLE
VASVAVCYGQNAVSELLEKGKALPNMQSHAFQEDLKKVQAMEREKRAAAAEKRM
LALSKNFGNVFSAVSSNVGFRDMNFDTHCSCCAAFLAGKVPFPRYNYKYCSTSCMH
PHREMLEDE

Figure 405. Amino acid sequence of SEQ ID NO: 1390. The conserved Zn-finger, C2H2 type domain identified using InterProScan is underlined.

MAEVLDIPPETLDRRRDRPSDRKEKEKPSEERSKRDRDSRERRDERDDRPPRRGGDY
HERTRSPAIGSGGGGPSRDYKRRHSPSPPPYIPRDRRHSPPSRRSPPYKRSRRDDVYDS
RRGSPRAGFNPDDRRFGYDNMGGYDRSGMGGRSGYVDERPHSRHLGRASGGFQGG
SPDWPGSGRAGFGEMGTPQREGLMTYKQFIAELEDDISPAEAERRYQEYRTEYISTQ
KRAFFEAHKDEDWLKDKYDPSHLEAVIQRRNENAKATAKEFLLDLQNGTLDIGPSST
GSTPLTAKGGQGSDHNSDDDAEVSGKRRRHGRGPAKENDPVSSAPKAPPVSSEPRR
VKKDIELGQALIRKLDSEKGIEENILGSSEQDKFEGDKSISGSIGVVIVRGTNTVKGLE
GLELLDVVATYLWRVHGLDYYGMIELKEPPKGLRHVRAESKNNHDEQSTAAAEWE
KKLDSTWQARLQGQDPLEIMAAKDKLEAATTEALDPFVRKIRDDKYGWKYG<u>CGAK
GCAKMFHATEFVHKHLRLKHPDLIGELTSKVCEEVYFQNYMNDPDAPGVTLTTQQA</u>
GQRDKARRRKAGHNLSGDGGQIGGTSRARDVDHPDRASRRENERTDRSHEDDRYD
RNDDSSPRDYQSIPGGQDVGHHDPSMFDPFAGPGMRGPPPFGSDMPPHLPVFMPLPG
AGPLGPFVPAPPEVAMRMLREQGGPAPFHPNDSNGGLRGRKGRSGGGPSMGGITDP
PMMLPISPGFRQDPRRIRSYHDLDAPEDEVTVIDYRTL

Figure 406. Amino acid sequence of SEQ ID NO: 1392. The conserved Zn-finger, C-x8-C-x5-C-x3-H SEQ ID NO: 3667) type domain identified using InterProScan is underlined.

MAEPNETGPSQQQTCNFFKKPTRNKNIRKREAEEVTEEENKDGSAVVHKPKAAKKP
DNKLHFSSGPSKKSNIEDNDSETAGLPASTFFYESSKEIQVQNDSRATATLETETEFTK
DARAIRERVLKQGEESLKGNNPGDEKLYKGIHGYTDHKAGFRREHTVSGEKAGGAH
GPLRASAHIRSSIRFD<u>YQPDICKDYKETGYCGYGDACKFMHDRGDYKSGWQMERE</u>
WQEAEKKRKNNLALGLLEEEEEPDSDEDALPFACYICRQPFEDPVVTRCKHYFCEH
CALKHHARNKNCYVCNKPTNGVFNTAHEIRRKMGKDNVGAKNK

Figure 407. Amino acid sequence of SEQ ID NO: 1393. The conserved Zn-finger, C-x8-C-x5-C-x3-H SEQ ID NO: 3667) type domains identified using InterProScan are underlined.

MDPFGHARKKARSETILNENGGLFNPHESNIFGDGNRFKAGGMKFALQPEKESLPTG
LGSKSKACTKFFSLSGCPYGEGCHFQHYVPGGVNPVTQIGTLGTALGAASKKPTGLL
PAEPTLNASNYKTRLCSNFGTDIGCRFGDKCHFAHGEKELGKVNAVAHNLKDDLAT
GPFGSRFPVGGLDGKPGGRPGYHEATPPGMAAAATFGASATAKISVDAALAGAIIGK
GGVNSKQICRSTGAKLAIRDHESDTNLKNIELEGSFDQIKEASALVRQLIMHTSATLP
AKQPSFTTNNFKTKLCENYAQGTCTFGDRCHFAHGASELRDNSK

Figure 408. Amino acid sequence of SEQ ID NO: 1394. The conserved Zn-finger, C-x8-C-x5-C-x3-H SEQ ID NO: 3667) type domains identified using InterProScan are underlined.

MDPFGPPRKKLRPEVEFVNGNGGIHTHTHALTDVGTRRFNPSDIVYGDPTRFKQPTF
VSPEMESLPTGLGSKSKACTKFFSTSGCPFGENCHFMHYSPGGVNLISQVSNLGSGLR
TASRNSTGPPTSILPPDQAAAVQPYKTRMCNRHGTAEGCRFGDKCHFAHSENELKKG
NTLAPVEREWTSSYGRPVPGGGRLVQHEATTPGMAAAASFGSSATAKISVDASLSGA
IIGKGGVNSKQICRVTGVKLAIKDHESDSNLKNIELEGSFDQIKQASTMVHELIMQTR
AVAAKPSGFVSNNFKTKLCENFSKGTCTFGDRCHFAHGASELR

Figure 409. Amino acid sequence of SEQ ID NO: 1395. The conserved Zn-finger, C-x8-C-x5-C-x3-H SEQ ID NO: 3667) type domains identified using InterProScan are underlined.

MESFEPTLKKSRGYDTDGANGMPWTSSSSAGNMNMNPGMNLSSGVNYHSGPNPNQ
GHGFNPNAAGANPNPNPTLNPNSGVNEVMQGPPQGGYPPAMGGGQYAGGSGASYG
GGSYGGGSYENGNHSTHFEVLGFQQQHQQGSNVNVGDLECRRYKLDEGCPYGLTC
RYKHGPTDERDFNIHVPSSGGKSKPCMKFFSTSGCPYGEGCHFSHYVVGGIAALGLA
PVQTMPAATMAPPRKQPGPIGDPSATVSGYKTRLCNRFNTDPGCRFGDKCHFAHGES
DLRSSNNISASNRNGVPMQSAPAIYDNGPLATVSNPAGFVDTTAYGNSASTATYGNS
ASTAAYGNSVVYSANTFPSSQSYAEPTPPGVAANTPFVPNYNMPVENSSQLPGVEGT
MQGGPVTGTNNVQVY

Figure 410. Amino acid sequence of SEQ ID NO: 1396. The conserved Zn-finger, C-x8-C-x5-C-x3-H SEQ ID NO: 3667) type domains identified using InterProScan are underlined.

MDYNAAMQGGFARQRGLVIDPDGWQQHGRPRAEITGVEEAMWQMNLQPQHESLE
PEIGSYPERPGEPDCTYYMRTGLCGFGMSCRFNHPPNRKQAAAAARNKGEYPERLG
QPECQYYLKTGTCKFGATCKFHHPRDKAGSTGRAAINVLGYPLRPNEKECAYYLRT
GQCKYGATCKFHHPPPVGPLVPVRGSSLFTPVQSPTTPGPQAYPGSLQTWPMQRASFI
QSPRWQGPSSYAPLILPQGIVPVPSWSTYPQGQVGSISSSDGQQQAIGAGLVYGPTSQ
TDPMASGIQGTFSSFPPGSPGMGPPTLQLPSSSAQRESMFPERPGQQECQFYMKTGDC
KFGMTCRYHHPKERIIPIPNCVLNSVGLPLRPGAPACTFFSRYGICKFGPTCKFDHPMV
HSSYSQSISSPIDIPVGRHQIGSASATLASVPLSSDLVVDSGGGKSIEHTSTAEARQQSS
GVENLGPDA

Figure 411. Amino acid sequence of SEQ ID NO: 1397. The conserved Zn-finger, C-x8-C-x5-C-x3-H SEQ ID NO: 3667) type domains identified using InterProScan are underlined.

MEYYRQEENWAMHSNKNNVLTFTSSTDMKSIEKSMGKMTLKSPVDPVESGSYPER
VDEPDCAYYMRTGLCGYGPNCRFNHPPNLKQAIASKGEFPERVGQPDCQYYLKTGT
CKFGATCKYHHPRDRNGLGGQVQMNFLGLPMRQGEKECAYYMRTGSCKYGVHCK
FHHPQPTTIMPVSGYASSGSPTTPASSYPPGILSWPLPRSPYVPGHRLQGSPTYVPMPII
FSPTQGVMPMPWNNYQGPLSPLLSPERHQQPLGTGVAYKSFQQSDSSASGVQSAVTP
LIQAGSAAMVLPTVQAQTSVGQKESFPERYGQPDCQYYMKTGDCKFGTTCKYHHP
KERVAQSPTCVLSPIGLPLRPDQPACTFYSRYGICKFGPACKFDHPLGGVSYSPSASSL
SEQPVAPYPRGSSPPRMLVRSSSSENSQAALAVKGQSSRLEESASFKHHSPTDGPVGE
KEADTSNSVAAVLSESA

Figure 412. Amino acid sequence of SEQ ID NO: 1398. The conserved Zn-finger, C-x8-C-x5-C-x3-H SEQ ID NO: 3667) type domains identified using InterProScan are underlined.

MIDGIYRASVPQQRLASGTRSRRVTDVRADNWLPSLAGLNSGKSAAESMKESLWRM
TLQPQDLRSRMNGYSESYPQRPGQADCSHYMRTGFCGYGMNCRFNHPTNVKQQAA
GNRGELPERVGHNACQFYMKTGTCKFGATCKYHHPRDRLRAGQIQLNMLGLPMRM
GEKECTYYIRTGFCKYGATCKYDHPQPPALGALVPVSGSSMYATVRPPISPASATQY
SPALPTWPSPRTPYRQSLHMPGALPYMPVMYSPHQGMLTASGWGTYQSTASPLTSP
EIQQQLRRMNIIYNSTQPNGLSVGGVQGSITPFTQGSSPTVGHQPGIFQPNRTQTETYP
ERPGQPECQYYIKTGDCKFGFACRYHHPRERVSQSSSCVLSPIGLPLRPMQPTCTYYS
HYGICKFGPTCKFNHPLTGLSYSPSASSLSEIPVAPYPRGSSPTTTHVQSPSEPTQEIAK
SRDQPSREPTSSKQDSEAVVSGNTKENASTYSDAAISSRSAQIALC

Figure 413. Amino acid sequence of SEQ ID NO: 1399. The conserved Zn-finger, C-x8-C-x5-C-x3-H SEQ ID NO: 3667) type domains identified using InterProScan are underlined.

MEYYGNSSAMPRYLGSAVDPPPTDWNSQHVAADLGMEEAMRQMNLQSHDVAERG
LFGPFPERPGEIDCAHYMRTGICGFGMTCRFNHPPRRNIAAAVARNRGEYPERPGDPE
CQHFVKTGTCKFGATCKYHHPKYKAGTSDWQQLNALGYPLRLNEKECSHYVKTGQ
CKFGVTCKYHHPQPVGPSVAIAGPSYYPTGPSLSIPSPQQYAGGLTTWPISRTPLMAN
PYLQAPSTYVPFVIPHGMMPVPGWNSFHGQVGSITSRDVGQQAPGTGLFYGPRYQT
DGMNPSIQGALASYSSRSGSMGIPSTNTQMEHMFPERHGQPECQFYMRTGYCKYGS
TCKYHHPRDRTVPLTSCTLSPLGLPLRSGAQTCSFYVRQGFCKYGPTCKYDHPMGTL
SYSPSASSLADMPVAPYPVGSAPATLAPSFSSTELRTETTAGPFKESILTPETPLSSSAG
ESLDLGAQGPLLSTSTGLTSSESEENPLVKKSNQVSVLANGIAKEGDIPISN

Figure 414. Amino acid sequence of SEQ ID NO: 1400. The conserved Zn-finger, C-x8-C-x5-C-x3-H SEQ ID NO: 3667) type domains identified using InterProScan are underlined.

MLFVQGQREGESPFSFTTTTHGGLQGSYTDGERTMHDNCPLSSSSSPRVPGDALEET
VLQISIQTLDTLEEIGFYSGPYPERPGEQDCAYYRTGLCGYGRHCHFNHPPNVKLDTQ
YMSELPERFGQPECKYFMKTGACKYGATCKYHHPHDRDGPRVQLNYLGLPMRQGE
KECPYYTRTGSCKFGATCKFHHSEPTALLSDSGSPVYAAAELPLSPASGSSYPAGLTS
WFLQGAPYVSDPHLQGSPTYMPVILSSQQSTPSVQPGWNTCHGPTSPLSSPEGKQQL
GAGTVYSSSYLTDSSSSPEGKQQLGAGTVYSSSYMTDSSSSSHMHGALSSPVQGSST
AMEHPGVQCQVAAPKREAFPKRLDQPQCQHYMKTGCCKYGTTCRYHNPQERVALS
PCCMLSSQGLPLRPGQPTCPFYSRYGICKFGPICKFDHPLTGPNCNPAAFSSSEQQTTS
YPKGGSSGAHCQSTSEEFSKQDLKATDQYSKAEEASSLKQKSTEEGAGDRLAAKSPS
TSGAAI

Figure 415. Amino acid sequence of SEQ ID NO: 1401. The conserved Zn-finger, C-x8-C-x5-C-x3-H SEQ ID NO: 3667) type domain identified using InterProScan is underlined.

MPGVSAEQHLFSGSGSPVVFGNRCCPVSRAFESQDLPKSFYAEPPELSPYALTNMEYL
QSLNLFSETSPNSEKSRYSKDSASVQKLFNKSLSFGSNGLGVDFGGMESENFLVSPRT
VIESPDGISSLHKFLPSNNEEEASWPAVDAYSCDEFRMYEFKVRRCMRGRSHDWTEC
PFAHPGEKARRRDPRRFHYSGTGCPDFRKGSCRRGDACEYAHGVFECWLHPARYRT
QPCKDGRNCRRRVCFFAHTPEQLRLLPGASQAQSHASSNFGNRNSFQMRNTVSGSY
DGSPLRYAVTAAASLDGAFGYDGFDGNASPRGPLNYLCKAKVKAKASQISSPTSTLV
GHSYSSPPLSPPLSPSASPPISPGSCLDSPVNYANSAVKSFPKSETNTAPGSFTPRGHLE
RLISIPQPNLDPSPLSPAVHSPAPSSKLIMEGLINTLQRMEINGDTLPWRQQQQQFNLP
GRSCLSFPGAPRLDDDAWEVEAAEDGSIQRVESGKHLRAKIYGRLTRESTLQDNNNT
NTEYSPDLGWVNELVM

Figure 416. Amino acid sequence of SEQ ID NO: 1402. The conserved Zn-finger, C-x8-C-x5-C-x3-H SEQ ID NO: 3667) type domain identified using InterProScan is underlined.

MDLMFPGVEGKMDTYEATRIVFTRIQSIEPENVSKIIGYLLLQDLGDQEMIRLAFGPN
TLLQSMISKAKTELGLSSPSPLQSPLRYTQFSNLLSRSFSSPAPNGFDDCQLQDHLFYP
TENLDSYSLPNDSHVYTEMLSFLNGSKTGLNHRRSYSMTDVSVSCEPVSWKPCLYFA
RGYCKHGSSCRFTHSYSRSDNVSSSIPLDPRFEEAFSVESLERLELELQELLRGRRAPV
SIASLPQLYYERFGKTLQAEGYLTESQRHGKAGYSLTNLLARLKNTVSLIDRPHGQH
AIVLAEDANRFTTYRPSERDPYYLSGVSSGSRQIYMTFPAESTFTEEDVSNYFRIYGPV
EDVRIPYQQKRMFGFVTYVFPETVKLILAKGNPHYVCGARVLVKPYKERNKHGDRK
NGDRGEQYARYLLPSYNVDSKDYDLCPAPRMFQNSELIRRHIEEQEQAIELERLRLTE
LHLADRAQRTQNNAITLQQQNSHSNGLLNVEEEETQVSEELNSFDPPTDHFGYLLDV
LDSEQNPEEEPKQQKADNDEECNGHNLPDSPFGFSHSIKTTLPHPEKTNNFSFFDTSPA
QESSTSIMTKEGTCSMCLDSIVEQVRLECKHVR

Figure 417. Amino acid sequence of SEQ ID NO: 1403. The conserved Zn-finger, C-x8-C-x5-C-x3-H SEQ ID NO: 3667) type domain identified using InterProScan is underlined.

MDAYEATRIVFSRIQSLEPENVSKIIGYLLLQDHGEQEMIRLAFSPDSLIQSMIIKVKKD
LGLMQQQGTPAPTVSSYLSRINRLPNLPLQSAQISQSRAFSSPTALSPHAAPWGSHISQ
QTRPLSNNFNSILNEIQTNTSTSSTINSTSNGYLNFSLPSMPDQANSLPYSEHPGLVDEF
QLQDQLPFLNDSPESAQSHANYLNYPEMLQAYCNGNQPLTIDHVSPTAANNSYPGTT
HIPKQPSSISDIYNLTSESAPGSAL<u>AWKPCMYFARGYCKNGSNCRFLHGNYGGHVRS</u>
ESNNDHSEKFMGSSSGPLEKLELELKELLRGRGSPVSVASLPQFYSERLGKALQAERF
TRYRSERDSSDHLASSASNSGSRQIYLTFPAESTFREEDVSNYFSIFGPVQDVRIPYQQ
KRMFGFVTFVYQETVKIILAKGNPHYVCDARVLVKPYKEKGSKPAERMKYTDCRGD
YSGYVTTHNLDIKDSNLQLGPPRFVENSLDLVTRRQLEEEQDHVEQAVELQTKRLAE
LQLGDRKRPQLVPSDPQVSMASTNSGPAQHYQNQFSNGPNNHSEEDATTSEDFSSST
LAEHFGYVLQVLDSESVYEEHPKPVNHHHDRLPITNGAMRL

Figure 418. Amino acid sequence of SEQ ID NO: 1404. The conserved Zn-finger, C-x8-C-x5-C-x3-H SEQ ID NO: 3667) type domains identified using InterProScan are underlined.

MGHQIYSSSQSLGSASRGNPVLGYNGGRALEPPMFPARPYDLPAESRYFSGDQMSNS
MQLDKPGGRYMFGERVPSERTPAETGSRPGSFSLERYMPSEATQRADSSRYYPGHNS
SMFLNGSDTALYKGGDAVGFGSTSAYFPSRHSAGLVSPPLQQTQWPGAESRGSMPG
GVTGVKRPNEEVSQTLLGTHNAFGQNEALSSVNALPKRPRLDGSSDLPIYPQR<u>PGEK
DCTHYMMTRTCKFGADCKFDHPS</u>WVPAGGIPNWKEVPSVATSSESPPER<u>PGEPECPY
YMKTGICKFGAKCKFHHPKDRLATLNSDENFDGNEVKLATGSLPERPGEPECAFFVK
TGICKYGAKCKFDHPKD</u>KGGSLKISEHKGNGDAAVTVGTEEQGVSGDINGKTDVIPI
KPATMHNSKGLPIR<u>PGETDCPFYVKTGSCKFGPNCRFSHPDRIL</u>NMPPAVMPFSVHD
QPLVGYSGMLPQHSLGAPIPPQR<u>PGEPECTFYIKTGECKFGPSCKFHHPL</u>NRPDPSVKL
TLAGLPRR<u>EGETICPFYLKTGICKYGVNCKFDHPPP</u>GELDTARAQQPVKLTLAGFPRR
<u>EGEATCPFYMKTGTCKYGATCKYDHPPP</u>GEAVAKAVAMAATTEDISADYDKIDSGN
VGANATDENIKD

Figure 419. Amino acid sequence of SEQ ID NO: 1405. The conserved Zn-finger, C-x8-C-x5-C-x3-H SEQ ID NO: 3667) domain identified using InterProScan is underlined.

MCGTPEHSKVSENNEDNGKVVLAEKQLSKMKETQKCFSILLELAANNDLIGFKQAV
EEDGSAIDEISFWYGRQNGSKQMGLEQRTPLMIAALFGSMDVLSYILSAYATCGIDV
NLKCGSDRSTALHCAAAGGSSFAVEAVRLLLQSDADVNCLDANGRRPVDVIVVSPK
LSNAKVILNNMLKAEYHSRAGACLKVLSRVSEYDNTDLSGRGSNSLSSLPHLSLPFEP
QSPKVLMSSPKISETSRNCADGIEKREYPVDPSLPDIKNGVYSTDEFRMYSFKVRPCS
RAYSHDWTECPFVHPGENARRRDPRK<u>YHYTSVPCPEFRKGTCRRGDLCEFAHGVFE
C</u>WLHPAQYRTRLCKDETNCTRRVCFFAHKPEELRPLSGFTGSAVPSPRASSSLDMNS
TMSPLTLGSPSPVFVMSSLSPSNPPQGGLSTPPRSPSSSSANSLSHSSFSGTWPQPSVPT
LHLPGGSLQVGLQASRLRASLNARDVPLEELTLDSDCEGQLINDFASLSGSGNTLMR
SGKYKSHGCSIAPVNLEDLFASEMSPRGPCLEPSVFSQISSQIQSHKAAQVQPQVQTSI
SNQISQIHQMQQGAIGSQGNSHLHSPVQQSHRLPSLGLDLERQTSNGSVLSPALMAG
MKSRSASFAQRDLRSYSSRDLGAHASLPSLADWGSPTGKANWGVQKGELNKFRKS
ASFGFRTSNEPDLSWVQTTVTENPVDAVEGCTVGFSLEALRNRQTENINNAVLGAW
AEQQMHLDQQMVA

Figure 420. Amino acid sequence of SEQ ID NO: 1406. The conserved Transcription factor CBF/NF-Y/archaeal histone domain identified using InterProScan is underlined.

MEPMDIVGKSKDDVSLP<u>KATMFKIIKEMLPPDVRVARDAQDLLVECCVEFINLISSES
NEVCGREEKRTIAPEHVLRALEVL</u>GFGDYIEEVYAAYEQHRLETLDSPKSGRWASGA
EMTEEEALAEQQRMFAEARARMNNGNANPPRQSDSD

Figure 421. Amino acid sequence of SEQ ID NO: 1407. The conserved Transcription factor CBF/NF-Y/archaeal histone domain identified using InterProScan is underlined.

MEIVGKAKEDVSLP<u>KATMTKIIKEMLPAHVRVTRDAQDLLVECCVEFINLISSESNDI
CYKEEKRTIAPEHVLESLKIL</u>GFGSYIREVKAAYEQHRIENWDCPRAGTRWSKNRLE
MTEEEALLEQQRMFAEARARMNSGSNTFPGQYQSQSQSQSQSQSQSE

Figure 422. Amino acid sequence of SEQ ID NO: 1408. The conserved Transcription factor CBF/NF-Y/archaeal histone domain identified using InterProScan is underlined.

MAYNRKHAAAATSPDSSLGSDNESGGGGGGGGGEGQSTKNGNGNYIREQDRLLPIA
NVGRIMKRALPGNAKISKDAKETVQE<u>CVSEFISFITGEASDKC</u>QREKRKTVNGDDLL
WGMTTLGFEDYVEPLKIYLNKYRELEGEKSSMAAPPRQSDLQQHHHVNGSDPHPYG
HSPHGPMAYHVPGGGAFGHGR

Figure 423. Amino acid sequence of SEQ ID NO: 1409. The conserved Transcription factor CBF/NF-Y/archaeal histone domain identified using InterProScan is underlined.

MGDHSGGESSPHSDIESTGIHNNGSSSSSQSIIREQDRLLPIANVGRIMKKTLPTNAKIS
KEAKEIMQE<u>CVSEFISFVTGEASDKC</u>HKEKRKTINGDDILWAMTTLGFEVYAEPLKV
YLDKYRELEGEKLSMSKQLQVDQPQPDLQYQACNPSAHNRPLVMTYKMPLPMPMH
GKGPSGADPAATGHGRRPF

Figure 424. Amino acid sequence of SEQ ID NO: 1410. The conserved Transcription factor CBF/NF-Y/archaeal histone domain identified using InterProScan is underlined.

MATTRHQRSPDSSPRSEDESGAHTYSNQDGSVKEQDRFLPIANVSRIMKKALPANAK
ISKDAKETVQ<u>ECVSEFISFITGEASDK</u>CQREKRKTINGDDLLWAMGTLGFENYVEPLK
VYLQKYRELEGEKTSMAKQSGDQSPSKDASSGSTVNGSTAGNPSISPGSTVKYSGGY
YPQPYGSQAAQMYGQHQMVAPYQMHINTGKAGGAGAANSGDHHPRGQW

Figure 425. Amino acid sequence of SEQ ID NO: 1411. The conserved Transcription factor CBF/NF-Y/archaeal histone domain identified using InterProScan is underlined.

MDEQSAMQHMPMHYRATPYPNAQLQPNIAHGAFQQPSIHGHPHALSSHHNQLPYQ
QQIHQHQRQLHHHQQQQIEVFWANQMQEIEQAVDFRN<u>HSLPLARIKKIMKSDDENV
RMISAEAPVVFAKACEMFINELTLRAWIHTEENKRRTLQKNDIAAAIARTDIFDFLIDI</u>
VPRDELKEDQVINLGNPRSVLSVGSSSTNAAAAAAAANSFPYYYLPNQHSVPHGVFV
GKPMDPTIYMQQPQSPVAYMPNIWQWGHVQADQSRSPNPAS

Figure 426. Amino acid sequence of SEQ ID NO: 1413. The conserved Transcription factor CBF/NF-Y/archaeal histone domain identified using InterProScan is underlined.

MADLASSVTSQESPHSEDTNNNSQNQGSNAREQDRFLPIANISRIMKKAVPANAKIA
KDAKDT<u>VQECVSEFISFITSEASDK</u>CQREKRKTINGDDLLWAMGTLGFEDYVEPLKIY
LHKYREAEGDSKGAATSRSGVGDPTKKDSSNFGALPNIR

Figure 427. Amino acid sequence of SEQ ID NO: 1414. The conserved Transcription factor CBF/NF-Y/archaeal histone domain identified using InterProScan is underlined.

MAEAGSPGSQESPRSGEQSPQSSVREQD<u>RFLPIANISRIMKKALPANGKIAKDAKETV
QECVSEFISFITSEASDKCQREKRKTINGDDLLWAMSTLGFEDYIEPLKVYLLMYREA</u>
EGDNKGSSKSGVDQYGKKESNVHQGIPNMQQSQMQHHHMVTMQGNDLS

Figure 428. Amino acid sequence of SEQ ID NO: 1415. The conserved Transcription factor CBF/NF-Y/archaeal histone domain identified using InterProScan is underlined.

MAEAGSPGSQESPRSGEQSPQSSVREQD<u>RFLPIANISRIMKKALPANGKIAKDAKETV
QECVSEFISFITSEASDKCQREKRKTINGDDLLWAMSTLGFEDYIEPLKVYLLMYREA</u>
EGDNKGSSKSGVDQYGKKESNVHQGIPNMQQSQMQHHHMVTMQGNDLS

Figure 429. Amino acid sequence of SEQ ID NO: 1416. The conserved Transcription factor CBF/NF-Y/archaeal histone domain identified using InterProScan is underlined.

MASTSEV<u>EDLPRANVRRVVKGKLSQLMKDNPSSSAKDIAIHKEALLACSESARIFIHY
LSATANDICCESKRQTINADDVLKAIEEMEFPELLDPLKTSLEVFRKQNASKKSESKT</u>
KSTDRKRKSEGDLEMENGNGSHTEDANEAQDDFGEENKEDENDDLEED

Figure 430. Amino acid sequence of SEQ ID NO: 1417. The conserved Histone-like transcription factor CBF/NF-Y/archaeal histone, subunit A domain identified using InterProScan is underlined.

MATTRHQRSPDSSPRSEDESGAHTYSNQDGSVKEQDRFLPIANVSRIMKKALPANAK
ISKDAKETVQE<u>CVSEFISFITGEASDK</u>CQREKRKTINGDDLLWAMGTLGFENYVEPLK
VYLQKYRELEGEKTSMAKQSGDQSPSKDASSGSTVNGSTAGNPSISPGSTVKYSGGY
YPQPYGSQAAQMYGQHQMVAPYQMHINTGKAGGAGAANSGDHHPRGQW

Figure 431. Amino acid sequence of SEQ ID NO: 1418. The conserved Histone-fold/TFIID-TAF/NF-Y domain domain identified using InterProScan is underlined.

MDQQQPTIPALPQVGYGTNPYIAPPIGGPPHPQLASYHQQLQAFWGNQMREVEQAQ
DFKTHSL<u>PLARIKKIMKADEDVKMISAEAPVVFAKACEMFILELTLRSWIHTEENKRR
TLQKNDIAAAIGRT</u>DIFDFLVDIVPRDEFKDEGLVIPRAAGAVPFMGPGDNVPSYYYV
AQQAPNVAAYAPPTQQMRSKAPAPPPHGSS

Figure 432. Amino acid sequence of SEQ ID NO: 3632. The conserved Transcription factor CBF/NF-Y/archaeal histone domain identified using InterProScan is underlined.

MDHHNHHQHHPSSSSGGAAPQGMSQGYPGGAAAQPSPVGMQGQAGQIVQTGLHQS
GGQQAFHHHHMQQQQQQQQLHMFWAFQMQEIEQVSDFKN<u>HQLPLARIKKIMKA
DEDVRMISAEAPVLFAKACEMFILELTMRSWIHAEENKRRTLQKNDIAAAITRTDIFD
FLVDIVPRDDLKEEGLGLGFARGG</u>VTPEGSFYYPPPSMPQSPHQQGMMGSSSIMMGR
PVPLQMDPSAMYMHQQQQPRPYGMPTHPHQPMWQHPHHPHQQQQQQQMPDGQS
YGHPHQQQQQHMPDGQPYGQQQMTDEHSYGTSPRSAN

Figure 433. Amino acid sequence of SEQ ID NO: 1421. The conserved Tesmin/TSO1-like CXC domains identified using InterProScan are underlined.

MDSPDKTKMEMDSPDRNVNTPSSTVQGSPFFNYLCNLSPIKPVKSVHVAQTFSELNF
PPPPAVFTSPRVPSQKESNFLKRPYQKDTRDEENKSDNPPCETVKDFAVPMSDCDVP
ASLNPLARKNTNFDSLASDQTKCEDNTMSTFASCSPSKLLEEYLADPVEEENYTVDS
SKIHLKSASSALVNTLVVDSDKPQETSDQCSKMKDTEMIEQSNFPEEFLGTGKIASEA
ETSQGDEEGTFSLNSEGSMKASVIRKMGHVGQNDTEGLSSVWSDVDSHHSNTLLFA
NNCETSETGVSHDENLVDQTTGSFAFILSKGSTCEIEEWQKASSSADCSGAFLQQGLK
DIVNHSDRACRESDLDSTPQLMYDSFLDTNSAADPNVKLDSEQKCVVEQQTSFGCKP
GNQSQRGIRRRCLDFEASEAQRKTMSNSSWKSTSLMPKTDPLLHSTHDSETNTSSSV
ACEKGVTSDCKQIVPLKRETGAGIGRISQSTSNVRFSSFSSKITELTSDKSDSNVRNNG
NTPISVNIPSGIGLHLNSLATTMSHNSGVNTLTSAKVSVSTQGMSPSSGGKEVSSDVV
GSSLPSASSGGNISVGSNSNIASGMVVSMVEKTRIDQQELQSSGMTQIGVTRSTTCFR
SVTVGIKPLQSRLPFKSEERNLSPLGKKRPPLLDISQQSSFGMGEEFSQSSPRKKRKST
TTGDKEGCKRCNCKKSKCLKLYCECFAAGVYCVEPCTCQECFNKPEYEDMVLGTR
QQIESRNPLAFAPKIVRGADSPPANGDECSETPSSARHKRGCNCKKSMCLKKYCECY
QAGVGCSDGCRCEGCKNVYGKKEGGSDDIEENETPIEGWDKDSLEEKTEVHDVGND
ILLSEQQHAKDLSPLTPSFQYSGQGKSSAKLNSCGKKHFTSEDLESPTVSQPSAKPPRS
PGKILRPTKGLQGNISAIHNRQAGSRTSASPIFTSKMDKSGQFSPQWDCLGDICTLTPM
LHPPMRPSATSASSVDGIDVSPFSGQQNETPSMSSRPLASRHSCHVGSSLGFRQPAAR
SPICTSDNIHWRTPVNAKVTPVTPALSSTACTAGNKLSDASDFDMQSHDVSCSLEDD
TPDILKNNCSPTRGLKASSPNQKRVSPPHNYCPKEMMNRRPISSPGIRSGRKYILQSVP
SFPPLTPLPGEGQANE

Figure 434. Amino acid sequence of SEQ ID NO: 1426. The conserved Hpt domain identified using InterProScan is underlined.

MDVIQLQRRFIDYTSSLYREGFLDEQFTQLQQLQDESNPEFVAEVVSLFFEDAEKLLA
DLSKTLAQQPIDFKKVDAHVHQFKGSSSSIGAHRVKNECISFRAFCEQRNREGCLQCL
EQLKQEYYNVKNKLETLFQLEHQILEAGGTIPMSE

Figure 435. Amino acid sequence of SEQ ID NO: 1427. The conserved Response regulator receiver domain identified using InterProScan is underlined.

MVTSRMSSAMRMKKEKNAACGEHGDELVRCDEMHVLAVDDCLIERKVIEKLLKTN
FFKVTSVDSAERALEVLGFHEEQSTCATTNAFKVNMIITDYCMPGMTGYDLLKKVK
ETKCLKEIPVVIISSENVPQRITSCLAEGAKDFIIKPLKLADITKLKGHIKPPKDVASVSA
RASGPVSSKRKISSGRGRGKMSERRPRVDGLTSV

Figure 436. Amino acid sequence of SEQ ID NO: 1437. The conserved Response regulator receiver domain identified using InterProScan is underlined.

MVMMAAHDSVTSTMGNSYGGGKTDHQFPAGLRVLVVDDDPTCLKILDKMLKRCL
YQVTTCCRATAALSMLRENKGAFDLVISDVYMPDMDGFKLLEQVGLEMDLPVIMM
SADGGTSTVMKGIKHGACDYLIKPIRLEELKNIWQHVIRKKRNEPKDFDLSGSFEDN
DRHRKGSDDVDYASSVNEGTDGNWKLLKKRKEAKEEEDDGEEDNDDPSASKKPRV
VWSVELHQQFVNAVNQLGIDKAVPKRILELMHVQGLTRENVASHLQKYRLYLKRLS
GVAQQQSGMNSSFGGTTEAGVGPMGLLGRLDLQRLAASGQISPQALVTLPAELLGQ
VNPNNGLGLPNIDRTLLLQAAFHGVNSNPLNRGKFGQPLMNSQGNLLQGLPRSIELK
QFSQPQQHIPSFGNLGLPTNDASAGFSMLQQQHNTGAEVGSVDCGINNNGASNPQN
NAMVMQLIQQQQQHQINQQQQQLQRSAAQQQPGGQLQGSQLQSGQVLNLPSASIV
GPQVLPNEIRGRATLSSLANGNSSLGNNIIGAPGSGQLNRMPMPAYGLGATESNVPE
GIGRMSTVDYKSQNVHILQGNDYSLSSTVCLSSPLTTSDIEGGMNISGIKRLGGISDIV
GSPTLSCSGISFGTSNGIGQNLSQSGRQGWQMQNVSMNQDLSQTATAILSPCHGQAS
HRTQGLNVPVVQDPGQVRSFGFVGKGPNLSSRLVQNAGYPGMLSNAQSQGELLGID
SGLRLKDKSASDFGLTPKIECGTLSDHFPSEDLMNLLFKQQQDGMGISENEFNLDGVS
IG

Figure 437. Amino acid sequence of SEQ ID NO: 1438. The conserved GRAS family transcription factor domain identified using InterProScan is underlined.

MSLASPCQESMRGDDNSYRTNSWYRGNLSGVPEISRNMGMQYMPGGIGLNLQRGW
GNSFRSCSTDLSPKQNGNFAIDHTSTTGERSAGTLKMIDQRSPISPLSPKGIGSDGLPQ
TSQSQRLYSSERIQMHDDLIHSSSHNHGSFNDQVYIHESFPCNNELSRESSICIQSSDGS
PLSSQHSQSYSSDSRYFHSAEDAADLVGNAYSGNGQPANLKILEEIETALLGPDGDDP
LDMDYAYGDHTLNSNSEWSLEALSDFNDFLDQTSNPGYSQINNADSSRVPDNLQQL
TNHGDRNVKEETVNEVNLKIEHFSPSSSDMEKLEIEELGSPQGDVKSLLIECAKAIAD
GRNADNLIAGLRQVVNIYGDPLHRLAAYMVEGLVARLHFSGGHIYKTLKCKEPTSSE
LLSYMHILYEVCPYFKFGYVAANGAIAEAFKDKDRVHIIDFQIAQGSQWVTLIQAFA
ARQGGSPHVRITGVDDPQSEYARGQGLNLVGERLSKLAESYQVPFEFHGLSVFGSDV
HAEMLKIRPGEALAVNFPLQLHHMPDESVNTSNHRDRLLRMVKNFSPNVVTLVEQE
ANTNTAPFFPRFMETLSYYTAMFESLDVTLPRDSKERVSVEQHCLARDIVNVIACEG
DERVERHELFGKWRSRLTMAGFKSYPLSAHVNSTIKVVLNSYNENYRLIEKDEALYL
GWLDRDLIVASAWK

Figure 438. Amino acid sequence of SEQ ID NO: 1439. The conserved GRAS family transcription factor domain identified using InterProScan is underlined.

MAYMCTENGNLMAIAQQLVQQQQQQQQHIYPNPGGYFNGGNMSMSMGGVNMNM
NMSPWLSAPTAWQHDGLMSFPPGICTDVVGDLCSTTTNSYLSEPNSVLDLSRASMLF
SPMEQFQDFTQHLHDGIGAKQMPLLGGVEPPAPAFKDNALYHHEALVKKERPPIKEP
GVGDGSSAALRSSVFRSPELHTFGFESPVSNRNDFVSPDVCTEWMDCLMSDLQPEAI
AGNGNAAIASCFDSSNPCESTESSELPNGGSGYRRHSSEDAAAWQSEFGILGEAFKRS
SPTSWTPDTTTEQLLCSSPSADLLSAASSELLSTNSLKGKAALQEQYGGAAGGGHEF
QTLHHRMPNVHQSVCPPKQQLIREPSTPPQKRQGGQQEQDPLKGKREEDPPKPEIDA
LDRHMQGQRSDLLHSLLDCAKIVDTEPERAGQSVAYLQRIASHHGDPTQRIASHFAD
ALAKRLSKGIEQKPQFQSSDECSKSFEDLTLAYKALNDACPYSKFAQLTGNQAILEA
MDKAEKIHIVDFGIVQGVQWAALLHAFATRPGGKPHKIKITGIPAPTLGQNPTSSLLA
TGKRLTEFAKLLDLEFEFCPVSKHMSEVELSTLKIEQDECIAVNFMLQLYNLLGDSPE
PLVKILKLAHALSPKVVTLGEYEAHLNACQFQVRFRNALEYFSAFFESMEPNMARDS
AERLNVEKHFFAEKIMGIVAFEGAERKIRLEGRDQWRIVMESAGFKFTNLSHYARSQ
ARILLYNYCEAYSLDESSGFLSLAWQNRPLLTVSAWCCC

Figure 439. Amino acid sequence of SEQ ID NO: 1440. The conserved HMG1/2 (high mobility group) box domain identified using InterProScan is underlined.

MKDAKAKRTAAKETKNKNVEAKKKLLSVKEKPNKKQAKPKAVKDPNQPKRPPTAF
FVYLEEFRKTFKQKHPDVKGVTAVGKACGDKWKELSEAEKAPYIAKAAQKRAEYD
VTMKAYKKKQEGVQSATPEESEKSKSELNEDDEDDESGEDDDE

Figure 440. Amino acid sequence of SEQ ID NO: 1441. The conserved HMG1/2 (high mobility group) box domain identified using InterProScan is underlined.

MKGTKAKVDQKQVAEKKAAKRKPATEAQAKRQMKKDKKAKKDPNKPKRPPSAFF
VFLDEFRKEYKKSNPNANSVSAVGKAGGEKWRAMSDGDKAPYVAKAEKKKAEYE
KSMSSYNKQKDASPEEVAEESDKSKSEVNDEEEDESGEEDDEHDDDE

Figure 441. Amino acid sequence of SEQ ID NO: 1442. The conserved HMG1/2 (high mobility group) box domain identified using InterProScan is underlined.

MKGAKAKNEASSTLKKIEDKPIGKRKAATKEVKPTSKKEKKGGKAAKDPNKPKRPA
SAFFVFMEEFRKTYKEKNPNVKSVSVVGKAGGDKWKSMSEADKAPFVAKAAKRKT
EYEKNMAAYNNKQTSTAGDSAEESDKSKSEVNDEDDDESGEDDDQE

Figure 442. Amino acid sequence of SEQ ID NO: 1443. The conserved HMG1/2 (high mobility group) box domain identified using InterProScan is underlined.

MATNSSSKTNPPRQRKRVDVDPANLKRARDGSGFIKCDVCNKSVPVALSDMHDCKL
EDKIWSNFDASKEAKHADAQKAPEAKKTKKKSEEKPKKRTKAKKTKDPNQPKKPA
TAFFVFMDDFRKTYKEANPDAKGAAQVGKEGGVKWKSMSDEEKKPYLEKAAELK
AEYDKAMSKYQQDLKDEAAKSSGECEDEGTKSDGDGGDDDEGAKSSGDGETEEE

Figure 443. Amino acid sequence of SEQ ID NO: 3633. The conserved HMG1/2 (high mobility group) box domain identified using InterProScan is underlined.

MKPKKRSAGAVKGSGKKDPKDLKPVQKERVLRVKKNEGEQTGKGKGKIKGKGKG
NDKSKGKGRQKQQHKEREKKTKTEKDPN<u>LPKKPATAFFYYMEEFRKTYQKENPGV
TGMREIGIACGIKWKELTYEEKAPYYDIATQKRAEYEKILAAYRKKKEAGEEVEAHE</u>
APGKTNSVINDGKEGGEEAGKEVEAHQGPDETNSEINDDKEGGKEAGEEVEVHQEA
DETNLKINDDKEGGEQEDME

Figure 444. Amino acid sequence of SEQ ID NO: 1445. The conserved ARID domain and HMG1/2 (high mobility group) box domain identified using InterProScan are underlined.

MSEQHHQHQTGHAKPIHPPPPVQRPLSQQRSAESQSAPGEPLPLPLPAPQSAGGCRFY
PSRLFK<u>HEEVVANRDLFFDTLNKFHLALGTKFMVPTIGGKELDLHLLYIEVTARGGL
DKVIKDRKWKEITCAFNFAPTTTSASFGLRKYYMTLLRYYEHVYFFQKKGQLPAAPL</u>
STVSPVPQSSDNGSAHPGSDEKQPEVKKRKKRSLPSPIVGVDPTSSVDQPVTGVIDGK
FEYGYLVTVKLGSDILRGVLYHKTSENLGAQFAGVSCLQDRNVFDTAASGNSTCQK
KKKERIKKRDPN<u>HPKPNRSGYNFFFAEQHARLKALHPDKDREISKMIGELWNKLSEE
ERGVYQDFGLKDKERYKKEMQEYKERLNVQSDTNEVFKQQFSRIPDSDVDMMRLS</u>
TQSGRRDINISAEQKISDQENNYKEPIVKQ

Figure 445. Amino acid sequence of SEQ ID NO: 1446. The conserved HMG1/2 (high mobility group) box domain identified using InterProScan is underlined.

MADGQLFNNILLGGRGGTNPGQLRIHSGGIVWRKQGGGKVVEMGKPEISSLSWTRIP
KGYQLGVKLKAGLNVKFNGFREQDVNNLSNFMTNTLGVTPEEKQLSISGRNWGEV
NLEGNMLTFLVGSKPAFEVSLADVSQTQLQGKNDVVLEFHVDDTTGANEKDSLMEL
SFHIPNSNTTFAGDEASPPAQIFREKIMSMADVGSSGGEAVALFEDIAILTPRGRYTIEL
HLSFMRLQGQASDFKIQYSSVLRLFVLPKSPHTLVVITLDPPIRKGQTFYPHIVLQFAM
EELAECALSMNEELLNTKYKDKLEPSYKGLSHEVFTQILRGLSAAKVTRPGKFRSSQ
DGYAVRASLKAEDGILYPLEKSFFFLPKPPTLILHEEIEYLEFERHGTGGASSISSHYFD
LIIRLKSEQEHQFRNIQRNEYHNLFNFISSKGLKIMNLGDAHGTSGVAAVLENSDDEA
VDPHLERIKSAREGGAGEDSDEEDEDFVAEKDDAGSPTDDSEEEQSDASESEETKEK
PAKKEVKKKEAPVAKATGTKRKKKDEEEDGGKKRKQKKKKKDPNAP<u>KRAMSGFM
FFSQIERENVKKSNPGIPFTEVAKALGERWKKMSAEEKEPYESRAKADQKRYKDAM</u>
AGYKSGPTNIIDSGNESDSE

Figure 446. Amino acid sequence of SEQ ID NO: 1448. The conserved Homeobox domain identified using InterProScan is underlined.

MSSIPGGRETR<u>RWSPTREQLRILEAIYNGGNQTPKPEQIQVIAAELRRHGTVAGINVFY
WFKNRKARERRK</u>SRSIQEAHAAANSSGFSSFQPNDHFSSEMTVGETNYLLNSNSEED
ESKFSNCVEVYDFLLNSDSAAAEVGVEVESSLQTLQLFPPSCTESMAYNNHQQ

Figure 447. Amino acid sequence of SEQ ID NO: 1454. The conserved Homeobox domain identified using InterProScan is underlined.

MGMDMEDCNTGLGLGMSIGLGMNLMREDLQSHRHHVNGPPVQLDLLPLAPVLPSR
DLPWGKTSPGTDGERSAGESKATVPRRIDVNKLPASCYYNEDTGTINVSSPNSALSSF
HVDSGGAINAESSCYGMSVKREREATEELEAERACSRVSDEEADQEGG<u>TRKKLRLS
KEQSALLEESFKENSSLNPKQKQALAKRLNLRPRQVEVWFQNRRARTKLKQTEVDC
EFLKRCCESLTDENRRLQKELQELRALKLASPLYMQMPAATLTMCPSCERVVPAENS</u>
RPPPFTLAKPQFYSYTHSSAAC

Figure 448. Amino acid sequence of SEQ ID NO: 1455. The conserved Homeobox domain identified using InterProScan is underlined.

MNLNDHTYNLSPMANSGNPEEQIDEDAVDDFMNYQPES<u>KKRRLTVEQVRSLERSFEI
ETKLEPEKKIQLAQELGLQPRQVAIWFQNRRARWKTKQLERDYSVLKASYDALKSD
FERLQQENKNIRAELESLKEKLEEADCCKEDNHSDMATSTKVTSTIENSKKLAADVA</u>
GEENDIDIKPFSDITLLFKEKDMGLEKMDIKPFRVMLLNEKEGSFSPGSDCSANTRNE
DKNPPHQILSHLAQASSSMKYPSGTNNIAGMDNINDQGLMHLAEALCGMGLPPKAY
QQLFRVDEGYLHEDAYNPLFQ

Figure 449. Amino acid sequence of SEQ ID NO: 3634. The conserved Homeobox domain identified using InterProScan is underlined.

MACDRSALYPSNVIMNTEDNSSANAIAAMIANSCTPPATFQGNRSMSVFETGNERKR
PAGNSYSALELSDDIGDEDGSDDCIHLGE<u>KKRRLTLEQVRALEKNFEMANKLEPEKK
MQLAKALGLQPRQIAVWFQNRRARWKTKQLEKDFNILKHDYDSLKQNYDNLMEEN</u>
NNLQAMIERLRNKSQSCHDQKFQANSSKLQKDDQDLPIFMMSATKVCANKENNNE
GRSSIGSEGSSVLDMDSPSTIESQQNIDSIGFSNVKARDPRLECNFRPKVEESVIEADEP
CNYLFYNNMESGPLLWEYNWSCL

Figure 450. Amino acid sequence of SEQ ID NO: 1457. The conserved Homeobox domain identified using InterProScan is underlined.

MACDRSALYPSNVIMNTEDNSSANAIAAMIANSCTPPATFQGNRSMSVFETGNERKR
PAGNSYSALELSDDIGDEDGSDDCIHLGE<u>KKRRLTLEQVRALEKNFEMANKLEPEKK
MQLAKALGLQPRQIAVWFQNRRARWKTKQLEKDFNILKHDYDSLKQNYDNLMEEN</u>
NNLQAMIERLRNKSQSCHDQKFQANSSKLQKDDQDLPILMMSATKVCANKENNNE
GRSSIGSEGSSVLDMDSPSTIESQQNIDSIGFSNVKARDPRLECNFRPKVEESVIEADEP
CNYLFYNNMESGPLLWEYNWSCL

Figure 451. Amino acid sequence of SEQ ID NO: 1458. The conserved Homeobox domain identified using InterProScan is underlined.

METTGTFKFSIPSPLVGCPGNIHDDDEEEDEEECSGTGQQTRKKRRLSLQQVRSLEKT
FEVENKLEPERKLQLAQELGLQPRQVAVWFQNRRARWKTKQLERDYGQLKLNYEC
LKSNFDAIKQENQKLTSELNYLKEKWEETQNLERDNTDLNKANEEKKVFGTGEDKA
ISDTKSLDKTMVCKQDHDGAEIKVTGVAMIFNEKLEGSESESSAIVNEQADNNNNNN
SPHSIDSHISTLSLNCCYVPGPPVASSAIDEGLMEALCPKGLIRPKEEHHHQQNFRADA
NFVQEDPACNFFNVDDTTVTLPWWEWA

Figure 452. Amino acid sequence of SEQ ID NO: 1459. The conserved Homeobox domain identified using InterProScan is underlined.

MEETKQRGLERLKSLANDDTTGLALGVGLSMAMPATITQEDDQKSAPLQLELLPFRP
IASRVGTSPAPSPPFRWFMPNNCREEVTVAETNLSGVARGGGGGIDMNRVPSTNEYE
ESAVFQADALRVVDNGPMAVKRERERAFDLEAERDRTCDVSSRTSDEEEIGSTRKKL
RLSKEQSALLEESFREHSTLNPKQKNALAKQLNLRPRQVEVWFQNRRARTKLKQTE
VDCEVLKRCCENLTEENRRLQKELQELRALKAAPQPCVIGQDNYYMPLPATTLTMC
PSCERVATMENSRSLQFSKSQISQFTQQSAAC

Figure 453. Amino acid sequence of SEQ ID NO: 1460. The conserved Homeobox domain identified using InterProScan is underlined.

MMMSGGRMYGGPNVLVTANENISRSADALEALLSSPVFNGSRSVANLEEVIGNVSK
RSFYNSFDQEETGDEDLDDCIHPPEKKRRLTADQVQFLERSFEIENKLEPERKIQLAKE
LGLQPRQVAVWFQNRRARWKTKQLERDYDILKSRYENLRVDYDSLLKEKDKLRAE
VTFLTDKLHDSDHEALTKDSESADKKVYPQPASHSDCVGEPERSTAAKDTPPGCKHE
DLLSSGTDSSGVLDEDSPHHVDCGHSSLDHVNSHLFEADQSDLSHAEEEEEEEGMSE
KLLPQTYTYHHLLKVEDGAYPDASIAYNDMFVLEDQVQLPWWD

Figure 454. Amino acid sequence of SEQ ID NO: 1461. The conserved Homeobox domain identified using InterProScan is underlined.

MASNGIMFNASNRNLIVMVNEAPSFEANSSLDGVMKNVSKRPFYNTLDADEAGDED
LLDECVHQPGKKRRLSVEQVRFLEKSFELDNKLEPERKTQLARDLGLQPRQVAVWF
QNRRARWKTKQLEREYDILKSSYDTLRVDYDNLLKEKDKLRSEVICLTDKLHAKEK
GFEIQTNDLETTCKKAFIQSDSQFESLEKSGIVSEGMTVSFDQQLVSYSIEDHHSSGTD
GSAVVDEESPHHIDSGHSSVVLLGYSVEDPLSSGTDGSDVLDEESPHHIDSGHSSVVG
YITSTRLSHIETDQSDFSQVDEEGSMREKLQFPQDCHNLKMECGLFPEAPTTSCNYVF
SMDDSWWDWS

Figure 455. Amino acid sequence of SEQ ID NO: 1462. The conserved Homeobox domain identified using InterProScan is underlined.

MPSVTQGSAMANPNFVALHNNQVMTEEQMETLRRQICVYSTICSQLVEMHRAMSQ
QQPSSVPTLLMGQHMLYDLAQGNPGFRTSA<u>RQRWTPSQTQLQILESLFDQGHATPSK
QKIKEITMELSQHGQISETNVYNWFQNRKARAKRKQL</u>PSQRGGESENETDDEYPGEK
RFKPQHDSNAQNPKSGHSEADPQVHKSDDVVQNKPCTTDQKQFGIQENDTQSLLQR
EDEMRPHASLGSTMLGVSGSAEHESVECLPEVKPIYSSVEVGNRDHDATQAYIHGSG
TTTGQVDGKSWQVPSVVVDVRRMFGENAVLVDSRGHMVPTNDMGVSFHPLQASE
GYTVLSQYQCASGVPVHALRANTGDPYRGT

Figure 456. Amino acid sequence of SEQ ID NO: 1463. The conserved Homeobox domain identified using InterProScan is underlined.

MVEYGGDVGVGSMMALMTEHHPESESIMTSIPIPSSYSSYSHGHGHGHGHGHGHGQ
SECLLSAAAMFQTSRPCQGSNKFEPANAQHIGGGGGGRGAGHFVMEQFIPEQAVISD
SSISSVKTEVCSGSGGQFELIRRKEEGRCGRAYAEPSFVVTPLVTSLPPQQQEGRMVT
SLAVDMDSSCSCKPNEADAMRAKIIAHVHYPRLVAAYIDCQKVGAPPEVVSELDDLS
HKCQTQHCVPTISVGADPELDQFMEAYCEMFIKYQEELTKPFKEAMAFLKKIENQLG
TLTKGTIRTSSLDQGDERGDGAASSEEEDGSGGEVEFHEVDPHAEDRELKDQLLRKY
SGYLSSLKQEFLKKKKKGKLPK<u>EARQKLLDWWTRNYKWPYPSESQKIALAESTGLD
QKQINNWFINQRKRHWK</u>PSEEMQFVVMDSPNPHNAAFFLEGHLRTDGTAFSMDC

Figure 457. Amino acid sequence of SEQ ID NO: 1464. The conserved Homeobox domain identified using InterProScan is underlined.

MQGMEHMNTTAQSSSSLYGVHMVEYGGDVGVGSMMALMTEHHPESESIMTSIPIPS
SYSSYSHGHGHGHGHGHGHGQSECLLSAAAMFQTSRPCQGSNKFEPANAQHIGGGG
GGRGAGHFVMEQFIPEQAVISDSSISSVKTEVCSGSGGQFELIRRKEEGRCGRAYAEP
SFVVTPLVTSLPPQQQEGRMVTSLAVDMDSSCSCKPNEADAMRAKIIAHVHYPRLVA
AYIDCQKVGAPPEVVSELDDLSHKCQTQHCVPTISVGADPELDQFMEAYCEMFIKYQ
EELTKPFKEAMAFLKKIENQLGTLTKGTIRTSSLDQGDERGDGAASSEEEDGSGGEVE
FHEVDPHAEDRELKDQLLRKYSGYLSSLKQEFLKKKKKGKLPK<u>EARQKLLDWWTR
NYKWPYPSESQKIALAESTGLDQKQINNWFINQRKRHWK</u>PSEEMQFVVMDSPNPHN
AAFFLEGHLRTDGTAFSMDC

Figure 458. Amino acid sequence of SEQ ID NO: 1465. The conserved Homeobox domain identified using InterProScan is underlined.

MEAKMANLNSVTNMPFACENGGCNKRFRPLVPKLTLSPNSAAPMANAVWSTQQSH
DQYSQLQQAFSSATSGNSVSVSAAACLLEPKISRLDGKVDDNSNQRNQIDRLIKGDQ
QNMKEEQAESCAVQSQPAASGTR<u>WNPTPDQIRILEMFYKGGMRTPNAEQIEHITAQL
RQYGKIEGKNVFYWFQNHKARERQKQKRNSSMHQVAATAAKKT</u>PTTIMADNPNEL
HKPNSNGTYSLYNLPFTAMSEDSRLMFTSTSLLTMPCSKGLAASLAQVGVDVLTPAT
KRDGLDVLKKSSHGPPQVQMNEEGSPSKNSMIWDSINSSGEGIITNLALSQAAADMP
VNAVNSCKRKNRLWQVMSPNEELGLHTESSSESICLQTSNSDPINPSDYTNEEDHRQ
LQTLQLFPLRPEGSLKSKGETNMDNSVLSLHVNPSSTYPFREFNKSAESSTQMGAAIF
EEHKYSKAAEFFPNLSADYSFLNSMT

Figure 459. Amino acid sequence of SEQ ID NO: 1466. The conserved Homeobox domain identified using InterProScan is underlined.

MAFHSLSHDMPLQRFSEQRLDGGGTRYSERRAPAGQLGIAEEGKEEIPIPRQRYGSLG
YTEAQSSSSSAKAALAGAGECGGGDKVPMLVLPLMSESGSASENNVKLGTTNTWLS
RAVSGQHRAQQQQQQHYAERSVEEGRKWCGCAAGSRDCIHSNFLKLQNPASAGSSS
AAANALSGRWLMPGPLLNDKIEGREGVELLGGEIPGESIMALSAQFKTAGSAAPERG
LLNLHSADAVNSNGEPVDSGGAGGDRDGGEEAEDHAALWQSARIKADIVSHPLYDQ
LLSAHLECLRIATPKDQHSMIDAQLEQSQHVVTKYSVLGNDNFLVGDKKELDQFMT
QYVLLLCSFKEQLQYHVHVHVMEAVRACIDLQHSLLTLTGVSPGEGTGATMSDDED
DNADSDTDLYDGGLDGGQDIVGLGPLIPTESERSLMERVRQELKVDLKQGYRAKIA
DVREEIL<u>RKRRAGKLPGDTTSRLKAWWQSHSKWPYPTEDEKARLVQETGLQLKQIN
NWFINQRKRNWQ</u>SNPSSSTTLKSKRKR

Figure 460. Amino acid sequence of SEQ ID NO: 1467. The conserved Homeobox domain identified using InterProScan is underlined.

MESEEDKISPENKKRRLKTPQQVEG<u>LESFYAEHKYPSEAMKSQLSEELGLTEKQVQG
WFCHRRLKDKRLMKEEA</u>SNNGKQDPHNGIMQDSVNGVKQDSSGSGKKSDHQRHSR
CKEVESQRFANAMDYPAAVLASELRDHDLFKVNHDNEDTFAGSSSASQDRSSLQSG
NPYEAEARRRPFQNGKHYEFEGKRKNRSSYMDPYSEEDGEHEAITAVREQLGDEYR
EDGPPLGVEFHPLPPGAFDDSTEPPYQGNIVVQDIQRMPKKMMEPDTRKMFRPEGFH
TPCSTGVGLGYMSVPMGLKFERASPKFERASPKCEWASYSKHESLNIKSAWRPANN
HLQIGDNYHVPDLNSSMQLDEDSPDDSPSSEFVTKSYPAWHKQEPAGRLSSDAHLPL
PYGSKNGMIPGKVLNAGKEFSIPRPYNGGDIYHDTSGVNPNVKAAMPPVQSRDLLSS
QGEDKFQPKKMTKRERLREERKIKREQDSALRLKQKLIPKEEKMNTQIERKKQMEEI
RKPREVAKCLAANEKVALSKNLMKGHTGEIPNNFSGGGLVAACSSME

Figure 461. Amino acid sequence of SEQ ID NO: 1468. The conserved Homeobox domain identified using InterProScan is underlined.

MPFAPTMAHARVTAPAVKSRNPSNFFSSTGLSLMLPGGGGGEGQNRSGHDEDQDYE
SSENMEGGSGDDIADLDHP<u>RKKRYHRHTPQQIQEMEALFKEFPHPDEKQRQQLSKKL
GLAPRQVKFWFQNRRTQLK</u>ATQERHENSLLRQEIDQLRSENVSLRESLRNPICSICGG
RGLNGDLMSFDEQQLRHENARLKDELDRVCALVEKLSGRPNSSRAPASNSSLDLTV
GLSGLHSPAMNSVNQRAMVLMGIERSKVTEVALAAMDELMKMSQTEEPLWVKNPE
AGMETLDHEEYSREFPRLIGPKPIGHKTEATRHTDIVVMKSSTIVDTLINANRWMETF
PCIISRATTVDVISNGVGGTRNGALQLMYAELQVLSPLLPTREIYFVRFSKQHADGLW
GVVDVSVDSLLDNPDPSLTKCRKRPSGCLLRDMPNNRSKVTWVEHLEYDNVGVHRI
FRSIISSGMAFGAQRWVATLQRQCQRIAFLMSTNGPTGDLAAVPTPSGRRSLMKLAE
RMTNKFCSGVSASSRHTWTKLSQGTGDDDVRVMSRKNVDDPGEPPGVVLSAATSL
WLPVSPNRLFDFLRDQSFRNEWDILSNGSPIEEVTHISNGKDRGNRVSVLSAKNSSQS
NTLILQESCADTYGSMVVYAPVEISAIHQVMNGNDSINVALLPSGFVILPEGPPESRSV
IDNRQVEGSILTIAFQILVNDLPSAKLTLESVETVNNLISCTAQRIKAALHKVEDV

Figure 462. Amino acid sequence of SEQ ID NO: 1469. The conserved Homeobox domain identified using InterProScan is underlined.

MPEGLMVHARHLPSLIAKPSFTSSGLSLAPPRLVEERQNSQTAETDLEKMREEEFESK
SGSENIEGASGEEQDVDPRS<u>RKKRYHRHTQHQIQELEMFFRECPHPDDKQRQELSRR
LCLEPRQIKFWFQNKRTQMK</u>AHHERQDNIMLKSENEKLRLDNMRYRDALSSITCPN
CGGPATLGEISFDEQQLRIENAKLREEVDRISGIAAKYVGKPLPSPVTRLNTLSSSTLD
LGSGGGSSCLGDFHGTAGGDIVSRHVVLADSEKPMVVEVAVAAMEELVQMAQVCD
PLWTTRFEDGCEILCQEEYTRMFPRGNLGSTSRSPYGVKTQEASRDTALVIMSSINLV
ETMMDVNQWSSMFSCIVSRASTLEIFSTGVAGNFNGALQVMYAEFQVPSPLVPTREN
YFVRYCKQHSDGIWAVVDVSLDTLRGNPQPHPNCPPSTLRCRRRPSGCLIQEMPNGY
SKVTWVEHVEVDERAVHRIYDKLVSSGMAFGAKRWLSTLERQCERLASMLACNIPA
RDLGVISNPEGRRSMLKLAERMTNSFCAGVSASNAHTWTTLSGSGAEDVRVMTRKS
VDDPGRPPGIVLSAATSFWLPAPPMRVFQFLRDENLRNEWDILSNGGLVQEMAHIAN
GQDPGNCVSLLRVNNLSNQGNMLILQESCTDVCGSYVIYAPVDIVAMNVVLNGGD
PNYVALLPSGFAILPDGTQSSLSLGSNVINDKISSGSLLTVAFQILVDSVPTAKLSLGSV
ATVNSLISCTVDRIKTALNCENA

Figure 463. Amino acid sequence of SEQ ID NO: 3635. The conserved Homeobox domain identified using InterProScan is underlined.

MATYFPGSNIQADNMQTLYLMNPGYAGYTDATTSGNMVLLNHSVGNTLPANNMA
GGQPSQFIGIPLPTASLSQQRSSLGVMGNSPTAQQDINTNLLASRIGGHPYNVWRNGG
NELTFMQTTDAAGSSQTLSGHLNNSGSMGHQPVAEISQLGLRRAPMSSIQEQQSGML
PSGLSLQLEHSHGSTGHGQGLSLSLSPQQPSTVQLPSFQNQPTDSDINCPGISATSEENI
SRTDRSTSKWAGSLSAFRASSRDGMLGSGFSNTGFSGNLLAPGANKQMHLDSSSTG
APGLSNVLIGSKYLKAAQQLLDEVVNVGKGIKPDSAKHQKSQSWIGTTANKENSGA
EGGGKDGAAAAPTWRSTSAQETNDRPSELSPAERQELQMKKAKLVAMLDEVDQRY
RQYYHQMQIVVSSFEAAAGYGAAKTYTSLALQTISRHFRCLRDAISGQIRLTSKSLGE
EDSTVSGKGETSRLRFVDQQLRQQRALQQLGMIQQHAWRPQRGLPERSVSVLRAWL
FEHFLHPYPKDADKHMLARQTGLTRNQVSNWFINARVRLWKPMVEEMYVEETKEA
EVDHGSNDKTGKESGEKKEDALSKEGAAGNNGNIHEQQSGKISKLDNIAQDGGADE
KPAGVPKSENASNLINVRNQSFGMGGTSDSQIFNETENEGIRQGQLKKARNGTQECT
SLLSPNMSIEVDLKSDETNSGEFGDHKFSDERQNTEDYSFVHNAMVHPDNSGSFGSY
QIGDLSRYGHESFTPRFSGSGGVSLTLGLQRTDGLSLQGAQQNYMSTQSLALGRRHD
LGGNSSDYCNIETSAPHPANLYENINIQPRKCFATQLMH

Figure 464. Amino acid sequence of SEQ ID NO: 1471. The conserved Homeobox domain identified using InterProScan is underlined.

MTVTVVTAQSFGMEAGKYVRYTAEQVEALERLYNDCPKPSSLRRQQLIRECPILSHI
EPKQIKVWFQNRRCREKQRKEASRLQTVNRKLTAMNKLLMEENDRLQKQVSQLVY
ENGYFRQQIQTVSITTTDTSCESVVTSGPHPHHLTPQHPPRDASPAGFLSIAEETLTQFL
SKATETAVDWIQMPGMKPGPDSIGIVTISNSCTGVAARACGFAGLEPSKVADILKDRP
AWLHDCRRLDVLTAFPTGKGGAVELLYTQMYAPTTLAPARDLLTLRYTSLLEDGSL
VVCERSLTGTQSGPNMPPVQHFVRAQMLPSGYLIRPCEGGGCIIHIVDHMDLEPWSV
PEVIRPLYESSAVLAQKMTITALRHLRQVAQEVSGEVVLGWGRQPAALRAFSQRLCR
GFNDAVNGFADDGWSLLGSDGVEDVIIAINSSPSKFLSSQIASSDGLSALNGGIMCAK
ASMLLQNVPPALLVRFLREHRSEWADCNIDAYSSATMKANAYNVPGSLGGITGSQVI
LPLAHTVEHEEFLEVIKLEGHGL THE
EALLSKDIFLLQLCSGIDEHAAGFCSQLVFAPIDASFADDAPLLPSGFRVIPLESGSDVS
PPNRTLDLASALEIGSAGTRASGDCGDSPCNLRSVLTIAFQFTYQNNVRDSVAAMTR
QYVRNVIASVQRVAIALAPSQQSPHIGPRLPPGTPEALTLTRWIFQSYRMHLGLELIGD
NSEPNESVLKLLWHHSDGIMCCSWKPLPVFTFANQAGLDMLETTLVALQDISLEKIL
DENGRKRLCSDFTQIMQQGYAYLPSGICISSMGRPVSYDRAIAWKVLNDEDVIHCIAF
MFLNWSFV

Figure 465. Amino acid sequence of SEQ ID NO: 1472. The conserved Homeobox domain identified using InterProScan is underlined.

MAVMANNKDAKNSMDTS<u>KYVRYTSEQVEALERVYSECPKPSSLRRQQLIRECPILSN
IEPKQIKVWFQNRRCREKQRK</u>EASRLQTVNRKLTAMNKLLMEENDRLQKQVSQLV
YENGYMRQQLQNASVAATDTSCESVVTSGQHQHNPTPQHPPRDASPAGLLSIAEETL
TEFLSKAKGAAVDWVQMPGMKPGPDSIGIVAISNTCNGVAARACGLVGLDPTKVAE
ILKDRPSWLRDCRCLDVLTAFPTGNGGTIELLYMQTYAATTLASARDFWTLRYTTVL
EDGSLVVCERSLSGTQGGPSIPPVQHFVRAEMLPSGYLIQPCEGGGSIIRIVDHMDLEP
WSVPEVLRPLYESSTVLAQKMTIAALRRLRQIAQEATGEVVFGWGRQPAVLRTFSQR
LSRGFNEAVNGFTDDGWSLMGSDGVEDVTIAINSSPNKHFASQVNASNGLTTLGGGI
LCAKASMLLQNVPPALLVRFLREHRSEWADSNIDAYSAAALKSSPYSVPGSRAGGFS
GSQVILPLAHTVEHEEFLEVIKLEGHGLTQEEAVLSRDMFLLQLCSGIDENAAGACAE
LVFAPIDESFADDAPLLPSGFRVIPLESRTDGSGGPNRTLDLASALEVGSTGTRTSGDS
GTNSNLRSVLTIAFQFTYESHLRENVAAMARQYVRSVVASVQRVAMAIAPSRLNSH
VGPRPPPGTPEALTLARWICQSYRLHIGVDLFRADCEASESVLKLLWHHSDAIMCCS
VKSLPVFTFANQAGLDMLETTLVALQDISLDKILDENGRKSFFTDYGQIIQQGYAYLP
AGICLSSMGRPASYDRAIAWKVLNDEDSTHCIVFMFMNWSFM

Figure 466. Amino acid sequence of SEQ ID NO: 1473. The conserved Homeobox domain identified using InterProScan is underlined.

MAVMANNKDAKNSMDTS<u>KYVRYTSEQVEALERVYSECPKPSSLRRQQLIRECPILSN
IEPKQIKVWFQNRRCREKQRK</u>EASRLQTVNRKLTAMNKLLMEENDRLQKQVSQLV
YENGYMRQQLQNASVAATDTSCESVVTSGQHQHNPTPQHPPRDASPAGLLSIAEETL
TEFLSKAKGAAVDWVQMPGMKPGPDSIGIVAISNTCNGVAARACGLVGLDPTKVAE
ILKDRPSWLRDCRCLDVLTAFPTGNGGTIELLYMQTYAATTLASARDFWTLRYTTVL
EDGSLVVCERSLSGTQGGPSIPPVQHFVRAEMLPSGYLIQPCEGGGSIIRIVDHMDLEP
WSVPEVLRPLYESSTVLAQKMTIAALRRLRQIAQEATGEVVFGWGRQPAVLRTFSQR
LSRGFNEAVNGFTDDGWSLMGSDGVEDVTIAINSSPNKHFASQVNASNGLTTLGGGI
LCAKASMLLQNVPPALLVRFLREHRSEWADSNIDAYSAAALKSSPYSVPGSRAGGFS
GSQVILPLAHTVEHEEFLEVIKLEGHGLTQEEAVLSRDMFLLQLCSGIDENAAGACAE
LVFAPIDESFADDAPLLPSGFRVIPLESRTDGSGGPNRTLDLASALEVGSTGTRTSGDS
GTNSNLRSVLTIAFQFTYESHLRENVAAMARQYVRSVVASVQRVAMAIAPSRLNSH
VGPRPPPGTPEALTLARWICQSYRLHIGVDLFRADCEASESVLKLLWHHSDAIMCCS
VKSLPVFTFANQAGLDMLETTLVALQDISLDKILDENGRKSFFTDYGQIIQQGYAYLP
AGICLSSMGRPASYDRAIAWKVLNDEDSTHCIVFMFMNWSFM

Figure 467. Amino acid sequence of SEQ ID NO: 1474. The conserved Homeobox domain identified using InterProScan is underlined.

MAVTSGKEGKSSSMDQGK<u>YVRYTAEQVEALERLYHDCPKPSSIRRQQLIRECPILSNI
EPKQIKVWFQNRRCREKQRK</u>EASRLQAVNRKLSAMNKLLMEENDRLQKQVSQLVY
ENGYFRQQLQNASIATTDTSCESVVTSVKHQQQNHLTPRDPPRDASPAGLLSIAEETL
TEFLSKAKGNAVEWIQMPGMKPGPDAIGIVTISHGCTGVAARACSLVGIDPTKVAEIL
KDRTSWLRDCRSVDVLTAFSTGNGGTIELLYMQMYAPTTLASARDFWTLRYTSVLE
DGSLVVCERSLSGTQGGPSMPAVQQFVRAEMQPSGYLIRPCEGGGSLIHIVDHMDLE
PWSVPEVLRPLYESSTVLAQKVTMSALRHLRQIAQEVSSDVVLGWGRQPAALRTFS
QRLCKGFNEAVNGFTDDGWSLMGNDGMEDVTILVNSSPSKLFGQQFASSDGLPALG
GGILCAKASMLLQNVPPALLVRFLREHRSEWADSNIDAYSAASWKANPCTVPSSRIG
GFGGGQVILPLAHTVEHEEFLEVIKLENHGLTQEEALLSRDMFLLQLCSGLDENAVG
ACAELVFAPIDASLADSSPLLPSGFRVIPLDSGMDGSSPNRTLDLASSLEIGSAGARTS
VDYGGNSGNLRSVLTIAFQFTFENHLRENVASMARQYVRGVVASVQRVAMALAPS
RLGSHLGPRLPPGTPEALTLARWVCQSYRFHLGVELLRPNSEVNESLLKTLWHHSDA
IMCCSLKSLPVFTFANQAGLDMLETTLVALQDISLEKILDDNGRKSFCSDIAQIMQQG
YAYLPAGVCVFSMGRPASYDRAIAWKVLNDEENPHCIAFMFMNWSFV

Figure 468. Amino acid sequence of SEQ ID NO: 1475. The conserved Heat shock factor (HSF)-type DNA-binding domain identified using InterProScan is underlined.

MAHSAKQNNDGTPVTVESHRSVPA<u>PFLIKTYQLVDDSNTDDIISWNEAGTTFIVWRP
AEFARDLLPNYFKHNNFSSFVRQLNTYGFRKIVPDRWEFSNEFFRKGEKQLLSEIHRR
K</u>GLIQPPPPPENRSISPSNSGDEQTWSSTSSPNSSTGVDALSHKNAIEENEKLRKENLLL
VSELTQMKKLHSQLLLFLSRHVNITSADHVANFLSQNVGPSEGLSMLARLKDYLEQY
GGEEISRDFPGSSLSSGISVANDDPFVSSSAKESMASKRPPFVDGACREVGRKSYISVK
IEDDDEKGNPKLFGVPLLPSKRPLPGSNDNGQPEPVIRKIGRCAN

Figure 469. Amino acid sequence of SEQ ID NO: 1476. The conserved Heat shock factor (HSF)-type DNA-binding domain identified using InterProScan is underlined.

MYEDKMAQSGEQPNEATVPRPADSHRSIPT<u>PFLMKTYRLVDDPSLNDIISWNEDGTT
FIVWRPAEFARDLLPNYFKHNNFSSFVRQLNTYGFRKIVPDRWEFANEFFRRGEKKL
LCEIHRRKNSQANGATANRPASPSITGEDQQGCSSTLLPLSSQAEAGVLLDENERLKQ
QNLFLMSEVAQIK</u>GLCSDILAFMSKHANISAESLRKSFDLHNVPDRFQQGEPMDGSP
AQSKDSCQRTQLCSSVHHSENETANGCGNSREMDDSKCVDSVKAEDKDNSGNPKLF
GVPLLSKKRSRPCSPDNDEKPEGNGNPFCVGNDAALKCVKAEPGLEMDLRQKQAP
WLKFLSVRNEKVCN

Figure 470. Amino acid sequence of SEQ ID NO: 1477. The conserved Heat shock factor (HSF)-type DNA-binding domain identified using InterProScan is underlined.

MTLLLDSCEGMLLSVESHKSVPA<u>PFLTKTYQLVDDPATDHIVSWGEDDTTFVVWRP
PEFARDLLPNYFKHNNFSSFVRQLNTYGFRKIVPDRWEFANEFFRKGEKHLLCEIHRR
KTSSQAVPNSAHGMPMSSSISPTTSDDQDWSPLSTPLSSPRGV</u>AAAAAVAAASVGGG
GMGGSLMVGCSGGGAGGGATAAMHASAAAAAAVSALSDDNDRLRRNNSMLLSE
LTHMRKLYNDIIFFVQHHVRIPPPPPHQSGSSSSSAMNMNRLKYHHQPTANPNAVPL
LLEAPTVPSTPRIADARDHRIMNPATREVVEISSSSPRSQQLFGLATARASSISFVDTKL
KEMAAAATSSPSTSSVTVADQEGIKSPPKLFGVPLHGKKRLHPQWDVVDQADTPNS
RNIIVTPPKVLKTDLALNLAPSSA

Figure 471. Amino acid sequence of SEQ ID NO: 1478. The conserved Heat shock factor (HSF)-type DNA-binding domain identified using InterProScan is underlined.

MDGSQNSGGNAV<u>PPFLTKTYDMVDDSSTDSIVSWSPGNNSFIVWNPPEFARDLLPKY
FKHNNFSSFVRQLNTYGFRKVDPDQWEFANEDFLRGQRNLLKNIHRRKPMHSHSQN
PQQGVCNDAIKYELEEEIQRLKRDKGLLMMELVRIRQQHQGTEMHMQTLEERLQA
MEHRQQQMMAFLAKA</u>VQKPGFVAQLVQQSENNKLLEAANKKRRLPKQENCSEAG
ETELTDSQIVKYQPASGDECSAVPLKVLNTDPFNRMESSLNTLETFFQDVGQACGEV
MDSGNSSQAGLTEMHGTCFSSICISPAISDIQGSCSLSEMHSSSHPSPQLAESITSEIPCQ
MSLGLSLSQCETSKGGETPNQSGKDEREAYMGSKTSGIDVNSEPVAMEMGDNERAA
GKVTASGKVTSGVNDLFWEQFLTETPGSATDTQEAESKIQETRTKDQDERLPENGKC
WSNKQTLDQLTEQMGQLASGTQT

Figure 472. Amino acid sequence of SEQ ID NO: 1479. The conserved Heat shock factor (HSF)-type DNA-binding domain identified using InterProScan is underlined.

MATSAEGSSSSPLGFVEESSQQLPSVAPQPMEGLQSSAI<u>PPFLTKTYDMVEDPSTDPV
VSWSSAGNSFIVWDPPEFSQNLLPRCFKHNNFSSFVRQLNTYGFRKVDPDRWEFANE
GFLRGQKHLLKNIHRRKPVQIQQLSPPLGSCVEVGKFGLEGEVERLKRDKNVLMLEL
VRLRQQQHNTECEMQTMNQRLQATEQRHQQMMSFLAKAM</u>QNPSFLAQLVQQKEK
RQLAAARKRKRLPKQQQDPQGDMGPSNEGQIIKYRPNPNDDTQPSLIETFELGSGAK
LEPPSSPFRAFFSGNPGENLQESNTLAGELMAVKGVEQMIQEGVPNPVALEIPNMSHL
QPPSVVALAKGKHVESSQPEDDLQGEEYLVSFGQTACSEEESTDLMGLELDLPGDVD
FCINKEEPKSVLGCEMSNDPFWDQLFGDNPQSIQSGPEGAGEFPGTGIQGPEEKPGAG
EWWDSQSNMSEIAIQMGQLAKDPPNA

Figure 473. Amino acid sequence of SEQ ID NO: 1480. The conserved Heat shock factor (HSF)-type DNA-binding domain identified using InterProScan is underlined.

MEGSQNGSSNAPPPFLTKTYDMVDDPATNAMVSWSPGSNSFIVWNPTEFSRVLLPTY
FKHSNFSSFVRQLNTYGFHKIDPERWEFANEGFLRGHRHLLKNIHRRKPVHSHSQQK
GESLSGGSCVEIKQLEDETEKLRQEKQGLVLELVRLKQHQQGTEFDLQSLEERLQLM
EQRQQRMMAFLAKAVQNPNFVAQLVQHHDKIAHIATTNKKRRLPKHDEVLEISENG
CTSSQIVRYDPGKSDAFSRDSPDKLETSADAFKNFFDAVPVDAHEKAKDCGSPQSHS
SGPTITEMHGKPCFPDMPVSLGVSDIYTSSALSDLNSSSGLPEMSVSLRSQDIQASAGL
VGSLRSDILCNLSLSPHSSSLELSKIDDATKAIQSGSPENRSLIGSKTGSNDGNSEAIDM
EVRLRYGAAKTTVQEGSVNGKARGTGKSMGAETTRKRINDVFWEQFLTESPQPIDT
EGTDSESQESSKDQDDVVPEYSNFCNRKENLDQLTLQMGQLASSVNL

Figure 474. Amino acid sequence of SEQ ID NO: 1483. The conserved Zn-binding protein LIM domains identified using InterProScan are underlined.

MAFAGTTQKCKACEKTVYLVDQLTADNSVFHKSCFRCHHCNGTLKLSNYSSFEGVL
YCKPHFDQLFKRTGSLDKSFEAIPRASRNDKMHENENRTPSRVSALFSGTQDKCVAC
GKTVYPIEKVAVDGTSYHRPCFKCCHGGCVISPSNYVAHEGRLYCRHHSSQLFREKG
NFSQLSKATPTKGVTENSDTDDK

Figure 475. Amino acid sequence of SEQ ID NO: 1484. The conserved Zn-binding protein LIM domains identified using InterProScan are underlined.

MAFAGTTQKCKACEKTVYLVDQLTADNSVFHKSCFRCHHCNGTLKLSNYSSFEGVL
YCKPHFDQLFKRTGSLDKSFEAIPRASRNDKMHENENRTPSRVSALFSGTQDKCVAC
GKTVYPIEKVAVDGTSYHRPCFKCCHGGCVISPSNYVAHEGRLYCRHHSSQLFREKG
NFSQLSKATPTKGVTENSDTDDK

Figure 476. Amino acid sequence of SEQ ID NO: 3636. The conserved Zn-binding protein LIM domains identified using InterProScan are underlined.

MAFTGTQQKCKACDKTVYFVDQLSADGVSYHKACFRCNHCKGTLKLSNYSSMEGV
LYCKPHFDQLFRESGNFNKNFQSQRSSKAIDGLSPEMTRSPSKVSMMFSGTQDKCAT
CGKTAYPLEKVTVENLSYHKSCFRCSHGGCSISPSNYAALEGILYCKHHFSQLFKEKG
SYNHLIKTASMKRAAAVPEVASAVPEI

Figure 477. Amino acid sequence of SEQ ID NO: 1486. The conserved Zn-binding protein LIM domains identified using InterProScan are underlined.

MAFTGTQQKCKACDKTVYFVDQLSADGVSYHKACFRCNHCKGTLKLSNYSSMEGV
LYCKPHFDQLFRESGNFNKNFQSQRSSKAIDGLSPEMTRSPSKVSMMFSGTQDKCAT
CGKTAYPLEKVTVENLSYHKSCFRCSHGGCSISPSNYAALEGILYCKHHFSQLFKEKG
SYNHLIKTASMKRAAAVPEVASAVPEI

Figure 478. Amino acid sequence of SEQ ID NO: 1487. The conserved Transcrition factor MADS-box SEQ ID NO: 3668) domain identified using InterProScan is underlined.

<u>MGKTKMEIKRIQNPSRRQVTFSKRKNGLLKKAFELSVLCDAEVALIIFSETGKICEFAS
HDERTLLARSRLAGDQIRGLELPSSRSWKTSEGCSFHQIGESQLKALREKMNKLKKK</u>
ERNMVGEDLDSLTIKELQRLENQLQIGIKRISDKKMKILVQSSKLLLQKVI

Figure 479. Amino acid sequence of SEQ ID NO: 1488. The conserved Transcrition factor MADS-box SEQ ID NO: 3668) domain identified using InterProScan is underlined.

<u>MVRGKIQMKRIENTASRQVTFSKRRNGLLKKAYELSVLCDAEVGLMIFSPGGKLYEF
ANTSMEKILEKYRKYSQHTSRNGLTTEQDNECVKQELANTKAQMRVLDSAQKKML</u>
GEDMETCSMQELDELEIQFEQGLNCIRARKTELLMAEVEELERKVTLSAQRYASTA

Figure 480. Amino acid sequence of SEQ ID NO: 1489. The conserved Transcrition factor MADS-box SEQ ID NO: 3668) domain identified using InterProScan is underlined.

<u>MVRGKIQMKRIENTASRQVTFSKRRNGLLKKAYELSVLCDAEVGLMIFSPGGKLHEF
ANTSMEKILEKYRKYSQHTSRNGLTTEQDNECVKQGLANTKAQMRVLDSAQRKML</u>
GEDMETCSMQALDELEVQFEQGLNCIRARKTELLMAEVEELERKVTLSAQRYASTA
YKVLCIVTLTHGLHC

Figure 481. Amino acid sequence of SEQ ID NO: 1490. The conserved Transcrition factor MADS-box SEQ ID NO: 3668) domain identified using InterProScan is underlined.

MA<u>RGKTQMKKIENVTSRQVTFSKRRNGLLKKAFELSVLCDAEVGLIVFSPSGKLYEF
SRPCMGKLLEKYEKNSRESGINNAAKEKDTQHSKREIANMEEKIRILESTERKMLGQ</u>
NLASCSDEELSQLQSQVERGLNRIRRRKNELLMDRIEQLKRKCADLEGGSVLTSSVL
QPGSTQCIDFETQLVMGPPNV

Figure 482. Amino acid sequence of SEQ ID NO: 1491. The conserved Transcrition factor MADS-box SEQ ID NO: 3668) domain identified using InterProScan is underlined.

<u>MAGEKRKINRIANASARQVTFAKRRRGLFKKAQELSILCEADVALLVFSSTGKLYQY
SSSSMKMILDQYILYSRSIQKDGKPNLEESHDIQKIKQQIKDISQNLRKLRGKELEGSS</u>
VKDLEELEEQLEMGLSSVRSRKDEYLIMEINELQQKGTRILKENTDLRRQLKERYGL
HMENNETSGNKDPQSSESKI

Figure 483. Amino acid sequence of SEQ ID NO: 1492. The conserved Transcrition factor MADS-box SEQ ID NO: 3668) domain identified using InterProScan is underlined.

MG<u>RGKIEIKKIDDVTSRQVTFSKRKMGIFKKAHELSVLCDAEVAVLIFSNTGRLYDY
ASSRCMERTIERYEKCTKAINCPTSDPIVENKSPIQEGIEILRQKLRALQRLQRNMMGE</u>
ELALLKVGELHDLEHNIECAILKVRARQNQIQLEKIANLRFKEQLLMGENEQLQKML
LEEAQRSLGLRPTSLIQTDIITSPTTIMNPYEGFF

Figure 484. Amino acid sequence of SEQ ID NO: 1493. The conserved Transcrition factor MADS-box SEQ ID NO: 3668) domain identified using InterProScan is underlined.

<u>MARGKTQMRKIESATSRQVTFSKRRNGLLKKAYEMSVLCDAQLGLIVFSPRGKVYE</u>
<u>FSSTCMQKMLARYENFSEGSKATSTAKEQDVQGLKRQIANMEERIEILESMHRKML</u>
GDELASCALKDLNELESQVERGLRNTEILVTEIEQLQRKEWILSEENAFLGKKFVHPH
SVSKTPGSESGSIQNSEVETQLVMRPPCTNAHFLINSSH

Figure 485. Amino acid sequence of SEQ ID NO: 1494. The conserved Transcrition factor MADS-box SEQ ID NO: 3668) domain identified using InterProScan is underlined.

<u>MGKTKMEIKRIQNPSRRQVTFSKRKNGLLKKAFELSVLCDAEVALIIFSETGKICEFAS</u>
<u>HDDMATILEKYRIYTETDGNMESSSVQSVKIGESQLKALREKMNKLKKKERNMVGE</u>
DLDSLTIKELQRLENQLQIGIKRISDKKMKILVQSSKLLLQKVRALEEEKIELETKLRIK
GYSFSSATNLNLGLSYSTMPSGLCDMNSNGNSFSVEIP

Figure 486. Amino acid sequence of SEQ ID NO: 1495. The conserved MADS-box SEQ ID NO: 3668) and K-box domains identified using InterProScan are underlined.

MGKTKMEMKHIQNPSRRQVTFSKRKNGLLKKAFELSVLCDAEVALIIFSETGKISEFA
SHNDMATILEKYRIYTQTETDGNMGASSVQSVKGWFPNFLEIAGITIESVAREDGQFE
KQERNMVGEDLQSLSVKELNRLENQLRIAIKKISDRKTKIFAQNAKSLAQKVRAMEE
EKIELQSKLRTRDDSFSSTNLNLGGLCDGNINGDCFSSEIH

Figure 487. Amino acid sequence of SEQ ID NO: 1496. The conserved Transcrition factor MADS-box SEQ ID NO: 3668) domain identified using InterProScan is underlined.

MGRGKIEIKMIENTANRQVTFSKRKGGLLKKAHELSVLCNAEIALIVFSNTGKLHDW
SSSSMKKVMEKYQKSDQGLGLMDYQQQQLLCEMKRITKENESLRARLRHMNGDDI
NSLKLPELFHLEQQLETAATQVRRRKDQVLDNEKIKRRNKMRRKEEENIILHEMLDQ
HHGQMEEDNAQINFLFCQPLNRSDTTFPASLLRLQPNQPNLQDIGY

Figure 488. Amino acid sequence of SEQ ID NO: 1497. The conserved Transcrition factor MADS-box SEQ ID NO: 3668) domain identified using InterProScan is underlined.

MGRGKIEIKKIENSVHRQVTFCKRRGGLMKKAYELSVLCDADVALIVFSSRGKLYEL
GTSNNNNNSMRSILERYQKCSQTAKHMNFSNNTSDEKMKQEINLLKQQIDQLKLTN
RYLMGEGLGSVSFEELTQLESRLQRGINQVRAKKHELMLDEIRALQSKEHTLRINNM
MLQERLEECTNGKRLSSLLTHGFTTLLPNQHVPSGYDLSNQSLSSNVEM

Figure 489. Amino acid sequence of SEQ ID NO: 1498. The conserved MADS-box domain and K-box domain identified using InterProScan are underlined.

MGRGKIQIKKIENSVHRQVTFCKRRGGLMKKAYELSVLCDAEVALIVFSGGGKLYEL
GTSNSNRNSMRSILERYQKCSQTAKHMNFSNNTSDEKMKQEINLLKQQIDQLKLTNR
YLMGEGLGSVSFEELTQLESRLQRGINQVRAKKHELMLDEIRALQSKEHTLRINNMM
LQERLEECTNGKRLSSLLTHGFTTLLPNQHVPSGYDLSNQSLSSNVEM

Figure 490. Amino acid sequence of SEQ ID NO: 1499 The conserved Transcrition factor, MADS-box domain identified using InterProScan is underlined.

MGRGKIQIKKIENTTSRQVTFCKRKNGLLKKAYELSLLCDAEVALLIFSTSGRLYEFA
NKSVSATTERYMRTYAENMPQSRALYPDCHHWQEEVRKLTQQRDSLTNSIRQIMGE
GLESLSMKELKHIQVQLEKSISCVRSKKNEMLLSEMENLQRRDCLLSAENQFLRSKIK
ELEDCSGKPDQLEATFAQNFIQQNTATETQQHSQTAPVVIQTALQLG

Figure 491. Amino acid sequence of SEQ ID NO: 1500. The conserved MADS-box domain and K-box domain identified using InterProScan are underlined.

MV<u>RGKTQMRRIENATSRQVTFSKRRNGLLKKAYELSVLCDAEVALIVFSPRGKVHEF
ASPSMQMVLDKYQKYSQESGISNRTKEKNTRHLKGEIAQMEERVNILESAQRKMLG
EDLASCSMKELNQLESQAERGLNRIRARKTEILMDHREQLKSKERMLTEQNVFLRK
MCAG</u>SQDDSDLTTPAIHLERIRMEHSEVETQLVMRPPHVQKNHLSTYSVH

Figure 492. Amino acid sequence of SEQ ID NO: 1501. The conserved MADS-box domain and K-box domain identified using InterProScan are underlined.

M<u>GRGKIEIKKIENSVHRQVTFCKRRGGLMKKAHELSVLCDAEVALIVFSSRGKLYEL
GISNRNRNRSMRSILERYQKCSQTAKHMNFSNNTSDEKMKQEINLLKQQIDQLKLTN
RYLMGEGLGSVSFEELTQLESRLQRGINQVRAKKHELMLDEIRALQSKEHTLRINNM
MLQERLEECTNGKRLSSLLTHGFTTLLPNQHVPSGYDLSNQSLSSNVEM</u>

Figure 493. Amino acid sequence of SEQ ID NO: 1502. The conserved MADS-box and K-box domains identified using InterProScan are underlined.

M<u>GRGKIETKKIENSVRRQVTFWKRRGGLMKKAFELSVLCDAEVALIVFSGRGKLYE
LETSHSNRNKSMRSILERYQKCSQTAKHMNFSNNTSDEKMKQEINLLKQQIDQLKLT
NRYLMGEGLGSVSFEELTQLESRLQRGINQVRAKKHELMLDEIRALQSKEHTLRINN
MMLQERLEECTNGKRLSSLLTHGFTTLLPNQHVPSGYDLSNQSLSSNVEM</u>

Figure 494. Amino acid sequence of SEQ ID NO: 1503. The conserved Transcrition factor MADS-box SEQ ID NO: 3668) domain identified using InterProScan is underlined.

MV<u>RGKTQMKRIENDTSRQVTFSKRRNGLLKKAYELSVLCDAEVGLIIFSPRGKLYEF</u>
ASPSMEEILEKYKKRSKENGMAQTTKEQDTQYSKHSKQKLANMEEQIRILESTQRK
MLGEGLESCSMAELNKLESQAERGLSHIRARKTEILVDQIECLKRKERLLSEENALLS
RKWVDRQSVDGSGSTSSSIGLGSIEQIEVETQLVIRPPNAQDHCSVNSGH

Figure 495. Amino acid sequence of SEQ ID NO: 1504. The conserved Transcrition factor MADS-box SEQ ID NO: 3668) domain identified using InterProScan is underlined.

M<u>GRGKIEIKMIENATNRQVTFSKRRGGLKKKAQELSVLCNAEVALIIFSSTGKLHEWS</u>
SSSSFFMLQKSMKKILERYQKSEQGLGLMDYQHQQLLCEMRRITKENESLQERLRH
MNGEEVNSLKLPELFKLEEQLDKAATQVRRRKDHVLENERIKQRNKMRRMEEENIIL
HGMLEQNQGHMEEDNGQFNFVLYQPVKKMRTAFPAPLLRLQPNQPNLQDIGY

Figure 496. Amino acid sequence of SEQ ID NO: 1506. The conserved Transcrition factor MADS-box SEQ ID NO: 3668) domain identified using InterProScan is underlined.

MV<u>RGKTQMKRIENATSRQVTLSKRRNGLLKKAYELSVLCDAEVGLIVFSPSGKLYEF</u>
ASTSMQKLLEKYEICSQECGTSESNKKQDPQCLKQEIENMEKRVRILQSTQRKMLGE
GLALCSIKELNQLEGQVERGLNHVRATKTKVLLDEIEKLKQKEHVFREEKALLHKKS
VNLRGANGCTIPSIGLTSIERVEVQTQLVMRPPHATEMDDNFMDVDNVPLSG

Figure 497. Amino acid sequence of SEQ ID NO: 1507. The conserved Transcrition factor MADS-box SEQ ID NO: 3668) domain identified using InterProScan is underlined.

<u>MGKKRVELKRIQNPSSRHATFSKRKNGLLKKAFELSVLCDAEVALIIFSETGKIYEFA</u>
<u>SNNDMAAILGKYRVHEEGTETSSPTSLQNVK</u>YHESGLEKLQEKLTALQKKEKNLIGE
DLEVLTMKELQRLEKQLQIGIKRISDRKMRIFSQSSKLLTHKVRALEDENKKLQTKIC
TRGESSTSVQETVVVQQTNLHLGLNTLPSRPSEMTGDGDNSQIGETEISNA

Figure 498. Amino acid sequence of SEQ ID NO: 1508. The conserved MADS-box SEQ ID NO: 3668) domain and K-box domain identified using InterProScan are underlined.

<u>MGRVKREIKKIVNATRRQATFSKRRNGLFKKANELAVLCDADVGLIVYNTAGKLFE</u>
<u>FSNSSMKMLINKYLKDRGGGES</u>DFFCEMHGCDDEIEVERLKEDIKNLSRFCRGDELE
GISLKMFEDLEESLEMAVKCVQSRQREIFTRQINILRNQENNALNERGELRNRMEEIH
TRTGSTRYCELVDVERESAENINSESTNGTKNRQSNYANKELDDFETFLTLRL

Figure 499. Amino acid sequence of SEQ ID NO: 1509. The conserved MADS-box SEQ ID NO: 3668) domain and K-box domain identified using InterProScan are underlined.

<u>MAREKIEIKRIANAPARQVTFSKRRRGLFKKAQELSILCEADVALVVFSSTGKLYDYS</u>
<u>SSSMKMIL</u>DKYSLYPTTNQKDGQPNLEPETQDIRRIKQQIEEITQTLRIISNELQQLEEQ
LEIGLTHVRSKKGENIVKEINALQQKGIRIIEENTKLRRELKEGYLRHVENNDAEESVL
IEPLENQDPQSSESITTYAFNFKLHKSAMKDYEDSDTSLQLGLSSQSKF

Figure 500. Amino acid sequence of SEQ ID NO: 1510. The conserved Transcrition factor MADS-box SEQ ID NO: 3668) domain identified using InterProScan is underlined.

MDLMESFEAKGKGEKRR<u>TVRGKTQLKRIENGTSRQVTFCKRRNGLLKKAYELSVLC</u>
<u>DAEVALIVFSPRGKRYEFANPSMQKMLARYENFSEGSKATSTAKEQDVQGLKRQIA</u>
NMEERIEILESMHRKMLGDELASCALKDLNELESQVERGLRNVRARKTEILVTEIEQL
QRKEWILSEENAFLGKKFVDPHSVSKTPGSESGSIQNSEVETQLVMRPPCTNAHFLIN
SSH

Figure 501. Amino acid sequence of SEQ ID NO: 1511. The conserved Transcrition factor MADS-box SEQ ID NO: 3668) domain identified using InterProScan is underlined.

<u>MGRGPVQLRRIENKINRQVTFSKRRNGLIKKASELSILCDAEVALIVFSNKGKLYEFSS</u>
<u>SS</u>MTKILERYRKRSNLIQDIGKDPQNSDIELTHLKEEVDRLQRSRRHLLGEDLHQLGA
TDLQHLEQQLEEALQKVTLTKTQFMLHLIEELRRKEQLLEGINKSLLRNFSELEGQYP
RDHYSLPISSRSLHSTTENYPQGEPTLQIGCPSTLTGITTTAQRQSRNYDAEGWMV

Figure 502. Amino acid sequence of SEQ ID NO: 1512. The conserved MADS-box SEQ ID NO: 3668) domain and K-box domain identified using InterProScan are underlined.

MA<u>REKIEIKRIANAPARQVTFSKRRRGLFKKAQELSILCEADVALVVFSSTGKLYDYS</u>
<u>SSSMKMIL</u><u>DKYSLYPTTNQKDGQPNLEPETQDIRRIKQQIEEITQTLRNMHGEELEELS</u>
<u>LNELQQLEEQLEIGL</u>THVRSKKGENIVKEINALQQKGIRIIEENTKLRRELKEGYLRHV
ENNDAEESLLIEPLENQDPQSSESITTYAFNFKLHKSAMKDYEDSDTSLQLGLSSQSKF

Figure 503. Amino acid sequence of SEQ ID NO: 1513. The conserved Transcrition factor MADS-box SEQ ID NO: 3668) domain identified using InterProScan is underlined.

MG<u>RGRVELKRIENKINRQVTFSKRRNGLLKKAYELSVLCDAEVALIIFSSRGKLYEFG</u>
<u>SAGMLKTLERYQKCSYVLQDATVSDREAQNWHQEVGKLKARVELLQRSQRHLLGE</u>
DLSPLSIKELQQLERQLEVALTHVRSRKTQVMLEMMDELRRKERILQEVNKSLRKKL
QEAEGQAFNAMQPPPHAWDSHAVANNAYAMQHPSNAVDCEPTLQIGYQYAPPESS
MPRHEQAQNNYMQGWMV

Figure 504. Amino acid sequence of SEQ ID NO: 1515. The conserved Transcrition factor MADS-box SEQ ID NO: 3668) domain identified using InterProScan is underlined.

MG<u>RGRVQLRRIENKINRQVTFSKRRNGLLKKAYELSVLCDAEVALIIFSTRGKLYEFA</u>
<u>SSSMNKTLERYEKCSYAMQDTTGVSDREAQQNWHQEVTKLKGKVELLQRSQRHLL</u>
GEDLGPLNVKELQQLERQLEVALTHLRSRKTQVMLDQIEELRQRERLLHEVNKSLQ
KKLSETEGRDVITGIEQTSNTNTGTNGPWDSSITNTAYALSHPQQDSNSSLHHVDCEP
TLQIGYQPVAPESIVPPHQPPHNQTPNQYMQGWWV

Figure 505. Amino acid sequence of SEQ ID NO: 1516. The conserved Transcrition factor MADS-box SEQ ID NO: 3668) domain identified using InterProScan is underlined.

MG<u>RGKIELKKIESTSNRQVTFSKRRMGLLKKAQELSVLCDAEVGVIIFSNTGRLYDFS</u>
<u>SSSMEKMIETYYRFIEKNGHSQQPHLPIHPNQDLGRLMQELQAIESTYKKSIGEELSSL</u>
SITDLKRLEHQLELGISRIRGRKNLLVEEQIANLQSRERELLEENNVLHRLVSEARSST
EMAASRFVNDNLAVNISSAPVTSTNPFQQRFGQTSQVCIGNSSSSRNIEQSSSGPHSIA
QQCPLPDQHGYHTQSAGLILDEWDLMEEYGSVIK

Figure 506. Amino acid sequence of SEQ ID NO: 1517. The conserved MADS-box SEQ ID NO: 3668) domain identified using InterProScan is underlined.

MG<u>RAKIPIKWIPRHTSRNMTFMKRKKGLEKKVKELSILCGVEACMVCFGPQMDQQT</u>
<u>TSDYPDVWPGKSKALEIVERYRNLSKEEQAKKKLDNSSFLEQRIKKLKVELSAKRKE</u>
NRELEMEAVYSWDACLNYFTIDQLKDLVDYIDIRLETANERMNFLSRDEREISNGAR
QQMEDGGSYNSMMPYQSGHDSSGSTLDHLKPYLSLEGHYKEHMSSCETVAMDYSK
ANPPFIRAFNDYHAPNYKEAMDNGEDDRMAVCNSHLMVNESFPLLGIDGVNPIQSST
GSCSQWCRTITPCSLHNPLYSTCPQHDGMNPTIQQVQFSCEPHYQQWLDEMMESQTI
QRVLGDEGINFQNDSGVRSTPLLLNRSSGSNDHCYIKNIF

Figure 507. Amino acid sequence of SEQ ID NO: 1518. The conserved Myb DNA-binding domain identified using InterProScan is underlined.

MTDMDRSSSDDNTSVDSQDDVNESYK<u>VDFSEDEADLISRLYNLLGQRWALIAGRIPG
RTADEIEKYCSKRY</u>ASD

Figure 508. Amino acid sequence of SEQ ID NO: 3637. The conserved Myb DNA-binding domains identified using InterProScan are underlined.

MGRSPCCEKAHTNKGA<u>WTKQEDDRLIAHIRAHGEGGWRSLPKAAGLLRCGKSCRL
RWINYLRPDLKRGSFTEEEDELIIKLHSFVGNK</u>WSLIAGRLPGRTDNEIKNYWNTHIK
RKLLSKGLDPQTHRPLGQPNNTPVTRPVLEHEIPAFQNPATPEIADLLQHHRLESSPIK
PAASDAEEHPDLNLNLCISLPSNSAPAVNRVSSVDTTVDSNSNSGDGLCWQFL

Figure 509. Amino acid sequence of SEQ ID NO: 1520. The conserved Myb DNA-binding domains identified using InterProScan are underlined.

MGRAPCCANGDR<u>SKGAWTKEEDDRLTQYIQAHGEGCWRSLPKAAGLLRCGKSCRL
RWINYLRPDLKRGGFSEDEDDLILKLHALLGNK</u>WSLIAGRLPGRTDNEIKNYWNSHL
KRKLISMGVDPLTHRPFQRNSRHDLSLPGKVEVPEIARPRELVENFFHSPSELCGDSE
QVSDAASESLARDEPSTLNLNLELSINWASMHVAVKEEPILKSKPGEEEGAGGRFDE
KGYLFRYEECPVGKSLL

Figure 510 Amino acid sequence of SEQ ID NO: 3638. The conserved Myb DNA-binding domains identified using InterProScan are underlined.

MGRSPCCEKAHTNKGA<u>WTKEEDDRLIAHIRTHGEGCWRSLPKAAGLMRCGKSCRL
RWINYLRPDLKRGNFSEEEDELVIKLHSLLGNK</u>WSLIAGRLPGRTDNEIKNYWNTHI
KRKLLNRGLDPQSHRPLGQPHNSNTTCPSLPALEHEILVFQRPRTPEIADFFQYERSES
SPMEPATSKDAEEHPDLNLDLCISLPVHSPPATSRASSVDGTVDSKPNSVSCHMGLQV
NYGVQCENRYCEESASGVSSFYTLVL

Figure 511. Amino acid sequence of SEQ ID NO: 1522. The conserved Myb DNA-binding domains identified using InterProScan are underlined.

MGRKPCYNAKDGVN<u>KGSWTEDEDLRLIQSIEAHGEGRWSALAKNAGLKRCGKSCR
LRWMNYLRPNLKRGNISSDEEDLIIRLHKLLGNRWSLIAGRIPGRTDNEIKNYWNTRL</u>
NKKVHGNGSIGRLKSVRRTEPNVKETAVNLKQTINTNQLGERDKVIAQELNKGSTSS
NSIESENSMCPTKQNPSSYLHAGTVSAEMKLWNQLQLNLILPSSWTNSSFLHIDDSNV
DTEENGHPYSCTFDTVNVCQDFIDQRMYAIPHSSLPSPEFVPTDTMGEFADFFNFIPYP
Y

Figure 512. Amino acid sequence of SEQ ID NO: 3639. The conserved Myb DNA-binding domains identified using InterProScan are underlined.

MGRSPCCAKEGL<u>NRGAWTKTEDIILSEYIRIHGDGGWRSLPKKAGLKRCGKSCRLR</u>
<u>WLNYLRPDIKR</u>GDISP<u>AEEELIIRLHRLLGNRWSLIAGRLPGRTDNEIKNYWNTRLSK</u>
KLLLSMNKSQCKSRKNLKSKAKPSPIQNRVFKTTPVKITTTVRLSGTATPNGSMNGY
GRSNPSSDKASKLCNVKETTNSSKSWCEHLGIDTDAAISTSSMSSLPLERSPHSYYFG
ADAAPLAESLLDLNELGLTVSDDQRIEEFYDHTQHLDWIHELDYAEGPSPQSLSLLLL
ESDDEREERLGDHGQIP

Figure 513. Amino acid sequence of SEQ ID NO: 1526. The conserved Myb DNA-binding domains identified using InterProScan are underlined.

MRRTKGLSKPSDGVL<u>HRGSWTPEEDRILKTYIEANGVGRWSTLPQNAGLMRRGKSC</u>
<u>RLRWMNHLRPNVKR</u>GH<u>ISADEEELIIRLHNLLGNRWSLIAGRVPGRTDNEVKNYWN</u>
<u>TRLSK</u>KLGSTGDNLARSLARRQIAKASPRIGVDNDAAVHLNSESSNFKFTPSLRSPTG
STIVPEETRSDIQLPSPESNNDGDRRTTVEKDDTPHLEPLDIAQTNPCGVPPPEEIGQCS
AQESGFVEQNHDMNSLGKEQSPDFSSTPYNTCLDSLLWFNYSPEMDDLFHCDYDQE
TSFSVSFSDHLQYISFGSQFWGDMIS

Figure 514. Amino acid sequence of SEQ ID NO: 3640. The conserved Myb DNA-binding domain identified using InterProScan is underlined.

MGRAPCCEKVGLKKGPWTPEEDQKLLAYIQEHGHGSWRALPQKAGLLRCGKSCRL
RWTNYLRPDIKRGKFNPQEEQTIIQLHALLGNR<u>WSTIATHLPKRTDNEIKNYWNTHL</u>
KKRLVQMGIDPMTHKPKSESTIAVGRQSCNGSSNLSHMAQWESARLEAESRLARES
KFRAQGLWPPSMRNPNVNSDILTRLRLAGQGFDSDKEGSNILGLNPTGGFERMKIAG
KWDKFQDLSLGIKSDQSNSSALGSSLRGYNPVENDQSADRASNTSYLSLLQQAMCPS
AQGSKILYNEAKKLMENQKNRQANVTATLYNVHQPHGNCSESKHL

Figure 515. Amino acid sequence of SEQ ID NO: 3641. The conserved Myb DNA-binding domain identified using InterProScan is underlined.

MGRQPCCDKVGLKKGPWTAEEDRKLVNFITLHGHGCWREVPKLAGLLRCGKSCRL
RWTNYLRPDLKRGLLSESEEKLIIDLHAAIGNR<u>WSRIAAQLPGRTDNEIKNYWNTRIK</u>
KKLRQMGIDPVTHKPLTQMQMQSTPAQTLLLQENDTEQQQQEQHNEPDPDQNQSSN
GTVETLVSRAREPHDDIEPLQNFNMEDSNFNMEDSMQLFNVCSPTSGISLSGRTEEVD
SDDSDQVSKSFGNGSSTHSQYIGRETSGVKAECGLSGWDQMAGVLGDPLSEWNVDL
EAWAAGLDAPAASASAWIQQLPDCQWNDFQGDFEICSSKSCPETLQRLGPFLDDDEL

Figure 516. Amino acid sequence of SEQ ID NO: 3642. The conserved Myb DNA-binding domain identified using InterProScan is underlined.

MAMSNGRLCEDLDRIKGPWSPEEDASLQRLVQKYGPRNWTLISKGIPGRSGKSCRLR
WCNQLSPQVEHRPFTPSEDAAILQAHAQHGNK<u>WATIARALPGRTDNAIKNHWNSTL
RRRCRDPEKGIVVHLDDEISSLDAARKRSSDGFSHDGSSALEDNGCSSWEVDSKRLK</u>
RLGELGTEQGPEVEAEVEVSDRSDANPGRVLYRPVPVVSFFSSFGKTVANLQETAAG
AVGVDPPTSLSLSLPGLDPAIPSPKLSTQKDSHNNSTVNNNIPIPPVVEYMRADEAVV
ERLSTAVKATVASMLTPVLNSSPRGYNPPAVSSDLLALMRDMVAKEVQKYMSSHH
QPGMYTPLSPHPEFLGAANLVRNVVLGGALHLNK

Figure 517. Amino acid sequence of SEQ ID NO: 1531. The conserved Myb DNA-binding domains identified using InterProScan are underlined.

MGRSPCCSKEGL<u>NRGAWTKREDMILSEYVRIHGDGGWRNLPEKAGLKRCGKSCRL
RWLNYLRPDIKRGNICPAEEELIIRLHRLLGNRWSLIAGRLPGRTDNEIKNYWNTHLS
KK</u>LSSQESQDKTSKNLSTSSKSPVPVQNRVFKATAVKITTAVRHCEIIRPNACNGDGC
SNFIPGEALQLCNVENTTKSSSCGLLVNDSTTSKQPERNAFATTDNLVQTEATNCTSS
MLNFGDQQSPYSDYFEGDAANLAESLLFLTDLSSPDCNLLASASDCSTDFASEDLYR
GPAALPEETNGFEDMCSDQNNMQRVNSSSMDQELEEFYNNAQDEDWIHELDCLENS
GAQPLSSLLLESENEWEERSIGKLALEDHVQI

Figure 518. Amino acid sequence of SEQ ID NO: 1532. The conserved Myb DNA-binding domain identified using InterProScan is underlined.

MAMSNGRLCEDLDRIKGPWSPEEDASLQRLVQKYGPRNWTLISKGIPGRSGKSCRLR
WCNQLSPQVEHRPFTPSEDAAILQAHAQHGNK<u>WATIARALPGRTDNAIKNHWNSTL
RRRCRDPEKGIVVHLDDEISSLDAARKRSSDGFSHDGSSALEDNGCSSWEVDSKRLK</u>
RLGELGTEQGPEVEAEVEVSDRSDANPGRVLYRPVPVVSFFSSFGKTVANLQETAAG
AVGVDPPTSLSLSLPGLDPAIPSPKLSTQKDSHNNSTVNNNIPIPPVVEYMRADEAVV
ERLSTAVKATVASMLTPVLNSSPRGYNPPAVSSDLLALMRDMVAKEVQKYMSSHH
QPGMYTPLSPHPEFLGAANLVRNVVLGGALHLQQMTISSCR

Figure 519. Amino acid sequence of SEQ ID NO: 1533. The conserved Myb DNA-binding domain identified using InterProScan is underlined.

MGRAPCCDKANVKKGPWSPEEDTKLKAFIEQHGTGGNWIALPQKAGLKRCGKSCR
LRWLNYLRPDIRHGGFSEDEDNIICSLYASIGSRWS<u>IIAAQLPGRTDNDIKNYWNTRL
KKK</u>LLGKRKDQQTRRFKEAKNMSNGTGPYVSEGMSTTSSTINAIRSLMSNTEALYLS
DRMPHMDMDPSSLGLLNPQVLQHTVSNIANYCSSSEHISFGTGPPQRLDQELTFDNV
SLRKLLFRTECGFTAENNNNSVSQASPPIISSQIYSPSTILDPGLVHDSFEKCCMNVNV
KEEPVAGALDHHHIDYLASMTLRDSCSSTEGNYIQSPWLYQNGLQDHSCLTYEFPME
QLNEGLYWNSASSSLQGHHEKEDLCAYSSYKESAHAQETGATFWGGTQLPCNYSKP
LSDCPNYLSGAPSDANQQGLSRSQEAGIIY

Figure 520. Amino acid sequence of SEQ ID NO: 1534. The conserved Myb DNA-binding domains identified using InterProScan are underlined.

MGRHLCCNQQKVK<u>RGLWSPDEDEKLINYITKYGYGCWSEVPEKSGLQRCGKSCRLR WINYLRPDIRRGNFSPNEEKLIIHLHTMVGNRWAYIASHLPGRTDNEIKNYWNS</u>WIK KKLAKAEIISKNIEASKVHNNLPQFLFEESATLGNENKLLKSEMNTDGHAAPQSHVLP SKETCETFPLWDYKMINHSTARNSQYEMEDSKTALTIDSLLIRTDSETGPIREFNTWD PSGILTNSSSKNCKNSDFQYILQRDNGQQVQGLPVSNTWHGYSSLNPIEGSFYYNPNS ESSNAVHTTSSINESDFMRSLDMGPLIYSHHETLDPADHANVATMWESGSSPNGVDL GYSECLYSGEQYNHATENSCSYLPPLYDVSEESAAIDIKHSGNNSLRYLEQIQSNEINI SQEMDAIQQIFEQNSSLVTTIQYCLGSHSPVSDSHHLHHRPQDAFD

Figure 521. Amino acid sequence of SEQ ID NO: 1535. The conserved Myb DNA-binding domain identified using InterProScan is underlined.

MRCKTGQAQGVLEVEGTHPAPSKPKLRKGLWSPVEDNQLTNYILRRGLVGCWNYV AKQAGLQRTGKSCRLRWINYLRPGLKRHPISRQEEQLIIELQSILGNR<u>WSQIAAQLPG RTDNEIKNYWNSC</u>IRKKLWFKPYSYSSTAITNGNINSKFNHPFPSDRIGNANSMPADV HVGVTSPRSAQPYLELMPEGYQPTNSAFNVVTNGDYQLCFPGYLELKQEQSQDEND ELLIDPKPTNNLLNSYSQLWNNGNSTHTHERFSTNAAFMSSSLQDQALHNYKAGRSA TTNTVANHEAPASTNNCSVDSIRITIPALGERRLLKENIENDGQINQNLIMDDHSSLTV SSRSCSWSAGHSYECMVSDFADVYPGVSYTTNEHELLGIRILEDHLDGHNSYQLPYT ERAGDGMANQLGCSRISNEEANVKPITAIFAGGTGVLEIHEYNGVAGQVTVWAQDD MYNISNATASDFLDHICLS

Figure 522. Amino acid sequence of SEQ ID NO: 1536. The conserved Myb DNA-binding domain identified using InterProScan is underlined.

MGRSPCCEKAHTNKGA<u>WTKEEDHRLIAYIRANGEGSWRSLPKAAGLPRCGKSCRLR WINYLRPDLKRGSFTEEEDELIIKLHSVVGNKWSLIAGRLPGRTDNEIKNYWNTHIKR</u> KLLIKGIDPQSHRPLGQPYSSNNMPVSRPISDLEIPALQNPRTPEIADFFGHDRSERSRV EPAVLDAEENADLNLSLCISLPSTSSPAGNGPSSVDRTVVSTPTSGL

Figure 523. Amino acid sequence of SEQ ID NO: 1537. The conserved Myb DNA-binding domains identified using InterProScan are underlined.

MGRAPCCSNDDRNKGA<u>WTKEEDDRLIQYIKVHGEGCWRSLPKAAGLLRCGKSCRL RWINYLRPDLKRGFFSEDEDDLILKLHALLGNNRWSLIAGRLPGRTDNEIKNYWNSH</u> LKRKLISMGIDPLTHRPFQKTSHHHPSPPQNVREAETTPSIGIVQDFFRCPSELSTKSEQ ISDAASGLAQDEQPHPNLNLNLELSIARSSVHRVAEKEDVVNSQQGESNLSEGK

Figure 524. Amino acid sequence of SEQ ID NO: 1538. The conserved Myb DNA-binding domain identified using InterProScan is underlined.

MRRLRCEKGNTNKGAWTQQEDARLIAYIRAHGEGGWHSLPRAAGLLRCGKSCRLR
WLNHLRPNLKRGNFSEEEDDLIIKLHNLLGDK<u>WSLIAGRLPGRTENEIKNYWDTHIK
KRKLSRELDPQSHRSL</u>WLPDNGSTTLSSPFADDHEISALQSPRTAETTDFFQPDQSESS
RIEPAASENEEHGDLNLDLSMSLPSKSPRTENRVLSVDGTADSNFNSGCGLFRVYI

Figure 525. Amino acid sequence of SEQ ID NO: 1539. The conserved Myb DNA-binding domain identified using InterProScan is underlined.

MGRTPCCEKGHTNKGA<u>WTKEEDDRL</u>IAHIRAHGEGRWRSLPKAAGLMRCGKSCRL
RWINYLRPDLKRGNFSEEEDEFIIKLHSIIGNK<u>WSVIAARLPGRTDNEIKNYWNSHIKR
KLLSRGIDPRSHRPLCPPSNTTSLS</u>WLAPDREFPAIQNLRTPEITDFFQHNRSESSPILPA
APDAEEDPHLNLNLCISLPSNSSPAANTAQSVRKTVDSNLNSGSDEVCYPVGLQINYG
KYCDSGYCEQNASCFSQFRLVL

Figure 526. Amino acid sequence of SEQ ID NO: 1540. Amino acid sequence of SEQ ID NO: 768. The conserved Myb DNA-binding domains identified using InterProScan are underlined.

<u>MPANMSNGEWTREQDKAFEMALADHLEDTKDRWEKIALAVPGKSPAEVKRHYEIL
VEDIASIEAGRVPIPCYVDEVAEQAADNGSAKKGGTHSSVYANLASENNGTKGSSK
SDQERRKGIPWTEEEHKMFLLGLEKFGKGDWRSISRNFVISRTPTQVASHAQKYFIRL</u>
NSMNRDRRRSSIHDITSVNGSDVSSPQGPITGQGNQSSGSAGQSANHASQPGLPSVYG
ATVGQPIAGPMVSAVGTPVMLPPGHAPYVVPVAYPMPQPTMHR

Figure 527. Amino acid sequence of SEQ ID NO: 1541. The conserved Myb DNA-binding domain identified using InterProScan is underlined.

MGAP<u>KQKWTSEEEGALKAGVEKYGTGKWRTIQKDPEFGHCLAARSNVDLKDKWR
NMS</u>VSASGQGSRDKVKTPRVKAIASLPYSSVTAESTSVFSIEATTSTTPDNLISPKSSS
NGKIHSPRYDGMILEALTSMQDPNGIDIATIASFMEERHELPPNFKRALGTKLRRLVA
QEKVIKIRNSYKLKDMTSTEVTSEVLGSAIPIDNSMQYSNAFTNTIDTFSVDRVNEAS
MAAAMKVADAEAVSAMADKAVEESELAAMLAEESDMIFEAASEVFEQLLQDGVLV
LS

Figure 528. Amino acid sequence of SEQ ID NO: 1542. The conserved Myb DNA-binding domains identified using InterProScan are underlined.

MWDMDLPSQGSSLSSSGSV<u>WTIQQNKIFENALADFDKDTPDKWEKVAARLPGKTAT
DVRKHYEDLVEDVTCIEAGRVALPTYSNSSCSHEWLEKSGAMHGLKQQFGSGGRGQ
STKASEQERKKGVPWTEEEHRQFLMGLRKYGKGDWRSISRNFVVSRTPTQVASHAQ
KYYIRL</u>GSDNKNKRRSSIHDITTVHGTDRMPSPLLHVSNRQTNSPSTQAEMNHSPCLT
YPSQISRGPLINSLGPQIDGNLLFSPHYPLNLYTQRGFGGLSPRTIIPDSSIAMHHSGYP
GQSAMQY

Figure 529. Amino acid sequence of SEQ ID NO: 1543. The conserved Myb DNA-binding domain identified using InterProScan is underlined.

MGRKPCCDKVGLKKGPWTAEEDKKLINFLATHGQCCWRTVPELAGLSRCGKSCRL
RWTNYLRPDLKRGVFSESEEKLILDLHSRVGNR<u>WSKIASFLPGRTDNEIKNYWNTHI</u>
KKKLKRMGLDPATHRPISETLPQPAPVAENNDVPKNNEAGGLVNPSEDEKPIQQELQ
ASSVLMKHVKEEESEQSSFPFNAANTQTTCKMDEELQVPEMMNAQTPLLLHAEYW
WDYSDIVAGFAESSQDNINSWVNPESIAGHLFETQRTVVPVPESSNSHLFLQSLDYFP
QGTSSKIFPLDF

Figure 530. Amino acid sequence of SEQ ID NO: 1544. The conserved Myb DNA-binding domain identified using InterProScan is underlined.

MGAPK<u>QKWTHEEEAALRTGVEKYGPGKWRAILRDPILSSCLSSRSNVDLKDKWRN
MS</u>VTANGWGSREKARLALKRSKYIAKQSGRQLALSALSNGNMDVVVTKPLSTVNP
YFPSSNTKRSISRLDKLILDAVFTLKEPNGSNKSAIATYIEENQYPPPNFRRMLSSKLKS
LVICGKLVKIRQNYMINGSFRPDDEKVPKNEKVEKHVTTLSKNSSKKVVGEVGIAVK
SEVDAEVSKMRRMNAEEAAKAAAVAVAEAEAAIAAAEQAACEAAAAEAEAEAAE
AFAEAAMMALVNSRSC

Figure 531. Amino acid sequence of SEQ ID NO: 1545. The conserved Myb DNA-binding domain identified using InterProScan is underlined.

MGRSPCPPKEALNRGAWTGMEDTILTEYIRVHGSGGWKDISKRAGLKRCAKSCRLR
WLNYLRPDIKRGNISPEEEELIIRLHRLLGNR<u>WSLIAGRLPGRTDNEIKNYWNTHMSK</u>
KPWLSMDESQSNTSQNLKTRSKSPVPVQNHVFKTTALKINPAARFSGTVSADGYSGD
GCSNHISNEAFNFCNVKETRKFSWRELLMNDSIRDEESGNTAFATTNNPVEAEATNS
LSFMSDLADQESPNRDHFQGDAITLSNSLLYLNEKSFPNCNLLPSPSDCSTDFASEEFY
RGMEEFYDNVQDEDWIREFDY

Figure 532. Amino acid sequence of SEQ ID NO: 1546. The conserved Myb DNA-binding domain identified using InterProScan is underlined.

MVRSSCYSKQGHRRGIWTPMEDMILSEYIRIHGSDGWKNIAKRAGLKRCGKSCRLR
WLNYLRPDIKRGNISPDEEDLIIRLHGLLGNR<u>WSLIAGRLPGRTDNEIKNYWHTHMSK</u>
KLYPSMNDSQPKSSQKLRRRAKSPVPVNPVFKATSVRIKPAMRLPGIVRENGYNDA
GSSNLISYEAFRLCNVKEIRKSSWGDLLVNHSIGDEESDLIALGLADNPVETSATNPLS
PMWSLADQQSPHYDHFEEDAATLAESSFYLNEKSSQDCNLLPSLSDCSTGFTSEGLY
REMVELYDNAEHDDWIHEFGYLEK

Figure 533. Amino acid sequence of SEQ ID NO: 1547. The conserved Myb DNA-binding domain identified using InterProScan is underlined.

MGRSFSCWSCSKDNGHERLNRRSWTVEEDTILSEHIKTHGVGRWTSLPKKAGLKRS
GKSCRLRWFNYLRPEIKHGNISPEEEELPIRLHRLLGNR<u>WSLIAGRLPRRTDNEIKNY
WNSHL</u>RKKIEMGELKPKIQKPLKRWGIPSYFDYKEEQAKAKDNCISHTTPVMKRAV
GHCGTVTSDVENYNNDNYDLIHNNLEAINPEEEGMKAANDHVMEIDASKSRCQLL
WENCIGNDKNDGFEVTDGLQPNSIVRTHNFGIEHHLHDQFCYYTNNYEIHSSYPSFFE
DQEFPHSKHFHSTSFESLLDLSELPFFPQ

Figure 534. Amino acid sequence of SEQ ID NO: 1548. The conserved Myb DNA-binding domain identified using InterProScan is underlined.

MTRKCSHCGNNGHNSRTCPNRGGVKLFGVRLTDGPIRKSASMGNLMMMSNPSSPA
DPSEPASAAAAAAAAAASGYLSDGLVEASTSSNSR<u>ERKKGVPWTEEEHRMFLLGLQ
KLGKGDWRGIARNFVITRTPTQVASHAQKYFIRQSNMTRKKRRSSLFDMTPPNNGAP</u>
LSSQPASDQEFESNYSEKTAEAENSFSQCAAAMACGVPMTFPGFMAPLLPFPFPVWP
GFRPATTELPPNSNIFKPRAEIPKAPVNIIDETGISKLSIGDPPGSIEPSGLSLKLLNKPSR
QSAFHTNPALNDNGFSSSGNAIHVV

Figure 535. Amino acid sequence of SEQ ID NO: 1550. The conserved Myb DNA-binding domain identified using InterProScan is underlined.

MTRKCSHCGHNGHNSRTCPNRGVKLFGVRLTDGPIRKSVSMGNLLHYSNNASSSNN
SPASASAMEPCESVANAAASADGYVSDGLVHNNSR<u>GERKKGVPWTEEEHRMFLIGL
QKLGKGDWRGISRNFVPTRTPTQVASHAQKYFIRQSNLTRRKRRSSLFDITAEPISCPL</u>
PSPALPVLSSQSASDQEEAESGDNSANSADVETLLPQVDETASADLTVFPGFVTPYVP
YGFPIWHTFRPTITQTSNVYKPTAVMPTAPIKMDECTGLSQLSLGGVAAASAMKPSE
LSLKLHGRPPSRQSAFQAKPSLNESSSLSSSSNVISVV

Figure 536. Amino acid sequence of SEQ ID NO: 1551. The conserved Myb DNA-binding domain identified using InterProScan is underlined.

MANRSLWGGSDFDYENEADTRKGPWTVEEDMQLGIVNLHGEGRWNFLARASGLQ
RTGKSCRLRWVNYLRPDLKRSKITPEEERLIIELHRRWGNR<u>WSRIAQSLPGRTDNEIK
NFWRTRMK</u>GKLNSETQKDIAGVDADDGVQFESELGSCRLPVISSHALPEVDVAEPSS
TFPQQNAEEIMVQTNTTPSLQNDTPPQVIQSSEGNSENVLQGGEIDGHYQINDDGQPG
ESNPEHLEGPDSVFQKTRLPHTFSVGSLVTLLSSEFFADSAIQDCKISPLSSYVAASPEA
VSDSEIYLSCYSDVLWNMDEEDNRCFRSWQSAEDTRLY

Figure 537. Amino acid sequence of SEQ ID NO: 1552. The conserved Myb DNA-binding domain identified using InterProScan is underlined.

MGRAPCCEKVGLKKGPWTPEEDQKLLAYIQEHGHGSWRALPQKAGLLRCGKSCRL
RWTNYLRPDIKRGKFNPQEEQTIIQLHALLGNR<u>WSTIATHLPKRTDNEIKNYWNTHL
KKRL</u>VQMGIDPMTHKPKSESTIAVGRQSCNGSSNLSHMAQWESARLEAESRLARES
KFRAQGLWPPSMRNPNVNSDILTRLRLAGQGFDSDKEGSNILGLNPTGGFERMKIAG
KWDKFQDLSLGIKSDQSNSSALGSSLRGYNPVENDQSADRASNTSYLSLLQQAMCPS
AQGSKILYNEAKKLMENQKNRQANVTATLYNVHQPHGNCSESKHL

Figure 538. Amino acid sequence of SEQ ID NO: 1553. The conserved Myb DNA-binding domain identified using InterProScan is underlined.

MVKELLMMCSNCGHSGHSSRACPDRGSVKLFGVRLIATDDGMACMRKSLSMGNLG
HYRSLYNVNHCSGTSECGSADQDGYLSDGFVHSSSNA<u>RERKKGVPWSEEEHRMFLY
GLEKLGKGDWRGISRNFVTTRTPTQVASHAQKYFLRQSNLNKRKRRSSLFDMCPHD
SHV</u>TSSFRREDSLGNLYEFSPKHSALGVSPNFELYSFGVSPTLSLGRSLQPVEAVLEEK
AAHYHPVNSEEDTSSMSSTTDAPAKEKNSWPSSAPQKFQLSLWPELELMTSSNASSG
KENGMKPMVAGMPVHCGENTDLSLSIALPPRNTSLNSNGSLSNAIRVV

Figure 539. Amino acid sequence of SEQ ID NO: 1554. The conserved Myb DNA-binding domain identified using InterProScan is underlined.

MNRRCSHCGHNGHNSRTCPDRGVKLFGVRLTTDEPMRKSLSMGNLPLTPEQSESGA
AEDGYVSDGLVQNS<u>RERKKGVPWTEEEHKMFLLGLHKLGKGDWRGISRNFVTSRTP
TQVASHAQKYFLRQSNLNKRKRRSSLFDISTDSMEDCYQGIPELSPVMHDLSLGQNS</u>
SLTSGNFFETGGAPPNLAASVGAFSVPPLAASRPVIPPCLSLGMYKSDDGEMARYEA
KYSSLNEAERQESGGYSNPTSHYSFTLPFWPDLGTKASKIIKPSAPTSPSMEARESIEN
SGLSLSIAPPSVDPPAPHNTLNLDQSNSRRSAFRSSNLDSSSNAISVV

Figure 540. Amino acid sequence of SEQ ID NO: 1555. The conserved Myb DNA-binding domain identified using InterProScan is underlined.

MSSRSCSLCGLNGHNSRTCVGSGVMLFGVRLTDGPMRKSASMNNLSNLSQYEHSDP
AEVAAEGFDGYVSDDLVHSSSNA<u>RERKRGVPWTEEEHRMFLVGLQRVGKGDWRGI
SRNFVKTRTPTQVASHAQKYFLRQSNMNRRRRRSSLFDITTDTFLSIP</u>VESEDLVPGT
GNTPSFTRQLSLGQNSSFPAPETGNFAIPVTSFPVPLSHAVLPGLPVGKSHELEKEESTP
MECGDSPGSSSLAFSEDAVNASVSHPKIMDVGPLRYKMWKAATPLSSVEGSKVVRPI
PIIPTPPLKTTESDVEKPMSSQNPVMEPSPLSLKLSEQPKRHSAFQSMTSHSSHELKSQ
GNLSNVISVA

Figure 541. Amino acid sequence of SEQ ID NO: 1556. The conserved Myb DNA-binding domain identified using InterProScan is underlined.

MSSRSCSLCGLNGHNSRTCVGSGVMLFGVRLTDGPMRKSASMNNLSNLSQYEHSDP
AEVAAEGFDGYVSDDLVHSSSNARERKRGVPWTEEEHRMFLVGLQRVGKGDWRGI
SRNFVKTRTPTQVASHAQKYFLRQSNMNRRRRRSSLFDITTDTFWSIPVESEDLVPGT
GNTLSFTRQLSLGQNSSFPAPETGNFAIPVTSFPVPLSHAVLPGLPVGKSHELEKEEST
PMECGDSPGSSSLAFSEDAVNASVSHPKIMDVGPLRYKMWKAATPLSSVEGSKVVR
PIPIIPTPPLKTTESDVEKPMSSQNPVMEPSPLSLKLSEQPKRHSAFQSMTSHSSHELKS
QGNLSNVISVA

Figure 542. Amino acid sequence of SEQ ID NO: 1557. The conserved Myb DNA-binding domain identified using InterProScan is underlined.

MGRSPCCSKEGLNRGAWTKREDMILSEYIRIHGDGGWRNMPKRAGLKRCGKSCRLR
WLNYLRPDIKRGNISPDEEELIIRLHRLLGNRWSLIAGRLPGRTDNEIKNYWNTHMSK
KLLPLNESQPKTLPVPKRRSQSPSPLQNRVFKANPVKITTVVSPSDIGRPKGYSNRRSD
ETTNSSKSRYQLLVNDSDSITGSESKPIPSANADNHVATEAAMSSLADQQSLESNHFY
AAAMADSLLYLNELSSPDSDLLSYPSNCSTDFGLEEFYSVPTTETNGFEDMCSDQRN
MERVDNSTVAEKQVMEEIFHNTERLDWIHEIDYLQKSSSQQLSFLLLEAEDEWEERA
TGKAVPENTEQIP

Figure 543. Amino acid sequence of SEQ ID NO: 1558. The conserved Myb DNA-binding domain identified using InterProScan is underlined.

MTQATNYTAGTIRDDQEEQCVRRGPWTVDEDMSLIRCVTTRGEGRWNTVAKFAGL
KRTGKSCRLRWLNYLRPDVKRGNITPEEQLLILELHRLWGNRWSKIARQLPGRTDNE
IKNYWRTRIKKHIQKAHCDANPRQLEDSLRYSWLSALLQPKGIESSNQSAQAASSSEII
QPSELDYMLSQYKWMSGLETEIAGINEPGDSLNPASFRTSQGSIRSREYLNQNSRATF
QDVHDMDQSTSEKQNCYYHQSLFGYSNSDSVHHEISQAISPSEVGIDKDMGTPCNGV
ALVQPIMISESEELKDIHESTAGFGIQYVNSEAQTSSCNNQISGIETNWPQESNNTSLW
NEELWYIPSSAQL

Figure 544. Amino acid sequence of SEQ ID NO: 3643. The conserved Myb DNA-binding domain identified using InterProScan is underlined.

MAMSNGRLCEDLDRIKGPWSPEEDASLQRLVQKYGPRNWTLISKGIPGRSGKSCRLR
WCNQLSPQVEHRPFTPSEDAAILQAHAQHGNKWATIARALPGRTDNAIKNHWNSTL
RRRCRDPEKGIVVHLDDEISSLDAARKRSSDGFSHDGSSALEDNGCSSWEVDSKRLK
RLGELGTEQGPEVEAEVEVSDRSDANPGRVLYRPVPVVSFFSSFGKTVANLQETAAG
AVGVDPPTSLSLSLPGLDPAIPSPKLSTQKDSHNNSTVNNNIPIPPVVEYMRADEAVV
ERLSTAVKATVASMLTPVLNSSPRGYNPPAVSSDLLALMRDMVAKEVQKYMSSHH
QPGMYTPLSPHPEFLGAANLVRNVVLGGALHLNK

Figure 545. Amino acid sequence of SEQ ID NO: 1560. The conserved Myb DNA-binding domain identified using InterProScan is underlined.

MGRAPCCDKMGVKKGPWTLDEDKILVDYITKHGHGNWRALPKQAGLLRCGKSCRL
RWTNYLKPDIKRGNFSPEEEDQIIKLHELIGNR<u>WSTIASYLPGRTDNEIKNVWNTHLK</u>
KRLARMKADSVAVDAQPTPASSLASSTTEMTCHGSSPVRSQILCNSVPSAPSESQICD
PVYVLPELSEDITSSSYNICTSTIDYQSTSTDSPLDVFQSDSIDSLEPEIDQNHISINTLDE
LECQQPLSKDPQIFIGNYQNNFEDSAGGSAISHDDKAEMGSSSSQGMSSDCDGEMIIS
DKSLNSPLNLRVDSPMQQFYAAEVDWFLDQSENMSAAMDSNHLPTNTNQLWGTDL
HVNEGMDFWLNILRQVEPLPLFQFASPALVSSPINSSHHC

Figure 546. Amino acid sequence of SEQ ID NO: 1561. The conserved Myb DNA-binding domains identified using InterProScan are underlined.

MGRAPCCGD<u>HEGLKRGPWTAEEDQKLIHYVQSHGLGNWRNLPKLAGLSRCGKSCR</u>
<u>LRWANYLRPDIKRGAFSMPEELTIIRLHAVLGNKWSAIASHIPGRTDNEIKNHWNTKL</u>
KKRLLFMGIDPVTHMPLPTPDMLSPFMASSSTPIAARLNSALVEAQLGRLARDYVNT
AHVSAGTADHQYSWQLSQILNLLGAHNNPVSAAPSGLLSSISRNEFLQPDALTWSHG
SQKQINHEFISRQKDDSAKYNAFSQESLQFSDPQKKSKGKNLSINTDHSNEHRTPSSLI
AERPSAFDTEISGWNPMPILMPSNNPHQNDHHYSYSDEKSSSTTCTNSCKGGSENTEN
TIQYQQDAPFGSAIRSSLSMSLPAASVDLHEDESNYWADLLNSIEDSNPAFPLPSP

Figure 547. Amino acid sequence of SEQ ID NO: 1562. The conserved Myb DNA-binding domain identified using InterProScan is underlined.

MPMLAETYRDSFETTSGGSSVDLVGMALPGLAPNLSSASVSASASEDSAKKIRKPY<u>TI</u>
<u>TKSRESWSEQEHDKFLEALQLFDRDWKKIEAFVGSKTVIQIRSHAQKYFLKVQKNGT</u>
REHVPPPRPKRKASHPYPQKASKNVPVSQQVSTAFPTAATQLDSGYYPRAESSSILTK
SGSSCPTVSSWVHHTIPSIDASFVEKDDGGPPGIATGNNCSSGSTESSPPTWPPCSEIPE
KVKPDFSQVYKFIGSVFDPSTTDHLKKLKEMDPIDLETVLLLMRNLSINLSSPDFEEH
KLFLSVYDMNPEDAEPAIENQTDECVAVPGTAAKQPSDLWNGPLGSVHLGSVKGHE
KEEQNSQQKSHDLKGSSDSKHSDLDGSSVNGTAASFHGNLAKTCGMTRSCFSNEAP
T

Figure 548. Amino acid sequence of SEQ ID NO: 1564. The conserved Myb DNA-binding domainidentified using InterProScan is underlined.

MGRAPCCT<u>KVGLNKGAWSAEEDSLLGRYIQTHGEGNWRSLPKKAGLRRCGKSCRL</u>
<u>RWLNYLRPCIKRGNITTDEEELIIRMHALLGNRWSIIAGRVPGRTDNEIKNYWNTNLS</u>
KKLAVRGIDPKTHKKITTDGTNRVNGDRFSQRKGEKIYDSPQKPRQPERNVARAAQS
TGLVIPNVHNLKADLKAQYIARIREFKSSNTISSSSRLNAQIEPKSRELSTEDPIFRCSSA
SEKTRETTHPDFMEPHPVASSDAGKQTNDSTVYCSSDSAASCSLIEHFSSEDDHHYLS
MEGNSNECYSQTLAEDYGSLKPSTPHTESEPICDSRERDNDSHVQKHDQFPEYDVFSF
FDVRNAENEICCSADQWVHEQEAEFMQQKDQEMPQLGSWEKQIDDQEKENFESHV
NNDVTAMSWEASFWF

Figure 549. Amino acid sequence of SEQ ID NO: 1565. The conserved Myb DNA-binding domain identified using InterProScan is underlined.

MGVPKDEAAMAMAVAERIKGPWSPEEDASLHKLVEKYGPRNWSQISRGIPGRSGKS
CRLRWCNQLSPQVEHRPFSPHEDATIIQAHARHGNK<u>WATIARLLPGRTDNAIKNHW
NSTL</u>RRRYHGEKDQSNGLAVNLESAAEDKETMTPMTPVTATATATATAMPVAL
VFPTAVDNVRKRSNSSCSANDNPGDAEVESCRLKRLNFSESPSSSENINNNNNNEEA
VSGHCNSAAAPGSSPGQQLHRPVPRQSAFNCYEAVKVQEEASASVSASGSACAFDPP
TSLSLSLPGSASSSENNSSGECSPTEQSSEMKYAKFQAYQQPTGYSFANPFPVGGYMK
TEEAMAMMSTAVKIAIGQALPLIFQLPSGNSQEGCSGDSANYGGSLLSIMREMIAKE
VQSYTNGSPCSNQGSGMNSVAPAFREVGLMLKK

Figure 550. Amino acid sequence of SEQ ID NO: 1569. The conserved Myb DNA-binding domain identified using InterProScan is underlined.

MSCTTGGLSSPVSKPKLRKGLWSPEEDDKLINYMMKNGQGCWSDVAKQAGLQRCG
KSCRLRWINYLRPDLKRGAFSPQEEQLIIHLHSILGNR<u>WSQIAARLPGRTDNEIKNFW
NSCI</u>KKKLKHLSASTNNSKSISAPNRTSTMNSSITPFSESSAEPLEVMATRYQPSNAFN
HEVPTAENQFCIPDVLALRHEQVQSQNQFSIDQDSATNNLISHLWNSNSTAVSSHESF
SHAFMSPGLQTQGHVVKTPIKPCDQISWSTPLTREAAGSHACNYSLGCNIPALVESES
LKEKFKNDAGDQINENEIMYSSTASSVITAWSTNSYSDAEYCTVDPHDQVGSILEDY
VSHEKTTDHQPCPPLNSSLQFSAPEIRWTADQSNDHEEYDCKDRLNLRYDVNLGYPN
NTNNKQNGYQLPQIGGGGVNGDHWDCTRIPNMEEANSTTPTSTILGGSGQFEFECDG
DAGGQVTAWAHDALYNDIHTAASDLLGQIYFG

Figure 551. Amino acid sequence of SEQ ID NO: 1570. The conserved Myb DNA-binding domain identified using InterProScan is underlined.

MGRHSCCYKQKLRKGLWSPEEDEKLVRHITKYGHGCWSAVPKQAGLQRCGKSCRL
RWINYLRPDLKRGTFSPQEENLIVELHSVLGNR<u>WSQIATHLPGRTDNEIKNLWNSCIK
KK</u>LRQRGIDPNTHRPLSEVNAEAGDSKNDNSNKEVETQAAMDESHVSAGNEFKHLN
AIPRADTANPKFFHVPVEDNTLIASDSQAMLQNGFINSNSTTTTTTATSTASAANFSLP
KEFFLERFNSVNATPTSVEAGFNFINQTTSTQGFTGERDQKLIDNPVLWVLQAPNRSV
GFPTENLMPWPGQGLAKAVSDAFSDFSSDVCDYNSIMANPSMYRPGPCLSSLLYSER
SLDQDLLDNAGTNCMNGSGAAGSAQYWDNTDNNNNNNVRSSSRSSSCNSSTANLE
VNNGAAFGHFWGFGERLDATDITSENERKAPLFLERADQSEYAVKWSEMLPPFSSHT
QEETLPIYITTDSKSQDLVSSENINNPNHAALNSAIFPISWQQLQNTEYPVLGDRTATM
LSTPLSDPDFHRIAAVLDQI

Figure 552. Amino acid sequence of SEQ ID NO: 1571. The conserved Myb DNA-binding domain identified using InterProScan is underlined.

MKMSLPSNVLTLSADSNSNSNSISSSGDELAAKVRKPY<u>TITKQRERWSEDEHLKFLEA
LKMYGRAWRRIEEHIGTKTAVQIRSHAQKFFSKL</u>VRGSSNKGVSSTERAEDIEIPPPRP
KRKPRHPYPRKAAGTSHQSGSPASNEGDVFPPVVSSVPLLSLGDGPCKRARFDQHNA
NTRLSNSDNAQDIKMESPRLNSSPLSLKLFGQTMFVSNSEGSNTFSTEPAVSNNQGDF
QEFVPVQQETSSLRTKAKNQILDDGTEILHGYGLNSHITAVANTILRSGSVSTADKDS
REKTDSDEQLSSELDTNSSCLTRNQESPSIFSGYPRHVPVQRVVDGVVSENVNEVVN
MTPLSESSLAMSMSNNTSSLSKSEIMSPCPSTFSPVFPWVQMQHGDTAVAEAVAVAT
VAAASAWWSLYGAVPSHLHERMFSGAATDAENMSSACKAEAVMGVREQSQSNTT
EREGETLFQGSQSENRTSSFIQESNDARRHTEKQSCQTKEEDQIMKETELGKEGSGCA
SNTPSSTEPEIDPYSGTNSQGNTRNCVQSIQCNGGGYLPEAEEGSSTDEEETRYSDNLS
TKQGGLKEAKICIQNSRNNSYSRVDGHVDDTWKDVLSEGQIAFRALFAQEVLPQSFS
SGDGTFSKINGRDSFFEDSKKKSNRSVEGETCPHVKGSGTSVEQAYTGKVHTQSPKA
SFVSTSREEVLEDSEGAVSHGLLEVSAVNFCKANKFFSSSFSKSKSGVGFVPYERCSM
QARNNELHL

Figure 553. Amino acid sequence of SEQ ID NO: 1572. The conserved No apical meristem (NAM) protein domain identified using InterProScan is underlined.

MAGKNRNSTGSSQLIDAKLEEYRIKQCPACGHQIERQEALQDWPG<u>LPCGVKFDPTDQ
ELIEHLQGKVGLDNSAPHPLIDEFIPTIGGEDGICYSHPEKLPGISRDGLIRHFFHRPSKA
YTTGTRKRRKIQTACDESSEGETRWHKTGKTRPVLVNGKQKGCKKILVLYTNFGKH
KKPEKTNWVMHQYHLGSQEEEKEGELVVSKIFYQTQPRQCNWEKVTDGGDTHRVS
VTEATQVSERCTAGETVSSTARHIYNHLEQQTKITHRSYDLSVGRLENSDRVSISE</u>

Figure 554. Amino acid sequence of SEQ ID NO: 1573. The conserved No apical meristem (NAM) protein domain identified using InterProScan is underlined.

MEGVAFQQQTVPELL<u>VGFRFHPTDEELITHYLEKKVSSSPLPAPIIADIDPYQHDPWD
LPAKAFFGENEWYFFSPRNREYLSGARPNRAAGSGYWKSTGSDIPIVNKSGSTSPRK
VGAKKALVFYKGKAAEGVMTNWIMHEYCLAQTLPTKRKGSVPLDDWVLCRLFQR
LNHSPGMLSCSQLEVPSPSATDVQRTGQKPAMPKFSSFSRVLLNEVPSMENLPSHATS</u>
DANNAAVSSAESTYSLQVVHHPLNSAESGSHSSMNWSAQRLQGMSRRRINIFDIFSD
KNPSGKEGKQS

Figure 555. Amino acid sequence of SEQ ID NO: 3644. The conserved No apical meristem (NAM) protein domain identified using InterProScan is underlined.

MTQKGGTGGQID<u>LPPGFRFFPTDEELVVHYLCKKVVSHPLPAFIIGDVDLYKYDPWD
LPEKALFGEKEWYFFTPRDRKYPNGSRPNRAAGSGYWKATGADKPITTCGGRKRVG
VKKALVFYKGKAPKGSKTNWIMHEYRMAEINMAARKKNTLRLDDWVLCRIYNKK</u>
SSAERLEEKKLAEEMESCHDMQETVGLHDMQETVEQQKKTQSVPSEPSPTDASTVS
AEAGLPSTNSSLFNPHLPAPPMNPFCQQQSTTTDEVQMNIKLANQLIQKQQQSGQCL
NFNLGLDIVQSPFFQLDNSEPSSLFNPYQEFMDNYSIQRSY

Figure 556. Amino acid sequence of SEQ ID NO: 1576. The conserved No apical meristem (NAM) protein domain identified using InterProScan is underlined.

MNTLSR<u>VPPGFRFHPTDEELVDYYLRKKVASKRIDLDVIKDIDLYKIEPWDLQEKCKI
GSEEQTEWYFFSHKDKKYPTGTRTNRATAAGFWKATGRDKAIYCKLNLIGMRKTLV
FYKGRAPNGQKSDWIMHEYRLETNENATPQEEGWVVCRVFKKRITTQRKGNDDNV
CWYEDQVGLMPELDSPKKLPQGGDMGYQLPF</u>ACKQELELHYHMSHDPFLQLPQLE
SPKVPCNASSSAPGKRAECSMPYNGFETGCNMEGHHGNANPQSAATQEDQQGVNT
YNEEQVTDWRVLDKFVASQLSQEDVSKDARFSNETMYPIPDMTVLLRQSNKHEQQA
DYASNSNCDVDLWSFAGK

Figure 557. Amino acid sequence of SEQ ID NO: 1578. The conserved No apical meristem (NAM) protein domain identified using InterProScan is underlined.

MGDLNC<u>LPPGFRFHPTDEELVCYYLRKKLSNSKSELESDYLNPITDIDLYKYEPSDLA
ATACFQGRDQQWFFFTEGNRKKYPNGSRKNRATEGGYWKTTGKDRRVLSKGVTVG
MKKTLVFHRGRSSRAERTSWVMHEYRLVHGEAGESSLLEKDHFVLCRVFLKSGSGA</u>
KTCEQHGVSLSREDSRSTDNQSALVTENKQYDDVILPSSGEGEVEETYSPLKPLTATS
EENTIPWDGDHLSKFLLECLKEPDNDQAACDSLQIPVGADEWSGLINDPFAEVEGVN
TLVDEVDILIRND THE
QSSADQKLHTERNVHRVDYIDEANITEQSNFEELFSPAYLGGDFLELNDLISPLDSDFL
L

Figure 558. Amino acid sequence of SEQ ID NO: 1579. The conserved No apical meristem (NAM) protein domain identified using InterProScan is underlined.

MGRRDAEADLQ<u>LPPGFRFFPTEEELIVHYLCRKAALLPLPVPIIADVDLYKYDPWRLP
EKALFGEKEWYFFTPRDRKYPNGSRPNRAAGSGYWKATGADKPITSTASKGVKKRV
GVKKALVFYVGKAPSGSKTNWLMHEYRLADINRPARKKDSLRLDDWVLCRIYNRKI</u>
SAEKLALEQKESFNDVPMETIDEKEMKVEPTSTSFNHSTIEQSNPSFDHLSKFGSSPTC
YNSVPPGASPMNSNSRFQNLDFLQNSTTPFSGSTLKAPVQNTAFNPISPSQTNYNSTEL
ISGLHDDFSCSKASSFSEPIWEKEVESSFRLENFSQKQQQSLFNLDLEGLQSSFPHLDQI
SFSDAYQDWFLV

Figure 559. Amino acid sequence of SEQ ID NO: 1580. The conserved No apical meristem (NAM) protein domain identified using InterProScan is underlined.

MGSRSAEADLHL<u>LPPGFRFFPTEEELVVHYLCKKATSQSLPVQIIADVDLYKYDPWQL
PEKALFGEKEWYFFTPRDRKYPNGSRPNRAAGSGYWKATGADKPITAKGGKKRVG
VKKALVFYVGKAPKGSKTNWLMHEYRLADLNTPARKKGSLRLDDWVLCRIYSKKI</u>
SAEKLQREQKESSNDVPMETIDEKEIENQPTSASIEHSGIEESKPFSDNLNELGPSTTSY
NAVPMNSNIYFQNPGFFQNSTTPFIGNTLKAPVQNTAFNPISSSVNHHWTNCNSADLI
SRLHTDSSCSKPYSEPISEKEEIQSSFRMENISQEKQLPLFNSSLEDIQNTSSYLDQVTFP
DTHQDYFTTLNCSDYLPRFYPNELFR

Figure 560. Amino acid sequence of SEQ ID NO: 1581. The conserved No apical meristem (NAM) protein domain identified using InterProScan is underlined.

MGRRNAEAELELPPGFRFCPTDEELLVHYLCKKGASQSLPVPIIADVDLYKYDPWQL
PEKALFGEKEWYFFTPRDRKYPNGSRPNRAAGTGYWKATGADKPISAKGGKKRVGI
KKALVFYAGKAPKGSKTNWIMHEYRLADVSRPARKKGSLRLDDWVLCRIYNKKTS
AEKLALDQNESYMDVPMEAIDEIEMVNQPSSTSIEHSGIEQNGPSSDLLNKSGPSPTSH
NGVPPRALPMNTNNISSPNLDFFQKIITPSSAGTPKAPVQNTEFNPISSSINQQWINYNS
IDLLSGLHTDSNSSKPSSSSNPILEKEEVQSSLRLETSSPEEQKPFFNFSLEGLEYPFSHL
DQITLPDPYQDYFTSWTGSDLPRFYANDMRFC

Figure 561. Amino acid sequence of SEQ ID NO: 1582. The conserved No apical meristem (NAM) protein domain identified using InterProScan is underlined.

MGMSRRNAEADLQLPPGFRFFPTDEELVVHYLCKKAASQMIPVPIIAEVDLYKYDPW
QLPEKALFGEKEWYFFTPRDRKYPNGSRPNRAAGSGYWKATGADKPITAKGGKKR
VGIKKALVFYAGKAPKGTKTNWIMHEYRLADVSRPARKKGSLRLDDWVLCRIYNK
KISAEKLAQGQKEISHDIVPMEAIDEKDMDNQPSSTSIEHSGIEQNNPSSGRLMKLEPS
PTSHNVVPPRSYPMNSNFNLQNPDFFQNTSNPFNASTPKAPVQNTAFNPISPSIDHQW
ANYNSADLVSGLHTDSSSSKPSSSSDPISEKEEVQSSFRLENFLQEQPQPTYNFSMEGL
QNPFPQLDQITFLDFNQDYFTGLTTSDYLPRFNSNDIQFQ

Figure 562. Amino acid sequence of SEQ ID NO: 1584. The conserved No apical meristem (NAM) protein domain identified using InterProScan is underlined.

MTLSVNGQSRVPPGFRFHPTEEELLYYYLKKKVSFEKIDLDVIRDVDLNKLEPWDIQE
RCKIGSTPQHDWYFFSHKDKKYPTGTRTNRATAAGFWKATGRDKAIHTNLKKIGMR
KTLVFYKGRAPHGQKTDWIMHEYRLDDAEYPQANTFNELQEDGWVVCRVFKKRN
HHKSQESAELSPKYGSKQFSNNKILSDSDCPSDNLTDQLHYTHQLNMCKQELEMQQ
YAFPHDQFMQLPQLESPKIPTCNNPPSSGIKRFFPDSRSGFFQLENIPNSKRPCSYPMTL
DMTELEGSTVTTHDHMTEFKPTEEVQNLQDWTVLDRLVASHLNGQEVETPKLEVRT
YGAPNSSSDHQALVDAATASGDQLTLLPQLRINRLNPHDYSSCEIDLWNFVK

Figure 563. Amino acid sequence of SEQ ID NO: 1585. The conserved No apical meristem (NAM) protein domain identified using InterProScan is underlined.

MARPWITDGRRIAMKIRNPTQLLENENGRNDVRIACPNCDYEIDNSHVTQEWPGLPS
GVKFEPSDEQLVGHLAAKVGIGNSRPHPLINEFILTLEERDGICYTHPENLPGVKQDG
SSTHFFHRTSKAYTTGTRKRRKVDNFRWHKTGKTRKVCENGEQIGCKKIMVLYTTP
SKGSKSVKTDWVMHQYHLGTEEDEKEDEFVLSKIQLKQCDKNDPGIPEEEDAGTSN
SKGDPSTPTTSTPPQPCSKKQHSCLDRIEEEHMFRASSPQAADLDPKFHLSEPIEAEC
DGQIFPDVTSWLAGESQCFEDSQEQMVGHFSCEEILGNGSCQENVEETNIPGLSDCGR
IGGNGHEKEMQQTSYSDLANLDFDTPPDGPIPLDSQFSSQESLLGWLKNFGNSQ

Figure 564. Amino acid sequence of SEQ ID NO: 1586. The conserved No apical meristem (NAM) protein domain identified using InterProScan is underlined.

MARAPWLIDSRRFATKIKNPTFDPSKEDQNGGLVRKCPNCNYEFDNSDVAQQWPGL
PAGVKFDPSDQELMGHLAAKVGVGNGKPHPLIDEFIPTLEEDDGICSARPENLPGVK
QDGSVCHFFHTTAKAYHTGNRKRRKIQEDRWHKTGKTRPVIENGIHRGWKKILVLY
VSTGKGKMFEKTNWVMHQYHLGSEEDENDGEFVASKIFYQQQHKQSDKNEVPQET
EVTSLIPIPDPLTPVTSAPKLSSHAKSQADLDSVREEQLDCMDSPGQGVSHHTNENLD
YSTWQGLNCQENISLDDSILLPKESQSRVDSQQLLDDFLFCAETVQCSSPQNLIPDAV
EHGRIKAKELDKYGNVSDAIPCLDNTELDTHPQNAILDLGEHGRIKAKELDKTVNAS
DMIPCLDNIDLDTPPDIENIELNFNSQESLSAWTRGTTH

Figure 565. Amino acid sequence of SEQ ID NO: 1587. The conserved No apical meristem (NAM) protein domain identified using InterProScan is underlined.

MESATVNNKQQQQMNKIDDEHLPPGFRFHPMDEELVTYYLTQKVLDSSFSCRAIAE
VDLNKCEPWDLPDKAKMGEKEWYFFSLRDRKYPTGTRTNRATEAGYWKATGKDR
EIYRGKTNTLVGMKKTLVFYKGRAPKGEKTNWVMHEYRLEGKFAYYDFPKTAKDE
WVVTRIFQKSSGAKKGPLGLGRSSSYLDIDSPNLPPLLESPCIPTSVGGAISFESESAGS
DQQHVTCFSTPGYTNNNQGFGLAPNQVQQTLGSISSDMPDFQFLQNMLMGMNSNSS
PTQISPQMSNRASQLPSYPMGPNSNFPTFANLLYPGGMQQNSYNNIFKTHADIANDRF
KQCKMEPPSPLFDASGTVKNSTVQQPGSSRWINPSSGYQHGNQDNLEQKYRVPQQQ
QQQMQNQNMVSLSQETGLSTEINTDMSSVVSSQLNQAYQEETPDMDSLWNSFS

Figure 566. Amino acid sequence of SEQ ID NO: 1588. The conserved No apical meristem (NAM) protein domain identified using InterProScan is underlined.

MGTLALPPGFRFHPTDEELISCYLEGKLNHGLKEAELEVITEVDLYRNEPWDLPEKSF
LPSRDMEWYFYSPRDRKYPNGSRTNRATEAGYWKATGRDRKVYSRASTVGKKKTL
VFYIGRAPQGERTDWIMHEYRLEENECEAGPCLQNAFVLCRVFKKSGLGTKSGEQY
TAPLERGDLSPTEKNPSPGYSGDMEVQSEDLSKPVEGIDANLHLPSNISSKILHDTTGD
NEPLNKWLDILLDDTIPNSSCVAADEDTIHTQVDAMPDTPRIQCESACLPSVESELRDI
PVNISFPQYRVPNGRLDAYFEEERMLEEMLSVAPEDYTNFKAYHNSLGDTCADILNG
GYIKVKNLIPSIGEPENHDSCLWEVPYPSFDCEGSGIQLCTGSPCLQSHKQGFSFEGTA
ARGVCMQLYKMEDSTERNEKDVTVRHSQNTQNDWYDSGPEMQQLHFDRFAGTKW
DSENIKENEDSVAEALPTYMTGQIDGMCTLNIFLTLKKISLE

Figure 567. Amino acid sequence of SEQ ID NO: 1589. The conserved No apical meristem (NAM) protein domain identified using InterProScan is underlined.

MGTLA<u>LPPGFRFHPTDEELISCYLKGKLSHGLKEAEIEVISEVDLYRNEPWDLPEKSLL</u>
<u>PSSDMEWYFFSPRDRKYPNGSRTNRATEAGYWKATGRDRKVYSRAKTVGIKKTLVF</u>
<u>YRGRAPQGERTDWIMHEYRLEENECEAVPCLQNAFVLCRVFKKSGPGTKSGKQYTA</u>
PLGKGDLSPTMKIPSPGYTGDVEVQSEDPSKPVEGIDANLHLPSKISSKIPDDTTEDSA
PLNKWLDILLDDSIPNPSCVAADEDTIHTQVDAMPNTPRIQCESACLPSVENELQDIPV
NISFPQYGVPNGHLDAYFEEERMLEEMLSVASQDYTNSKAYHTSLGDTCDDIFILNG
GYIKIKNLIPSIGELENHDSCLWEVPYSFFDREETGIQLRSCSPVLQSQKQGFSFEGTAA
RGVCMQLHKMEDSSEINEKDATVRDSQNMRNDWYGSGPEMEELHFDRFAGKKWD
SENIRENEDSVPEALPTYMAGQIDGMYTLKIFLTLKKTD

Figure 568. Amino acid sequence of SEQ ID NO: 1590. The conserved No apical meristem (NAM) protein domain identified using InterProScan is underlined.

MGTLA<u>LPPGFRFHPTDEELISCYLKGKLSHGLKEAEIEVISEVDLYRNEPWDLPEKSLL</u>
<u>PSSDMEWYFFSPRDRKYPNGSRTNRATEAGYWKATGRDRKVYSRAKTVGIKKTLVF</u>
<u>YRGRAPQGERTDWIMHEYRLEENECEAVPCLQNAFVLCRVFKKSGPGTKSGKQYTA</u>
PLGKGDLSPTMKIPSPGYTGDVEVQSEDPSKPVEGIDANLHLPSKISSKIPDDTTEDSA
PLNKWLDILLDDSIPNPSCVAADEDTIHTQVDAMPNTPRIQCESACLPSVENELQDIPV
NISFPQYGVPNGHLDAYFEEERMLEEMLSVASQDYTNSKAYHTSLGDTCDDIFILNG
GYIKIKNLIPSIGELENHDSCLWEVPYSFFDREETGIQLRSCSPVLQSQKQGFSFEGTAA
RGVCMQLHKMEDSSEINEKDATVRDSQNMRNDWYGSGPEMEELHFDRFAGKKWD
SENIRENEDSVPEALPTYMAGQIDGNLVHGLTLTIGVGSTKDVHETLA

Figure 569. Amino acid sequence of SEQ ID NO: 1591. The conserved No apical meristem (NAM) protein domain identified using InterProScan is underlined.

MGTLA<u>LPPGFRFHPTDDELISHYLKGKLNNGLKEAELEVIPEVDLYKCEPWDLPEKSS</u>
<u>LPNTDMEWYFFSPRDRKYPNGSRTNRATEAGYWKATGRDRKIYSRASAIGIKKTLVF</u>
<u>YRGRAPQGERTDWVMHEYRLEENDCEAGPCLQNSFVLCHVFKKSELGAKNGDQYT</u>
APVEKDDLSLTKNVRDPLPYHFGDIEVHSEDRSKPVESVDAISSLTPKFSLKILNDTTG
DNATLNTWLDIFLDDSNSNSSCVAPNKDTINTQFDAVLDNPRMQCETACLDESEFPQI
PVDLSFFRYEVQNGYLDTFFEEERMLEEMSFAASQVYNNSKAYHSSLGDVFADILNG
GCIKLKSLMPSIEEMEHHDSGLWEVPNSSLDHVGTGIQISSHSSMLQGHQRGFLFDGT
AARVCLQLHKMEDSEERYEKDLSVRKLQNTSNDMYDGNNCSTCGPETQQLHFDQS
DGQKCDSHVRKINEKNNRENEDSAPEDLSTDMACEIDGTSSQFYCKFDSNQFYSKFD
TSCDVI

Figure 570. Amino acid sequence of SEQ ID NO: 1592. The conserved No apical meristem (NAM) protein domain identified using InterProScan is underlined.

MDQVSLQPGFRFHPTDEELVSYYLKRKVRGQRFSFNAISEIDLYKFEPWDLPGKSCL
KSRDLEWYFFNPKDRKYPNGSRTNRSTKDGYWKTTGKDRAISSASKTVGMKKTLV
YHRGRAPRGERTNWVMHEFRLEGKDLKMPNIAQDSYVLCRVFQKSGPGPKNGEQY
GAPFREEDWNADILGKAETKSSVEMDHISTNDSTLSKTMEEVISYHGENPPLDNEIVA
QVDEPAPARSDYDINRILEENPPLDNEIVAQVDEPAPARSDYDIDRILEEWIGNPNDM
EPNTDENELVQGNQDWDTLISKETLEHIIVQTEDVEVFNDLGDLFGNINNPVQRNME
DYAGVFHLQDGRGVEERVSTSIDPFISNPHESSPAFLDGSFLELKDLANPVELNSSDLE
TFDIKDTFFDVSESPDNFAASSIALYSKESQNQNTDLRFLRGKQKMSTEVSEQTHSPT
YGYSVLQEAYNVERHPFSSPLGENLGSLSWMQEQWINNASDGFAFSEVDVARNLVP
SADYEFMTKRQDASAGMQNLKNHEDSDIGSSSKFASMLASIPARPALAAEYPFKSKY
LSLVPKVDSVTVETATNHVAAVSITCACSMVLEPKIKHSSGALLPTCSCGVGNGIVQ
GSFASSWPASSSIGFKSADLVTPRKTSGGLHAGLLFVFFLGAIAVFVWALLMGGTFIL
GKYMYKLVIS

Figure 571. Amino acid sequence of SEQ ID NO: 1593. The conserved No apical meristem (NAM) protein domain identified using InterProScan is underlined.

MASSVQAAAVNFPPGFRFRPSDEEIVGYYLKNKVHGNKFEFDVIREIDLYKCEPWDL
PEKSILPSRDLEWYFFCPRDRKYPNGSRSNRATEAGYWKATGKDRKVSSRSNNFKIG
TKKTLVFYKGRAPNGERTDWLMHEYRLEGTQCKGGTNLQDLYVLSRVFRKPRQGS
NDQETFQEPFPIINKTSSPTDGSDGDIEGQSEDASPGKPEDDAPASSRSETSSEILDNKIE
DNCIDGPMECPEDISNPNCNSVSHRDTSTKENDDSQRRNQQLQNDPFYSPYEYEFPLI
FNNPYSDYSLGTQVNFSVMEPEAFERDFDFGSVSDQDNIDLASMLNSIECEDLYPLLP
IIEEEKNDEPCVAGLLTSMPDNGVQIQFRSRSQLSHSNQQPLPSQGTAMRRLRLQIYK
TEESANGRKENPLTVNGRSASSDCNSDDSDESEVITQSEDSPLASFPSQISCCSVEDDA
DSDTIHDSVESSEIVANGHDFNLEPTQFLPSSFFPVEAASEKSDMSVNSKESADKSVLI
ERTESVMSSACSQSSSTEIQIETTVSHTTSSQEIDSVSVKSSALGMESPTVLASKKALVS
EGASSFGSRQLGAISSNHNGVAETQGLGKFTGFNVILTGLNLRGKFREKYVRSDHVE
ESRNVAQNVSDLCSKDSSKGFSSLRKALGIFIQPFQLQSKMSKGANCIPLICLLSTVFL
VLCIWNTYLSARSSSPIIL

Figure 572. Amino acid sequence of SEQ ID NO: 1594. The conserved No apical meristem (NAM) protein domain identified using InterProScan is underlined.

MAPIS<u>LPPGFGFHPTDEELVAYYLKKKVHGHKIERDIIPEVDLYKCEPWDLPDKICLQ
SKNLQWHFFSPRDRKYPNGSRTNRATEAGYWKATGKDRKVTSQRSTIGTKKTLVFY
MGRAPFGERTDWVMHEYHLDEKECQAAGLQDSFVLCRVVKKNGLGTKSDDQSVA</u>
PTEKNDSDGANNNTLPGILAETFCTGHQSPVLQEGENKSNLKLPSETSSENLNDMNE
ESVERWLDILLDDPDQNCSITSPAELTNNAKVDTAQEIQEVISSPLNWVQDFNWIPAG
VDFNTPGDLEHLQFPNTLETFEEAEIIEEIFHTAQASQEDNIEANSLLLSDYLDEIWGG
EEFRDEYHDTSMVQTGNHTNPEVTGIQLRQRSQICQQELPYQGTAMKRVRMQKYPV
QHSAIEHQQDGCTAYSENDCIYDLQEQHILLDSFNRQNHNSKNMTPLQDPVPLASAR
QIDAIREGHSPYHLRGPLANESLGKNRQKAHSGRGVGSSFSRDNCQPGTSSMGFRQA
NEYKFNFPLHDSVMEGELSASDLADKVTVNHVISSMPPQSLIYGLFLNSQSSEIVDIPA
ESPNQTMKHEPGNSLEIWKSQQQVLTSLTEDKMPISKINHQTSLSEDGLLSTVAVIKE
HEFVPSEDDSETPDQFGEPIKGSSSGEVPDSSGASSKVVHPEKILPAPSSSEPTSVRGW
KISQRILKFCSSIPSYAAPVMEYLGRFNPKKAILPSEFACNFGPTDGVTDSAGNMGTC
MCTEGNMEHARSNIFLSQLKQRVKPKVKSVMPDSGEESGDAMKMFCHRCADQSNS
ATLHGLEPPSGVLNGFSEFWNRCAPTSSTSVIVSVCLLGTTSLLFLFLLFRAIWRFSRS
VSALIF

Figure 573. Amino acid sequence of SEQ ID NO: 1595. The conserved No apical meristem (NAM) protein domain identified using InterProScan is underlined.

MAPIS<u>LPPGFGFHPTDEELVAYYLKKKVHGHKIERDIIPEVDLYKCEPWDLPDKICLQ
SKNLQWHFFSPRDRKYPNGSRTNRATEAGYWKATGKDRKVTSQRSTIGTKKTLVFY
MGRAPFGERTDWVMHEYHLDEKECQAAGLQDSFVLCRVVKKNGLGTKSDDQSVA</u>
PTEKNDSDGANNNTLPGILAETFCTGHQSPVLQEGENKSNLKLPSETSSENLNDMNE
ESVERWLDILLDDPDQNCSITSPAELTNNAKVDTAQEIQEVISSPLNWVQDFNWIPAG
VDFNTPGDLEHLQFPNTLETFEEAEIIEEIFHTAQASQEDNIEANSLLLSDYLDEIWGG
EEYRDEYHDTSMVQTGNHTNPEVTGIQLRQRSQICQQELPYQGTAMKRVRMQKYP
VQHSAIEHQQDGCTAYSENDCIYDLQEQHILLDSFNRQNHNSKLWQNMTPLQDPVP
LASARQIDAIREGHSPYHLRGPLANESLGKNRQKAHSGRGVGSSFSRDNCQPGTSSM
GFRQANEYKFNFPLHDSVMEGELSASDLADKVTVNHVISSMPPQSLIYGLFLNSQSSE
IVDIPAESPNQTMKHEPGNSLEIWKSQQQVLTSLTEDKMPISKINHQTSLSEDGLLSTV
AVIKEHEFVPSEDDSETPDQFGEPIKGSSSGEVPDSSGASSKVVHPEKILPAPSSSEPTS
VRGWKISQRILKFCSSIPSYAAPVTEYLGRFNPKKAILPSEFACNFGPTDGVTDSAGN
MGTCMCTEGNMEHARSNIFLSQLKQRVKPKVKSVMPDSGEESGDAMKMFCHRCAD
QSNSATLHGLEPPSGVLNGFSEFWNRCAPTSSTSVIVSVCLLGTTSLLFLFLLFRAIWR
FSRSVSALIF

Figure 574. Amino acid sequence of SEQ ID NO: 1596. The conserved Plant regulator RWP-RK domain SEQ ID NO: 3669) identified using InterProScan is underlined.

MPQESVTNRHMAKLGTDPQQIS<u>WDESLTFDEVAKFFSVPIAEAANILGVSSKVLKKIS
HDNGIPRWPYRKFLAGKTVEEIKREAVRDKEMNEELSKASNDNNKTVPSSGGPSVAI</u>
SAQMPTPKPPNLAMQNQSKTGNTVNETGRWQPGVATSGNILQPSGSRIPQAARQPY
HSGHRAFISTYLDDFKQGFPKNGLSSVSKKWWGSSGSISKEDAPEDSEISEAKLTSRK
FNESSEGVELGTTNENGGRVTSEVDGFLKEGKSSDSESISKLFGHMGSQDEDLMHISI
LSRTRKRKAENGRKALKLAVTNGYGTYKIGNKDKILLERIFGSPLPRKWKTSLSFSD
GTE

Figure 575. Amino acid sequence of SEQ ID NO: 3645. The conserved Chromo domain identified using InterProScan is underlined.

MVGRGAWSSRRRSVDSGSGNSMKSSSKRRVRRGPREGTEEDEETKESEGEEQEHDE
EQQQEEEDEEEQGEEESENGQVLG<u>EGFYEVEDIRKKRIRKGQVQYLVKWRGWPETA
NTWEPYDNVKSCADVVQAFEDSYGGRISKPGRKARRKSGFPFSHQKRKRVSLSSAD</u>
EGAEAEAEVETEAKRAKTSYFGDSQISGKSEVEVEPQQLHGSGVGTVSEQCHPEKDD
GAQSHIPEKEGKETEEQNGGKDVTNSVEEEAENKTEDQNPQQEEPTSEDHTKNGPPP
SPEDARCAEEKEMAVDESKPDQGAAVNDSSRHIQTTQFTGAKKRKSGFVRRVKQAL
DSREHELKQGEENSNSQPAKEMFVENSKAQEANAVGNGEEIKSQKPSIAGLHSNANN
KSSNSPDSALTLAITRILKAISYNNSTSNNKQDVSVLFKAQRADGQEVVVDNKFLRA
NYPLLLIDFYEQHLRYSTAQ

Figure 576. Amino acid sequence of SEQ ID NO: 1598. The conserved AP2 and B3 domains identified using InterProScan are underlined.

MGADSTRTDYEDGKAVTEEDSSSSPAAASFLLPNWAGLEEMGNGINVVCSQNIRNPS
AQRKLP<u>SSQYKGVVAQPNGRWGVQIYEKHRRVWLGTFNSEEDAARAYDRAAIKLR
GAEAITNFGTDRHP</u>GAFFLRGHSNSEIVDTT<u>YDEELGNDDTTSLSVYPDIAWSTTTEP</u>
REHLFDKAVTPSDVGKLNRLVIPKQYAEKYLPFDKASIHDKGKGVLLNFEDSSTEKI
<u>WRFRYSYWNSSQSYVLNKGWNRFVKEKRLQAGDIVTFDRTSRSRRLFITFRHRPHYL</u>
LPPAALPPPLARCQLAINPFAAKDYPHSEQLFYAPPTADVQNSAFHRLIPCVPSPNSVD
LLLTPKSVSDDGKPSSLAFVDHQRSSPSTDGNCDSSSVWLFGVNLQPTPLTFARA

Figure 577. Amino acid sequence of SEQ ID NO: 1599. The conserved AP2 and B3 domains identified using InterProScan are underlined.

MEKSPGGPKRTGSGLSVVTGSGGESDEREDSRRYLISTEQARRLP<u>SSQYKGVVPQPN
GRWGAQIYEKHQRVWLGTFNREEDAARAYDRAALKVRGRDATTNFSPVGEGHPEA</u>
QFMREHSKEEIVEMLRKHT<u>YDEEMMMTVDRCATMDNSEASREVIGSGQGRSCEEN
KEHLFDKAVTLSDVGKLNRLVVPKQYAEKYLPLNVNSSERGMLLNFEDYTGKVWR
FRYSYWNSSQSYVLTKGWNRFVKDKKLEVGDIVSFHRGSVQSDHLYISWRRRPSGR
PRLAVNPQSHESNVRVVKGSCSLNPFNSGNQSAVVYNAQWMPVFWSSSRNPNALLQ</u>
FNSKSIFPLINKFGHVDTLWSESHRVFPFYCSSPPTKDTDMNLKPLPSVDQNLNLQES
VNSGDGSDIKPPNSLVSPPVLSVAQELDLDLDLDTPEQKPAPYLAPATTKGVRLFGVI
LTETQRLSTQRQGQLNLP

Figure 578. Amino acid sequence of SEQ ID NO: 1603. The conserved SBP plant protein domain identified using InterProScan is underlined.

MKITSSPTPTWEWDNGENLMLFPGNGNGSRKATVNSKLKDEPKLHDAAAGFLRVQS
VSEDGNSSPGEIRTSDASTPDDQQHHSGVVTVAVPAGSGDSGAIGLKLGKRTYFEAV
KAIPGPAPSASSCGPAAKKQRSAMQGTHMVP<u>RCQVEGCKTELTASKDYHRRHKVCE</u>
<u>LHSKSPKVIVNGIEQRFCQQCSRFHILSEFDEGKRSCRRRLAGHNERRRKPQPDSL</u>AIN
PARFASAFYDDRGLNSILMDRSPFMHQRITSNSILEDSIDFKLGGYGKGAWPRVKAE
DESSYDGQVSAGTVSHHNADRLLFFLQSSKTVPGGPISQDVHQYMQSSGAHAGQAL
TLSSSSGENLAGLDVVSATHGLSGVSDSGCALSLLSFQSGGSRASGSASFDMTTRSGL
TMDQLIQGDQPLMAQPLMQGVQHNFGLFGADKLLTVCSQSSTNLATGGFPATVVNS
MDKQHQGEPLVSNAGGIGNFGGHVFGLLQGSNFRASQAASSQDIQGTIDLMRRSSET
QNDSHDQHGMVHQGRRQFTDAQLLRSFESSIYDTHQLL

Figure 579. Amino acid sequence of SEQ ID NO: 1605. The conserved SBP plant protein domain identified using InterProScan is underlined.

MADLLDDPVALTLDAGDWEWDSVLDFSPGSFPGHILPWQSEELSDERLLTSQALEV
QQVREVQNASPRNQSHDAEEDEKEAASGRIRKRDPRLTCSNFLAGRVPCACPEMDN
MEEELSRKRAKVVVL<u>RCQVPSCEADISHLKGYHRRHRVCLGCANAAIVVLDDVPQR</u>
<u>YCQQCGKFHLLTDFDEGKRSCRRKLERHNNRRRRKPVNV</u>VEGSVQQQTLRAESALQ
NADTEPHNDGKSGQASKSFSSLGCGEKQASSGSEEINISEVEQPYKGDLSLKNVGSKS
ADVSKVTSSMPVNVSTELEGKLLPERDMGNGEKFNDQDVRVVDNSQAILCVGPQNG
DNGSTYAELNEQSYTGMPMEESSRKDRFPHNASGRSERDEGAGPLQSSLSSNRHDK
HFSYASVCPTGRISFKLYDWNPAEFPRRLRQQILQWLADMPIELEGYIRPGCTILTAFI
SLPQFMWEKLSANSPGYIHSLLNGSQSILLDKGNMLVYLNDIVMQIKNGEACLVNTK
MDMRIPKLHSVHPIFFEAGCPIEIVACGRNLFRSKYRFLISFHGNYIHYGTCEAIPLGNP
SSCFRSKENIFHPSNHESFKIFIPSTDPRLFGPAFIEVENEYGISNFIPILIGDKQICSEFQM
LEQELVKSGFCSRSNHGLAIGSSSSDICEQNLVKRQSILELLVDIGWVLKDPESDEDK
VPVNFLHIQRLNCLFSYLINGHFLAITEKVLHSPKVVKMLRQVYGKSNEVNGADMKL
LQNYVEHAWQSLRKQRDYKGTTDFQSFLDNVVLQGFPPPLTIATLSCNQQRCTVSHE
NQETERLLKIQPEIRPFSEIESSDTRVLSVEENNMLTPLLEKECSSNIAGDLKYNSTWR
GPKIEVAEYTRKMKVCLKGDIRVDRRIFILAITVISVCAGICVVLQHPPQVMEISMSLR
RCLFGLRKAREDISHP

Figure 580. Amino acid sequence of SEQ ID NO: 3646. The conserved SBP plant protein domain identified using InterProScan is underlined.

MDGKAGPQVATPFFQHQLLSGPLYEPSLGAKRCVEPADSSWTRTNWQHQQQQKSPP
VYEAPKPNWNVNVWDWDSVRFIAKPADLANHREPNPSNIKPQASPEILRLGSNDIGS
NVVNGPSFPDQKRKLDEPPKPFLPGKDSSENDPGNLTLKLGGSSYSYADDTNPSRQN
KRVRSGSPGSAYP<u>MCQVDDCRTDLTSAKDYHRRHKVCETHSKASKALVGSLMQRF
CQQCSRFHPLQEFDEGKRSCRRRLAGHNRRRRKTQPEDALPRGLLAASQENGGLGN</u>
LDIVSLVSILSRLQGNNSSMEKSNGQSSLDGDQVVQLLNRMNSSFPSSQKVAPPSEGF
DLNIAQNLQSPRSEVPKANGSPSTGLTTELLAILSALTGPSHDALALLRNSLATNLKG
NLKAHHQNVLPPSPTPVAQQKPQERDIQNQKTNLIVDSGANNRKINATYQDNSRTHL
PLRLFNSLEEDNSPPNAFTRKYFSSDSSNPTERSPSSSPPVVQNLFPLHSGDESRENDC
VSVCKEDNLTLETSPSNDRCSAYELSKLESRVHNQNFMSGFLHQSLESRTAVVQPSY
TSSSGSDQSPASSNSDSQERTGRIIFKLFGQHPSNFPVALRAQILEWLSHSPSDMESYIR
PGCVILSIFVSMPSANWERLREDLPQRLKLLVEDSRTDFWRCGRVLVQAEQRLASSN
DGKVRFCSSWRSWDAPEIYFVQPVAVVAGQETTITLRGHNLATTGTKILCAYRGKYT
SIDVLPEEEASECIPTDSRVQKFTFSGGPPNVLGRCFIEVEHGFKGNCFPVIVADPIICRE
LQSLESEIEIEFSSDKTSSIKVERSQEHFQGYSAATARDEVIRFLNELGWLFQKSSERQ
AELNVVKDASFLEFSSDRFKFLFIYAVERDMCALLKKLLDIFFEMNAGQEASAPESSK
NLLESNLLHRAVKRNCKQMVDLLLNYAPSPNNMNLLQTKSFIFPPNLTGPGGLTPLH
LAASIRNSEPLVDALTSDPQDVGLQSWSTALDSSGQTPHAYALLRNNHSYNRLVERK
LADRKYGQVSITISNNEPSLDGIAADVNGSHTGSSVLSLQKLPQSCAQCMIFSNKRVR
RITGSPGALYRPYMHSILAIAAVCVCVCLYFHGPPHVGSSGPFKWENVDFGPA

Figure 581. Amino acid sequence of SEQ ID NO: 1607. The conserved TCP family transcription factor domain identified using InterProScan is underlined.

MDAERIGLQGSSSIAEDLETISGAPISSSCTGN<u>DLQGTNQQGIAKKKPSCKDRHTKVD
GRGRRIRMPAACAARIFQLTKELGHKSDGGTIQWLLQQAEPSIIAATGTGTSPASAAA
MAGSIGELGINVLTDSPHGSLGLTVRGCGHGDIIMERRSLLQGAGVHEAVGRYQNEG
FVQKGIQLGHMQQDAELSERRALSVNLSVASRHFSMQQENPSEGLPHIWADSPMYRI</u>
TPPPPASIQAGAGNLTCSNPMTPLTTYMLPSALNRMPGMNLSGLELQTGHMGHMPL
SAMLQGSHHEQHLLGVQAAGEGQIGIIASNSAYNNSVRSITQDYQHHHHHHYPHAA
SGQDHSYDQNQ

Figure 582. Amino acid sequence of SEQ ID NO: 1608. The conserved TCP family transcription factor domain identified using InterProScan is underlined.

MVTMDGVSGIGPPANSPSSSSAQQTDENRSLTLITGVSQSVEVKQEVQREGDLKDQQ
<u>QSIVKKTPPKRSSTKDRHTKVEGRGRRIRMPATCAARIFQLTRELGHKSDGETIRWLL
EQAEPAIIEATGTGTVPALAMSMGNSVRSSAPSTMASSSTIRPLAMGLRAKTEWDESE
DKKNVLDRTRKISAGPDASGGSRIVQEGQTMEGGSVKKRARGLVVKKEHDPLTASA
PINAVPAKPAPTARQTPLQPPPQAQAAPLSQNTTLPQASGLMSMWAVAPDRAGSMP</u>
GAFWMLPVTASSASAPGIVGGGPSSQQIWTFPSGSVGPMYSMAAAAAGAAAPSGSN
NPSSITNPGVMPLTSVLPSGMIMPRLNIPGGMGLEFPGGHLRHMPLTSMLLQDTSQA
GTGLGIGAEGHLGMLAALSAYNKSTKSEHQFMGSSHQQQGESGDDPTNSQ

Figure 583. Amino acid sequence of SEQ ID NO: 1609. The conserved TCP family transcription factor domain identified using InterProScan is underlined.

MVGYNVQNTAANRQNQDDHGRSGLGSSGYLQAQAALVASSQVDSSLAMSAAKLY
SNSESTAIIIPKSHEQQKTGGGGGGGVAVTEDAAKKPLAKRSSTKDRHTKVDGRGRR
IRMPATCAARVFQLTRELGHKSDGETIEWLLQQAEPAVIAATGTGTIPANIASLNISTR
SSSSSISAPLKPPYFHSGSLTLNANFAARLDQQIRSRNEWERVQEERSGMNTGLGIGH
HHHTDSSGLTQALIHEQNLINDRAEINDLMNSDCGNSRKRLREEQQQQQFKNMQPM
WAVTPATGLSSSGQNMPGTFWMLPPTPGVMGHAGPGSDPIWTFPASSGGAMYRTS
MSSGLHFMPRPINLNSSSTSMGHVQFGSMLMQGPAGSGSGSGGAGGGAGSGSASQQ
LPQTGLGLGGGGGSNETHLGMLAALNAAYNNRSMNNNSEHQSMGSSGHNHADSGE
DRRDNSQ

Figure 584. Amino acid sequence of SEQ ID NO: 1610. The conserved TCP family transcription factor domain identified using InterProScan is underlined.

MWCSLRMEITGGIFVELWEPDERSDRGKSEQRDSGGCEISELGGLQRSLVQGYHGSP
ASSRVMEAQHPGLQLGRGSLVQAMQAAMAGSNRIEGGSRALGAYRDYSGKERADQ
QMNAASVALVTVSRAVEETKAAVAPQVQNAVVAATSSGAASEQGGEIKKVPPKKP
TKDRHTKVDGRGRRIRMPATCAARIFQLTRELGHKSDGETIQWLLQQAEQSIIAVTG
TGTVPASAQNISGSMRSSGSMVASGRPSTSYGPMGLALRGAGSEPDMRDNSEMAER
RFMEGLAGASLGFHHEGFVMGSVPPGKGEQQSVGHMHDESERGTGFLTSATAGSKY
GPGSTSLSSQAAGLMPPPAAAAALWTVAPTSSRSPTIWMLPVTAGSSSTPPSSVALNQ
SQEQLWTSGYRLAAPASTSIHLGTGRGGDHNNLQSSSNPMMPLPTQMLPSGFTLMPR
INLSGLELQTAHLGAHMPMSSMLLQQGSPQHPGIGLGLGGEGPYGIIAPLGAYNPAG
RPMSSPDQYDHQRAQQQQDTSNDDQQPGQQ

Figure 585. Amino acid sequence of SEQ ID NO: 1626. The conserved Tubby domain identified using InterProScan is underlined.

MSFKSIVRDMRNGIGSLSRRSFEVNLSHIHRTKSQSAVYEEQIHASPVQQSCWANLPP
ELLHDVIQRLEASEETWPARKHVVACAAVCRSWRDISKEIVQTPEKCGKLTFPISLKQ
PGPREVPIQCFIRRDRAKSTYHLYMGLTPAMPAENGKFLLAAKKIRRTTGTEYIISLD
ADEISRTSSTYVGKLRSNFLGTKFEIYDSQPPYSGATPTSGRTSRRFYSKKVSPRVPSG
NYNIAHIAYELNVFGTRGPRRMRCTIHSIPASAIEDGGSAPTPSELTRSLERSFSSSFSN
AMEKIVEFSSSSLTEVPVGSQSKGGPLILRNKSPRWHEQLQCWCLNFRGRVTVASVK
NFQLVANKEPSPPVTQSDPDKVILQFGKIGKDIFTMDYCYPLSVFQAFAICLSSFDAKL
ACE

Figure 586. Amino acid sequence of SEQ ID NO: 1628. The conserved Tubby domain identified using InterProScan is underlined.

MPPIKNIIQDMKGGIGSISKRSFDVKLSYNRRSRSHSHGVAVTSGDENHCKTAADVLH
ESCWANLPYELLRDIIERIESSEITWPARRNVVVCAGVCRTWREIIKEIVKPPLLSGVL
TFPVSLKQPGPKDSAVQCFIKQDRTASAYYLYLGLASTICENGKFLLAARKFRKATST
DYIISFDGEDMSRGSNTYVGKLRSNFLGTKFTIYDSQPSHSGGVATSHAGRRVGSKQ
VSPRVPASSYNVAHIAYELNVLGTRGPRRMQCTMHSIPASVVEGGLNTSTFEIPSSTL
VEPLASFRSSRSKSVISESNAFSGPLNSGNLKDDPLILKNKAPRWHEQLQCWCLNFQG
RVTVASVKNFQLVAATEPAQSVSQSDQVKVILQFGKVGKDFFTMDYRYPLSAFQAF
AICLSSFDTKLACE

Figure 587. Amino acid sequence of SEQ ID NO: 1629. The conserved Tubby domain identified using InterProScan is underlined.

MTVKNIFQDMKGSIGSISRRSFEVKFLRSRSQSAVDDLHYRSNANNKNNSNNGGLQC
SLWANMPPELIRDVIQRIEESESSWPFRKSVVACAGVCMTWRQITKELVPIPELSGKL
TFPISLKQPGSREPSVQCFIKRDRATSTYQLFLCLNTTLSENGKFLLAARKFRRATSTE
YIISLNADDMSRGSNTYVGKLRSNFLGTKFTIYDSQPPHSGAIASTSRAGRRVGAKQV
SPRVPAGSYNIAHIGYELNVLGTRGPRRMQCIMHSIPASAVQPGGSAPTPVEPSVASL
DQSLASCPTFGSKSCILESSSISEPLTGSNLKDEPLVLKNKAPRWHEQLQCWCLNFKG
RVTVASVKNFQLVAAPEPNPSVSQNDCDKVILQFGKVGKDMFTMDYRYPLSAFQAF
AICLSSFDTKLACE

Figure 588. Amino acid sequence of SEQ ID NO: 1630. The conserved DNA-binding WRKY domain SEQ ID NO: 3670) identified using InterProScan is underlined.

MDNWGSNGDNVENSQCGDKGLDSFNSLLWYNPLAANALSALNQQLNVPVEGQAQ
GQGQKEAWTQFVVEDKAEMKTEWIANSPVAQSIRSQEDQQSEICNVEEHVSEISDNK
ASVEGDIVDSKIIKKRKIKTEKGPRYAFKTRSETDVLEDGYKWRKYGRKIVKSSPHPR
SYYRCSESNCSVKKRVERDPTDQGLLITTYEGTHNHESPSVIYYIGKPIILPQQGSKPAI
VLVNASLCPEPVIKYASHQAL

Figure 589. Amino acid sequence of SEQ ID NO: 1631. The conserved DNA-binding WRKY domain SEQ ID NO: 3670) identified using InterProScan is underlined.

MPESYGQINPFVSAECMQGYFLTRPQHELVHSMNSFQETFHERNGVQEGGLQPSNFA
SQSDNSDYCFLRPGHLKLSGEYSAFSNRVSQDQALLINSTEFNDTQRGMISSPLGHAG
DQVNFSCTDTISHMEYRNNLPEISLLRSTDDQSFESSVPDNAKRTEGLKNLSNLWWG
SSSSCDVKMKKVKVRRKLREPRFCFQTMSDVDVLDDGYKWRKYGQKVVKNTHHP
RSYYRCTQNNCRVKKRVERLADDPRMVITTYEGRHTHSPCSDTQSEQHDFLSSL

Figure 590. Amino acid sequence of SEQ ID NO: 1632. The conserved DNA-binding WRKY domain SEQ ID NO: 3670) identified using InterProScan is underlined.

MEGNMNKMAKLVADINHLKEKNQRLNSKLKRMISKYNDLRKHIGLLMQQRRGIDG
SQVCNPDHRIKDQVCAKYFTGSDHCWEQGEEKEKKKAKFMEDQQLHSKKTKIDDN
PCCDDKLTKNQNQVLSRSSGEEAVAAPKRIVSVQTTSVTSL<u>VSDGCHWRKYGQKMT
RNSTLPRSYYKCAMVPGCPVKKQVQRCAEDPTIVITTYKGEHTHSL</u>SPLAIAVIHAST
NQPTTCTSSPTITLDLADNQLNPAFYLHPAHLTAGSFQQLTPLSSDMGQILDNQSQVG
QSAIMESVASMKADPNFTKALAVAIAGSILKLGSPIEGMPQHPPPTHYTNDSTTSVNT
SVE

Figure 591. Amino acid sequence of SEQ ID NO: 1633. The conserved DNA-binding WRKY domain SEQ ID NO: 3670) identified using InterProScan is underlined.

MLMENSDKFLSSTLEVNLSIQEAVRSGLQSAYQVLNILAKQNQQCPFEKIQEDFSWA
AEEALSKFRKAVSLLGRTDHIRIRKSPVLPVSGNGEPFIDAFNVIPPLNSNPVAHHVSS
ALLDVPSHAPSDLPILQKVRQLFFPTNGNNPQLAGHQAQNNFSEVDIMLKNNFRIFEN
SINCTGNLPQSCTKSFVSSVSIESSVGDDRHMTLQYPLAVSNEVTPSLYFKRKCSGKG
DEPGGKCSSSGGCRCSKRRKLRIKRTIKVPAISSKLADI<u>PPDDYSWRKYGQKPIKGSPH
PRGYYKCSSMRGCPARKHVERCPDEPSMLIVTYEGEHNHSR</u>ILPGGPNLVLHT

Figure 592. Amino acid sequence of SEQ ID NO: 1634. The conserved DNA-binding WRKY domain SEQ ID NO: 3670) identified using InterProScan is underlined.

MAVEMLDSRNFMDRDVHQAASATLESVQNLIQLISRHREMQDERESQCGSAAEMA
ANRFKRVVSMLGTTTGHARFRKAPAGTSVPAPKISPSFEHGHANMSAAAAVASCSS
QEPLKDSEGFISPAPLNNNTLFRPTPLHVQAPAQNPVMDSSPQQPKISLVPVNSDYSF
MGSRSFKESVISSPPLSSTNSFISTLTASDPCDKTSILVRSLSPTAVGRPPLSSSKKACIH
GKPDDLSGKCNTTGGRCHCSSKRKKSRVKRTIRVPAVSA<u>KLADIPSDEFSWRKYGQK
PIKGSPHPRGYYKCSTVRGCPARKHVERALDDPNVLIVTYEGEHSHSHS</u>GSENTGLV
LDS

Figure 593. Amino acid sequence of SEQ ID NO: 1635. The conserved DNA-binding WRKY domain SEQ ID NO: 3670) identified using InterProScan is underlined.

MAVEMLDSRNFMDRDVHQAASATLESVQNLIQLISRHREMQDERESQCGSAAEMA
ANRFKRVVSMLGTTTGHARFRKAPAGTSVPAPKISPSFEHGHANMSAAAAVASCSS
QEPLKDSEGFISPAPLNNNTLFRPTPLHVQAPAQNPVMDSSPQQPKISLVPVNSDYSF
MGSRSFKESVISSPPLSSTNSFISTLTASDPCDKTSILVRSLSPTAVGRPPLSSSKKACIH
GKPDDLSGKCNTTGGRCHCSSKRKKSRVKRTIRVPAVSA<u>KLADIPSDEFSWRKYGQK
PIKGSPHPRGYYKCSTVRGCPARKHVERALDDPNVLIVTYEGEHSHSHS</u>GSENTGLV
LDS

Figure 594. Amino acid sequence of SEQ ID NO: 3647. The conserved DNA-binding WRKY domain SEQ ID NO: 3670) identified using InterProScan is underlined.

MASKLYMKQRIMDPVNISLSLNIQRDCDVQIMSRAGLDSAQRMVSILSQKHQQNQQ
EQVQQEFVLAAEDALSKLNKVVSLLSRKGHARVRRGPLQTQSASGSGSEQLFMDGP
NFLDLESPKTHASASIYSSSSSDFALSQCVKQFLPCQSSSSGVLSADTNRHQQLHPQM
HYPPLQLQHLSPQAEVMFRNGYMQLDNSMSCTATISSTKSFMSSLSMDGSIANDKQL
LQYQSISAAQERIPGASSKRKCSGKGDDSSKCGSTGRCHCSKRRKLRVKRTIRVPAIR
SKLADI<u>PPDEFSWRKYGQKPIKGSPHPRGYYKCSNLRGCPARKHVERSLEDPSMLIVT
YEGEHNHSRLLSSNSSLIVHP</u>

Figure 595. Amino acid sequence of SEQ ID NO: 1637. The conserved DNA-binding WRKY domain SEQ ID NO: 3670) identified using InterProScan is underlined.

MGSRIGSGLMSTDVDDFAGFESPYMSFTQCLQAGLQMGEADYSALSKSLACGELGD
HEQQQQPEFPEYDQEIKVQANCKSQNPSAIQLGPSMAEAQVGSRSGDMSTVPGTPN
SSISSSSEGHELEQSSLVAPSSVTTNSTAAKGQGPADTESQPDLTAAEKPSMEPKKPP
RKKGQKRNREPRFAFMTK<u>SDVDHLEDGYRWRKYGQKAVKNSPFPRSYYRCTNGKC
SVKKRVERSSEDPGIVITTYEGQHSHPSP</u>AILRGSAESQSHFSDQRLNSPFTQTPLIRFP
PHPMMMSSTNQVPAASPSSTNNFHHLGSIKSCMNPHLLPQSHHGNSQPHPTHLMPTN
LSQQPLIDQGLLEDIVPPGMRKF

Figure 596. Amino acid sequence of SEQ ID NO: 1638. The conserved DNA-binding WRKY domain SEQ ID NO: 3670) identified using InterProScan is underlined.

MAVEMLDYRGSFRKEEDLKEAASAGLESMDRLIRLLAQQQQQQKESYSSNPPDAMD
VDCCAIADVAVNKLKKVVSLLSRTGHARFRRGAGVDSRRPSSVSLQNFSDPHERSFS
NNNSPDNNAENANANGTNSAALLCPMAQQPLLPRPQAQSQSLSQSQTQTQSHSPHPF
IKRSSSKPDAYFPMNSSKPIAADFSMNSFKPVASDFSLNSSKPVSSIKPAKDLTFEGLT
GAGPTQLKPMQELTFKGFTSQGSKPITDFSMALTNHVATTDFYGHRKDSVCSSPPLS
NTNSFLSSITGDGSVVSTDKRPSMLLASFPPSSGRPPLSSSKKKCHGKSNDTDGGKHC
GPSGRCHCSKRRKSRVKRTIKVPAISAKMADI<u>PADEYSWRKYGQKPIKGSPHPRGYY
KCSSVRGCPARKHVERSLDDPSMLIVTYEGEHNHSQSMSESTGLVVDP</u>

Figure 597. Amino acid sequence of SEQ ID NO: 1639. The conserved DNA-binding WRKY domains SEQ ID NO: 3670) identified using InterProScan are underlined.

MDYQQEQHPVTSSSHFYFPDQDLDMNSKSFSDLLADNNGDSLIWGANEQKLEFGAA
GGVTRGGNSFAERFAARGGEPLKLSTAKFKTMSPSSLPIPRSPFLSIPPGLSPTTLLDSP
VLLSTAQDMESPTTGTFPLQSFSFQSTAATASLDIVKNEDGSCSSFAFKPLAGSNPSSD
MQPLGNLATFGYNHHQSLKGVQDDARMWTSPIFSQTNETNETGANSSSEPTTTGTT
AMQAVPLQAVRSQAASFEEQQQRPLSDFNQTAIVPPTGIERPSDDGYNWRKYGQKH
VKGSEFPRSYYKCTHPSCPTKKKIERSLDGHVTEIVYKGLHNHTKPQPSRRMGAAAA
AAAAAARLEEGESTEGCGALVKVEDPSSTPPRRQNSNHLESLGTPEQSISASEEDDAR
TQVDKFSGDEDLDEEESDSKRRKKEVNTMDIIGATRTIREPRVVVQTTSDIDILDDGY
RWRKYGQKVVKGNPNPRSYYKCTNAGCSVRKHVERASHDPKAVITTYEGKHNHDV
PAPRNSSHTNAGLGSGQPPVPILQNSVAPSTNGMALTAPGTQETFSHFDRHPDLHNG
YGNNNYMFGRIANESYNSQNGRGLGMSLGAFGLESKHSEIQQAEAPTSFPMQIKPAS
HEYSSIGSGNSGHIYYNQPNERDGLIRPKEEQKGQFLV

Figure 598. Amino acid sequence of SEQ ID NO: 1640. The conserved DNA-binding WRKY domains SEQ ID NO: 3670) identified using InterProScan are underlined.

MAGNEENNKMGFLDWGPLTSPTTLIASMMAEDFSSRSFSQLLAAPQIETPQSQEQNL
KPLSPAGFNGSSSRSGKENDPFSISGGFAAGSVPTSGFGQVHKPPSRTGGGSFAERLA
ARGGFNAPRLNTARFKCLPSVSSPGGVRSPYLTIPPGLSPTTLLDSPVLLSNSQAAQSP
TTGSFPLPPFLYESSLSPPVNSGSDGLKDKSYEDGTSSSFIFKPHVKSGPSSCLSPLGGL
ATFGSSQQQAVGGFQVQTESQTWPQFDSQMPSRSNSQGQAQTYTQIQTQAHAQSHT
QAQNRTDAQVFMQAGNKARSHAAAQVKTQAQDQGQAHVPAQGQAQLWEQAVAN
STGTKDLVAYSLPESPVPNNVIEEAKCVPPLQVAPPLHVDPQDFPSEESVPSEEQEQM
HDSDAQLQLPEGDQKGLAPHTISGRPSEDGFNWRKYGQKQVKGSEYPRSYYKCTHP
NCQVKKKVERSPHGQVTEIVYKGGHNHPKPQPSRRSAVGSAHMIQEGAESTEATTK
VEGGNTWRNTELGLLKDKDAANCSKTWKNELLERSSSASVVTDLSDPSSTAQVQSS
SRLDSLGTPEMSSTIASDDDMEDANDSKSVGDDGDENESDSKRRKKENNTVDIVAAS
RAIREPRVVVQTTSEIDILDDGYRWRKYGQKVVKGNPNPRSYYKCTNAGCPVRKHV
ERASHDPKAVITTYEGKHNHDVPAARNSSHDNAAKGNGAAPLAMQNNVPAPMNAI
PRPVPQVQDIVSRPVPQVQGIVSRFDRHLDPRNEYVKRAYYEKVVDENLHLQDKNG
GSLDLKMGAGMGFGMFGLANNHTDKRQIAEGHPPFPMQIHSTTSHGLPGIQFSGKPT
VPVQSYFGQAKDNGMRFLRPKEEQNDDSGFGNTLTFNPTPNPSLYQQIMGKLSMGP
SL

Figure 600: Amino Acid sequence of 044463/0191/SEQ ID NO: 832. The conserved Pathogenesis-related transcriptional factor and ERF domain is underlined.

MARP<u>QQRYRGVRQRHWGSWVSEIRHPLLKTRIWLGTFETAEDAARAYDEAARLMC
GPRARTNFPYNPNM</u>SQSSSSKLLSATLTAKLHRCYMASLQMTKSALQVQEPQKPPSS
HFVNANGIFERNNDMGHQKMQFQLQESESWVIKKEKVEEAETQQFKPLEDDHIQQM
IEELLDYGSLEFSSSIAS

Figure 601: Amino Acid sequence of SEQ ID NO: 859. The conserved AUX/IAA family domain is underlined, and the conserved transcriptional factor B3 family domain is in bold.

MANRGGGEDDLYTELWKACAGPLVDVPRAGERVFYFPQGHMEQLEASTNQELNER
IPLFNLPPKILCRVMYIQLLAEQETDEVYAQITLLPEAPQSEPMSPDPYLPEPPRPRVHS
**FCKVLTASDTSTHGGFSVLRKHATECLPPLDMNQSTPTQELAARDLHGYEWKF
KHIFRGQPRRHLLTTGWSTFVTSKRLVAGDSFVFLRGESGELRVGVRRMARQQ**
STMPASVISSQSMHLGVLATASHAVQTQTLFVVYYKPRTSQFIISLNKYLEAVNNKFS
VGMRFKMRFEGEDSPERRFSGTIVGVEDISSQWTDSKWRSLKVQWDEHASVPRPDR
VSPWEIESSVPSIPPSMTESAVAKKRPRPPAELPALDTAGATLHDVGLMQSCDSTQPT
VFIEGKRSDNHGIWHHKQTSVNTGSNSISWPQTEGDRQFSPSVCGWPLLSSSTMHSP
KPRNEPKVELAEKPERPTSCRLFGIDLINHSSNSQQVDRLTVQP<u>LDGSAGINETHTPGN
APAADSQQKSVVLKTSKEIIPKQSVVSPKEIRSKQSCSTTARSRIKVQMQGVAVGRAV
DLTMFEEYDQLIDELEEMFEIKGELRPRNKWEIVFTDDEGDMMLVGDDPWPEFCNM
ARRIFIWSSQDVKKMSPGSRLPVFSVEEEGSLA</u>

Figure 602: Amino Acid sequence of SEQ ID NO: 860. The conserved transcriptional factor B3 domain is underlined.

MASHPSNHSCGRPHQGAFADALYKELWHACAGPLVTLPREGERVYYFPQGHMEQL
EASTNRGLEQQMPSFDLPSKILCRVVNIQLRAEPETDEVYSQITLLPEPEQKEVTSPDP
PLPEPPRCKVH<u>SFCKTLTASDTSTHGGFSVLRRHAEECLPLLDMTQQPPWQELVATD
LHGNEWHFRHIFRGQPRRHLLTTGWSVFVSSKKLIAGDAFIFLRGEDGELRVGVRRL
MRQQSNMPSSVISSHSMHLGVLATASHAIATGTLFSVFYKPRTSRSEFIVSLNKYLEA
RAHKLSIGMRFKMKFEGEEVSERRFSGTIIGVGDSMSSGWTNSEWRSLKVQWDEPSS
IMRPDRVSSWELEPLVVTAPSNSQQVQRKRERPTVLPSSSVQELSVFGGPKAPEYSSD</u>
FLHGDSQRGRDVYLSPKFSPSARSKSLNYNGNGSPAALSGYTVNWPSHMETITDPCT
PVNGKESSEKRESGGSGCRLFGVQLLDSAKKESLSVTLAAGQRDDDKTALSVDDDS
KEHQEPSCVNHFDNPSACYDPEKSCPNSSQDLQSRQIRTCIKVHMQGIAVGRAVNLA
QFNRYEDLLMRFEEMFEIGGELCGSMRKWQVVYTDDEDDMMMVGDDPWNEFCSM
AKKIYIYTTEEVKRLLPKIKLPVEDVGPANGGSDVAVNTDDRSSVVGSGC

Figure 603: Amino Acid sequence of SEQ ID NO: 861. The conserved transcriptional factor B3 domain is underlined.

MIDLNTVEDDETPSSGSSPASSLSSAISASNINSNPAYPTSSSSSSSSCSPLCLELWHAC
AGPLISLPKRGSLVVYFPQGHLEHVSDFPTSVFDLPSQIFCRVVDVKLHAD<u>ASTDDVY
AQVSLVPEREQIEHKLREGDNEIDLDEDEIEPAVKSSTPHMFCKTLTASDTSTHGGFS
VPRRAAEDCFPPLDYNQQRPSQELVAKDLHGLEWRFRHIYRGQPRRHLLTTGWSAF
VNRKKLVSGDAVLFLRASNGELRLGVRRAIQVKGASAFPSLCIQTLNQSALMDVPKA
VSLGSAFSVYYDPRASSSEFLIPARRFFKSLNQTLAPGMRFKMRFEAEDTAERRHSGL</u>
IANISDMDPVRWPNSKWRCLQVRWDDVEPDRGSRICPWEIEPSGSVSSPIGFMMPGS
KRTRFGIPSMKPEYPVPNGIGASDFGESFRFQKVLQGQENLGFGTPYDGIETQSHRLS
EVRRHHPDDSGGSEAAATRNGITNPSVNASVTYKGMGFGESFRFREVLQGQETFANP
PYTRPWFTSGAQGNGAFGVRDGFQMVPSRNGCSALSQGSDNRFGLPVSSVQVSSPSS
VLMFHQPSRKSSNRSSLCNTLPWDEKLSSPMKVSFGGTSPLGLLNEENRLSFPHSSILL
PSEGVVSEDMAPPLKSSCRLFGISLTEGRDVSHKEVSMSSSRLNGEPLFGHIGENFHPK
ANVSRVVGSNCTRVLDLPPVSDVLFDVAS

Figure 604: Amino Acid sequence of SEQ ID NO: 3648. The conserved Zn-finger, CONSTANS type domains identified using InterProScan are underlined.

MKMKVQ<u>CDVCEKAEATFLCCADEAALCSACDNNVHAANKLASKHQRVSLINPSSQ
SPKCDICQEKTGIFFCLEDRALLCRQCDVSIHSLNNLVAAHQRFLVTGVKVGLEPSNT</u>
ISPSTKTSTQSSDITNKKSQTLRNGPTEVSASLHQGVQKGIGGGGISRRGTVSEYFSDL
LPLWRMDEFLNLPELDNGYGFGEAGSSRADNANFVEEWPANSFSTEEDNSENCLAQ
VPEMASPPTASGLYWPRKIICQPKEGKRREDLTIFGFDDASLVPDIGCRSSPPDSPLSK
RRRLHA

Figure 605: Amino Acid sequence of SEQ ID NO: 863. The conserved transcriptional factor B3 family domain is underlined.

MEIDLNHAVSDVENASNACCDGHCEKGNGCLHCLSSTSSNSSSSSSSSAVPCSIYSEL
WHACAGRLTSLPKKGNVVLYFPQGHLEQVASASPYSPMEMPTFDLQPQIFCRVVNV
QLLANKDNDEVYTKVTLLPQLELVGLDSEGRALEELGVDENDIGGSPPRSTP<u>HMFCK
TLTASDTSTHGGFSVPRRAAEDCFPPLDYKQQRPSQELVAKDLHGVEWRFRHIYRGQ
PRRHLLTTGWSVFVSQKNLVSGDAVLFLRGEDGELRLGIRRAHRPRNVLPGSTVGEQ</u>
NMCPAVLSAVASAVSTKSVFHVFYSPRASHAEFVVPYQKYLKSINNVICIGTRFKMR
VDVDDAPEKRCTGVVTRIGDLDPYRWPNSKWRCLMVQWDDDITNGHQDRVSPWEI
DPSVSHSPLSIQSSPRLKRPRTSLPTMPPVPGGGVRLLDFEESLRSSKVLQGQEKLHLV
SPVYGRDTLNCQVDFEQSPAHQGLASVVVEKANNINEYMRANAPSYAGFVESDRFP
RVLQGQEICTLKSLTTKPEYNLGTWGKSSLSCSSFGVHQAPKYHFDQVKSSESLQKV
YFPYNDILKSSQDRTRCSDSTNFLREVASVRSLRVQNEAIERTKVDVRNLESICTSPNF
GDSQRAQANGSIDSLLSGCKLFGYPLTAEAPTSTLQNSGKRSCTKVHKQGNLVGRAI
DLSRLNSYQDLLNDLERLFSMEGLLRDHDKGWRILYTDSENDVMVLGDIPWHEFCD
VVTKIHIYTQEEVEKMTTGMISDDTQSCLDQAPLMMEASKSSSVGQPDGSPTVVRL

Figure 606: Amino Acid sequence of SEQ ID NO: 864. The conserved transcriptional factor B3 family domain is underlined.

MRDLCLDQREMASGSSRVEARADAEMALYNELWQACAGPLVAVPRQGERVFYFPQ
GHIEQVEASTNQVANQQMPLYNLPSKILCRVINVQLKAEPDTDEVFAQITLLPEANQ
DEDSLDKEPPPPPPPRFKVH<u>SFCKTLTASDTSTHGGFSVLRRHADECLPQLDMSKQPP
TQELAAKDLHGNEWRFRHIFRGQPRRHLLQSGWSVFVSSKRLVAGDAFIFLRGENGE
LRVGVRRAMKQQGNVSPSVISSHSMHLGVLATAWHAISTGTMFTVYYKPRISPAEFII</u>
PYDQYMESLKKNYSIGMRFKMRFEGEEAPEQRFTGTIIGIEDADPKGWRDTKWRSLK
VRWDENSAIPRPERVSPWNVEPALAPLALNPLPVSRPKRPRSSILPSSPESSVLTREVA
ADPSSSNGHSRILQGPESSTLRGIATDNDLDVVEKSVMFTPSMEEEKIDMLSASKRHG
LDSWMTSGRRGPTCADLLSGFGGNTDVSHGFSLSSEQSSAANPARKHLVDQGRKFHI
IGNSWSMIPSSLSLNLSESNRNSSLHGNDMHSPQGIGKYSGSKEYPVVHGQRVEQPH
QNWVMRPPMSPHFNFPHASESISKSPYAQQHEAIKAKGGNCKLFGIPLVSNPVMAKS
AVSVRSATNVFTDHVDSPSCQAHGFRLDQPTEPLNAANGGDDLVANELEKEKLFQN
SQPHNRDVHHRVQASSTRSCTKVQKQGIALGRSVDLAKFSNYDELRAELDQLFEFG
GELMNPRSNWLIVYNDDEGDMMLVGDDPWQEFCGIVRKIFIYTREEVQKMKPGTIS
AKDEDNLMVDEGVFSKKMTSDTLPSASDPKNC*

Figure 607: Amino Acid sequence of SEQ ID NO: 865. The conserved transcriptional factor B3 domain is underlined.

MRLSSSGFNHQSPEASNAGEKKCLNSELWHACAGPLVSLPPVGSRVVYFPQGHSEQ
VAASTNKEVDAHIPNYPNLSPQLICQLHNVTMHADVETDEVYAQMTLQPLSPQEQK
DLYLLPAELGTPSKQPTN<u>YFCKTLTASDTSTHGGFSVPRRAAEKVFPPLDYSQQPPAQ
ELIARDLHDNEWKFRHIFRGQPKRHLLTTGWSVFVSAKRLVAGDSVLFIWNEKNQLL
LGIRRANRPQTVMPSSVLSSDSMHIGLLAAAAHAAATNSRFTIFYNPRASPSEFVIPLA</u>
KYVKAVYHTRVSVGMRFRMLFETEESSVRRYMGTITGISDLDPVRWQNSHWRSVK
VGWDESTAGERQPRVSLWEIEPLTTFPMYPSPFPLRLKRPWPSGLPSFHALRDGDMSI
SSSLMWLQGVGDQGVQSLNFQGFGMTPWLQPRYDTSMAALQTDVYQAMASAALQ
DMRAVDPSKCASQSLLPLQQSQNVPMGQASIIQRQMLQQSQSQNSLLQGFQENQAT
AQGQVLQHPSYNDQRQQQQQHQQQPQQSQQFNHTSLQQQMPNIITTLPQYGSIGQS
QSSSLPAISQSQQNIFSDGMENPIVASDVSPMQSILGSISRDGASQLLSVNGSDSMISSS
LLKKQNSVEPHLLSEAAHCILPQVEQLATTHTNVSEFANYLPPFPGREYSAYPGATDP
QSSLLFGVNIDSTSLMMQNGMQHLRNIGSEHDSLSVPFGTSNFASVAGTEFPHNSDM
ATSSCVDESGFLQSSENVDQVNPPTRTFVKVHKSGTFGRSLDISKFSSYDELRSELAR
MFGLEGQLEDPQRSGWQLVFVDRENDILLLGDDPWQEFVNNVWYIKILSPHEVKQL
GKQGINPANSVPRQAL

Figure 608: Amino Acid sequence of SEQ ID NO: 866. The conserved transcriptional factor B3 family domain is underlined.

MRLSSAGFSPQAQEGEKRVLNSELWHACAGPLVSLPAIGSRVVYFPQGHSEQVAAST
NQEVDAQIPNYPSLPPQLVCQLHNVTMHADIETDEVYAQMTLQPLSPQEQKEAYLPA
ELGSPSKQPTNYFCKTLTASDTSTHGGFSVPRRAAEKVFPPLDYSLQPPAQELIARDL
HDNEWKFRHIFRGQPKRHLLTTGWSVFVSAKRLVAGDSVLFIWNEKNQLLLGVRRA
NRPQTVMPSSVLSCDSMHLGLLAAAAHAAATNSRFTIFYNPRASPSEFVISLAKYIKA
VYHTRVSVGMRFRMLFETEESSVRRYMGTITGICDLDPVRWPNSHWRSVKVGWDES
TAGERQPRVSLWEIEPLTTFPMYPSPFPLRLKRPWPPGLPSYGLRDDDMGIASPSMWL
RDGDRGMQSLNFQGMGLTPWLQPRLDASMLGLQPDMYQAMAAAALQEMRAVDH
SKLATASLMPVQHVQNITSASASLMPSQMLISTQPQQSLLQGSRESPHHSVSQDQVQS
HLLQRQLQHQNSFTNQQQPQQEQLRQQLVNQEQIPSASSPSQFALASQSHTASLQTM
PSLCQQLSFSDSTGNPVTSPVVSPLQTLLGSFTQDGSTHHLNLPRTNSSVSPSSWPSKR
AAIESLVPSGPSQRVLPQMDQLGPPQNNLSPSSVSLPPFPGRECLDQEVTDVQSHLLF
GVNLEPSSLLMQNGISSLRAVGSESDSTSMPFPSNYISNSGADFAPNPSVAPPGGIDDS
GFLQSPENLNQVNVPTRTFVKVYKSGSFGRSLDITKFSSYNELRSELARMFSLEGQLE
DPVRSGWQLVFVDRENDSLLLGDGPWPEFVNSVWCIKILSPQEVQQMGKQDLELLN
SIPVQRHSNGGCDEFTNRQDSRTINSGIPSVGSLDYGTL

Figure 609: Amino Acid sequence of SEQ ID NO: 896. The basic helix-loop-helix (bHLH) dimerization family domain is underlined.

MHHPPNPDSLSLLQSARTPNAPPEHPVPSTSRRDEVAVLKSQKAGREKLRRDRLNEH
FIELGNTLDPDRPKNDKATILSDTVQLLKDLTAQVNQLKAEYSTFCEESRELTQEKND
LKEEKASLKSDIESLNAQYQQRARAMFPWPIMDHSVVMAPPSYPYPVPVAVPSGPIP
VHPPMQPYPFYATPNSNVFPNSHSTLLPFATPNMQFEQLSGHYAHPLMQMGNQSLV
SSNKNDKGKERKHEKSGSSNDVTTDLELKTPGSATENDSSSPHRSSMKSMRKDDDT
AERSSSTHSSSPHSVQDSSSSSIAGGSNSRAND

Figure 610: Amino Acid sequence of SEQ ID NO: 900. The basic helix-loop-helix (bHLH) dimerization domain is underlined.

MKQGFYLQSSSPVQHMMSGNPNYWWNNINPPPPRSPFCHSSSSSPNLFLPYPPSSSLS
SLFHLNPSWVYNNNVNQEQLPESLSQLLMGGLVGEEDKSSVMMNYLQEKRVEDWE
EQQVLQQSPNDASVLDNQHHHLHVKQEDSASSYGVYGGAASDHHALQGTTNKSA
WSQHHHHAMIPNSPPKSCVTTSFSSSMLDFSNKKPVNKRQTPPDLSSECNSNATGGV
QKKAKVQPPSTSQSNTFKVRKEKLGDRISALHQLVSPFGKTDTASVLLEAIGYIRFLQ
NQIEALSSPYIGSASGKTRHHQSVRGERSPMFSEDSGQESINEEPKNDLRSRGLCLVPV
SCTLQVGSDNGADYWASAFGGGGLR

Figure 611: Amino Acid sequence of SEQ ID NO: 901. The basic helix-loop-helix (bHLH) dimerization domain is underlined.

MSLWADYDHAAATDLSAFWPPPATPPPPAPAPPLSQESLQRRLQALIEGARGRDGEE
GAGGPAAAWTYTIFWQSSGDYSGPVLGWGDGYYKGDGRARSRGSACSQAEQEHR
KKVLRELNSLISGAPPADDAVEEEVTDTEWFFLVSMTQSFAGGVGLPGRAYFSSNPA
WVTGAERLGNCGCDRARQAQIFGLQTIACVPVLNGVVELGSTEPIYQSSDLISGIRGL
FNFHESEMGCGGRVLNSEHDPASLWICDPPVTMEINDRPMTFQIENPSSSSLTESPSAI
CAINDQQSDQNQQQNEGFFAKELNFAEYAINSSSRSNNGDSHPMKPESVEVLNFGDS
GSGRLLSSHSQVAVAGETAKKKKRSATSIGSNEEEMMSFTSGVIVPSSGMLKSVSGA
GDSDHSDVEASVVKEAESSKVVEPEKRPRKRGRKPANGREEPLNHVEAERQRREKL
NQRFYALRAVVPNVSKMDKASLLQDAESYIREQRLMVALQELNLELQHASVSVVNE
LMIQQATVKMGSQLYTQEQLKAALLAVI

Figure 612: Amino Acid sequence of SEQ ID NO: 902. The conserved basic helix-loop-helix dimerization domain is underlined.

MASGMENRGEIPANLKKQLALAVRKIQWSYGIFWSISTRQPGVLEWGDGYYNGDIK
TRKTIQAVELNTDQIGMQRSEQLRELYESLSAGESSPQVRRPSAALSPEDLTDTEWYY
LVCMSFIYDIGQGLPGRTLTTGQPTWLCNAHYADSKVFTRSLLAKSASIQTVVCFPFR
GGVIELGVTEQVSEDPGVIHQVKGTLLEIQYPIASKKFSALIGDTIDQDDVDILDHDIL
DVKLVPVARELDMASPDTSSNGFEANQLPENSFVVEAINGVASQAQSWQFMDDEYS
NCLHHSVNSSDCISQTIVEPTNLRSVQEDDKANDPQGCGYRKPTILENEIDDVHYQSV
LSSLLRTSHQLIVGPHFQRGNRESSFVAWKKGWFPSRQTTQGGTPQGVLKRILFQVP
RMYDNALQSPLEDGGENGVWRPEADEIGLNHAVSERKQKEKINDRLGVLKSMVPSV
SKVDKLSILDDTIAYLRELQRKVEELESWGIGMEVEAKSRRKPHDMVERTSDNCGTH
VTGSGKKPVRNKRKASNIDSMELETNSVVQRDVSADNLTVKINDRTVLIEMRCSSRE
GVLLEIINEVNNLHLDSHSVQSSTIDGILSLTIKSKFTGSTVMSAATIKQALWRFAQKC
GNSSPY

Figure 613: Amino Acid sequence of SEQ ID NO: 903. The basic helix-loop-helix (bHLH) dimerization domain is underlined.

MATGVEGNEGVPANLRKQLAVAVRSIQWSYAIFWTLSATKQGVLQWGDGYYNGDI
KTRKTVQAVELKPDKIGLQRSEQLRDLYESLLEGETDAQNKRPSAALSPEDLTDEEW
YYLVCMSFVFNPGEGLPGRALADGQTIWLCNAQYADSKVFSRSLLAKSASIQTVVCF
PYLGGVIELGVTELVPEDPSLLQHIKVSLLDFSKPICSEKSSSIPQNGDADKEPMCAKV
DCGMVDELVLENLYSPAQEIKFDPEKISEFCESIPKELDMDSPDECSNGCEHNYQTED
SFMVDGMNGGASQVQSWHFVDDDFSNGVQGSINSSDCISEAIVNQDKYISSPRRENA
KNSHLKELQECNHSKLSSLDLGPDDISHYRRTISAVLRNPDQLPETRCICSCGCKSSFL
RWRMVEVHKPRAHQETLKKILFEVPLMHRGQALKSELQNGVESLLGDVDFCAGHIL
STKKKEHEKFLVLRSMIPSIEEIDKASILDDTIMYLRELEARVEELESCMDSTDLEGKV
TRKKFPDMIEQTSDNCKKRWINKRKASDIDETDAELDRNAQGDGLQTDVKVNIKEQ
EVSIEMKCPYREYLLLDILEAVNNLHLDAYSIQSSTLDGVLKLTLKSKFRGAAVSPAG
MIKQVLWKITGKY

Figure 614: Amino Acid sequence of SEQ ID NO: 912. The conserved basic-leucine zipper (bZIP) transcription factor domain is underlined and the basic-leucine zipper (bZIP) transcription factor domain signature is in bold.

MENPDLPGDDLALEFDFQSLFDELSPDAAGLLDASDVDASSPGSLSSWIGEIEGMLM
KDDEEAVAVEPSQEVFDRFFAGLLVDSPEGGPAEATDGASDKESNSSDGGGGGGE
RDEKLVVGDNELSEDADDD<u>DPVSKKQRRQLRNKDAAARSRERKRSYVKELEMKS
KYMEGECRRLGRLLQCFVAENQALRLNLENGGAYGATMAKQESAVLLLESLLLGSL</u>
LWFLGIMCLFTRPVSLQPCPVAPPLENVGEKDLRSWAPRGIRGHAFEVSAAHSFVMT
RRCRASRTKMKLCYLVPRALA

Figure 615: Amino Acid sequence of SEQ ID NO: 913. The conserved basic-leucine zipper (bZIP) transcription factor domain is underlined and the basic-leucine zipper (bZIP) transcription factor domain signature is in bold.

MGTGEETTASKPSKPTSSIQEVPTTPSYPDWSSPMQAYYAPGATPPPFFASTVASPSPH
PYMWGSQHPLMPPYGTPVPYSAIYPPYVHPNMAPTPVAAQTNVEPDGKGADGRDG
ASAKKSKVTSGNSSLVGGKAADGVKATSGSGNDGASQSADSGSEGSSEGNEDNSQQ
EFTAGKPGVPTPATNLNIGMDLWNASSAGGAAKIRPNPGAASSTLVPTGMMPDQW
MQD<u>ERELKRQRRKQSNRESARRSRLRKQVECEELQARVETLSNENHTLRDELHRL
SEECEKLTSENSA</u>IKEELTRVCGPEAVANLEHDSTSALQSHGSEENS

Figure 616: Amino Acid sequence of SEQ ID NO: 915. The conserved basic-leucine zipper (bZIP) transcription factor domain is underlined.

MEMRDPPPNPSHSPHIPSPQNPRAAPAIAPPLAAPRGGHHRRAHSEVNFRIPEDLDLG
PDPFENGPSGSFEDFGSEDDLLSTYMDIEKFGSKLDDGQGPSDPKPENAGGGGDVGE
KSARPRHRYSNSVDSSSILESIEAKKAMAPDKLAELW<u>TIDPKRAKRILANRQSAARSK
ERKARYISELERKVQTLQTEATTLSAQLTLFQRDTSGLTAENTELKLRLQAMEQQAQ
LRDALNEALKKEVERLKVATGEAMTPSDTYNLGLHHFPYAKPSYFPHQPQSGHVDP</u>
QNLQMTQFHMFQPNMAHQPLVAAAHSNAFSDMMQQESLGRFQGLDISNKGSQIVK
SEAPSISASESSSTF

Figure 617: Amino Acid sequence of SEQ ID NO: 916. The conserved basic-leucine zipper (bZIP) transcription factor domain is underlined and the basic-leucine zipper (bZIP) transcription factor domain signature is in bold.

MNSTTQFVSSRRMGMYDPIHQIGMWDENFKQNGNPNAPPALIIPMHANLDNQSED
TSHGSQDTAGKYEQETS<u>KPYDKVQRRLAQNREAARKSRLRKKAYVQQLEASRLKL
VQLEQEVDRARQQGVYMASGVDSAYPGYGGCLNSGIVAFEMEYGHWIDEQNRQIC
ELRAALNDHRTDVELRILVESGMNHYLELFRMKAVASKADVFYVMSGMWRTSSER
FFLWIGGFRPSELLKVLMPQLDPLSDQQWAFVSNLRQACQQAEDALKQGLDKLQLN
LAEAVASGHLGEGNYIPQVATALEKLEALVSFVNQADHLRQETLLQMSNHLTTRQA</u>
ARGLLALGEYFQRLRALSNLWATRPREPA

Figure 618: Amino Acid sequence of SEQ ID NO: 918. The conserved basic-leucine zipper (bZIP) transcription factor domain is underlined and the basic-leucine zipper (bZIP) transcription factor domain signature is in bold.

MVAVSPFSSKQMSDQITYLTASMNSPLAQLVNPRRMHTYEPFDQFPMWGDTFKADK
VKNLEASSSVIVHAVDDGLDKKFEYVSHESAENSSSRSDQEA<u>NRPDKVQRRLAQNR</u>
<u>EAARKSRLRKKKYVQQLESSRLKLAQLELELGRARQQGLLLGNGFDA</u>THFGFSRTV
HSGIATFEMEYAHWVEEQQRKTCELGTALQGHVGDVELRFMVESSLKHYYELFRM
KAEAAKADVFFLMSGAWRTSAERFFLWIGGFRPSELLNVLLPQIELLTEEQMLQLCN
LRHLSQQAEEALSKGMEKLQQNLAQEVADDQLGAGNYSSEVAAAMEKLGALEDFV
SQADHLRQQTMQRTYLFLTTRQAARALLVLGTFWHRLRALSALWTTRPQDPA

Figure 619: Amino Acid sequence of SEQ ID NO: 921. The conserved basic-leucine zipper (bZIP) transcription factor domain is underlined and the basic-leucine zipper (bZIP) transcription factor domain signature is in bold.

MNSVFPVDEIGDSYWQPPPPPSSAADPAPGAMGRSQSEWALESFLAQVTCSGSISPSA
SSIAPPPTPGRPGEGGVLEDVVEIKKPNGQLAQLNQPQPPPPPQPQPQLQPQPKVPEGT
MKPGEPIGYPKMPLQASISTQSDFQADGSGHGVPIPQGADSGSLGTSALPTIQRDSGV
HVKQTTSESSREDSDDEEFEGDTGTTENKD<u>PAEVRRARRMQSNRESARRSRRRKQE</u>
<u>HMSELENQVGQLKVEHTGLLKRLTDMSQKYDVASVDNRILKADIETLRAK</u>VKMAE
ETVKRVTGINPLVIAMSNLPSSDIPFGSSPMDSFTTAATPMQPNADHFFHHAAPNITSI
NPHHPRFDSSGFPRNNPLPVLTNIQADAISNNVAPVSSMQGVPGAPGAIPGWSSNIPPP
LANTNIKHK

Figure 620: Amino Acid sequence of SEQ ID NO: 922. The conserved basic-leucine zipper (bZIP) transcription factor domain is underlined.

MDKDKLTGHSSGLPPPPSGRFAGFSPNANAFSVKPEQPSAAASSSSFLPMAQGQNLV
SDFSHDISRMPDNPPRNRGHRRAHSEILTLPDDISFDSDLGVVGAADGPSFSDDTEED
LFSMYLDMDKFNSSSATSSFQMGEPSSAPMAMPGAGDSGSGAAPSSAENVASGSTE
RPRIRHQHSQSMDGSTSIKPEMLMSGSEDASAADAKKAMSAAKLAELAL<u>IDPKRAK</u>
<u>RIWANRQSAARSKERKMRYIAELERKVQTLQTEATTLSAQLTLLQRDTNGLTAENSE</u>
LKLRLQTMEQQVHLQDALNEALKEEIQHLKVLTGQSMPNGGPMMNYPSFGSGQQF
YPNNHAMHTLLAAQQFQQLQIQSQKQQHQFQQHQLHHQLQQQQLQHEQQQPAGD
LKFRAPIPSPNQKDGNAAESNSSKME

Figure 621: Amino Acid sequence of SEQ ID NO: 923. The conserved basic-leucine zipper (bZIP) transcription factor domain is underlined MGPQMNFRNLADVPAAERSTGGQPGIPLLSRQSSVYSLTFNEFQNTWSGLSKDIGSIN
MDEFLKNIWTAEESQLQLQDMAPSGNGGEGGGQVGNLLRQGSLTLSRTISQKTVDE
VWRELFKETEDVKEGSREGGDINLPQRQRTLGEMTLEEFLVRAGVVREDTQMMARP
GDNGVHEEMSQFTSNGLASSAAAGNDFIFSSKPAGSSLDFIGTRPTQLQQQPQPQPLE
PPAPLFPKPETVSFATSVHLPNTAHIASPGSREAIGITHSSFNKALVHSGAMQAGGLCL
GDLGRAGFAVESPAKLVSPDAISNNSTDVSSLSPVPYAFGRGRRSKDGLEKAIERRHR
RMIKNRESAARSRARKQAYNMELEAEIARLKEINQELLRKQAEFMEMQKNQISQKV
NGLYREDKRQCCLKRTLTGPW Figure 622: Amino Acid sequence of SEQ ID NO: 924. The conserved basic-leucine zipper (bZIP) transcription factor domain is underlined and the basic-leucine zipper (bZIP) transcription factor domain signature is in bold.

MASQFNFKGITDASQAEGVAGKSHGNHSLTRQPSIYALTFDEFQNTWGGLGKDFGS
MNMDELLKNIWTAEETQAMTSTTGTDGSVPGGNIQRQGSLTLPRTLSQKTVDEVW
KDLLKESTVAKDGNRGGGFNMPQKQPTLGEMTLEEFLLRAGVVREDAQEVGRPNN
SGFVSDFSLMSTSTGLGLNFQHPSQNNGFVMNQISENSKSIPGQHPNLAFNVGSIRSN
QQQLQQQHDLPLLPKPATMPFASSVSIANNSQMPGLGLRGVIGMTDASIKSSLAQGG
GLQTGVGMTGLDTRGVALQTVSPANHISPDVISRNTMDSSSLSPVPYPFGRGRKSGG
ALEKVVERRQRRMIKNRESAARSRARKQAYTLELEAEIQKLKELNQELQRKQDEL
MEMQKSQIVEKVNRQWGGKRICLRRTLTGPW

Figure 623: Amino Acid sequence of SEQ ID NO: 926. The conserved basic-leucine zipper (bZIP) transcription factor domain is underlined and the basic-leucine zipper (bZIP) transcription factor domain signature is in bold.

MGSNINFKNFSTDPTPTNNRPPGNTLLTRQPSVYTLTFEEFQNSIGKDFGSMNMDELI
KNIWSAEENQSMASASGAGGGGGQDGIGVPGGHLQRQGSLTLPRTLSQKTVDEVW
KNISKEDSVGKDGGLVTGGPVVPQRQQTLGEMTLEEFLFRAGVVREDAQYSGKPNG
GGLFGELPRAGNNAGLEFGFPQPGKAENLMGMRNLEGGNLNSMHPLNMPVNANAN
GIRSNQQQLTQPQPQAHQPQILPKQPILPFSQQIPSPNNTQLNGHGFRGGLMAIPDQV
MTNNLIQGGALHGGGMGMVGLGAGPAGMPTGSPANPVSSDGMGRSNGDTSSVSPV
PYVFNGSVRRKCNSAVEKVVERRQRRMIKNRESAARSRARKQAYTMELEAEVAKL
KDENEELRKKQAEIMEIQKNQVKEMMNTQRGAKKRCLRRTQTGPW

Figure 624: Amino Acid sequence of SEQ ID NO: 927. The conserved basic-leucine zipper (bZIP) transcription factor domain is underlined and the basic-leucine zipper (bZIP) transcription factor domain signature is in bold.

MPSFVPATPASNSIGSEGNIVQSNQNTDFGSFEHSLGFRIEDAINLSRNPVFNQIKPNGR
ALGTDIQARAFNKSVVASERDQSSTASASQRIPLQKESQPNLLSIPGGCSENWGDSNM
ADTSPRTDSSSDDTDDRNQRLEAGPSAALGASDSSGRSKEK<u>AVDQKTLRRLAQNRE</u>
<u>AARKSRLRKKAYVQQLESSRLKLTQLEQELQRARQQGIFISSSGDQSHSSNGNGAM</u>
AFDVEYARWLEEQNRHINELRSAVNSHVGDTELRIIVDNVTTHFDDIYRLKDTAAKA
DVFHILSGMWKTPAERCFLWLGGFRSSELLKLLISQLEPLTDQQMMGLYNLQQTSQQ
AEDALSQGMEALQQSLAETLANSPPGSTESSGNVANYMGQMAMAMGKLGTLEGFL
RQADNLRQQTLLQMHRLLTTRQSARALLAIHDYFSRLRALSSLWLARPRE

Figure 625: Amino Acid sequence of SEQ ID NO: 928. The conserved basic-leucine zipper (bZIP) transcription factor domain is underlined and the basic-leucine zipper (bZIP) transcription factor domain signature is in bold.

MGSRTRVGGGGDDGRVVNGMPSFVPQLPTSNSMGSEGNSIRSSRITDFGTLEQSLGY
RIEDAVDLSRNPVFNQMKSSAQALGADVQFGSLNKSLSSSDRNLSVNIVGSQTLSMH
RESQSNLVSIPGAHRENWGDSTMADSSPRTDTSTDDTGDKNHRFEGGQLGVAAASD
SSDRSKEK<u>ATDQKTLRRLAQNREAARKSRLRKKAYVQQLESSRLKLTQLEQELQR</u>
<u>ARQQGIFISGSGEQSHSMSGNGALAFDVEYARWLEEHNKVVNELRNAVNAHAGDTE</u>
LRTIVDNVAAHFDEIFKLKGTAAKADVFHILSGMWKTPAERCFMWIGGFRSSEVLKL
LVNQLEPLTEQQLVGIGNLQQSSQQAEDALSQGLEALQQSLAETLANSTTATAGPSG
NVANYMGQMAMAMGKLGTLEGFLRQADNLRQQTLQQMHRVLTTRQSARALLAIN
DYFSRLRALSSLWLARPRE

Figure 626: Amino Acid sequence of SEQ ID NO: 929. The basic helix-loop-helix (bHLH) dimerization domain is underlined.

MGDAEDSRNDTSRGLQSSFGTLQPKQAFSMNHLDIPHLSAPDMRAPMRQFAQSFVG
GGDGNKRAGIPPSHPNQIPPISPYSQIPMPRPLNQQMGSSNFSHGPTHSRSLSQPSIFNF
DNLPPLSPSPFRDSPSSTSISDHVSGDVSMEDRDASSHPLLPPSPFPRGNPSRIGESLPPR
KAHRRSNSDIPFLSSLMQSSPPLIPSSSSKGLGTLERSVSGRESMSSAKPAQLVKKESS
WDRGVYSNAEGMGERKSEGEVVDDLFSAYMNLDGIDALNSSETDEKNGTETREDL
DSRASGTKTNGGDSSDNEAESSVNECGNSMQRLGMNSSSEKREGIKRSAGGDIAPAS
RHYRSVSMDSFMGKLNFADESTKMPPSPGVRPGQLSPGNSIDGNSNTFSLEFGNGEF
SGAELKKIMANDKLAEIA<u>LTDPKRVKRILANRQSAARSKERKMRYIQELEHKVQTLQ</u>
<u>TEATTLSAQLTLLQRDSVGLTNQNNELKFRLQAMEQQAQLRDALNEALTAEVQRLK</u>
LATAELNSESHPSKCMVSQLPVSSQMFQLHQMQQQQQSQQQTQSQQQNGNTTTKSE
SNQ

Figure 627: Amino Acid sequence of SEQ ID NO: 940. The conserved DOF-type zinc finger domain is underlined.

MTPPGTAPPKPPPMAGKEEAAPSSGSRKAASSSSSGK<u>QPEQALKCPRCDSSNTKFCY
YNNYSLTQPRHFCKTCRRYWTRNGALRNVPIGGGCRKNKKLKP</u>SLASSRLFPGGGG
DPKEYYSVAAAPPHPELGGFKLFHGLAPAVDFHLGGLSNFSKAVQNHNPPAPGIYSQ
FSSFSDASAIETAAAAPTSAATCFSLDQMAGPSGTILGFNNYHALPPFIAAAPGFGTSG
ALHEPGGSMKVDSNLASSIESLSSINQDLHWKLQQQRLAMLFSGDNNNNHNPKANN
GGDVAASSINIATAPFEDQSQNLRQPVLFQNLDAAGSSRKEGSSVTEWFFGNAYASV
TTPSPTNSSSNGNDNNNAGNWNSKGPGQGFQYTALP

Figure 628: Amino Acid sequence of SEQ ID NO: 941. The conserved B-box zinc finger family domains are underlined.

MLKEDTSGSGGSSGGGSGSGGN<u>SWARVCDTCRSAACTVYCRADLAYLCSSCDARIH
AANRVASRHERVWVCEACERAPAAFLCKADAASLCTACDADIHSANPLARRHHRV
PIL</u>PISGCLHGPLAGNVGGPVMGHAADTEEGFLTPEDEEAIDEEDDDEAASWLLINPV
KSNNSHTNGFIFGGEVEDYLDLVEYNSGAENQYVDQYNQHQQQQQQQQQQHYGVS
RKNYGGDSVVPIQHSDCQRHNFQLNLDYEPSKAANSYTRSLSHTVSISSMDVGIVPES
TPTDISISHPRPPKGTIDLFSGPPIQMPSQLSPMDREARVLRYREKKKTRKFEKTIRYAS
RKAYAETRPRIKGRFAKRTDVDIEVDQMFSATLMTENAYGIVPSF

Figure 629: Amino Acid sequence of SEQ ID NO: 950. The conserved B-box zinc finger family domains are underlined.

<u>MASKLCDSCKSATAALFCRADSAFLCPSCDAKVHAANKLASRHARVVVCEVCEQSP
AHVTCRADAASLCISCDRDIHSANPVAQKHDRVPVV</u>PFYDSLPPNHHHHHHPAVAPP
FAKPPAAGDFVLKSEDDVSREEEEEAASWLLPNPSKAAESPDVNSAHQFLFGDDDVD
PYLDVDYGPVDPKFEPSGDQNSSGTADGVVPVRSEGVVHGPFVGEGGFDLELTAGS
KGYGYSYGAPCLSHSVSSSSLDVGVVPDGSTVTDISNPGGRAVGVGFESLSRALQLSS
VDREARVLRYREKRKNRKFEKTIRYASRKAYAETRPRIKGRFAKRADIEAEAERMFG
FGVVPSF

Figure 630: Amino Acid sequence of SEQ ID NO: 968. The conserved C2H2-type zinc finger is underlined.

MVKRDREDAEVEALAVANCLMLLPRVGESAVSNRESRSTERMFA<u>CKTCNREFSSFQ
ALGGHRTSHKKQKLIPGGLFHLGCTADSSPAKPKRHECSICGLEFPMGQALGGHMRR
H</u>RAAMAEGLAAEAAKPVPVLKRSNSKRVMCLDLNSSLMEDDLTLRLGKVAPPLVL
DLLL

Figure 631: Amino Acid sequence of SEQ ID NO: 970. The conserved C2H2-type zinc finger domain is underlined.

MKPTIDLEVEAVSENDSEISSQVASNLSNQEPSMGPSNDSLANSSYLISPSAVGSGSET
VFLDLSLGCSNDESSGRDSVGVAFSSTSECSNEPESHPAAAGPTTSRVFS<u>CNYCQRKF
FSSQALGGHQNAHKRERTLAKRAMRMGMFSSQRYSSLASLPLHGSPTVRDLGIKAH</u>
SSVHQVHQGMLQQTRPHDLSSGPRFGDGFLGVPIFIEDDDVELLWPGSFRQAAQAHA
PQPSFVLTGGSNISFVGVNPPSDAGNSAPDLTLKL

Figure 632: Amino Acid sequence of SEQ ID NO: 971. The conserved C2H2-type zinc finger domain signatures are in bold.

MALEAINSPTAASAPFQFMEEPLSSRFLEPLNKRKRSKRPHHPPSEDEYLALCLIMLA
RSGAAPKPNHHASPAPLPPPPPPAPTKPEEAAATATATAAPANNLSYK**CAVCGKGFP
SYQALGGHK**ASHRKSAAAAAAAAAAASSAGADEPSTSATNSGGGAAAASSSGGGR
SHECSICHKSFPTGQALGGHKRCHYDGGASGSANSGVTTSEGVGSAAPPALGYDSGR
RNFDLNVPALPEFPTGFIVSGDDEVESPHPSKKPRFSTPLKIKLSPEQ

Figure 633: Amino Acid sequence of SEQ ID NO: 972. The conserved C2H2-type zinc finger domain is underlined.

MAASSSSVPPFYRIQEGGDQLIQMEQHRHAQMEQHRHAPSAPLASSAAASAPPAPAP
APQKKKRNQPGNPYPDAEVIALSPKSLMATNRF<u>VCEVCKKGFQREQNLQLHRRGHN
LPWKLKQKGTNKEAVRRKVYLCPEPTCVHHDPSRALGDLTGIKKHYSRKHGEKKW
KCEKCSKRYAVQSDWKAHSKTCGTREYRCDCGTLFSRRDSFITHRAFCDALAQENA</u>
RHPPTLNSIGNHSIYGSTNMGLGLSQANRQIPSMMQGGQINHSNNNDISPLGRARSGQ
LFDHLLAPSIGTASSTFNQPLPSMGSPSPNSFLFQAQSNQSYNSQEQASPQQGLLQNKP
FHGLMMQQMIPDHVKSNNNDPSPSSSVANIFNLGMLSSSSSNSNNNSSSTSSLLNSGL
LVPDQHRFKSEIGSEGSNLLPRSIPGDHHQISSSGVPSLYSTSLLQTGNHHDFSPPHMS
ATALLQKAAQMGSSTSRTNTNNNASFLKTFASYSSSSGTKSDRSPLAPVSFTGIFGVD
NNLQELVNCAFGGGQDHHQESAGDAYDGMYDNANKTGSEQSTTTHMGQHGLTRD
FLGVGEIVRRVSNNVNNNGNNGGFMDVQREDDQRRQNQEKYGLMISDDKAISSSLD
SAPTSQTFGDFR

Figure 634: Amino Acid sequence of SEQ ID NO: 1008. The conserved transcription factor CBF/NF-Y/archaeal histone family domain is underlined and the CBF-A/NF-YB subunit signature is in bold.

MAEAPASPMGGGSHESGGEQSPQSGGVREQD<u>RYLPIANISRIMKKALPANGKIAKDA
KDTVQECVSEFISFITSEASDKCQKEKRKTINGDDLLWAMATLGFEEYIEPLKVYLA</u>
RYRELEGDTKGSARGGDGSARKDVSGGQPGQNVQYVQQASLNQPVGYMNPQFGQ
QGSVNYVNAHQ

Figure 635: Amino Acid sequence of SEQ ID NO: 1014. The conserved Ethylene insensitive 3 family domain is underlined.

MGILEEMGFGSSIDFSSANPQEADAE<u>QETEAVVEEEYSDEEVEVDVDELEKRMWRD
RMLLKRLKEQSKNKEVLDGAKQRQSQEQARRKKMSRAQDGILKYMLKMMEVCKA
QGFVYGIIPEKGKPVSGASDNLRAWWKEKVRFDRNGPAAIAKYRADHSIPGNGEDA
ATIGPIPHTLQELQDTTLGSLLSALMQHCNPPQRRFPLEKGVAPPWWPTGEEEWWPQ
LGLPADQGPPPYKKPHDLKKAWKVSVLTAVIKHMSPDISKIRKLVRQSKCLQDKMT
AKESATWLAIINQEEALSRKLYPNSFPPVCSDSGFGSYVISDASDYDVEGADDEPKFE
AEECKPFDPSAFGIGPRVSTGELLIHPLVSQIKGEVHETKTNSRLVSKRNQPSDEPKAK
MDQKIYTCEFSQCPHSDHSFGFLDRTLRNNHQLSCPYRSKPIPSQAIGISNFQVNNGQ</u>
QAAFLHSFAQPNPSPPPGTHTPSFNIRGIGLPEDGQKTISNLMSFYDVNLQQNSTSAGK
LGAPSNEQQLLNVQHSMGDSLFAHGAFMGGKTHEEINLPLNHSVFPSMGSQHDQSK
AFDSPFEFCLNDGTVDSRFGSPFSVTAAAADCNRMDLLPRQDGFVWYR

Figure 636: Amino Acid sequence of SEQ ID NO: 1023. The conserved SHAQKYF SEQ ID NO: 3671) class Myb-like DNA-binding domain is underlined.

MYQQKGGASSSLVPGNTMVHGQHLDSGANTMDSIGGGNNHSNNANLAS<u>KQRLRW
THDLHDRFVDAVAQLGGPDRATPKGVLRVMGVQGLTIYHVKSHLQKYRLAKYLPD</u>
SSSDGKKAEKKESADVLSDMDGSSGGMQITEALKLQMEVQKRLHEQLEVQRQLQL
RIEAQGKYLKKIIEEQQRLSGALADGSADESGDKGQEDSKTDPPTPAPISESPIQDKSK
DCAVAKSLSLDGSLSSHNHEPLTPDSGCNVSSPAESPDGERSAKKPRVTAGASHAKP
EIVLHPIFESSLGYSYTNSSFKLPDQGSV

Figure 637: Amino Acid sequence of SEQ ID NO: 1024. The conserved SHAQKYF SEQ ID NO: 3671) class Myb-like DNA-binding domain is in bold.

MFPRLIQPHEGLIGHPDDFVGGGGGGGGPGHRGDPCLVLTSDPK**RLRWTTDLHERF
VDAVTQLGGASKATPKAIMRTMNVKGLTLFHLKSHLQKYRLGKQSGKEGADAPKD**
GSYLLENPGSGNSTPSLPSSDLNENYEVKEALRAQMEMQSKLHLQVEAEKHLQIRQE
AERRYMAMLERACKMLADQFITSAIIDNENQKCQAYGVRMPRNPSIDPLGFYTHEV
AAVHGTEDDLPPSLHSQRGDCSTESCLTSHESPRILALEESPAGGKKRPMGIDSTSAPL
IWSEAKLKIQDVAVPQVSPHGLTGFGM

Figure 638: Amino Acid sequence of SEQ ID NO: 1031. The conserved SHAQKYF SEQ ID NO: 3671) class Myb-like DNA-binding domain is underlined.

MLVVSPLRNPNDGSNNNQGEMESFSIGGGVGGSDDFPDFSDGSLLDSIDFDDLFMVI
NDGDVLPDLEMDPELLAEFSASCGEESGTGCSSISVEKAEVNNGSKREVDEDKASEL
DNISSVSRGEEIVSKRDDSVVVNPVPNNNEETDNKRKKSSAQSSKSNHQAQGKR<u>KVK
VDWTPELHRRFVQAVEQLGLDKAVPSRILELMGIDCLTRHNIASHLQKYRSHRKHM</u>
LAREAEAANWSQRRHMHGNGGQKMRPDTMLVMSHSTTPTNGSPWLAPATLGFPPV
TPMPPHFRPLHVWGHPPADHSLMHVWPKHSPSLLPPPLPSAWASPPQGAAPYGHQR
VPNPPMPGTPCFVNPPLPATRFGAPPVPGIPPHAMYKVERKHNNNNNNDNNNRGYG
VPPPGPLASHPPFDFHPDYAFDEHSKETLDAAIGDVLAKPWLPLPLGLKPPSTDSVVG
ELQRQGVPKIPPSCA

Figure 639: Amino Acid sequence of SEQ ID NO: 1034. The conserved GRAS family domain is underlined.

MTGMLHDEGSSPVTSSPLQIFS<u>MMSLSPGIGSPYPLLREVSPEDRGLWLIHYLIGCAN
HVAAGSVDNANICLEQISHHASPDGDTMQRIAAYFTEALADRILKGWPGLHKALNST
KISPVSEEILVKRWFFELCPFLKLAYVITNQAILEAMDGEKMVHIIDLNSFEPAQWVN
LLQSLSTRLEGPPHLRITGIHEQKEVLDQMALQLNEEAEKLDIPFQFNPVVCKLENLD
LESLRVKTGEALAISSVLQLHTILAADDETQRRTSPSASNSSNSSHQQRALHMRQRTL
GEWLEKDVVNLYCASPDSALVSSPKMGGFLTSLWGLSPKLMVITEQESNHNGTLME
RYVEALYFYGSLFDCLESTVPRASVERQKVEKMLFGEEIKNIIACEGIQRKERHEKLE
KWILRLELAGFGKVSLSYNGLLQAGRLLQNYGYDGYTLKEENGCLLLCWHDRPLFS
VSAWRFRR</u>

Figure 640: Amino Acid sequence of SEQ ID NO: 1035. The conserved GRAS family domain is underlined.

MDTLFRLVSLQSSDQSFNSSRTSSSSRSSRQNHHYHHQPEADEECLNIFMDEEDFSSSS
SKHYSYPYHPATTSTTPTTTSSTHTPH<u>TYDPADVSVSPARDLNFDFSSKWASDILLET
ARAIVDKNSTRVQHLMWMLNELCSPYGDIEQKLASYFLQALFSRMTDSGERSYSAW
LAASDKTCSFESTRKMVLKFQEVSPWTTFGHVACNGAIMEALEGESKLHIVDISNTY
CTQWPTLLEALATRTDETPHLRLTTVVVSKANGGAETSGVVAVQKVMKEIGSRMEK
FARLMGVPFKFSVLYHSGDLSELNLDELDIKEDEALAINCVGALHSTTTVSNRRDFV
VSSFRRLQPRIITVVEEEADLDVGVDGIEFVRGFQESLRYFRVYFESLDESFPRTSNER
LMLERGAGRAVMDLVACPPHHSVERREPASRWSRRLRGGGFNPCLFSDEVCDDVR
ALLRRYKEGWSMTPCSDAGIFLTWKDQPVVWASAWRA</u>

Figure 641: Amino Acid sequence of SEQ ID NO: 1036. The conserved GRAS family domain is underlined.

MQTSQKKSHLSMSNKICYQSALEIGTYCLPQFHTLDCYPSYCTLESSSASGGYAIYNP
PSTISFSSDGSPVSLQDSVSYPPDALHSPDNTYASSISGSCVTDDANDFLHKLRELENV
MLGPDSDISIN<u>NDRSFQKGIHVASPGSKLKDAIERKDLKRVLIASAKAVSENDLWTAN
WLMDELRGMVSVSGEPIQRLGAYMLEGLVARLASSGSSIYKALRCKEPESSELLSYM
HILYEVCPYFKFGYMSANGAIADAMKNENRVHIIDFQIGQGSQWITLIQAFAARPGGP
PHIRITGFDDSTSAYARGGGLEIVGKRLTKLAQLYKVPFEFHAALIPGSDLLLHHLDV
RRGEALAVNFAFMLHHMPDESVSIQNHRDRLLRLVKSLSPKVVTLVEQESNTNTAAF
LPRFIEAMDYYAAMFESIDVTLHREHKERINVEQHCLARDVVNIIACEGAERVERHEL
LGKWRLRFAMAGFTPFPLSSLVNGTIKTLLENYSHRYRLEERDGALYLGWMNRDLV
ASCAWK</u>

Figure 642: Amino Acid sequence of SEQ ID NO: 1046. The conserved HMG1/2 (high mobility group) box family domain is underlined.

MAGGGSSKSNAPKARKRVEVDAAAAAAAAASSSLVRGKDGSAFARCEECNKDVPV
ALISMHSCGLDAKIKMNLEAQVMERPAEAKKKPAVDRKRSSEPKAKKAKTEKKSKK
GKDAN<u>APKRPATAFFVFMDDFRKAYKEANPDSKGVKEVAKQGGEKWKSMSDEEK
KPYLDKASELKAEFNKAMEAHNA</u>GDGENEEGSDKEEAADEEAANEETAGEEAANE
ETAGEEAANEANEENEEVLEDE

Figure 643: Amino Acid sequence of SEQ ID NO: 1048. The conserved HMG1/2 (high mobility group) box family domain is underlined, and the structure-specific recognition protein family domain is in bold.

MTDGHLFNNISLGGRGGSNPGQIKIFSGGISWRRQGGGKAVEVDKSDIVGVTWMKV
PRTNQLGVRTKDGLHYKFTGFRDPDVISLTNFFQNTCGLTPEEKQLSVSGRNWGEVD
LSGNMLTFLVGSKQAFEVSLADVSQTQLQGKNDVILEFHVDDTTGANEKDSVMEITF
HVPNSNTQFVGDENRPPAQVFRDRIMSVADVGAGGEDAVVTFEGIAILTPRGRYSV
**ELHLSFLRLQGQANDFKIQYSSVVRLFLLPKSNQPHTFVIITLDPPIRKGQTLYPH
IVMQFETDYVVQSTLSMNDDLFSTKYKDKLEPSYKGLIHEVFTTILRGLSGAKV
TKPGKFRSSQDGYAVKSSLKAEDGVLYPLEKSFFFLPKPPTLILHEEIDYVEFER
HAAGGSNMHYFDLLVRLKTEQEHLFRNIQRNEYHNLFNFISGKGLKIMNLGEQG
ADGVPGVLDVDDDDAVDPHLERIRIEAGVDESDEEDEDFVIDKDDGGSPTDDSGDDE
SDVSESGDEKEKEKYGKKESRKEVKASSSKKKAKAGDEEGSKKKKQKKKAPNA**<u>PK
KAMSGYNFFLQTESEKMKRTNPGLSFGDVSREIADKWRGLSAAEKAPYTAKAEEDK
KRYQEQLSGYKNTSQAMNVDSD</u>

Figure 644: Amino Acid sequence of SEQ ID NO: 1050. The conserved homeobox domain is underlined with the homeobox domain signature in bold/underline. The lambda-like repressor helix-turn-helix motif is in italics.

MNDLSEDDMALISELYPGVYMRPSPPPQEAKPPRRRRKKSRGLENPGEEGGGTGGEG
RGKRKLTAEQVELLEQNFGDEHKLESE*RKDRLAAELGLDPRQVAVWFQNRRAR*WK
SKKLEVEYAKLKSVHETVVVEKCRFESEVLKLKEQLSEAEMEIKRLSEKADLGLSGN
SPCSSVTADAATDDPVWGDFGVAGECDDQDVLYYMPQNAYLQGLEWYNQYV

Figure 645: Amino Acid sequence of SEQ ID NO: 1051. The conserved homeobox domain is underlined.

MKVHQFARGFFELEPTTLTLGCKRLRPLVPKLPHQTDVVSTAAFVDIKSFIRPESGPR
RLGSSSDDKRDPPQVETH<u>PGGTRWNPTQEQIGILEMLYRGGMRTPNAQQIEQITAQL
SKYGKIEGKNVFYWFQNHKARERQKQKRN</u>SLGLSHCSRTPTTAATIATVTLNTTKGS
EGEIRGEEDSPYKRKCRSWAFDFSEVEEDVSRSSSSSFRDEDEAVHCRTLELFPLHPE
GR

Figure 646: Amino Acid sequence of SEQ ID NO: 1052. The conserved homeobox domain is underlined with the homeobox domain signature in bold/underline. The homeobox-associated leucine zipper is in bold. The lambda-like repressor helix-turn-helix motif is in italics.

MFSTGEYSAAAFEGMDSLPSPRKKKN<u>QLVNRRRFSDEQIRSLESIFESESRLEPR*KKLQ
LARELGLQPRQVAIWFQNKRAR*</u>WKSKQLERDFAILRANYNALYSRFESLKKEKQS
LVTQIEKLNQLVEKPQGEGQSCGHDLATNSTDRESDNGVPKYEDSQPVFPDKLTRL
MGIPCEDDYFGLEEEQSLLNMAEPDPEPAPADSSLTSPEPWGSLETDDLLNQSSGSSQ
WWDFWS

Figure 647: Amino Acid sequence of SEQ ID NO: 1060. The conserved homeobox domain is underlined with the homeobox domain signature in bold/underline. The homeobox-associated leucine zipper is in bold.

MAFFSPNFMLQSPHDQDHEHPHHQHQHQILSSCTPQDFHGVASLLGKRSMSFTGIDV
GDDPNINNGNVNGEEDLSEDDGSQPG<u>GEKKRRLNMEQVKTLEKNFELGNKLEPERK
MQLARALNLQPRQIAIWFQNRRARWKTKQLEKDYDLLKRQFDAVKADNETLQ
AQNQKLQTEILALKNTREPAES</u>INLNKETDQGSCSNRSENSSEIRLDMTRTPPVESP
VSGHALPAAGRQLFPASMRPAASGGSVAQLFQNPSRPDLPMIVKEESSITNMFCGIED
HSGFWPWLEQQHY

Figure 648: Amino Acid sequence of SEQ ID NO: 1062. The conserved homeobox domain is underlined, the ELK domain is in italics and the KNOX 1 and 2 domains are in bold.

MQEPNLAMMGGGGGGGGGGGGIVGGGGGGLGSEASFSGDHPQ**RQLKGEIASHPM
YEQLLSAHVACLRVATPIDQLPLIDAQLAQSHHLLRSYASSVQHGHSSLSPHDRQ
ELDHFLAQYLVVLCSFKEQLQQHVRVHAVEAVMACREIENTLQALTGMSLGEG**
TGATMSDDEDELQMDFSLDQSGADVHDLMGFGPLLPTESERTLMERVRH*ELKIELKQ
GFRSKIEDVREEIL*RKRRAGKLPGDTTSVLKNWWQQHSKWPYPTEDDKAKLVEETGL
QLKQINNWFINQRKRNWHNNSQSVTSLKSKRKR

Figure 649: Amino Acid sequence of SEQ ID NO: 1063. The conserved homeobox domain is underlined with the homeobox domain signature in bold/underline. The homeobox-associated leucine zipper is in bold. The N-terminus of the HD-ZIP protein domain is in italics.

*MGERDDLGLSLSLSFPQGHLHQQQQQQQRQSLQLNLMPSLVPSSASSAQSGFNLQKRSC
NDAFPSSSDRNSEARSFLRGIDVNREPSAGAAADYGEDEAGVSSPNSMASTVSGKRSERDH
QSQTNGDDLDNERASSRGGGSDEEDGDMSR*KKLRLSKDQSAVLEESFKEHNTLNPK
QKLALAKQLGLRPRQVEVWFQNRRARTKLKQTEVDCEYLKRCCESLTEENRRL
QKEVQELRALKLSPQFYMHLSPPTTLTMCPSCERVAAPSPPSAVGRPLAAVPAHPR
PVPLINPWAPAAAPLAHAPLDALRSCS

Figure 650: Amino Acid sequence of SEQ ID NO: 1064. The conserved homeobox domain is underlined with the homeobox domain signature in bold/underline. The homeobox-associated leucine zipper is in bold. The lambda-like repressor helix-turn-helix motif is in italics.

MAGGASASASAITTLLQNQRVPPPPPSDAFFLSGSSPFLGSRAMVSFEDAHRGNRLNR
PFFRSIDPDENGEDDLEDYFHQPEKKRRLTVEQVQFLEKSFEVENKLEPD*RKIQLAKD
LGLQPRQVAIWFQNRRAR*WKTKQLEKDYETLQASFNTLKSDYDTLIKERNDLKA
EVLNLTDKLLHKGNEKESSESSSKSQGLFQNPIADSVSEDEVSRVPIPTWPEDICSVK
SDMFDSESPHYTDAAHSSLLEPGDSSYAFEPDHSDLSQDEEDNLSKSLLSTRNYPKLE
NSDYAILPPNSCNFGFHAEDPAFWPWSY

Figure 651: Amino Acid sequence of SEQ ID NO: 1066. The conserved homeobox domain is in bold with the homeobox domain signature in bold/underline. The homeobox-associated leucine zipper is underlined. The lambda-like repressor helix-turn-helix motif is in italics.

MAGEEPYSADTNSDTFADEETLIPSSSEALESAWVPTSSTAHHGSKSVVNFEDVCGG
GDTNTAPRPYLRQIDLKEEAVEEDYGDGNFQPPGKKRRLSADQVHFLERHFEVEN
KLEPE*RKIQLAKDLGLQPRQVAIWFQNRRAR*YKTKQLEKDYDSLKARFESLKADH
DKLIKEKENLKGEVLSLRDKLRSRAKGSEEGSLEADDSLRGATPKPTTPSTLDAVSYV
DATILKQEDVSSAKSDVFDSDSLLEPANSSHVFEPDCSDFSQDEDDSFGKSLLPLDFLP
RFDDGYAFQQNPPAISCNFAFPAEENPFWSWSY

Figure 652: Amino Acid sequence of SEQ ID NO: 1067. The ELK domain is underlined, the KNOX1 domain is in bold, and the KNOX2 domain is in bold/italics.

MDEMYGLCGGGGGGGGGGGEEYSERALMSPENLVLPSEYQAWLCSAGFRDNRIPM
YGFGSEEFVSSASGMSETASVTPDQEDAAE**TAIKSKIKSHPSYPRLLHAYIDCQKVG
APPEVVGLLDEIRPENGVCKRDAA***VSTCLGADPELDEFMETYTDILVKYKADLARP
FDEATTFLNAIEMQLTSLSTS*TRTGASANEGDASSDEDFSGGEVEAPETQPRGEDR<u>D
LKDRLLRKFGNHISTLKLEFSKKKKKGKLPKEARQTLLEWWSVHNKWPYPTEADKI
ALAKSTGLDQKQINNWFINQRKRHWKPSENMQFALMDSIPGQY</u>

Figure 653: Amino Acid sequence of SEQ ID NO: 1071. The conserved homeobox domain is underlined, the ELK domain is in italics and the KNOX 1 and 2 domains are in bold.

MEEYGQMNENSSTGSRGNNSFLYASPVLGPSSSGNSNYGRGNSSGGHFYSQSGDHC
FQSEAPPHPVVKTEATTSHHGHAQKFHHYSLVRDHHDPSASHHHHHQHHQHQQLQ
TASESSREV**DAMKAKIIAHPQYSNLLEAYMDCQKVGAPPEVVAKLSVARQEFES
RQRSSVASADGSKDPELDQFMEAYYDMLVKYRDELTRPLQEAMDFMRRIETQL
NLLSNNGPVRVFNSGVGSSEEDQDNSGGETELPEIDPRAEDR**<u>*ELKNHLLRKYSGYLSSL
KQELSK*KKKKGKLPKEARQKLLSWWELHYKWPYPSETEKVALAESTGLDQKQINN
WFINQRKRHWKPSEDMQFMVMDGLHPQGAALYMDGHYIGDGPYRLGP</u>

Figure 654: Amino Acid sequence of SEQ ID NO: 1072. The conserved homeobox domain is underlined, the ELK domain is in italics and the KNOX 1 and 2 domains are in bold.

MEGGSNSTNSPSCLMAFGENGHHSGGGDGLCPMMMTMMPINTITSSSHPHPHPHHQ
HHHHHHHHHQNLNTSTHQYFLDQTARNSSSGSSPILDDRNNNSNNNAGGSGSGSGS
**GCFFMDNDVKAKIMAHPHYHRLLSAYVNCQKVGAPPGVVAKLEEACASAAIMA
GNSGMSNTGCIGEDPALDQFMEAYCEMLTKYEQELSKPFKEAMLFLQRIECQF
KALTLGVPSDSVALSEAFDRNGSSEEDDVNNFIDPQAEDR**<u>*ELKTQLLRKYSGYLGSLK
QEFM*KKRKKGKLPKEARQQLLDWWSRHYKWPYPSESQKLALAESTGLDQKQINN
WFINQRKRHWKPSEDMQFVVMDATHPHYYMDTCSAIPFPWTSLRPCFEVYG</u>

Figure 655: Amino Acid sequence of SEQ ID NO: 1074. The conserved homeobox domain is underlined and the lipid-binding START family domain is in bold.

MALAMHRECSSKQMDAS<u>KYVRYTPEQVEALERVYNECPKPSSLRRQQLIRECPILCN</u>
<u>IEPKQIKVWFQNRRCREKQRKEAYRLQTVNRKLNAMNKLLMEENDRLQKQVSQLV</u>
YENGYMRQQLHSASTATTDNSCESVVMSGQHQQQHNPTPQHPEKDASSPAGLLAIA
AETLTQFLAKATGTAVDWVQMIGMKPGPDSIGIVAVSRNCNGVAARVFGLVSL
EPMKVAEILKDRPSWFRDCRCLEVLNVIPAGNGGTIELVYMQTYAPTTLAAARD
FWTVRYTTTLEDGSLVICERSLTTSTGGPSGPSSSSFVRAEVLPSGYLIRPCEGGG
AIIHIVDHVDLDAWSVPEVLRPLYESSKILAQKMTVAALRHIRQIAQESSGEIQYG
GSRQPAVLRTFSQKLCRGFNDAVNGFVDDGWSVLSSDGVEDVTIAVNSSPNKFLGS
QYNATIFPNFGRGVLCAKASMLLQNVPPAVLVRFLREHRSEWADHGIDAYSAASLK
TSSYAIPCVRPGGFPSSHVILPLAHTVEQEEFLEVVRLEGHAFSPEDIPLAHDMYLLQL
CSGVDENAVGACAQLVFAPIDESFADDAPLLPSGFRVIQLDPKTVKHP

Figure 656: Amino Acid sequence of SEQ ID NO: 1075. The conserved homeobox domain is underlined and the POX domain is in bold.

MATYYTNSNQRDAAPALYLRESMHSSFPETPVLSGNMMLYMNPGPYADNPLGGNS
QQQSNGMEVPSVGGIDSVQQQQQQQQEILSNFGGSRSGDQDFSLWRDGRNEMLLMP
PLQSPHGQGLSLSLGTQIPSGIHMPSANLSSISFLGPIPMVSGDGGGRTGSERSRNADC
APAGFPGGDEDVNKGGDIPYGMSTIVRVIPNSRYLRVAQQLLDEIVNVRKALKRP
DDANDQSRHENQRSPKDADGGSKNEASSNPQESASNSSELSAAEKQDLQNKLTK
LLSMLDEVDKRYKQYYHQMQIVVQSFDTIAGSGAAKPYTALALQRISRHFRCL
HDAITGQIQATRKSLGEQDTSNSNGISRLRYVDQHLRQQRSMQHLGIMQQHA<u>WRPQ</u>
<u>RGLPENSVSILRAWLFEHFLHPYPKDSDKIMLARQTGLTRSQVSNWFINARVRLWKP</u>
<u>MVEEMYKEEIGDPEMDSNSSSET</u>AAKATGGDGRSSEDKGEDLQQSASSTATKRCGT
GNFMDLKPPVVNPEMEISGPTFNSGTHGEVDAEYGFKLRGGHIPGGNDGILFSDSIVQ
SDGGNNRFMAAATAAYNVSNFGQFGGGTGVSLTLGLQHCDGGTLPLSNSMDHGIAS
MRGDGFYNAAASSVGAETMEFEGSSPGEQQHRLASNQLFHDFVA

Figure 657: Amino Acid sequence of SEQ ID NO: 1076. The conserved homeobox domain is underlined with the homeobox domain signature in bold. The lipid-binding START family domain is in bold/italics.

MGVVDMSNNNPPTSRTKDFFASPALSLSLAGIFRDAGAAAAASASMDVEEGDEGSG
GGGGRREDTVEISSENSGPARSRSDDEFDPDGDNDEDGGDGDKSKKKK<u>RKKYHRHT
AEQIREMEALFKESPHPDEKQRQQLSKQLGLAPRQVKFWFQNRRTQLKA</u>IQERHE
NSLLKTEMEKLRDENKAMRDTIQKSCCPNCGSATTSRDTALTTQEQQLRIENARLKA
EVEKLRTALGKYTPGTASPSCSAGNDQENRSSLDFYTGIFGLDKSKIM***ELVNQAMEE
LKKMATAGEPLWIRSVETGREILNYDEYVKEFKVEAPSEGRPKRSIEASRETGVVFV
DLPRLVQSFMDVNQWKEMFPCMISKAATVDVVCSGEGPNRNGAVQLMFAELQMLT
PMVPTREVYFIRYCKQLSAEQWALVDVSIEKVEDNIDASLVKCRKRPSGCIIEDKSNG
HCKVIWVEHLECQKTTVHPMYRTIVNSGLAFGARHWMTTLQVQCER***LVFFMATNV
PTKDSNGVATLAGRKSILRLAQRLTQSFCQAIGASSYHSWTKVPTKTGEDIRVASRK
NLNDPGEPLGVILCAVSSVLLPVSPHLLFDFLRDESRRSEWDIMASGSPVQSIANLAK
GQDRGNAVNIQTMKNKDNSMWVLQDCCTNAYESMVVYAPVDITGMQAVMTGCD
SSNIAALPSGFSILPDGIESRPLVISSRHEEKSSEGGSLLTIAFQILTNTSPTAKLTVESVE
SVNTLISCTLRNIRTSLQCEDG

Figure 658: Amino Acid sequence of SEQ ID NO: 1079. The conserved homeobox domain is underlined and the lipid-binding START family domain is in bold.

MAMTMVPHRESSSGSINKHLTD<u>SGKYVRYTAEQVEALERVYSECPKPSSLRRQQLIR
ECPILSNIEPKQIKVWFQNRRCREKQRKEASRLQTVNRKLTAMNKLLMEENDRLQK</u>
QVSQLVCENGYMRQQLHTTSATTTDASCDSVVTTPQHSLRDANNPAGLLSIAEETL
**AEFLSKATGTAVDWVQMPGMKPGPDSVGIFAISQSCSGVAARACGLVSLEPTKI
VEILKDRTSWFRDCRSLEVFTMFPAGNGGTIELVYTQIYAPTTLAPARDLWTLR
YTTTLENGSLVVCERSLSGSGAGPNPASAAQFVRAEILPSGYLIRPCEGGGSIIHI
VDHLNLEAWSVPEVLRPLYESSKVVAQRITIAALRYIRQIAQETSGEVVYGLGRQP
AVLRTFSQRLSRGFNDAVNGFNDGGWSLMNGDGAEDVMIAVTFSKKLNTTSNPANP
LSFVGGILCAKASMLLQNVPPAVLVRFLREHRSEWADFNVDAYSAASLKASPFGYPG
MRPTRFTGSQIIMPLGHTIEHEEMLEVIRLEGHSLAQEDAFVSRDIHLLQICSGIDENA
VGVCSELIFAPIDEMFPDDAPLLPSGFRIIPLDSKSSDVQDSLTTNRTLDLTSSLEVGPA
STNCVGDVAPSHGARSVLTIAFQFPFDANTQDNVAVMARQYVRSVISSVQRVAMVIS
PSGLGPSINPKLSQGSPEALTLANWICQSYSLYLGTELLGSDLLGADSMLKTLWSHQD
AILCCSLKSIPVFIFANQAGLDMLETTLVALQDITLDKIFDESVRKELSPEFAKLMQEG
SAYLPSGICMSTMGRHVSYEQAIAWKVLSAEENTVHCLAFSFVNWSFV**

Figure 659: Amino Acid sequence of SEQ ID NO: 1080. The conserved heat shock factor (HSF)-type DNA-binding domain is underlined and the HSF-type DNA-binding domain signature is in bold. The type I antifreeze protein domain is in bold/italics.

MAQRSA<u>PAPFLTKTYQLVDDPATDDVISWGESGRTFVVWKTAEFAKDLLPSSFKHN</u>
<u>NFSSFVRQLNTYGFRKI</u>VPDKWEFANDRFQRGQKELLSEIRRRKSAATPPNPPASGA
AKSAAGAAGGQASPESSGEDMGSTSTSSPADSKNAGSVE*TAAVAAAAAATATATAAQ*
*FADLTGEN*EKLRRDNEALNSELAQAKKHCDELVAFLTECLKVAPDQIDRIVRRGCR
GAAAFAAAGDGADGVDRDDDDDDEKAAAEVDGEKSTKLFGVWLNGKGKEARKR
AREDKVGPVGMEFRQPLMKTSKVCN

Figure 660: Amino Acid sequence of SEQ ID NO: 1083. The conserved heat shock factor (HSF)-type DNA-binding domain is underlined and the HSF-type DNA-binding domain signature is in bold.

MAQLMVDKCGEGLLVAVEAQKAV<u>PAPFLTKTYQLVDDPSTDHIVSWGDDDSTFVV</u>
<u>WRPPEFARDLLPNYFKHNNFSSFVRQLNTYGFRKI</u>VPDRWEFANEFFRKGEKHLLC
EIHRRKTAQPQLTHHHPHSASPLSGPTPAFFPFPSRLSISPSDSDDQHSSHWCDSPPPPP
PPPLSSPRSGCGGHNNSVGPVASAANYNSSAVTALSEDNERLRRSNNMLMSELAHM
KKLYNDIIYFVQNHVKPVAPSTYSWSPPSMVQKPSNQLLGYNNYANAIAAPNNNSC
VVTNHVKPVVRSNSNVTQSSLTILEDPPVMNKMKLFGVPLLSKKRLHPEYNSSPVGY
METNKARLVLEKDDLGLNLMPPSTC

Figure 661: Amino Acid sequence of SEQ ID NO: 1084. The conserved heat shock factor (HSF)-type DNA-binding family domain is underlined and the HSF-type DNA-binding domain signature is in bold.

MEMKGGVVPKEEEASSDVGQPPPPPPPPPQPMEGLGEAGP<u>PPPFLTKTFEIVEDPATDPI</u>
<u>VSWSEGRNSFIVWDAHQFAATLLPKHFKHGNFSSFIRQLNTYGFRKV</u>DPDRWEFA
<u>NEGFLGGQRHLLKTIKRRRNVLHSPRQPGGACVELGHYGLDSELERLRRDRGLLVAE</u>
<u>VARLRQQQEQSRDHIFAMEQRIQRTERKQQQMLAFLAKACNNPSFIRQLMQRNARG</u>
RDIRGVEIGHKRRLTATPSLENLQDEDTVAALGRGGAGDSAIPMQEEMVTLESEMQT
MFSAALDDESSSDVNELSAAPVLATRGGNTDAVNQTILEELLSEDLMTGNPEEEILV
GDRPEIDMEAEDLVPGRRNASEESQDLSQLEAVTPSSSLRQDKFMEEW

Figure 662: Amino Acid sequence of SEQ ID NO: 1085. The conserved heat shock factor (HSF)-type DNA-binding family domain is underlined.

MVKPSGGGGDRAPPL<u>APFLSKCYEMVEDEATDPIIAWGSAGDTFVIWDITQFTLQLL
PHYFKHSNFSSFMRQLNIYGFRKVDSDRWEFANDGFIKDQKHMLKNIRRRKNVQVV
DQKKSLQKQDNSVEEVDKIKIDGLWKEVENLKIDKTVLSLELGKVRQLQETSDNKL
VLLRDRVQGMENNQQQMLSFL</u>VMAMQNPGFLVQLVKLKDNHCRVTEMGNMLEPQ
GAENGSWISEGTIVKYQPPTDGKTNPELSPLSGLGETPKSGPSFDGTRDVLMNNDLM
SMLMNEKFSLDTPLIFPDSPDDNAWEKLLLACPFIESASEKRQDNEGPNYLGMETEPA
FSGASSVSTDFEALMRMMGNPQEAETESDVDGDDWEDAPNVDFLAEQLEYLASKA

Figure 663: Amino Acid sequence of SEQ ID NO: 1097. The conserved MADS-box SEQ ID NO: 3668) transcription factor family domain is underlined and the K-box transcription factor family domain is in bold.

MARGKVQM<u>KRIENPVHRQVTFCKRRAGLLKKAKELSVLCDADIGLFIFSPHGKLYEL
A</u>TKGTMKGLIERYMKTTQSQAALTEEATPSQPLDAKEEINILKQEIEALRKGLGY
**MFGGGAGNMTLDELDVLEKQLETWIYHTRSTKMDIMFQEIQLLRNKEGILKAA
NQYLQEKIEENTAITNTAPMTTNYTYPLTIQNELFQDLLLV**

Figure 664: Amino Acid sequence of SEQ ID NO: 3649. The conserved Transcrition factor, MADS-box SEQ ID NO: 3668) domain identified using InterProScan is underlined.
MEFPSEFSEASSQKRIGG<u>RGKIEIKRIENTTNRQVTFCKRRNGLLKKAYELSVLCDAE
VALIVFSSRGRLYEY</u>ANNSVRGTIERYKKASSDSSHPQSVSEVNTQFYQQEASKLRRQ
IREIQVSNRHILGEGISDLSFKDLKNLESKLEKSISRVRSKKNEMLFAEIEYMQKREIEL
QNDNMYLRAKIAENEGAQQQQQQGSDHHFNMPGSSSVYEALPSQPAYDRNFLQVN
VLEPNHQSYSRSDHTALQLV Figure 665: Amino Acid sequence of SEQ ID NO: 1123. The conserved MADS box domain is underlined and MADS box SEQ ID NO: 3668) domain signature is in bold. The conserved K box is in bold/italics.

MGRGRVQL<u>KRIENKINRQVTFSKRRNGLLKKAYELSLLCDAEVALIIFSSRGKLY
EYCS</u>SSSMMKTLERYQKCS*YGAQLNPSRSIDETQSSYQEYLRLKARAEVLQQSQRNL
LGEDLGSLDSKELEHLESQLESSLKNIRSTKTQSMLDQLFNLQNRVLLETNKILSRKL
EE*VSPQIPFQLAWEVGGQGGGGGNGGGGGGGIPFSLFPPQSEGFFNPMDGNLSLQI
GYNPTCLDEMNASVSSQNVAGFIPGWML

Figure 666: Amino Acid sequence of SEQ ID NO: 1125. The conserved MADS box SEQ ID NO: 3671) family domain is underlined.

MGRRKIEIQPITHERNRSVTFLKRKNGLFKKAYELGVLCSVDVAVIIFEDRPGHSPKL
YQYSSRGIQDIVQRHLHHDGETDNRGPGDFSGAGGGKLDEVDEDDEEEEVPVRTKR
KKDVGKLKPPSDMNITNDREYPRNPAPMNSSHSAGNNWRTLPASAQMPPPQPPQPSS
HKRPRAELDDDGYGGYTHSTRPGGPPQPHHGYHQGHQYTPMFGTQHHHTPPPPPSFI
PLHESDFPPQHDFHPAHRLMGGSHRHHDNEYPGGSGGASGGGAGRGEIFPFVEGDA
RSHQQPSGRGPGLALDWPVHSPAPPAAVQHGHRNGPQQQNQNGNPSWFDFLSNTAS
TPNTALSWERGGGGSGGAGGGSNRGLNDRGNDIAAVLGVGGNTSEERYLRTMALP
VGDAGGSRTPSLPPGDDHDGPKSRQMESIGRGSGTPNPGPGTNGSPSVSGTPTIAPKA
LREGEDSEEDQGNGKKMDVS

Figure 667: Amino Acid sequence of SEQ ID NO: 1135. The conserved Myb DNA-binding domain is underlined and the Histone H1/H5 domain is in bold.

MGNPKQKWTQEEEEALRAGVAKHGTGKWKDIQRDPEFNKFLFSRSNIDLKDKWRN
MIGGASGQGQRDKSRAKAKASSDAPSTLPSLPNAPNVPVSDEATAEPATDGAQRIAD
DGKNTPRYNAMIFEALQTLKDPNGSDTAAIFNYIEKRQEVPQNFRRLLSSRLRRL
VAQEKLEKVQNCFKIKEIASFETKTPAPKEQDVRPKQLQPVVNANFLETVDEAAVA
AAYKIADAENKSFDAAESVKEAERISKMAEDADAMLQMALGILEKCSRDEMVLVA

Figure 668: Amino Acid sequence of SEQ ID NO: 1139. The conserved Myb DNA-binding domains are underlined.

MTVDETTSDCSWSREQDKAFENALATYPEDSADRWEKIAADVPGKTVEEIKSHYEIL
VDDVNSIESGCVELPPYSCSPEGSTSHGGDEMNSKKGSHVGNLHGNLNHEGKASRSD
QERRKGIAWTEEEHRLFLLGLEKYGKGDWRSISRNFVVTRTPTQVASHAQKYFIRLN
SMNKDRRRSSIHDITSVDNGEVSTPQGPITGQTSSSVAGVSSSKPSKQPFQPPTGPASIG
VYGAPMIGQPIGGPLVSAVGTPVNLPGPSHMAYGVAPVPGAMVPGAPMSVGHVTYP
MPHASAQR

Figure 669: Amino Acid sequence of SEQ ID NO: 1141. The conserved Myb DNA-binding domains are underlined.

MRNPSSSSGGTKTPCCSKVGLKRGPWTPEEDELLAGYINREGEGRWRTLPKRAGLLR
CGKSCRLRWMNYLRPSVKRGQIAPDEEDLILRLHRLLGNRWSLIAGRIPGRTDNEIKN
YWNTHLSKKLISQGIDPRTHKPLNPETQNSSSNPPAKPPPSKAAPRPRSPNPSPISSGLE
ETSSGSPAILKENDQIQSADNTEAVYQNGTATAHGGEASYLPGTQHYHVMGLRSSH
GLSNEEEEDLNCCGDDVFSSFLNSLINEEAFPIQHQLQQQAVGSSPDSDSLIPMAAAP
AFGIAAGWDS

Figure 670: Amino Acid sequence of SEQ ID NO: 1143. The conserved Myb DNA-binding domains are underlined and The Myb DNA-binding domain repeat signature 2 is in bold.

MGRSPCCSKEGMNRGAWTVMEDKILTSYIKAHGEGKWRNLPKRAGLKRCGKSCRL
RWLNYLRPDIKRGNISLDEEELIIRLHKLLGNRWSLIAGRLPGRTDNEIKNYWNTTLG
KKLAKTDRSSSSPPSLKDINHPSSKSRSKRPVSKSSCLFPTKATRPRVTRYKPLEGTKV
HASPGSSLPSKNQSLYSITQEYPPYLQANYRPSGSTCQQGLDSESPRSHRVHCGAHDD
RLQKNFVGDFGLINFGYGDEFNAANVMCADQPLTVEQEMLENWTASFCVEEKDTL
DLDSLAYLLNSEEWP

Figure 671: Amino Acid sequence of SEQ ID NO: 1149. The conserved Myb DNA-binding domains are underlined.

MLLASREMNRGIEILSPYLQNSNWLFQESKGTKWTPEENKRFENLLAVYDKDTPDR
WAKVAASIPGKTVGDVMKQYRELEEDVSDIEAGLIPIPGYGGNSFTLEWINSNNGSD
GLKQLYSTVGKRGTSTKPSDQERKKGVPWTEEEHRQFLMGLKKYGKGDWRNISRY
FVTSRTPTQVASHAQKYFIRQGTGGKDKRRSSIHDITTVHLPDSDPPSPVKRQSASPD
NSSTITKLPVQAQPHDHHPKIEEMSTDILCWNNQSNGGLATAYDQVGVDAALGPFR
GISSYGNKLHEQRFLMSGLHGAQFDPYFQMQPMHYQ

Figure 672: Amino Acid sequence of SEQ ID NO: 1152. The conserved Myb DNA-binding domains are underlined and the Myb DNA-binding domain repeat signature 2 is in bold.

MRKPSETMGMAMGIKEKASSNPHNHKLRKGLWSPEEDEKLMRYMLTNGQGCWSDI
ARNAGLQRCGKSCRLRWINYLRPDLKRGAFSPQEEELIVHLHNILGNRWSQIAARLP
GRTDNEIKNFWNSTLKKRLKMNSATSSSNESDLSNPQDIAAGIMPSFHAQYDVLAT
CMDSSPAPFPPMDNISAPNQFDPFPTLNNRCDTWEGVGFFTFPSGIAPVSMGDDSSYL
NLEHAKVGLLGSEFSVPPLASSTTTTEENNYRSIGCGMDGKGENSFSNNNDSCFSNTT
TASFKAEDDMSGFGNNLQAANLRIGEWDLEGLMDDLPSFPFLDF

Figure 673: Amino Acid sequence of SEQ ID NO: 1157. The conserved Myb DNA-binding domains are underlined and two Myb DNA-binding domain repeat signatures 2 are in bold.

MIIHIFHFLYILLITKPGIYFDLASDVEEFPFGHAIMDSSGRANSGSGDDGKSAAACPR
GHWRPAEDEKLRQLVEQYGAQNWNSIAEKLQGRSGKSCRLRWFNQLDPRINRRP
FTEEEEERLLAAHRVHGNKWALIARLFPGRTDNAVKNHWHVIMARKQREQSKLC
GKRIHQEYSLGDPTGLQGRKTHFQDELLGSQFRFDQGKGFFIFQSPSKERNFALPSSSS
ASWTFGSQSLAKSAHNSSSVDDLNRIERRDYYNRASNNYSGREGARSLSQPFHSHPY
SSLSSAYSISQYQRVVPSPFGYVCLGDGCNDSNTMKKQEIVSFHDEMPRLEKTRLHV
NSTHQEQADKSLKHKDVPFIDFLGVGISS

Figure 674: Amino Acid sequence of SEQ ID NO: 1166. The conserved Myb DNA-binding domains are underlined.

MGRAPCCEKMGLKKGPWTPDEDRILINYVQHHGHGNWRRLPKLAGLLRCGKSCRL
RWTNYLRPDIKRGNFSREEEDTIIQLHEMLGNRWSAIAARLPGRTDNEIKNVWHTHL
KKRLRKEHEAAVLDNVPSKRLVTMSHTNNEPHAKYESHGGPISSPQTQQSSSSVSLSS
TTTEDNSGNDNKCIKEALEDAISGLIDENFWSELVSSDDNNSAMSDDFLAVSSEFQSS
LSSNVGPWDMNGGGMVDCFWYDLLKGAELADV

Figure 675: Amino Acid sequence of SEQ ID NO: 1169. The conserved Myb DNA-binding domain is underlined and the Histone H1/H5 domain is in bold.

MGAPKQKWTAEEEAALKAGVIKHGAGKWRTILTDLEFKEILKMRSNVDLKDKWRN
INVTAIWGSRQKARLALKKNLLTPKHDSNTLALASARNDEEILDATPLAVSSETINNA
NPKERMKSRLDNLIIEALTNLKDPSGSDRAAIAAYIEDQYLAPPNLKKLLSAKLK
LMIANGKLIKVKHRYRIAQNPKTMEARRGSSRSIVEGRPKDSFKGDKREVKIYTKT
QIDAELLKMKSMTAQEAAAAAAKAVAEAEAAMAEAEEAAREAEAAEAEAEAAQIF
AQAAINALKCGTLHA

Figure 676: Amino Acid sequence of SEQ ID NO: 1170. The conserved Myb DNA-binding domains are underlined and the Myb DNA-binding domain repeat signature 2 is in bold.

MGRSPCCERKDLKKGPWTPEEDQILIDYISKNGHGSWRVLPKLAGLLRCGKSCRLR
WTNYLRPDIKRGSFSLQEEKLVIQLHGILGNRWAAIAAQLPGRTDNEIKNLWNTHL
KKRLLSTGLNPLTQDPFSPQGSMTKLPASSITRHMAQWESARLEAEARLSRETLLLNT
LPLQQKTDGDYFLRVWNSEVGESFRSINRRSKSASLSAVSQASSCAECETSSVATIEIG
TTYLGADADSTPNDHDNDADGKSSGAEYEALATSEYSGSSEFDSSTVTALEMLFDFP
IDNDMSFLEGSA

Figure 677: Amino Acid sequence of SEQ ID NO: 1173. The conserved Myb DNA-binding domains are underlined and the Myb DNA-binding domain repeat signature 2 is in bold.

MGRTPCCDKKDLKKGPWTPEEDEILVEYIRQNGHGSWRSLPKLAGLLRCGKSCRLR
WTNYLRPDIKRGPFTPEEEKLVIQLHGILGNRWAAIAAQLPGRTDNEIKNLWNTHL
KKRLLCMGLDPQTHEPFLTRGPMTNSPASTVTRHMAQWESARLEAEARLSRESNLF
NPLPLQKADADHFLRLWNSEVGESFRKINMEMGRSPVSPASSCAKCESNSAISAEMG
PSLGGSAAVTNDGDEDKECETYKSYFQQMAAGTESSGSSALEDSSDTALQLLLDFPI
NNDISFLGGDIDQYASSSGLV

Figure 678: Amino Acid sequence of SEQ ID NO: 3650. The conserved No apical meristem (NAM) protein domain identified using InterProScan is underlined.

MASSVQAAAVN<u>FPPGFRFRPSDEEIVGYYLKNKVHGNKFEFDVIREIDLYKCEPWDL
PEKSILPSRDLEWYFFCPRDRKYPNGSRSNRATEAGYWKATGKDRKVSSRSNNFKIG
TKKTLVFYKGRAPNGERTDWLMHEYRLEGTQCKGGTNLQDLYVLSRVFRKPRQGS
NDQETFQEPFPIINKTSSPTDGSDGDIEGQSEDASPGKPEDDAPASSRSETSSEILDNKIE</u>
DNCIDGPMECPEDISNPNCNSVSHRDTSTKENDDSQRRNQQLQNDPFYSPYEYEFPLI
FNNPYSDYSLGTQVNFSVMEPEAFERDFDFGSVSDQDNIDLASMLNSIECEDLYPLLP
IIEEEKNDEPCVAGLLTSMPDNGVQIQFRSRSQLSHSNQQPLPSQGTAMRRLRLQIYK
TEESANGRKENPLTVNGRSASSDCNSDDSDESEVITQSEDSPLASFPSQISCCSVEDDA
DSDTIHDSVESSEIVANGHDFNLEPTQFLPSSFFPVEAASEKSDMSVNSKESADKSVLI
ERTESVMSSACSQSSSTEIQIETTVSHTTSSQEIDSVSVKSSALGMESPTVLASKKALVS
EGASSFGSRQLGAISSNHNGVAETQGLGKFTGFNVILTGLNLRGKFREKYVRSDHVE
ESRNVAQNVSDLCSKDSSKGFSSLRKALGIFIQPFQLQSKMSKGANCIPLICLLSTVFL
VLCIWNTYLSARSSSPIIL

Figure 679: Amino Acid sequence of SEQ ID NO: 1186. The conserved Myb DNA-binding domains are underlined and the Myb DNA-binding domain repeat signature 2 is in bold.

MGRAPCCEKVGLK<u>RGRWTAEEDAILLNYIKANGEGHWRSLPKNAGLLRCGKSCRL
RWVNYLRTDLRRGNISTEEENVIIKLHASLGNRWSLIASHLPGRTDNEIKNYWNSH
LSRK</u>IDTFRRPSIDEALPMAMNLVKVSPPKRKGRTSRWAMKKNKNLLGPKKNPNKE
TSANFDMVSSPATQPVERERLSTTKASSEDRETKERESLATVNVASVPYSVGEGGTTS
PLSSNNLSNPLMLSPSGGREDGTILGPLEGIDEELSLSFNDIVDYAPLLDSSGIMDVSIE
TSGDHEEAAAVGSGLERKSEGGEWFSCVEDDCVNWDWENHVVQGHGHDQTAEER
DGQEMLAWLWETDGGEWGSQSFEEVDREKQNAMVAWLLS

Figure 680: Amino Acid sequence of SEQ ID NO: 1187. The conserved Myb DNA-binding domains are underlined and the Myb DNA-binding domain repeat signature 2 is in bold.

MGRSPCCDKVGL<u>KKGPWTPEEDQKLLAYIEENGHGSWRALPSKAGLQRCGKSCRLR
WTNYLRPDIKRGKFSLQEEQTIIQLHALLGNRWSAIATHLPKRTDNEIKNYWNTHL
KKR</u>LAKMGIDPVTHKPKNDALVSSDGQSKSAAKLSHLAQWESARLEAEARLARESK
LRSQSFQHHHSSSNSSQVYSAASALASTSAAPPGLVKKATAPLPPSSPQSLDTLKAWT
GSSWPSTKSGEGSGGAGGSANGIAGDLESPTSTLTFSEPMNVLCENPKQMIEFVGSSG
SSDSGMIKEEGEQEWKGLESSITLPEFKEGMGNNAVSFTSTFPEMTMSLEGPWTPESL
RASSVHGNVENNDMEEGFTSLLLNSSGDQSLSDGGGESDKRSDYYEDNKNYWNSIL
NLVNSSPSESPMF

Figure 681: Amino Acid sequence of SEQ ID NO: 1202. The conserved No apical meristem (NAM) domain is underlined.

MKKAQLALPAGFRFHPTDDELVTDYLIRKCASQPISAPIIAEIDLYKFDPWDLPEMAL
YGEKEWYFFSPRDRKYPNGSRPNRAAGTGYWKATGADKPIGRPKTLGIKKALVFYA
GKAPRGVKTNWIMHEYRLANVDRSAGKKKNSRLDDWVLCRIYNKKGTVEKHFPSA
LNKTAESPEMDTKPQIVMPAALNPYTPPQMTVDHMYMDSSESMPRLHTESSCCSEQ
VVSPNLSSCEKEVQSEAKWEDWENNLDFMDDFLDDPFPQGQLQSDQFSTLQDMSAY
LQKPF

Figure 682: Amino Acid sequence of SEQ ID NO: 1207. The conserved No apical meristem (NAM) family domain is underlined.

MEQRDSSDTRLHDKKKNKDDEEEVVLPGFRFYPTDEELVGFYLRRKVEKKPLKIEFI
KQVDIYKYDPWDLHDVSKMGEKEGYFFCIRGRKYKNSIRPNRVTGSGFWKATGIDK
PIYSGKYPHNCVGLKKTLVYYRGSAGRGTKTDWMMHEFRLPPVEKGGDLSDANDT
VTEEAEVWTLCRIFKRISSSRKYIATTECKETTFKQSSINSCSKSSSFESEYGDQCLSFG
SDHSAVQPSDQKPATRHVEQAQLSWVNHCHSIPQAPVATPCLSLWNLNGDDIFANGI
NWDELRSIVHEE

Figure 683: Amino Acid sequence of SEQ ID NO: 1208. The conserved No apical meristem (NAM) family domain is underlined.

MTVDMELPPGFRFHPTDEELVMHYLVRRCTSQPIAVPIIAELDLYKHDPWDLPGLAL
YGEKEWFFFSPRDRKYPNGSRPNRAAGSGYWKATGADKPIGSPKPVGIKKALVFYA
GKAPRGDKTNWIMHEYRLADVDRSIRKKNSLRLDDWVLCRIYNKKGAIEKKQPHV
QPQPPPVPAPAPAPVAIQSLGPAAASSFTEYEDEKPPVLTMPALPPPPPPVLNDLVHFD
TSDSVPRLHTDSSCSEHVVTPELACEVQSEPRWKNEWESMLDFGGGCSYGYFTGGA
AAGQMSPLQDMFMYLQKPF

Figure 684: Amino Acid sequence of SEQ ID NO: 1212. The conserved No apical meristem (NAM) family domain is underlined.

MKNCLQPNLPPGFRFHPTDEELILHYLRKKMTSTPLPVSIIAEVDLYKFDPWELPGKA
TFGETEWYFFSPRDRKYPNGARPNRSAASGYWKATGTDKIILDSSTGKNLGVKKAL
VFYQGKPPKGIKSQWIMHEYRLANSPVPIYSDKAIKLKELSMRLDEWVLCRIYKRSS
AAYSITPMATASDDPEEEQRLTREDINNDNSTVDAIRPMMMMNGSSSFSNLFDAVDF
SMLRNFLSDDYNGQCSNANDVRDVLVSTQSANQASLDQKMFQSLPQLTSYSAASQN
PLKRKYSWNEDSDAANLVKRNLMSQTFLDQHVLLSPHLHHQFQGF

Figure 685: Amino Acid sequence of SEQ ID NO: 1214. The conserved No apical meristem (NAM) family domain is underlined.

MEDEIVELPPGFRFHPTDEEIITHYLTKKVLNPNFNSCAIGEADLNKSEPWDLPKKAH
MGEKERYFFNQKDRKYPTGMRTNRATESGYWKATGKDKEIFRGKSNLVGMKKTLV
FYKGRAPKGEKTNWVMHEYRLEGKFSYYNLPKVSKDEWVVSRIFHKSTGIKKNESG
LIPGLFPIDPSGDDELPNPSPSPSLPPLMDDSYFARPISSFPKSENDFPGMTSASAPRSAE
GNYGDEMNGFHRFNPSNTNYQTDPSSSAFSSMFSGQLSFPISPYDGIDNPDFFLGFGY
GGSDNTQAIIRGMAASQHETRGLEQTLIKGEQFAMSNNKSMVSHSQDTGLSTDANA
ETSSSAISKHEAGNFSDFLWE

Figure 686: Amino Acid sequence of SEQ ID NO: 1216. The conserved No apical meristem (NAM) family domain is underlined.

MDGVCSDGRDGRIVSMADAASMYPGFKFSPSDAELISHYLTKKLEGIDKSVEQLIPE
VDFSAHEPWDLPAKSIVPSESEWFFFSVRGRKYPKGSQSKRATEHGYWKATGKERN
VKSSSAVIGTKRTLVFHLGRAPKGKRTEWIMHEYSMNAKSQNQQDSLVICRLRRSSQ
FQMGGASDLTQTSDVDRTDVSEGDNLAEGCARNCSGSYNSHSVEQIESSSNSSHQKN
SDGNEDFYADILKDDIVKLDESSVSPTRDSLPTVPNNLEAELMSQDSQTLVQDFISPIP
PFQGTANRRIRLRRHKPERSSKIVLEMKANDSSAEKAEPQTGSSGPSERRTRVIISRWL
VYGILIGLTLLFVYLLGGFQLSIESR

Figure 687: Amino Acid sequence of SEQ ID NO: 1225. The conserved No apical meristem (NAM) family domain is underlined.

MAVLPLNSLPLGFRFRPTDQELIDHYLRLKINGRDREVRVIREVDVCKVEPWDLPDLS
AIESRDPEWFFFCPRDRKYPNGHRLNRATPAGYWKATGKDRKIKLGRNLIGMKKTL
VFYTGRAPKGKRTYWVMHEYRTTLEELDGTHPGQGAFVLCRLFRKQDETLECPTRD
DAEVVVVSPTANSLPDDTESELVIAQDGPSVIAQDGPSSATQDKLPHEDCDLERRQC
VLPKNEVNLPQESDLNLLGDAMTHPPLPLPMKEELETSFMHEVVNAISNHETGVQLQ
NDKNEDDISDFFNSIFNVDYEGPCDESGQCNLDFGSEIGKNGPIVEDSLLQNDLLQEA
TERQSGCQLEWNGAKDYEIDTLQMGMARGNFQMGFPDSNFHQDSSAAASLFGISDA
SQSDVRPNSIHLQDLGTSSTDLQSGNPFGTGIRIRSRSSQILQPQFDHGAQGSAPRRLRI
QCKLQIGPLSCSRKPNDFISCDEVKKFKSINAEVRSS

Figure 688: Amino Acid sequence of SEQ ID NO: 1237. The conserved TCP family transcription factor family domain is underlined.

MGMKSTEGEIVQVQGGHIVRSTGRKDRHSKVYTAKGPRDRRVRLSAHTAIQFYDVQ
DRLGYDRPSKAVDWLIKKAKAAIDKLAELPPWQPNSSSVPSTSTAPDSAAHNGNSAE
MAVAEESESPKYNFQLHRQISANSRNATSQFLPPQLENDQSMLETMKSFFPTSSAASS
INFSSYPSEIMSRSTQQNQDLGLSLHSLQSQSALIHQSDPQENEMSQTLFSTSAPMVYE
PGFQRMMGWGTDPSGTDNRSGGRFLFNSPTPLTLPLPLLSQGSAAFPQRGTLQSSFAP
TFRSLDEFSVDSADHHKSQVIHHPSSLFGNRFVSDGLPGFCISPQIQNNGAPHDVVSA
RPSSSASLSNGR

Figure 689: Amino Acid sequence of SEQ ID NO: 1238. The conserved TCP family transcription factor domain is underlined.

MEGGDHDHFHHHYHHHHRRPTFPFQLLEKKEDEQPCSTSNYPSLAMSSDDAPPNPN
RSSSTSNTLQIVPAEDQQQQQTLAAAGADAGAA<u>GAKKPPPKRTSTKDRHTKVDGRG
RRIRMPALCAARVFQLTRELGHKSDGETIEWLLQQAEPAVIAATGTGTIPANFTSLNIS
LRSSGSSMSVPSQLRSSYFSPNFSLPPQRRGNPALFPGIGLSPESTTTLLNFQGSSSNLS
SMLFQAKQELREASNLELSEGADHEGMSKKRRPDQLDLSANSQPQSHAGSYLLQSSS</u>
GVLPASHGNLPANFWMVTNPSNQVMSGDPVWTFPASVSNSAALYRGTMSSGLHFM
NFPAPVALLPGQHLGSAAAAAGAGGGSEGQFNMLGGLSPYRPMSSSGVSESQASGS
HSHHGGGGGGGGGGDDRQPPFSDPGGD

Figure 690: Amino Acid sequence of SEQ ID NO: 1239. The conserved Myb DNA-binding domain is underlined.

MYLSEKPRPIDFYKEESAPRDMIIEVVSSNGDIPPHHPHPHPHPHPHQHQHPHPHQHP
HQHQAPPAPPPPPPPQPHHQMILGESSGEDLEVKAPK<u>KRAETWVQDETRCLIALRRE
MDSLFNTSKSNKHLWEQISSKMREKGFDRSPTMCTDKWRNLLKEYKKAKYQDRGS</u>
AKMSYYKEIEEILRERSKNNQYKSPTASALKVDPYMQFSDKGIEDAGMTFGPVEASG
RPTLNLERRLDHDGHPLAITTAEAVAANGVPPWNWRETPGNGESQSYGGRVISVKW
GDYTRRVGIDGTADSIKEAIKSAFRLRTKRAFWLEDEDQVIRSLDRDMPLGNYNLQL
DEGLAIKVCLYDESGHISVHPEDKIFYTEDDYRDFLARRGWTCLRELDGYRNIDNMD
DLRPGGIYRGVT

Figure 691: Amino Acid sequence of SEQ ID NO: 1243. The conserved Tubby domain is underlined.

MSLKNFVRELRREMKDGIGNVSRRGSEGRRWCSRTRSHIAPDHAAPPSMSVEQGRW
ANLPPELLLDIIQRVEESETLWPSRAVVVACASVCKSWREITKEIVKTPEQCGKLTFPI
SLK<u>QPGPRECPIQCFIKRDRATSTYLLYFGLVPSEDEKDKMLLAARKIRRATCTDFVIS
LVADDFSRASSTYVGKLRSNFLGTKFTIYDTQPPCEAAIQSNSRLNRRFNSKQVSPRV
SACNYSVGTVSYELNVLRTRGPRRMHCEMDSIPISCLQEGGSVPTPSLFTHSFDEPSSL
SPASKGKDKVTEFSSTSLLDIPVPVPGAGDPLVLKNKAPRWHEQLQCWCLNFRGRVT
VASVKNFQLVAAVDPSHKISAAEQEKVILQFGKIGKDIFTMDYRYPLSALQAFAICLS
SFDTKPACE</u>

Figure 692: Amino Acid sequence of SEQ ID NO: 1244. The conserved cyclin-like F-box family domain is underlined and the tubby family domain is in bold.

MHIKSIVHELREIRDRIKDIAGRKLERRHVHRQGRSHIVPETTVPTPSRPEAVQ<u>QGPW
ANLPPELLLHIIKRVEASQISWPSRRDIVACASICRSWREVTKEAVKTAEQCGRLTFPI
SLKQRGPRDFPIQCFIRRDTANSTFFLYLGLSPDLSEGTSKLLLAARKIRRALSTD</u>
**FVISFIADDFSQAGTSYVGKLRSRSNFIGTKFTVYDSQPPWDAAIQSNHKSYGRQNP
KQVPPSVPSGKFSVATISYELNVLRSKGPRRMHCNIRSNPTSAIQEGGTAPTPTEF
SRISVEPYLSPLPLPASNGKKQLNEHSSTSCKLLKSTHGAWDPLVLRNKTPRWH
EQLQCWCLNFRGRVTMASVKNFQLVAALEPYQNIPTTEHDNVILQFGKIGKDIF
TMDYLYPLSAFQAFAISLSSFGTKPACE**

Figure 693: Amino Acid sequence of SEQ ID NO: 1245. The conserved Tubby domain is underlined and the Tub family signature 2 is in bold. The cyclin-like F-box domain is in italics.

MSFRSIVRDVRDGFGSLSRRSFDVRLLGHNRGKSQGSVHELHDQPLLVQS*SRWASLPP ELLHDVIRRLEASESTWPARKHVVSCAAVCRSWREMCKEIVKSPELSG*KITFPVSLKQPGP RDGTIQCFIKRDKSNLTYHLFLCLSQALLVENGKFLLSAKRTRRTTCTEYVISMDADN ISRSSSTYIGKLRSNFLGTKFIIYDTQPPYNNAQLSPPGRSRRFYSKKVSPKVPTGSYNI AQVAYELNVLGTRGPRRMHCAMHSIPAAALEPGGTVPGQAELLPRSLEDSFRSISFSK SIDTSTEFSSSRFSDIIGPRDEEDDGKDRYLVLKNKAPRWHEQLQCWCLNFRGRVTV ASVKNFQLIAANQPSAGAPTPSQPAQSDHDKIILQFGKVGKDMFTMDYRYPLSAFQA FAICLSSFDTKLACE

Figure 694: Amino Acid sequence of SEQ ID NO: 1250. The conserved DNA-binding WRKY domain SEQ ID NO: 3670) is underlined.

MDRRFYTNPFVHDQEEDPEPEQGPDSPSSGEDSKVNASEPSQKRRKSVKKRVVSVPI AGDPEGSKSKGEAYPPSDSWAWRKYGQKPIKGSPYPRGYYRCSSSKGCPARKQVER SRLDPTTLLVTYSSDHNHAVPSSSSSKNHHHLRAAAVSDSSASASASASASASAADP DDCISAMFEPDELAGFIGGATLLDPGFDWLADVASTSSFLQRPVYEGGGAEAAPVHR MRDEEEGEDPLFADLGELPECSLVFRRTKLLEPEGESRRRGLSAVPCVGNVV

Figure 695: Amino Acid sequence of SEQ ID NO: 1253. The conserved WRKY family SEQ ID NO: 3670) domain is underlined.

MHGSFQSGSFMTEHDDNGSSPENSIGESPPWPSRYGDTMKTGPTATSPKRSRRGMQK RVVSIPIKDVEGSRLKGEGAPPPSDSWAWRKYGQKPIKGSPYPRGYYRCSSSKGCPA RKQVERSREDPTMLLITYSCEHNHPWPAAKNNHHHLNHQNSSAVTSAVEEKPKMLA NLPNPEAEPEPKPEPELEPDPEPEEKFPDMSDESVLMCATDEFSWFMDMPTTSSTILES PIFTESGNNSASKGAAIDADMAMFFPMREEDESLFADLGELPECSVVLRHGRSGGVS TQVQIC

Figure 696: Amino Acid sequence of SEQ ID NO: 1254. The conserved WRKY domain SEQ ID NO: 3670) is underlined.

MGSNWIVDTSLELNTSYPKKEIVLENDNSRRGRPEEPVIKHEAGALMEEYRRVSHEN RKLTEMLTLMHDSYNTLQNQLIVLENKTSDGELGASRKRKHEANIAAESCSYEEDRI CKKPKDIFKPMITKLHFQTDVSDMSLVVKDGYQWRKYGQKVTRDNPSPRAYYRCSF APTCPVKKKVQRSVHDPSVLVATYEGEHNHLSPSQPAIPLGSDKQGLNQGTRPIPSPS KSRSSSPRSTPDLIRLGCDTLSAKTGQEEEVTAAFQQFLVQQMASSLKTDPNFTAALA AAISGKLVDQARIGKW

Figure 697: Amino Acid sequence of SEQ ID NO: 1255. The conserved WRKY family domainSEQ ID NO: 3670) is underlined.

MDSSSWITSSLDLSIRPLQVSEEPPTKVVESDFMELGRTGSGNKDESGALHEELNRLA
AENKKLSQMLMTVCENYNALRNHVIEIVSKNAEREVSPSKKRKSESSTNDNGNEMV
VNRASESSSTDDDDLYKKPREETIKAKITRVYYRTEGPGTSL<u>IVKDGHQWRKYGQKI
TRDNPCPRAYFKCAHAPSCLVKKKVQRSAEDQSVIVATYEGEHNHPSSSLLEATCGS</u>
NARATLDSVPRSASLSSSGPTVTLDLMKPKQETDVKSSQPKVDSPELRQFLIEQMASS
LTKDPSFTTALAAAISGKMVGPYPTEKWI

Figure 698: Amino Acid sequence of SEQ ID NO: 1259. The conserved WRKY domain SEQ ID NO: 3670) is underlined.

MAIELHLGFSKMEDHTAIQEAASQGLKTMEHLIGVLSRQNLHHPGAVDCTDLTDRT
VSKFRKVISLLDRTGHARFRRAPLPSSSSSTSKSAPVASPVPPAVQSRSQPLAPTPIQAP
TSSQPSPASFLHAQPKQSLTLDFTRPSILGPNSKGVSEIEFAKDSFSVSSNSSFMSSAITG
DGSVSNGKLGTSMFIAPASGPASSAGKPPISSVPYKKRCHEHDPSDNISGKHSGSGSG
KCHCSKRRKNRVKKVTRVPAISNKIADI<u>PADEFSWRKYGQKPIKGSPFPRGYYKCST
MRGCPARKHVERAPDDPTMLIVTYEGEHRHSQ</u>PASQEIVPAGAMNLVFKST

Figure 699: Amino Acid sequence of SEQ ID NO: 1263. The conserved DNA-binding WRKY domain SEQ ID NO: 3670) is underlined.

MAIEESAPNETGPEGVKPENSPQNGGDTPQPDQKSNSKESPGCGVGLQGVQSKEPLA
SELTPESVKHGSQSGQEGSTPSISYEKS<u>SEDGYNWRKYGQKNVKGNEFVRSYYRCTH
PNCPVKKQVERSRSGRITDNIYLGEHNHAS</u>PQKHLPVAVSFAVSIVEEKPEKPSPISTQ
DKSSEVKREASHQVDDKKPPQLSVPTADVKPVVPAIVKVQDEIATDEDSPGSKRRK
KDSCNPDIPSGDKPTTEARVIVHTVSEVD<u>IVNDGYRWRKYGQKMVKGNPNPRSYYR
CSSAGCPAKKHVERASHDTKLVMTTYEGQHDHS</u>VPPSRTIMPNPGGFNGHATTQSG
DVNIKSPDGETVSHSVGENASSASGSKSTDQSNGKAEETSGTGDEVGDRTVLNNDLG
PEDRISEQKEDLSSTKSGDRDPVHLDSVVNVMENSHPPQQPSNAAAVQS

Figure 700: Amino Acid sequence of SEQ ID NO: 1264. The conserved WRKY domains SEQ ID NO: 3670) are underlined.

METKETDRVVIAKPVASRPTSSNFQSFSELLAGAINSSPPNACTESAVATIRPKTVRFK
PVPNRAPTAVNSSQAEVSGTATGNSNDKALKSDEKPTVIYKPLAKLVSRSTVSLLAN
MGSFNMAHHQTLSVAEARVKSQLQDKNNSRSQPIGNLHRSVSSQADMDGTSEPLRL
ASQNMEEDTRTSPALNMDRP<u>SYDGYNWRKYGQKQVKGSEYPRSYYKCTHPNCPVK
KKVERSFDGRIAEIVYKGEHSHPK</u>PQPPKRSLSGTQGLGNVLEGSGLDSTNNRLNER
DECSEDRVENKNLALTTYHGKGPLAYDPIANVASNAGGATPDNSCGISCEYDDGSKE
LEVEDDEPKNKRRKSDNQLNEPGISGEGIQEARAVQNSTDSE<u>IVGDGFRWRKYGQK
VVKGNPYPRSYYRCTSVKCNVRKHVERASEDPRAFITTYEGKHNHEM</u>PLRSTNTAG
SESDLQAASSKDKP

Figure 701: Amino Acid sequence of SEQ ID NO: 1265. The conserved WRKY domains SEQ ID NO: 3670) are underlined.

MAGKQPPPPLRPTISVPPRPPAAAMFGPCASPGPLTLVSSFFAESDGGSFSELLAGAM
YSPLAVNAAGPSSFLWDYPRENPSREGEPRDGQAGLPVGAVKSPLFTVPPGLSPSGLL
LSPGFFSPKSPFGMSHQQALAQVTAQAHVALARSHEHSQLEINPPSEASKEPLPDEPS
LMPNEDSHQLSPSEATTSMAESSDFVSSSHKWEALPMVLEKP<u>TEDGYNWRKYGQKQ
VKGCGFPRSYYKCSHLNCSVKKKVEHSLDGRITEITYRGQHQHEMPQAKRTSKDGN</u>
NLNRSTNSLAKSQAVLQGQSGRQSAPAMLRSGQDEESSQAIASNTSGLSNYVELDDA
KSKGDGSDVDNDDVDAGDDKSNPKQKIVPIPSSKYVTEPKIVLQTRSEVDL<u>LDDGFK
WRKYGQKVVKGSSYPRSYYKCTYAGCNVRKHIERAALDPKSVITTYEGKHNHTAPS</u>
AGKRGRTVEATEFGDAQRPSVLRLKEEQVAA

Figure 702: Amino Acid sequence of SEQ ID NO: 1266. The conserved WRKY domains SEQ ID NO: 3670) are underlined.

MGSPPAPDFEPHEFQFRSAADPSPGGPFSDSDAGPLAGGGGGGCGGGGGGARYKL
LSPAKLPISRSACITIPPGLSPTSFLESPVLLSNVKVEPSPTTGSLIKPHMMNGLIGSNSD
TRLANSGCPDNFDEGRSGIFEFKPLATSSMVPTEAKHQGSEQAVKVSGQRHSQPFAS
LSSVQSDLAVSSKELCLSVPTQAVRSGASPLAEADPDGLLGRKEQPNNVMQVTQLD
NKGNGPSVMTERL<u>SDDGYNWRKYGQKHVKGCEFPRSYYKCTYPNCEVKKLFERAP
DGHITEIIYKGTHDHPKPQPSRRFTGGATMPIQEERSDRFSFIPAVESTSTVYGETSYN</u>
VETDGTPELSPVAENDETIEGAASLSNRIQNEVDDGDDDPFLKRRRLDIGGEDVTPV
VKPIREPRVVVQTLSEVDI<u>LDDGYRWRKYGQKVVRGNPNPRSYYKCTNAGCPVRKH
VERASHDPKAVITTYEGKHNHD</u>VPTAKSSSHDTAAPSALSGLPRTRSEGETVSLDLG
VGRSAASEMASAEKQQILRPNPVQSRIHYASSALDAVQATPVTAYHGFLNGGINQFG
YRENLTEGHSKSTEFLQNMGRILTGP

Figure 703: Amino Acid sequence of SEQ ID NO: 1267. The conserved WRKY domains SEQ ID NO: 3670) are underlined.

MSGADDNVAVIGDWVPPSPSPRTFFTAMLGDDIGLRSGLEASGNNKTGGLFLGSQER
VTMGNFENKDTKRVGPSGGDHSSESRLAVEQKGYSRGCLGERLAARAGFNAPRLNT
EGIRSADLSSNPDVRSPYLTIPPGLSPTTLLDSPVFLSNTLAQPSPTTGKFPFIHNNNSRS
SGLMLDANTSKDNPFEENSSSSFAFKPLGEASSSFFGAGSKMNQATFPQQSYHRIEVS
VQSENSVQSRNVEATKLQSQNGSGFQFQGDFSRSSAENVAGHDGVPSDQRNFSTVT
GDPEHSPPLDEQQDDEGDQRISGDSLVGVNGGSP<u>SEDGYNWRKYGQKQVKGSEYPR
SYYKCTHPSCQVKKKVERSHEGHITEIIYKGAHNHPKPPPNRRSVIGGANPFGDMQL</u>
DNPEQMGLQNATDTDPAWANMQKTAGMGGSEWRQDNLEVTSSPSDGPEFSNAPTS
LQAQNGGNQLESGDQVDASSTFSNDECDDEQQTHGSVSLAYDGEEDESDSKRRKIE
AYATDMSGASRAIREPRVVVQTTSEVDI<u>LDDGYRWRKYGQKVVKGNPNPRSYYKC
TSPGCTVRKHVERASHDLKSVITTYEGKHNHD</u>VPAARNSSHVNSGASSAIPTQCTTS
AIQTQVHRPEPSQVHSMMGRYEGPGSLGSFSLPGRQQLGPGPGFSFAMNPPRLANFA
MAGMGPGQGNLPMLPVHPFLAQQHQVHEMGFMLPKGEPKAEPMSEPGPNLSNNSS
VYQHIMSRLPLGPQM

Figure 704: Amino Acid sequence of SEQ ID NO: 1973. The conserved PHD zinc finger-like domain SEQ ID NO: 3670) is underlined.

MEGGQYNPRTVEEVFRDFKGRRAGMIKALTTDVEEFYQQCDPEKENLCLYGFPNEL
WEVNLPAEEVPPELPEPALGINFARDGMQEKDWLSLVAVHSDAWLLSVAFYFGARF
GFDKTDRKRLFSMINDLPTIFEVVTGSAKKQSKEKSSVSNSSNKSKSSSKGGQRASES
VKYSKPVQAKDEEEVVDEEDEEEHGDTLCGACGENYAADEFWICCDMCEKWFHGK
CVKITPARAEHIKQYKCPSCSNKRARP

Figure 705: Amino Acid sequence of SEQ ID NO: 3651. The conserved PHD zinc finger-like domain is underlined.

MDGGGQYNPRTVEEVFRDFKGRRAGMIKALTTTQEKENLCLYGFPNEKWEVNLPA
EEVPPELPEPALGINFARDGMQEKDWLSLVAVHSDAWLLSVAFYFGARFGFNKADR
KNLFAMINDLPTIFEVVTGTVKKQTKEKISVSNHSSSKSKSGSKVRGSDSGKFTRTIQ
AKDEDDVVDGEDEEEHGDTLCGACGENYASDEFWICCDMCEKWFHGKCVKITPAR
AEHIKQYKCPSCSNKRVRT

Figure 706: Amino Acid sequence of SEQ ID NO: 1975. The conserved Pathogenesis-related transcriptional factor and ERF domain is underlined.

MRKMKARRKRKTRKRRRRTRSALALVREQKLKIRKMKRKRRRKKIKKKNSRVAEI
REPNKRSRIWLGSYTTPIAAARAYDTAVFYLRGPSARLNFPELVFQEDDELRDLSAAS
IRKKATEVGARVDAQASAAQPPAPEPNSSRVATEKPDLNEYPKAENSDGD

Figure 707: Amino Acid sequence of SEQ ID NO: 1976. The conserved Pathogenesis-related transcriptional factor and ERF domain is underlined.

MAAPGNFSDEEARLASHHPKKRAGRKKFRETRHPVYRGVRLRDSGKWVCEVREPR
KKSRIWLGTFPTVEMAARAHDVAALALRGRSACLNFADSAWRLPVPASADTKDIQK
AAAKAAEAFQPVESESEDVMSGDEKKSPSEEGMLYDDEDVFGMPGLLMNMAEGML
LPPPRCGGDGYGGEDDGNLDAYVSLWSYSM

Figure 708: Amino Acid sequence of SEQ ID NO: 1977. The conserved Pathogenesis-related transcriptional factor and ERF domain is underlined.

MAAPGNFSDEEARLASHHPKKRAGRKKFRETRHPVYRGVRLRDSGKWVCEVREPR
KKSRIWLGTFPTVEMAARAHDVAALALRGRSACLNFADSAWRLPVPASADTKDIQK
AAAKAAEAFQPVESESEDVMSGDEKKSPSEEGMLYDDEDVFGMPGLLMNMAEGML
LPPPRCGGDGYGGEDDGNLDAYVSLWSYSM

Figure 709: Amino Acid sequence of SEQ ID NO: 1978. The conserved Pathogenesis-related transcriptional factor and ERF domain is underlined.

MSPEIVERKRSRSRKEGSMSVAETLAKWKQYNDQLDPQANGDKPARRVPAKGSKK
GCMKGKGGPENT<u>TFNYRGVRQRTWGKWVAEIREPNRGSRLWLGTFPTAIEAAKAY
DEAATAMYGPCARLNFPTASHPM</u>YFGDLDARATTPVGTTANTTGTPSTGYSAGTPS
TGYSAGTPSEATTLSSQSELTGGPEVKDGDRKGESNADGGEMEPKSESIVDFDWLSD
YAVDDLFDVDELLRTLESDPKFSSDVKMEH

Figure 710: Amino Acid sequence of SEQ ID NO: 1979. The conserved Pathogenesis-related transcriptional factor and ERF domain is underlined.

MPETGPAATAADPIPTTQNFPDSAQR<u>EHRFRGVRRRPWGRFAAEIRDPWKKARIWLG
TFDSAEDAARAYDEAALSLRGPKAKTNFPLDPLTGL</u>PQAAPSPAALLPRPRPRPRPRG
RRRRGPPAEDFHVNRPTSSSLSSTVESYSGPRVSHPAPAVPRVVAVPRAPPEDCRSDC
DSSSSVIDDVDDCCVLAPSCFRRALQFDLNLPPPLEDADLDGEELRATALRL

Figure 711: Amino Acid sequence of SEQ ID NO: 1980. The conserved Pathogenesis-related transcriptional factor and ERF family domain is underlined.

MKMAERSNSSDPETSPSNSPSTSSSSSSYSPDPRRRAGSPAAARDPSRSSKRSK<u>HPVYR
GVRMRNWGKWVSEIREPRKKSRIWLGTFPTPEMAARAHDVAALHIKGSSAFLNFPH
LAASL</u>PRPSSLSPRDVQAAASLAAHMPDHQGTVETLRPTAELDSQHSSLPSRSLSSMV
SAMDISATVELSEIVELPSLGASCDELGGSEFAFVDSVGAEWGYCYHDDYQPTWPEH
LEDCGPYDCGHQTAALPESGGSLLWDYD

Figure 712: Amino Acid sequence of SEQ ID NO: 1981. The conserved Pathogenesis-related transcriptional factor and ERF family domain is underlined.

MNFSDKEVQLASDHPKKPAGRKKFRETR<u>HPVYRGVRLRDSGKWVCEVREPKKKSRI
WLGTFPTVEMAARAHDVAALALRGQSACLNFADSAWRL</u>PKPASTDAKDIQKAAAK
AAEAFQPVESEDIMSGDEKKLHSEEGVSYDEEDILGMPGLIADMAEGMLLSPPQCGE
DIYGGEDDGNLDAYASLWSHSI

Figure 713: Amino Acid sequence of SEQ ID NO: 1982. The conserved Pathogenesis-related transcriptional factor and ERF domain is underlined.

MLDLNLEMISSDSSCDNDKNQIDVQEREEEAATKLHEASGNYDMEEDSGTSNSTIVA
SAEEASGNAGEENSSNTTSSSSIFYIMKEKEKGSKGGFKAGDPPPSPQGLITRQLFPVA
GAGEHGHQAAELGLGLPARQQWLNLSFGEPTGAPTEFRILQPKQRKSRRGPRSR<u>SSQ
YRGVTFYRRTGRWESHIWDCGKQVYLGGFDTAYAAARAYDRAAIKFRGVDADINF
NISDYEEDMKQLQMVNLSKEEFVQILRRQSTGISRGSSKHRGMTLQKCGRWDARAG
PLLGNKASDNAANKCNGMEAVMNFQPGSYEGDTKPYPRAGGGGHNLDLSLGMSLP
SSSSMGAGTQRDMLFHCADHEMPNIVMVGCSSSAHKGGELPNIGMASRSPPIWSTLY
PALAPNYEGKAMEKRAEAIPALRFSSYRLPVHGNVNNANNGSQQAQLFTYAASSGF
SSSTATPHPPPQLPVSLQKNGVHNNTASRAYFSYRS

Figure 714: Amino Acid sequence of SEQ ID NO: 1983. The conserved Pathogenesis-related transcriptional factor and ERF family domain is underlined.

MAELDESSTLELITQYLLEDSINLAQLQPVKTENLFLDPGPDSPDSDHPTWQDLETPN
LEIKAEPITLESPESELGSPEKNQDEAGSAA<u>KASYRGVRRRPWGKYAAEIRDPTRKGS
RVWLGTYDTDVDAAKAYDCAAFKMRGRKAILNFPLEAGK</u>SAPPPNPGRKRRRVAV
KKEESKENLEDWPIEMLAQAERGEDEWTQC

Figure 715: Amino Acid sequence of SEQ ID NO: 1984. The conserved Pathogenesis-related transcriptional factor and ERF domains are underlined.

MEMKSVSENGGGASGGNWLGFSLSPHHLKMEVAPQAEYHQNHHHHHHQYHHQPQ
QGEPGSYFLSAPPPPPHYSSSGLCYGGGVGDNNNGGYLHSPLSVMPLKSDGSLCIME
ALTRSRPQGLGQGSTPKLEDFLGGASATVTATTMPLSLDSLYSYQQSADPEKQSLDL
LHEPFRHQQQHQIYYPNELTCPALYHSPLAEEEQKETHIASCDENGGFSCLKSWVTR
NFSSSSCHVGLDQMSSGMVCHNGGNSSEAVGPMECGDLQNLSLSMSPSSTSSCVTVP
TRQISPTENECVGMEMTKKRSSNCHNKQPVHRKSIDTFGQR<u>TSQYRGVTRHRWTGR
YEAHLWDNSCKKEGQTRKGRQVYLGGYDKEEKAARAYDLAALKYWGPSTHINFPL
ENYQKELEEMKNMSRQEYVAHLRRKSSGFSRGASMYRGVTRHHQHGRWQARIGR
VAGNKDLYLGTFSTQEEAAEAYDIAAIKFRGVNAVTNFDISRYD</u>VERIMASSTLLAG
ELARRTKEIAPNEEVAEYNALTQQKIGSDGTLQLESSGNVTNGSDWKMVLYHSSPQL
QASCMESSVNSSQPSVDDTAKLGTRHLSNPSSLVTSLSSSREASPDRAGSAFANKPPV
VSKLVNTSPTSASVTSWLPSPAHMRPSAIAMSHLPVFAAWNDT

Figure 716: Amino Acid sequence of SEQ ID NO: 1985. The conserved pathogenesis-related transcriptional factor and ERF family domain is underlined.

MATSSITEVSTRLQLIEQHLLGEFSPTDAAFPAHLAPAPSSYSIPFEPAVEPTRSESLSSV
SFSDFDCLPNEDLFEFDVSSFAFEQNQSESFGFEAKPQKLDLIPSVATSSSSSLSSETESF
LGFEAKPVIIGETASKTSQSSKKPSLKIAVPRKVELLQFSKANPMVQGGSNQARDEQR
<u>HYRGVRRRPWGKFAAEIRDPNRKGSRVWLGTFDTAIEAARAYDEAAFKLRGSKAIL
NFPLEAGK</u>PRSLVAPADGKKRPREEKEEENEVIVKKEKEAESDVSMWRDGPLTPSC
WKGTWDSDDTMGIFDVPLLPPLSPIPTLGFPQLMVK

Figure 717: Amino Acid sequence of SEQ ID NO: 1986. The conserved transcriptional factor B3 family domain is underlined.

MMMNRAEGRGGGGGDDLYTELWKACAGPLVDVPRHGDRVYYFPQGHMEQLEAS
TNQELNQRIPLFNLTPKILCQVVNVQLLAEQETDEVYAQITLIPAGNLMEPTSPDPVSA
ETPRTRVH<u>TFCKVLTASDTSTHGGFSVLRKHATECLPPLDMKQATPTQELVAKDLHG
YEWKFKHIFRGQPRRHLLTTGWSTFVTSKRLVAGDSFVFLRGDNGELRVGVKRVAR</u>
QQSSMPSSVISSQSMHLGVLATASHAVTTQTLFVVYYKPRTSQFIISLNKYLEALNNK
FTVGMRFKMRFEGEDSPERRFSGTIVGVEDFSPQWDNSSWRSLKVHWDEHASIPRPD
RVSPWEIEPFVASVPANIPQSTTKNKRPRPSSEVPADATAAPAIWNSGYTQTHDLKQR
RGTDEGKSSDHFMWNYKMADVNSSSSSITRVQTEGGWLPSPCLSVSPNVLPDAVDD
SKSVSALPVPCRHPIAHPSSLNNELMPNPAEDGKKVEPTSSCRLFGIDLINHTLSSPPSD
KGPFQSMCVSTATTEGHVQMALSTADSDQKCDIQKASEEVKQRQMQNLGKEGQTK
QICSTRSRTKVQMQGMAVGRAVDLTMLEGYGQLMNELEEMFDLKGQLQSRDKWEI
VFTDDEGDMMLMGDDPWPEFCNMVRRIFICSSQDVKKMSAKSKLPVSSVQEEGTVI
SSESADN

Figure 718: Amino Acid sequence of SEQ ID NO: 1987. The conserved transcriptional factor B3 family domain is underlined.

MITFIDSKEKLKEVEKTLDSQLWHACAGGMVQMPPVNSKVFYFPQGHAEHSSGPVD
FRSCPRIPAYIPCRVSAIRFMADPETDEVFAKMRLVPLTSSEPDFGDDGIGGLQGSDGQ
DKPA<u>SFAKTLTQSDANNGGGFSVPRYCAETIFPRLDYSVDPPVQTILAKDVHGETWK
FRHIYRGTPRRHLLTTGWSTFVNHKKLVAGDSIVFMRAENGDLCVGIRRAKRGIGSG</u>
PESSSGWNPVGGNCAVPYGGFSAFLTEDENKLITNGHGNCMSGNGSLMGKKRVTPE
AVVEAASLAANGHPFEVVYYPRASTPEFCVKSSLVKTAMQIRWCPGMRFKMAFETE
DSSRISWFMGTISSVHVADPTCWPDSPWRLLQVTWDEPDLLQNVKRVSPWLVELVS
SMPAIHLSPFSPPRKKLRLPHHPDFPLDGHFPMPSFSGDLLGPSSPFGCLPNSHSAAGM
QGARHAYYSQSLPDLHLSKQPSSLFPAGFPLLDHSIRSMRTSNGPRMHKSSSDDDIST
LLTMTNYGKVFKKLEEVKKPPQLVLFGKPILTEQQISLSNSATTTTTASPVRTSSEEK
IDKTGSFPDGPDSARQQSGQREQQSSCEQLRVHEDKHQQEMEACSEIGHCKVFIASE
DVGRTLDLSLLASYDELCRKLTDMFGVENSQSLARHVLYRDDKGAEKRIGDEPYSD
FIRTARRLTILTNSSSNGVGS

Figure 719: Amino Acid sequence of SEQ ID NO: 1988. The conserved transcriptional factor B3 family domain is underlined.

MSSCVESHDRSSSSCGNIGTGRGDNLHEQLWHACAGPLAYVPKAEETVFYFPQGHIE
QIEAYTNQDGDMEMPIYKLPSKILCKVVCVQLKAEIHTDEVFAQVTLIPEAKKDEVN
PNCKTSATPPRDNSR<u>FFVKILTQSDTSTHGGCSLPKRPADECLPSLDKSQHHPVQDLV
TKDLQGNLWCFRHIYRGKPERHLLTRGWSDFSTSKKLVTGDACIFLSGRDGDVRIGV
RRLMKSQ</u>TTTSSSILSGHSMRHGILASALHAVSTGTMFTVYYRPWACTSGFIIGYQQY
VKAMANDYSIGKRFRMQFEDELCGEQRLRGTVVGIEDLDQMRWPGSDWKCLKVQ
WDSSRVKCICPERVSPWDIESLDPDGKKQAVLPTSLKRTRPCSLQLDWPPTFVMDES
QWTSVAPKSQRQPVVFQGDGGKRESRGPGDHWPPASIAPGCNPVKSLPAQDVMPAN
STSWEARTTFETKDDNEKTLAQTNRFGKCKVFGVSLADDTSELPSLQVSNSSELSSPS
SVPPLSKSSDFVQVIINETARGRPADLSPFKGYDKFIHGLDQLFYFGGNLIGRSSGWHE
KCTDDNGDSVPIRDYNREFVSMVHQGLICPKEEEQGKQGPCSSDVVSS

Figure 720: Amino Acid sequence of SEQ ID NO: 1989. The conserved AUX/IAA domain is underlined.

MSEAMSIFLHNHIHIL<u>IDITQCSRKKEQASYGFHFTVSCDENPFVTIKPCARTLLRAQV
VGWPPVRSFRKNMVAAQKSSTEDMSSGGAASFVKVSMDGAPYLRKVDLKMYKSY
QELSEALCKMLSSFTIGRCESQGVKDFMSESKLRDLLNGSDYVPTYEDKDGDWMLV
GDVPWEMFVESCKRLRIMKGTEAVGLAPRAMEKCKSRS</u>

Figure 721: Amino Acid sequence of SEQ ID NO: 1990. The conserved AUX/IAA domain is underlined.

MAAQGED<u>LNLEATELRLGLPGTVEPEKQQAPLSGRSMKRNLIDVNNEYGSNEEESN
GSSAQKCDKQDVHRPSKAQVVGWPPVRSYRKNCFQKKAEGESTGVFIKVSMDGAP
YLRKIDLKPYKGYSDLLKDLQDMFKFKVGEYCEREGYNGSEFVPTYEDKDGDWML
VGDVPWNMFITSCKRLRIMKGSSEV</u>

Figure 722: Amino Acid sequence of SEQ ID NO: 1991. The conserved AUX/IAA domain is underlined.

MAAQGED<u>LNLEATELRLGLPGTVESEKQQAPLSGRSMKRNLIDVNNEYGSNEEESN
GSSAQKCDKQDVHRPSKAQVVGWPPVRSYRKNCFQKKAEGESTGVFIKVSMDGAP
YLRKIDLKPYKGYSDLLKDLQDMFKFKVGDYCEREGYNGSEFVPTYEDKDGDWML
VGDVPWNMFITSCKRLRIMKGSSEV</u>

Figure 723: Amino Acid sequence of SEQ ID NO: 1992. The conserved AUX/IAA family domain is underlined.
MEFREMERGVGDGVFGKDL<u>LNLEETELRLGLPGTEESGQKKSRTGKRLFSESSDVSG
SSKGSCVAPHHDEDHESAPAPKAQIVGWPPVRSYRKSALQPKKAEAEGPGIYVKVSV
DGAPYLRKIDLKVYGGYPELLKALENMFKLTIGDYSEREGYKGSEYAPTYEDKGD
WMLVGDVPWEAFILSCKKLRIMKESEARGLGYGV</u>

Figure 724: Amino Acid sequence of SEQ ID NO: 1993. The conserved AUX/IAA family domain is underlined.

MEMNKKD<u>VKHQDTELRLGLPGTEGLKCANNNKRSFIDTKEVSTSPKEDCVTNNTPP
PKAQVVGWPPVRSYRKNCLQAIKKEAENGNMYVKVSMDGAPYLRKIDMKLYSCY
QELLKSLEDMFKAQVGEYSEREGYKGGEYVPTYEDKDGDWMLVGDVPWEMFINSC
KRLRIMKGSDAKGLGCMQ</u>

Figure 725: Amino Acid sequence of SEQ ID NO: 1994. The conserved basic helix-loop-helix (bHLH) dimerization family domain is underlined.

MVGGGIEMKIELGAGYGPWNDEEKAMVAAVLGTRAFDYLVSRSVSNENLLMSIGS
DENMQDKLSNLVDHPNSSNFSWNYAIFWQISRSKSGDWLLGWGDGSCREPKDGEES
EATRILNLRLEDEGQQRMRKRVLDKLHTVFGGSDEDNYALGLDRVTDMEMFFLAS
MYFLFPSGEGGPGKCFASEKHVWLTDALKSSSDYCVRSFLAKSAGIRTIVLVPTDVG
VVELGSVRSVPESSELVQTIRLSFSTNSFMSVKPIAALPMTNEKKDENAPFSNLALAG
KGEAISKIFGKELTAVNSPGHYREKLAVRKMDSRQSWEPHHNGSKLPFSTPRNGTQD
TSWAHHAHGVKQLSPVEFYGSQTSASKLEERMNSGRNDFGLNRYPTPKQVQMQIDF
TGATSRPSVITRPFTADSEHSDVEASCKEEQGGAANEKRPRKRGRKPANGREE<u>PLNH
VEAERQRREKLNQRFYALRAVVPNISKMDKASLLGDAIAYINELQAKLKIMEADRER</u>
FGSTSRDASDVEVNATAEQSNQSPDVDIQATAADEVVVRVSCPLNSHPASRVIQAFQ
EAQVTVLDSKLSTANDTVFHTFLIKSQGSEQMTKEKLTAAFSRESNSLEPLSSVG

Figure 726: Amino Acid sequence of SEQ ID NO: 1995. The conserved basic helix-loop-helix (bHLH) dimerization family domain is underlined.

MELPQPRPFGTEARKATHDFLSLCSHSTLHHQDPRQPPSQDSFLKTHDFLGKTGAKE
EATSEISSSLERPPPPAPPGPPPSVPPPQSVEHVLPGGIGTYSISHISYFNNQNPPKPEATI
YTVAQASSTDRTDENSNCSSYTNSGFTLWEESAAKKGKTGKENVPSASVREAEVKL
GPWPASERPSHSSSNNNHRNSFSSLSSSQPSGAKNKSFMDMIRSAKSGSNQEDELDD
DDGEFLLKKETSPIPKGELRVKVDGKSSDQKANT<u>PRSKHSATEQRRRSKINDRFQTLR
SLIPNSDQKRDKASFLLEVIEYIQYLQEKVTNYEGSFQGWSQEPANMMPLRNGQRPT</u>
DNYVDQSQNITSGSSPALVFAAKVDENNIAMAPAVFRKAKNPLEPEMGSVTAFKSVE
HHPGMTNRAVPFPMSLQPNISNCVRGSGAVARGDPNLENNASQPLTQISRIKSLTNEC
SASTDKLKEEELTIEGGTISISNVYSQGLLNRLTQALQSSGVDLSQASISVQIELGKQA
NGRNATSSSLPKDTEARNQGVTRPRAAGEIADPALKKLKTGKS

Figure 727: Amino Acid sequence of SEQ ID NO: 1996. The basic helix-loop-helix (bHLH) dimerization domain is underlined.
MALEAVVFPDDPFNYYNCKEVQSLLGECWSFDFGDQEQCENSHFLSTLEIQTEDHEC
SGWNDQSNVSSKALIDRPKRCRYKRRKNKKEMES<u>QRMAHIATERNRRKQMNEHLS
VLRSLMPDSHVQKVDQASIIGGAINYVKELEQQLQQLGAHKEMEGQSSKCEDDISSP</u>
PFSEFFTCPQYSASPDQGNDSVPMNEWTSLTQSAIADIEVTMVETHANLKVRSKRRP
KQLLRLVSGLQSVGLTVLHLNVTTAEPFVLYCLTLKVEDGCQMTSGDEIAAAANQIL
SSIQE Figure 728: Amino Acid sequence of SEQ ID NO: 1997. The conserved basic helix-loop-helix (bHLH) dimerization domain is underlined.

MGGASLPTFKSMLDADWSYFATNPPHHSQQQQQLQPAPEMADLSFSSAAPIPDNAL
LLHHSHHPHPLDSSSSCSPSQAFVLDPSQTHQPFLQPKHCFSSLLNVAWNNSFDNGFD
LGCDAAGLFGSVQGNQTSSAPLLMGGSELGSGSELLPVPSRLVPLGENSTQLPGGGF
GLTGFEGFESPGNPLFTNRSTKVLRPLEVFPQTGAQPTLFQKRAALRNGSGSNGGGA
EKLGNLEISVSRFGELDKKRKKIDDGINDELSFDGSGLNYDTDEGNESGKAMEDSKH
EGCNSNANSTVTVGDQKGKKKGLP<u>AKNLMAERRRRKKLNDRLYMLRSVVPKISKM</u>
<u>DRASILGDAIDYLKELL</u>QRINDLHNELESTPPGTMLPPSTNFHPLTPTPPTLPCRVKEEL
CPSSLPSPKGQPARVEVRVREGRAVNIHMFCARRPGLLLSTMRALDNLGLDIQQAVIS
CFNAFAMDIFRAEQCREGQDVLPEQIKALLLESAGFHGMV

Figure 729: Amino Acid sequence of SEQ ID NO: 1998. The conserved basic helix-loop-helix (bHLH) dimerization family domain is underlined.

MTFSLPPQVSGSGPSEAPPGGWEAKDRVQMLIERMMTKAQISVVGEGIIGRAAFTGD
HEWIASTSYGGHAHPPEVVNEVHHQFSAGIQTVAVIPVPLHGVVQLGSSIAIMEHMG
FVNDVKSLILQVACIPGALFSSSSAGKAGMLGYPGSLTAAAPGNCQVIGSESLMTKSC
KDTSNSSRTAGFVRQSSPLITNTVDNLQPAASTLLTLEKATSLAELCSHLSKSSRASL
MKTSLSPRHGVDSGLARAEVIPANLDMWLNQHAVACNLGNDNRGQTALGPTDGT
WSFFEPIKKKVSAGVVLEKPENKWNSFINSTVTAQPGRNQCSIINPCKTSDATQFHQN
AKLLHGVTCPPRSISVSCSLSESVSRNLVANASFHDADSTKLEGIPLFNLSEQLLSGAS
GQRNHLMSTKRGQTELPSKKQRVVDNFSRQVMPPDYSDISLIEQKPEWALSSEKLEG
GSQKVISSCDTYENASVQQLVRNDLFDILGTDMTDNIIDGNLESLLTDGPYFDAHKSG
AEASSVVNLQETQTDLGSLSEGVSESGIFSMTAVDNLLDAVVSGTRPTSKPISDDNISC
RTSVTRISSSSVPSSSSLNKNFNMLNQEHKDFCGIQKSLVKAGVSDSGSLRSGCSKNG
VEMCSVSNSFYGSHISSWVDQGHGIKQDDNVSTGYSKRQDGMIKS<u>NRKRLKPGENP</u>
<u>RPRPKDRQMIQDRVKELREIVPNGAKCSIDALLERTIKHMLFLQSVSKHADKLKQIGG</u>
SKIINEEGRILLKDNFERGATWAYEIGSQSMVHPIIVEDLNPPRQMTVEMLCEERGFFL
EIADMIRGLGLTILKGVMETRSDRIWARFAVEADRDVTRVEIFMSLVRLLEETIESSPL
VANSIDGKTPMVCQPLTRATSIPATGGHNVLQ

Figure 730: Amino Acid sequence of SEQ ID NO: 1999. The basic helix-loop-helix (bHLH) dimerization domain is underlined.

MEELIISPSSSPSLASKSMSPTATPPPSLSLTLQQRLQLMVQSQPQWWAYAIFWQLLN
HDDGRLLLAWGDGHFQGSTKLTLASRSDRRRLLQALPRDPSNSRPDAAADVPLPAP
AGDVTDAEWFYVMSLTRSFSAGDGIPGKALSTGSLVWLTGARELESYKCDRAKEAE
LHGIRTMVCIPTGDGVLELGSCDVIPENWGLVQRAKSLFGSDLLLPKHPPPPPPFQL
HHDHSDISFADIGIIAGVQENDFAPHADHEKKVKKKQPLVEGAGGRPEAPFGCSSYL
VESEHSDSDSPFMAAVMTEKRTPKKRGRKPGLGRD<u>TPLNHVEAERQRREKLNHRFY</u>
<u>ALRAVVPNVSRMDKASLLSDAVSYINELKSKIGDLESQLQRESKRVKQEVTDATDNL</u>
STTTSVDHSSPSGCGGSLLEVEVKIVGCDAMIRVQSENANYPSARLMAAMRDLELHI
HHASLSTVNDLMLQDVVVSVPEGLKGEEDLRAALLRALEQ

Figure 731: Amino Acid sequence of SEQ ID NO: 2000. The conserved basic helix-loop-helix dimerization domain is underlined.

MESVMHNPPHLQQLNSSLMRYRSSPSSFFDCLVNGNGSDIGCEDYSYPHSLSPEMDA
AIVKLMSIDGFESNDMQEDGRRSVKQESEVVFRTSVSPAMDGTSPVHRHLDHEILAN
SIGFGSFFDEANSMVLQSNAPAELGSGKRSNLVRQSSSPAGLTSNIAVEIGFDARRDA
QNLEMRKGDGSFCSKSKSVGQTDLRSTSISTSRHMPQIAEMENENKLDRMRKSWKN
TTFNGLKRVREEDANLSSSIHTMENQDNVTRNRTHGLTHHLSLPKTSTEMAAVGNIL
HFQDSVSCKARAKRGCATHPRSIAERVRRGRISERMRKLQDLFPNFDKQTSTADMLD
MAVVYIKDLQEQVKLLSESKAKCICSSK

Figure 732: Amino Acid sequence of SEQ ID NO: 2001. The conserved basic helix-loop-helix (bHLH) dimerization family domain is underlined.

MEGCDGGDVGFRHGGDNFLNFPHSGVTPSSVREEFSGMAINPFVSSGWDPLVSLTQS
YRFANPSMASGFPFSSHPGIMENQRSGGDFPPPLGHNLSALTEQVSFERLPCSESRSYL
DAVGYFGLPDIANSGCPPNYGSQREDDHDGSEGASANNKLSQDCRIEEDGEGSSPSV
KRRKNAPAHDTIYDSKEVKRDPSRVISDVPKEWDEKKQKNEQTLHPNSQGKQTGKQ
VRDNVEAPKENYIHVRARRGQATNSHSLAERVRREKISERMRMLQELVPGCNKITG
KAVMLDEIINYVQSLQQQVEFLSMKLAAVSPELSINLERILSKDIFCSPGSSATIMDTE
RGIACSSPYTKGFFPEAFPSLPSSNHHYPPLTQAFCESELQTQCQSHFLSSSGVDSLGL
NGRLKSER

Figure 733: Amino Acid sequence of SEQ ID NO: 2002. The basic helix-loop-helix (bHLH) dimerization domain is underlined.

MDNEFFMPWQPLSSGMAIQPNDLNCASKQSPDCFFNPNWDNSSADQGGHFESALSS
MVSSPAAAGSYLSNESVLIRELIGKLGSIGNPGEASPSPHSLPLSGNATAAMPYIGGSN
STNTSCYNTPLNSPPDRAVKERFSSVAEFTADPGFAERAARFSCFGSRSFNGLTSQFSL
NNGEPPYKSNPLMESGKFQRVLSSPSLKALGSQAVATVQQNVISRLSDRIELTNSNEE
SSVSEQIPGGENGLKASNEANSRKRKAAAKGKAKESAPSTSVANAMKVSESHDNSSP
KRCKPNEDDGNGNDTAKGEDDAKGNSKKNDAKPPEPPKDYIHVRARRGQATDSHS
LAERVRREKISERMKLLQDLVPGCNKVTGKALMLDEIINYVQSLQRQVEFLSMKLAS
VNTTLDFNADALMSKDMFQPNNSVPRPMFPLDSSATAFHGHHRPQNQPLPPPLQGH
VSSGTATQVEPLNLGPCHTVESHSPLNDLQYQNFCGDDLQSIVQMSFGQNSNQETAF
QLQTFHG

Figure 734: Amino Acid sequence of SEQ ID NO: 2003. The conserved basic helix-loop-helix (bHLH) dimerization family domain is underlined.

MANNPSDGASDEFLEHLLGLPNFAAAAEAGLAPGDGTGLSVTAATPMMLQLGSGD
GSGGHGHGHGHGHGQGHLSALGGGGAGAGGGGGGGGGYHGAVFPLGLSLEQGK
GGFLKPEEASGSGKRYPEEVVDGRASTVKNLHSPLPNFPDVSQMASFRNRDVFHGQP
VPNPVPAAPHPPAMRPRVRARRGQATDPHSIAERLRRERIAERIRQLQDLVPSVNKTD
RAAMLDEIVDYVKFLRLQVKVLSMSRLGAAGAVAPLVTDIPLSSVEEEGGEGGRNQ
PAWEKWSNDGTERQVAKLMEENVGAAMQFLQSKALCIMPISLATAIYQTQPPDTSS
LVKSESNPPS

Figure 735: Amino Acid sequence of SEQ ID NO: 2004. The conserved basic helix-loop-helix (bHLH) dimerization family domain is underlined.

MENDFFMCGGALVPPPPPPLQCAEMNCFYNPSWEKSTVDHGVAKFDSALSAIGSSPA
GSTSNSNLSNGSFVMRDLVGKLVGVGNSSELPPHSHHLFSAMPAKTDSHVGGDNST
GNSCYSTPVNSPPMTDRLFQDNHHLPKLGHAVMPMNSGLAEFSPDPGFADRAARYS
CFGSRSFNGRSGQFSRKYGEIVNRSMPPMADEKLTRVSSGPSLKALESQMAAEQSKN
SPPQDRGELSNSQEGSSLSEQIPSVEIGLRASNDAGLRKRKAVPKGKAKGSAGTLPSS
NDAKVDEANENSDAKRCKPDESAGNENCSGKAEHDPKESTGTASEDKQTKTEEKD
YIHVRARRGQ<u>ATDSHSLAERVRREKISERMKILQDLVPGCNKAIGKAVMLDEIINYV
QSLQHQVEFLSMKLASVNSGPDYKMDALMSKEMFRSNDPIQYPILPPDSSAASVLYG</u>
HHRHQKNSAVHNHITEGTTAQFSMDPLNEPHFPPLDGLNDHVLASFCGDDLQMLVQ
MGFGQDKLTDAPLDHQDYHGQNPVSHMKIEL

Figure 736: Amino Acid sequence of SEQ ID NO: 2005. The conserved basic helix-loop-helix (bHLH) dimerization family domain is underlined.

MESIDEEFRNYWETLMFFQSEELLHNSCVSEVISRFNGPSSPDAAALPVA<u>SKSIDLERN
RRKKLNERLFALRALVPKISKMDKASIVKDAIDYIQDLREQEGKIRAEIAELESVILKK</u>
NPGFKFEGERSPPAHPKSKRKRAKLRHDISKSPDITPIEVLELRVMEAGEKSVVISLTC
SNRGDAMVRLCQAFESLKLKIVAANITALPEELLKMVFIEKEEKQGKEHIQSKIQAAI
AALNSHHAEPTDASMKQLMSRDI

Figure 737: Amino Acid sequence of SEQ ID NO: 2007. The conserved basic-leucine zipper (bZIP) transcription factor domain is underlined and the basic-leucine zipper (bZIP) transcription factor domain signature is in bold.

MEDLELHMDEDVMAHIDLDGFFGDLPEAGDVIGACSSANGSSSSPDSGLSWFDEIENI
LMKDDEDGGVVGGGIRADSSQEFCDRFLADVLVDSPGDGSAVIADDGSGDKEEPGS
SDDGGVEAAKVDGADGGGEAY<u>DPASKKIKRQLRNRDAAVRSRERKKAFVKDLEV
KSKYLEGECRRLGRLLQCVMAENQALRFNLQNSACGASVAKQESAVLSEPLPLGSLF</u>
WFLCITCLFTLPPPLLLALEAVLRENAGRGNLKPLAAPRGARSEMFGSCGVQTLDKS
RRYKALRTKMKAGFLLPRVLA

Figure 738: Amino Acid sequence of SEQ ID NO: 2008. The conserved basic-leucine zipper (bZIP) transcription factor domain is underlined and the basic-leucine zipper (bZIP) transcription factor domain signature is in bold.

MASHRIGEIGLSETGPSTHHVPYSVYHGINNPTTFINQEGSAFDFGELEEAIVLQGVNI
RNDEAKAPLYAGRPAATLDMFPSWPIKFQHTPRGSSKSRGESTDSGSGVNTNTLSSSI
AEARREADSPVSVKGSSSLDHQKLQKPMEMAASDTSPLPSPSQSASK<u>APQDKT**LRRL
AQNREAARKSRLRKKAY**VQQLESSRIKLTQLEQDLQRARSQGFLLGACGGANISSG</u>
ATIFDMEYARWLEDDHRHMLELRTGLQAHLPDGDLRVIVDGYLSHYDEIFRLKGVA
AKSDVFHLITGVWATPAERCFLWMGGFRPSELIKILITQLDPLTEQQFMGICSLQHSS
QQAEEALSQGLEQLQQSLVDTIAGGPSIEGMQQMAIALGKLTNLEGFVRQADNLRQ
HTLHHLRRILTVRQAARCFLVIGEYYGRLRALSSLWASRPRESMMNDDNSRQTTTDL
QIVQATQNHFSNF

Figure 739: Amino Acid sequence of SEQ ID NO: 2009. The conserved basic-leucine zipper (bZIP) transcription factor domain is underlined and the basic-leucine zipper (bZIP) transcription factor domain signature is in bold.

MEEGKAGGGAEKMKKSASELGLEESMRIMMIAPSPEHHHLDHHPPHNYCYDSPHTT
SISCITDAPPLSFHDWDISGPGSDHQHDMATAITAFWDPPLLTEHSPPDSNSSIFVGSST
SLANKPKYRDIQAREATSGSSRQHSDEDDAATVADPSEQSRY<u>PTDPKRIRRMVSNRE</u>
<u>SARKSRKRK</u>QAHLAELEIQADRLRGESSTLFKQLLDAAQHYRHADTNNRVLKSDVE
ALRAKVKLAEDMVARGPFPCSLNHVLQTLNHQHSIGTRGLSAVANVSPTITVHGDN
DSSTGLTVPMPNSCLGVENSNPNNSNFTNGVIHDPVSFVSGIWS

Figure 740: Amino Acid sequence of SEQ ID NO: 2010. The conserved basic-leucine zipper (bZIP) transcription factor family domain is underlined and the basic-leucine zipper (bZIP) transcription factor domain signature is in bold.

MGSSETEKSAKEKETKGPPPTTLEQSSTASANPVTPDWSGFQAYSPIPPHGFLASSPH
AQPYMWGVQHIMPPYGTPPHPYVAMYPHGGIYAHPSMPPGSYPFSPFAMPSPNGIAE
GSTTGEADGKPTEVKEKLPIKRSKGSLGSLSMITGKNNELAKTSGASANGAYSKSAE
SGSEGSSEGSDDNSQNDSQQKSGGRQDSLEDVSQNGNAEHGSQNGGSNTPHGTVNQ
SVALVPIAAAGPAGVPGPTTNLNIGMDYWGTPAMPAIRGKVPSTPVAGGMVTPGSR
ESVQSQMWLQ<u>DEREIKRQ</u>RRKQSNRESARRSRLRK<u>QAECDELAHRADALKDENAS</u>
<u>LRAEVSRIRSEYEQLLAENAS</u>LKERLGEVPAHEDSRSEERHLNSESQKTAKTEHGQN
AR

Figure 741: Amino Acid sequence of SEQ ID NO: 2012. The conserved basic-leucine zipper (bZIP) transcription factor family domain is underlined and the basic-leucine zipper (bZIP) transcription factor domain signature is in bold.

MASQGGGGSSGNARGGGGNNGKSTEVQPLTRQNSIYSLTLDEVQNQLGDLGKPLSS
MNLDELLKNVWTAEAGQSMFMDVEGTAVANQNALPRQGSVSLTGALSKKTVDEV
WRDIQQNKNREENKSKERQPTLGEMTLEDFLVKAGVVAESSSDKRSTGNIGGVDPSI
TPQVPPQGQWMQYPQPQFAHPQQNIMGIYMPAQTMPQPLQMGAGSMMDLPYPDN
QLALPSPLMGTLSDSQTSGRKRGVHEEVV<u>DRSVERRQ</u>KRMIKNRESAARSRARKQ
<u>AYTSELENKVSRLEEENERLRKRKELEMLLPC</u>APPPEPKYQLRRTTSAPF

Figure 742: Amino Acid sequence of SEQ ID NO: 2013. The conserved basic-leucine zipper (bZIP) transcription factor family domain is underlined and the basic-leucine zipper (bZIP) transcription factor domain signature is in bold.

MADGSPRTDISSDDTDEKNQRFDRGKSTAIVAYDSSDRSKD<u>KTDQKTLRRLAQNRE</u>
<u>AARKSRLRKKAYVQQLESSRLKLTQLEQELQRARQQGIFISSS</u>GDQAHSSGGNGAM
TFDVEYARWLEEQNRQINELRSAVTAHAGDGELRIIVDGIMAHYDEIFRLKSNAAKN
DVFHLLSGMWKTPAERCFMWLGGFRPSELLKLLVNQLEPLTEQQLTGIGNLQQSSQ
QAEDALSQGMEALQQSLAETLCSGSLGSAGSSGNVANYMGQMAMAMGKLGTLDG
FIRQVI

Figure 743: Amino Acid sequence of SEQ ID NO: 2014. The conserved B box zinc finger is underlined and the constans zinc finger domain is in bold.

MSPAVMIPHKNAANAFSG<u>KTARACDNCIQRRARWYCAADDAFLCQSCDRSVHSA</u>
<u>NPLARRHERVRLK</u>TAATPQKHLGEFSSHHRKKPSSWHRGFTKKPRTPRGAKSALHR
ATKPENAARNPFPVVPEVGGDETSNEESEEHLLYRVPAYDPFVAEMCTSKGAEATAF
SAEPETVAAFDGSGDGDNRSKGLADEVENLQEFLPSDADLAEFAADVESLLGRALDT
ESFGIEGLGFVDCKERDDNSMDCSLGSGGAIKVEEKEGVAEVVVELGHDDMEMDVS
KETFELNFDYDSPTTCGDEEEEAKVIVELEGEKNVENCGADEGTNISSEERKKKKKR
EIFLRLDYEAVISAWAGQGSPWTTGERPDFSPDNCWPDFMGMSGLEFQNLYGEAGV
HGGHVGMGDAGREAKVSRYREKRRTRLFSKKIRYEVRKLNAEKRPRMKGRFVKRA
SSASSSAPAFPLLNK

Figure 744: Amino Acid sequence of SEQ ID NO: 2015. The conserved DOF-type zinc finger is underlined.

MDTAEWRQGIGVIKAMEGSSRPALRSRP<u>QKDQALNCPRCTSTHTKFCYYNNYSLSQ</u>
<u>PRYFCKTCRRYWTEGGSLRNVPVGGGSRKNKRPSSS</u>SPSTSSSSSKNKIIPNLTPPPPTI
LHSDPQNPNNKPQEGQGFGLPSYLPAQAYAALSHHLPNPSSSSSPMEFLKSGGSWPS
GLSLSSLMAIPGSDSSACMYSASAGFPLQELKPNLQYFSLAGLEAGEFKQVPSRTAEL
EQMNRGQHGDPSTGYWSKLMGGGSW

Figure 745: Amino Acid sequence of SEQ ID NO: 2016. The conserved DOF-type zinc finger domain is underlined
MPSDARPQASAAAAAGGAGLHPHPP<u>PQTEALPCPRCDSTNTKFCYFNNYNLSQPRHF</u>
<u>CKSCRRYWTQGGTLRNVPVGGGSRKASSSSS</u>SKRPRSLAPPTSSSPCSNSNSSSVSQE
PLHGDHSGLLLAQVKSEVGSGDQVKRTENVAGPGVGSGHQGFTSLLGSPGGQGFLA
LGGLGLGTGLDGLGFGFGRGVWPFNEVGFVDGGGVYGGGGGGGPVAAAGGNAWQ
MGSGEGGGLVDGDGFAWPELAISMPGQGLK Figure 746: Amino Acid sequence of SEQ ID NO: 2018. The conserved DOF-type zinc finger domain is underlined.

MLEMKDAAIKLFGQTIGLREKRGVLDEPSWGGGKEFASEAGGPGSWDRGGSVSAD
AAWQEHRGGREAGETRGDKALSEREPMNDKYEEGISCWAVDNPKDSAESTIINQKD
ETGRETSPPSAQNKEESETSISRETTLK<u>KPEKILPCPRCNSMDTKFCYYNNYNLNQPR</u>
<u>HLCRKCQRYWTAGGTMRNIPVGAGRRKSKNSYA</u>ATVALFHNTGVPESLRADCAGD
LKTAGTTILRFGSDSPNWGQSAAPVPSTINGFLDPGRAIPCSGRGLDNFSDERSCGSSL
TASNSTEKASNCSAPEPAAHNYRGFPLDSVQWNSPTAVSTPGFPVSFYQAPQCYWA
YALPGSLPSSLSHSNASTSPPSLMILGKHSRDGNVYDCRATTKQSIIGAREALDGVSDS
GESDGFFSQAFQSIAKGKSFNDRRTLLLQANPAALCRSMNFQEST

Figure 747: Amino Acid sequence of SEQ ID NO: 2019. The conserved B-box zinc finger family domains are underlined.

<u>MGYICEFCGEQRSMVYCRSDAACLCLSCDRNVHSANALSRRHSRTLLCERCNSQPA</u>
<u>CVRCAEERVSLCQNCDWIGHGASTSASTHKRQTL</u>NCYSGCPSAAELSSIWSFVLDFH
SGGESACEKGMGLMSIAEGNENAACIPPKDSSSQDVSVCADDEAGNANAWVGSSSL
PELKSASLNMGQLAASASTATPKACLPITRSPGLFEDDRFYEDFNMDEVDLDLENYD
ELFGVALTNSELLFENGGIDSLFGAKEMSAADSNCQIQPACSVASAESMMSSKTEPIIC
FSTRQPHSNLSFSGHIGENNTGDYQDCGASSMILMGEPPWCTPGPENSFTSASRSNAV
MRYKEKKKTRKFDKKVRYASRKARADVRRRVKGRFVKAGDAYDYDPLSQTRSY

Figure 748: Amino Acid sequence of SEQ ID NO: 2020. The conserved type 1 antifreeze protein domain is underlined.

MALEALSSPTAPSAPFQFMK<u>DSSPAAAAAAASSSSSAYDLPIPASFSAPSAAAAPAAS</u>
<u>GVSVSEGVGSTHTQSQGHREFDLNIPALPEFSPRFVVSGGVDDEVESPHPSKKPRFLA</u>
<u>PAVKTEAA</u>

Figure 749: Amino Acid sequence of SEQ ID NO: 2021. The conserved C2H2-type zinc finger is underlined.

MTDPYSSYLNGWINFNPLHHCSPSPPPPPSSSFSSIATNNYYNSSHCFYSLYDYNHVYS
AASLPHASPPPSPPLKEALPLLSCLSPARHEEEEQASLSTPMEVENPSCQKDSFFPHNS
ADGADEDDDGDGEAVTVALHLGLPSPSSADLISRLSSTEISSDKELDQETTVASSGYF
TSNNKLNKGQYWIPTPAQILIGPTQFS<u>CPLCFKTFNRYNNMQMHMWGHGSQYRRGP</u>
ESLRGTQPTAMLRLPCYCCAPGCKNNIDHPRSKPLKDFRTLQTHYKRKHGIKPFMCR
KCGKAFAVRGDWRTHEKNCGKLWYCSCGSDFKHKRSLKDHIRAFGSGHTAYGIED
DCGFEEEEAATSEIEQDNNFECSK

Figure 750: Amino Acid sequence of SEQ ID NO: 2022. The conserved C2H2-type zinc finger family domain is underlined and the C2H2 type zinc finger domain signature is in bold.

MSNITGEGGSFSSGNTGEAEVQPQELLNHLFGANNSLLSSASANNDSLSASTHDEKPQ
QQAPQAKKKRSLPGNPDPSAEVIALSPTTLVATNRF<u>VCEICNKGFQRDQNLQLHRR</u>
<u>GHNLPWKLKQRGSAEIRKRVYVCPEPSCVHHNPARALGDLTGIKKHFCRKHGEKK</u>
WKCERCSKKYAVQSDWKAHSKTCGTREYKCDCGTIFSRRDSFITHRAFCDALTEEN
TKLNQALAPHLPSSVGQQPNNLSSSSVPLSQAQSNTIPSTEAPEFANHADTKPPLFSLP
QGLILHQSKPMTMPQTLFSGNNLFGTTNARTVAPPPISPSLIHGMNSPQRGSAFMSAT
ALLQKAAQMGATVSNNSATSFVSAPMAPSSFGGMLPKQAQHNGGFVDRFMEKGQE
EISEQFMNNVNNGSDREGVFSGLLGQNSHDFLKSLEVDHGKTTTVDFLGIGGTRSAG
NLHEGQREMPLKGFMSQFQPQSTMEKPMWEV

Figure 751: Amino Acid sequence of SEQ ID NO: 2024. The conserved C2H2-type zinc finger domain is underlined.

MEMKGLLAVNDNSMSNLTSSASGEICASSGSGSEIYGNNNNLYSHHSFASANHQPSP
PPKKKRNLPGNPDPDAEVIALSPKTLMATNR<u>FICEICNKGFQRDQNLQLHRRGHNLP</u>
<u>WKLKQRPKDEPIRKKVYVCPEPTCVHHDALRALGDLTGIKKHFSRKHGEKKWKCEK</u>
<u>CSKRYAVQSDWKAHSKVCGTREYKCDCGTLFSRRDSFITHRAFCDTLAEECAKTAPP</u>
NQPNFLIPSSSQPPTTSLVTSRINLQNISSLSIKREQEQQQHQQQVHIFNPRQQTIGPSW
TPLPYISRGTLSSPSSFLDPSAQVLQNPSSDNPSAGISINLPHAEHTGTGFSSPSSSPHMS
ATALLQKAAQMGVTMNNQPSSSLGVNCSAPQAHHSRMHDNNLVNLGSRDRHHHR
PQDHQMGTGRFADQSLSSFGNKAVAAPAGVLGGAGEPGPPLSLLQQDMNVMMMM
NPLSSLDGADDDLNEMILNNNYGDDISERPSSGHGGDDFKGAATLESAKRYRLEGD
KDSMATRDFLGLKAFSPKDFLNHKVAGFDPMV

Figure 752: Amino Acid sequence of SEQ ID NO: 2025. The conserved C2H2-type zinc finger family domain is underlined and the C2H2 type zinc finger domain signature is in bold.

MRELENNSLDLNNLPEDYTRDGNKQVFEGSSSSSVPLNGRRKRDIVITCQARSEKASF
ELLQCGPKVLIFLKIRERVDPKSIFQIVWKKKSDGKEECGK<u>VYECRFCSLKFCKSQAL</u>
<u>GGHMNRHRQERETETLNKARQLVFGNDTLAAHPALPPHHHLASCQSIPGGYHAATN</u>
VADPPLPFRSSMYPPPPPPRFFSASSSSSIVQPPPPYLYPSPPRLVAYPSHYNGNQHPPA
GDNYSMGHVFGRSPSSHFGTLESNYTCIGAPVGEGFSAPGGGGRERSPQGQKEGSN
WVSRLDPPSINRFHDGF

Figure 753: Amino Acid sequence of SEQ ID NO: 2026. The conserved C2H2-type zinc finger family domain is underlined.

MDSKMDLEERLRAETWGKPSSVNDLPQRVPPDRQTPFPNFASHKNLQKREDQDPSIS
NYGMRIEPSFSEFNRPSECQPPLPSNPISQDRGVQMNDILQLGKTQEWDPKAMLNNLS
FLEQKIHQLQELVHAIVGRRGPVLGRPDELVAQQQQLITADLTSIIIQLISTAGSLLPSV
KNSLSSASTPPIRQLGQLGGILNNSGSGIGLDSNLVLPSQGGSKVPDQSNQVDPMDQS
AIDNLEDHESKDDEDGDEGENLPPGSFEILQLEKEEILAPHT<u>HFCTICGKGFKRDANLR</u>
<u>MHMRGHGDEYKTPAALAKPHKEAGSEMMLIKRYSCPYAGCKRNKDHKKFQPLKTI</u>
<u>LCVKNHYKRTHCDKSYTCSRCNTKKFSVIADLKTHEKHCGKDKWLCSCGTTFSRKD</u>
KLFGHITLFQGHTPAIPFDENKGGLSLQGEHNEDTNKVGNVSFSFGSSTPSSGGVQNI
MEDVKGNVDDPSSFFSPLSFEASNFGGFNEFTRSAFDDSEGAFSFLLQASCNYPQKNG
GQSSSNNLE

Figure 754: Amino Acid sequence of SEQ ID NO: 2027. The conserved zinc finger C2H2 type domain signature is underlined.

MPGLTCNACNKEFEDDAEQKLHYKSEWHRYNLKRKVAGVPGVTEALFLARQAALA
QEKKKSSQTPMLYS<u>CGICGKGYRSDKAHAQHLQSRSHIL</u>RASQGVNLEDGEKTIIRPL
APRVQSRPAPQKESGMAESEDSEDEWEEVDSEDDLVGEAANSLSEMNVDEPSTDHH
MEDGSDDDDFCEVDPSCCFICDREHDSIELCMVHMHKQHGFFIPDVEYLKDPEGLLT
YLGLKVKRDLMCLYCNERCHPFSSLEAVRKHMTAKSHCKVHFGDGDDDEEAELEE
FYDYSSSYVDEDGKQLVASGDMGNSVELGSGGSELVITRRSDGGVSMKTLGSREYL
RYYRQKPRPSTGNNAAITAALASRYRSMGLTTTVRSREQMVRLKVIREMNRSGVEA
MRTKIGMKSNVIRNLPKNVTH

Figure 755: Amino Acid sequence of SEQ ID NO: 2028. The conserved C2H2-type zinc finger family domain is underlined and the C2H2 type zinc finger domain signature is in bold.

MEMKGLLAVNDNSMSNLTSSASGEICASSGSGSEIYGNNNNLYSHHSFASANHQPSP
PPKKKRNLPGNPDPDAEVIALSPKTLMATNR<u>FICEICNKGFQRDQNLQLHRRGHNLP
WKLKQRPKDEPIRKKVYVCPEPTCVHHDALRALGDLTGIKKHFSRKHGEKKWKCEK
CSKRYAVQSDWKAHSKVCGTREYKCDCGTLFSRRDSFITHRAFCDTLAEECAKTAPP
NQPNFLIPSSSQPPTTSLVTSRINLQNISSLSIKREQEQQQHQQQVHIFNPRQQTIGPSW
TPLPYISRGTLSSPSSFLDPSAQVLQNPSSDNPSAGISINLPHAEHTGTGFSSPSSSPHMS
ATALLQKAAQMGVTMNNQPSSSLGVNCSAPQAHHSRMHDNNLVNLGSRDRHHHR
PQDHQMGTGRFADQSLSSFGNKAVAAPAGVLGGAGEPGPPLSLLQQDMNVMMMM
NPLSSLDGADDDLNEMILNNNYGDDISERPSSGHGGDDFKGAATLESAKRYRLEGD
KDSMATRDFLGLKAFSPKDFLNHKVAGFDPMV

Figure 756: Amino Acid sequence of SEQ ID NO: 2029. The conserved C-x8-C-x5-C-x3-H SEQ ID NO: 3667) type zinc finger family domains are underlined.

MDGYAGGHEGSRSDPSPEWPNDSEADTGLEEPMWQLGLGSGGGGGGGGEGEGEP
DLAYPER<u>TEAADCIYYLRTGNCGYGAGCRFNHPRD</u>RSTVMGATRAGGAEYPER<u>AG
QPNCQFYMRTGTCKFGASCKYHHPRH</u>GAGSSSPAPLNLCGYPFR<u>QGEKECSFYVKT
GRCKFGATCKFHHPQP</u>AGVHVHAPSPPLQVAPPPIPVAPPSSYPAMQSPSVPSSQQYG
VVMARPPLVPSYVQGPYGPLLVSPSIFPSWNPYQAPVSPLASSSPQAGSGSSSVYGVT
QLSPSAPAFPWPYQPSPSSLGPSVNGRREQSFPVR<u>PGQPECQHYLKTGDCRYGSSCKY
HHPPDWNALNVNIVLSPTGLPIQPGAPPCMHFARGECKFGPACKYDHSF</u>GPPSYSPSV
SSLGDPFPAGFPFGMLFPSYSSPELRAEIISGPTEDSLPTRSSSTTSMSVTSVGSARASS
GPMPSQLPDLSSTNLANCNTKERHSPG

Figure 757: Amino Acid sequence of SEQ ID NO: 2030. The conserved RNA-binding region RNP-1 (RNA recognition motif) family domains are underlined and the C-x8-C-x5-C-x3-H SEQ ID NO: 3667) type zinc finger is in bold.

MDANEATSIVLSKIRGIDPENASKIMGYLLIQDLTEKDLIRLAFGPETLLHSLILKAKT
QMGLSSNALPAPSPGPSHPALAPSVSIPTNPPPGALPPQSSPRITPRGADYEVGKGPFS
AFAAAAGSVARQNSSPSLPFDGARYFAPLNGGGGGGGGGGGVSAGGGSDFMEDNN
QLGDYFAFLNDSSKSGDVFEMGYNADTHLHRRSYSESDAGFGCGGEDACFGGGYR
PCLYFARGFCKNGSNCKFLHGDDFEGSVNFVGSPSNFDAEDMMRLKVAHQQRLA
AASQFLPGISPTSHGKYMALLMQQHNETQRMGVPGVAMGDDFYKYGRYQVERNEY
LAMGLAEKANSASR<u>QIYLTFPADSTFKDEDVSDYFSNYGPVQDVRIPYQQKRMFGFV
TFVYPETVKLIL</u>TKGNPHFICNSR<u>VLVKPYKEKGKIPEKRQQHQQQLFERGEFSPCSS
HSLLDTGEPYDHLARSRVFHNPQEMVIRRKLEEQANLQQAIELQSRRLMNLQLPDLK
DDGIYHHLRSFSVGSPLSPR</u>IHPHTQINHKVVMPPDAPNHENAEDCRNSTAATISVIA
ATGEQQLHHDVNAACGQDVVSGEGKSESSKLTRGDSRGSLENILPDSPFASPTKFSSD
HLSDFSKLADATDFTASSGIPDNNVSLTVSSGDGPSH

Figure 758: Amino Acid sequence of SEQ ID NO: 2031. The conserved KH domain is in bold and the C-x8-C-x5-C-x3-H SEQ ID NO: 3667) type Zn-finger domains are underlined.

MDTRKRGRPEGGSYANGGLKKPKQELESLSGVGSKSKPCTKFFSIAGCPFGEGCHFL
HYVPGGYNAVAQMMNLAPAVPQAPRNMAAPPLQNGTGASQPA<u>VKTRMCNKYNTA
EGCKFGNKCHFAHGE</u>WELGKPIAPSFDDPRSMGPITGPITSHRLGGRMEPLPPPPGPV
SSFGASATA**KISVDASLAGAIIGKGGVNSKQICRQTGAKLSIRDHESNPALRNIEFE
GTFEQIKQASTMVRELIDNISALTGHSKGHGGPGGPAPPGSN**<u>YKTKLCDNFVKGSCTF
GERCHFAHGA</u>AELRKTAL

Figure 759: Amino Acid sequence of SEQ ID NO: 2032. The conserved G-protein beta WD-40 repeat domains are underlined and the Trp-Asp (WD) repeats signatures are in bold. The C-x8-C-x5-C-x3-H SEQ ID NO: 3667) type zinc finger is in italics.

MDMEGNKRVFQRLSGGPSTASDSRHHPQQQQQQKVCFHWRAGKCTRHPCPFLHRE
LPAPAQPLSNGGAPKRFAEDSGSQFLRRGPKFTGGSNTWGRVHGSNAVAK*KTEKLC
NYWVQGNCTYGDKCRYLHSW*SLGDC<u>FDMLTQLEGHQKVVTGIAFPSGSGNLYTGSK
DETLRVWDC</u>QSGQCAGVINLGGEIGCMISEGPWVFVGLPNLVKAYNTQSNADLSLN
GPVGQVYAMVVGNGLLFAGIQDGSILAWKFNAATNG<u>FEPAASLSGHTLGVVSLVVG
ANRLYSGSMDNSIRVWNL</u>ETL<u>QCMQILTDHTSVVMSVLCWDQFLLSCSLDKTIKV
WV</u>ASDSGNLEVTYTHNEEHGVLHLCGMHDSEVKPVLMCSCNDNCVRAYDLPSFAE
RGKIFAKNEIRAIEVGPGGLFFTGDGTGQVRVWKWRDSP

Figure 760: Amino Acid sequence of SEQ ID NO: 2033. The conserved KH domain is in bold and the conserved Zn-finger, C-x8-C-x5-C-x3-H SEQ ID NO: 3667) type domains are underlined MDFGGGRKRGRLDASSNGNGGPKRSREEAETFSTGIG<u>SKSKPCTKFFSTSGCPFGEGC HFLHYVPGGFKAVSQMLNLGGNPTLPHASRNAAPSYPEAPSPTA</u>VKTRLCNKFNTAE GCKFGDKCHFAHGEWELGKPTGPSYDDPRGMVPPSGRYGGRNEPPPPGLAAAASFG ASATAKISIDASLAGPIIGRNGVNSKQICRVTGAKLSIREHDSDPNLRNIELEGTFD QIKQASAMVHELIANVASASRPAMKNSAAHSAPRSN<u>FKTKLCENFAKGSCNFGERC HFAHGTEELNKPGL</u>

Figure 761: Amino Acid sequence of SEQ ID NO: 2034. The conserved C-x8-C-x5-C-x3-H SEQ ID NO: 3667) type zinc finger is underlined, and the ankyrin family domain are in bold.

MSQLTIQTEDTFASLLELAANNDTESFGRCVERDPSSIDEIGYWYGRQKGSKQVVNM QRTPLMVAATYGSVDVMRLILCLSDADVNRTCSTDKSTALHCAASGGAVNAVD AVRLLLSAGADPSLADANGQRPVDVIVVPPKLLSIKFALEELLSTEGSVNEHNLRVS VATSNSTSPPLSSSPDNGSPASANCSSPKNSKLSDAPVLYASEKKEYPVDPSLPDIKNS IYSTDEFRMYSFKVRPCSRAYSHDWTECPFVHPGENARRRDPRKFH<u>YSCVPCPDFRK GACRRGDMCEYAHGVFECWLHPAQYRTRLCKDGTSCARRVCFFAHTEQELRPLYV</u> STGSAVPSPRSSTSGAAAMDFAAAMSLLPGSPSSVSIMSPSPFTPPMSPSANGISHPSV AWPQQNVPTLHLPGSNLQSSRLRSSLNARDIPQEDFDLLSDYDVQQQQLLNEFSILSQ QSMGANSLNRSGRLKTLTPSNLDDLFSAESSSPRYADQALASAVFSPTHKSAVINQFQ QQQQSMLSPINTTFSPKSVDHPLLQASFGVQSGRMSPRNMDPISPISSRVSMLAQREK QQQQLRSLSSRELGSNSAAIVGSPVGSWSKWGATNGKPDWAVSADELGKLRRSNSF ELGNNGEEPDLSWVQSLVKESPTEMKEKLSSTLSGVPAPATSSEVPSISSQMESVDHE VLGAWLQQMQLDPLVAQQN

Figure 762: Amino Acid sequence of SEQ ID NO: 2035. The conserved C-x8-C-x5-C-x3-H SEQ ID NO: 3667) type zinc finger is underlined.

MPLGKYYCDYCDKQFQDTPGARKRHLQGLSHLRAKALWFDSLHHEPNQAYAEG<u>Y VRGVCNRFVNTGFCQYGDSCKYFHPK</u>SVSSPAPRTAGGNAQSTVIPGSHLVGGTSLQ GNVVVADGTGTATAWGNLPPSLKPPPEGGYPSLPFIDWG

Figure 763: Amino Acid sequence of SEQ ID NO: 2036. The conserved C-x8-C-x5-C-x3-H SEQ ID NO: 3667) type zinc finger is underlined and the conserved Cys and His residues in bold, and the RNA-binding region RNP-1 (RNA recognition motif) is in bold italics.

MDAYEATRIVFSRIQSLDPENASKIMGLLLIQDHGEKEMIRLALGPETLLHSVVLKAR
KDIILPSNSPSTPSTPSSPSPFMSTNPISISSRPKGSNFSPSSLSNIPSPSSWGGGGGGGGS
FSDLSSGDDLINSSSCLYGNGGSDTMIDELQLQDQLSFLNDNSPPLGPNSNPDMFCPQ
QDLLSSPTAVYGGAAAGWGAPVHRRSCSVSDVCSGSSEDPSCGVGWRPCLYYARG
YCKNGISCRFLHSGGLGDAASVVGSPDGSASAVVGSPSKVDMMGQCHEAVLRSKSA
QQQRLAAASQLIGSATFPYTPKSMNLLLHHQQNDAHRAAAAAALMMGDDFYKYGR
SRLERSDFSVNGCVNPASRQIYLTFPADSTFKEEDVSNYFSNFGPVQDVRIPYQQKRM
FGFVTFVYPETVKLILAKGNPHFVCDARVLVKPYKEKGKVPDKFRKQSQLVERGDFS
PCGTPTGLDSRGGPFDLNLGARPFYNSQDMLWRRRFEEQADLQQALEYQSQRLMSL
QLLDVKKHHHQRALSTGSPIPSPAQSPTLFNNPTFLNIPSVRSLGVTEENGSSPGLSDS
QPLNYQSVIVSAGKDLTGSDKSNGNDKESSHTEDKGLAESLEHNLPDSPFASPTKAS
AEHFSSLTNVVSEAEKDGVGSASSSPNSNNPVSSPLIPGTSAMDMASFTSFNCQIPSHR
NVCRCWRANMPSGYIASSSLTEGD

Figure 764: Amino Acid sequence of SEQ ID NO: 2037. The conserved CCAAT-binding transcription factor, subunit B, domain is underlined.

MSWYVGSSPSREASTISQFGLVPMPKGSSIKMGVPLQHSSGIKQLNVHFQERDLCSTQ
STSQSFSEVPNIGGSTDCSQATVLEQTEHGETEGQSVRGQAKSALSMGTQDLVFQPLE
VCIPLHYAEPSLGGFMPAAYGPQAMISYPQMAGMIPSRLPLPFDTT<u>QEEPVYVNAKQ
YHGILRRRQYRAKLGAENKLIKDRKPYLHESRHHHAVRRPRGSGGRFLSKDQKESKF
TSLNDESNVKSTARVSSAIDLPNSEVCQLKDHRDTGSTTSCSKTTQTTTSSDAIPVSKF
RFFGQPWHVMTTCDPSCDVRYSGDIRHLSLPGER</u>

Figure 765: Amino Acid sequence of SEQ ID NO: 2038. The conserved transcription factor CBF/NF-Y/archaeal histone domain is underlined
MDQTEQTQQQQQQQQVVGVVAGTNQMAYAPPFPTAPVVAPGTPAVPIPSPTQAPST
FPGSPHQLAYQQAQHFHHQQHQQQQQQLQMFWAGQMQEIEQTQDFKN<u>HSLPLARI
KKIMKADEDVRMISAEAPVVFAKACEMFILELTLRSWIHTEENKRRTLQKNDIAAAIS
RTDVFDFLVDIIPRDELKEEGLGVTKATIPVVGSPADIPYYYVPPQHPMGHPSTIMGKP
ADQAALYAAQQPQPPVSFMPWPHAQSQQTQDDQQTNS</u>

Figure 766: Amino Acid sequence of SEQ ID NO: 2039. The conserved transcription factor CBF/NF-Y/archaeal histone family domain is underlined and the CBF-A/NF-YB subunit signature is in bold.

MVDKSGSNSDREGDNKYNFSGGAATSASNEEASSLREQD<u>RLLPIANVGRIMKQILPP
NAKISKEAKETMQECVSEFISFVTGEASDKCHKEKRKTVNGDDIVWALGSLGFDDY
AEPLKRYLNRYREVEGERASQNKVTGGESRNEKNLYGDESPEKQLGAASSSPLKFFD
VADRSTNGSFSKRY</u>

Figure 767: Amino Acid sequence of SEQ ID NO: 2040. The conserved CCAAT-binding transcription factor, subunit B, domain is underlined.

MPIRIQNLPKKNFDQGSSLSMPHVGVTYPPWWSLNEQQLPQSLPKNSGLKAESPPML
HHQAKHLGLQLQEQESSSTQSAGNSCHEVSVVGGANSQDQSISSESGQDESCGRSFE
GQTKPIFMFNNPEIVFNSSLADQNQPLIRVPYPPVDPYYGGLLTAYRPQAIIQSQVGSQ
MFGMAPGRVPLPLNLAD<u>DGPIYVNAKQYHGILRRRQSRAKMEAQNKLVKARKPYL
HESRHLHALNRVRGSGGRFLSTKQRQQLDSASSSHSPFATGPRDRNKDAYEPETHQV</u>
GASERQFTSTMAGADFYPDSRFSGISTHMGGAMQCNKGLMRSGAAQHCSSSVR

Figure 768: Amino Acid sequence of SEQ ID NO: 2041. The conserved CCAAT-binding transcription factor, subunit B, domain is underlined.

MTFKEHEMIHNNPNTQSSSLSFAPWLVLHGSQTPQSESVGRLNSVEHHASEEFHPLSK
KATQAVEGSADRPDMTQFAIFSEESKFSIDWRKPQLTMSALPEYGSNFHSEFGPPMM
YSKYSNVDQISGLFPLYGAQCQGRIMLPLNLTAE<u>DGPRYVNAKQYQRILTRLKCRAK
KKLENFGRARKPYMHKSRHLHAMRRPRGSGGRFLNTKALKNATEVNMKKTGSDG</u>
MSPCPTSPQSSEVLQPESRGLNASKVGDNNRTNLTGSEVASLYSPHRLLNNHVRPCV
HPHLHVDNGGHDMVMPGKWAPAADSCHDLKVV

Figure 769: Amino Acid sequence of SEQ ID NO: 2042. The conserved transcription factor CBF/NF-Y/archaeal histone is underlined.

MRKKLD<u>TRFPAARIKKIMQADEDVGKIALAVPVLVSKALELFLQDLCDRTYEITLQR
GAKTMNSLHLKHCVQSYNVFDFLREIVSRVPDYGHGHGHSDAVSEDRTVSRRRKAT</u>
IDDGNDTDEESKKSRMLEMAHTGSSGRGRGRGRGRGRGRGGRATERETAHHETESS
EPTTSLQPVNKNIVNQGTVSDHSSEPKKTAEETITATDGSKLGAHGFDLNTQVTENEG
TPAKVPVAGVSSEEPNVDEAKHEEYPGWSLSEVDKMSIDPLQLANLGTRIDEDDEDY
DEEG

Figure 770: Amino Acid sequence of SEQ ID NO: 2043. The conserved Myb DNA-binding domain is underlined and the response regulator receiver domain is in bold.

MTVEDGGNDRFPVGMRVLAVDDDPTCLKVLENLLRSCQYQVTTTNQAIMALKM
**LRENRDKFDLVISDVNMPDMDGFKLLELVGLEMDLPVIMLSAYGDPKLVMKGI
THGACDYLLKPVRMEELKNIWQHVIRRKTSNSKNQSQLPNQDKDNGESGQGAQ**
GAQTTANPDGKLNKRRKDQNEEEEEDGEDNENENEDPSSQKKP<u>RVVWSVDLHRK
FVSAVNQLGLEKAVPKKILDLMNVEGLTRENVASHLQKYRLYLKRISNVQQANMV</u>
AAFGAKDPSYMRMTALNGFGDFRTLAGSGRFSGTSLYPQGIMLGRLNSPVGLGLQGI
AASGPIQPSHLQNVSKSINSLGKLQPNPPPANQNTSLLQPNHGKPGPHIRDITKFDNPT
ALKVSPIADNRVTASSSSNLSQSVPSSHLLLQGNPQQSRSGDEFGIQSSFGAVSLQSET
LNVGAIGGCNFIDKSRCNENWHGAVQLPQLPSANPTPLTVPFNCSQVAPTNMTEKFT
LPSPFIHNGPNNISSSPVPSALGDSRGDMQCQAGLLGNVIQNVDFTSSKSKWEDHNQ
NYQHQFNHGFGTFDSVVPANGDMEPLIQNMGSASSLRGGSVDAPFAVQSNSGNAPL
YQQAEVGKSASMEANMRSFENYLLGQTKFPDGFMPNGFESLDELMDGMIKQEHNE
AVLTNGDFSLGTYPVGSCM

Figure 771: Amino Acid sequence of SEQ ID NO: 2044. The conserved response regulator receiver domain is underlined.

MDCLELNLNKEIGDGTSGGGGVGGSVGKNANKSGGGEGFIDRSKV<u>RILLCDNDTKS</u>
<u>SEEVLTLLLKCSYQVMSAQDEVSIVVKCLRLGAADYLVKPLRTNELL</u>NLWTHMWR
RRRMLGLVEKNILSYDFDLIGSDPSDNNTNSTTLLSDDTDDKSRKNTNPEIGLSATHE
DESAAVAEPPLRGAVNCRPNVPGISDRRTGPCSSGPKKSELKVGESSAFFTYVKSTIV
KNTPSTAGQVDGCASVNYRMEEKNQAEDEQAVYDPQAHENGEVWEKSSLGDEFPS
GSSVPDSLSLERSCTPPGSADFPQQRNFMEERAPQMPIHATNEPRVDLPGLPAQSTYP
YYVPGVVNPVMVHSSAQAYQNNLHDLQNHPTSAMLPQYSHLPHFPTHVNGMASFP
YYPVGLCLQQGLMSSPHSWPSFGGSSISEAKTNKVDRREAALLKFRQKRKERCFDKK
IRYVNRKRLAERRPRVRGQFVRKVNGVNVDLNGQPESADYDEDEAEYEDEDLASRG
STPDAEISGT

Figure 772: Amino Acid sequence of SEQ ID NO: 2045. The conserved response regulator receiver domain is underlined.

MPIVQMTNNRPGTEGLAEQNHHKNDDNKDIRDGVRGDGQELAEEDELQIYGDVEG
ASDRKVEATEPQDFVHAHSVIPRSQQQSEEPSVHWERFLPLRSLKVLLVENDDSTRQ
VVGALLRNCGYEVTAAANGLQAWKILEDLTNRIDLVLTEVVMPCVTGIGLLCKIMS
HKTWKNVPVIMMSSHDSMNIVFQCLSKGAVDFLVKPIRKNELKNLWQHVWRKCHS
SSGSGSESGIRTQKSTKSKSCEDSDNNMGSNDEDDSESIGVRDGSDNGSGTQSSWTK
RAVEIDSPRKASSWEQLADPPDSTCAQVIHARPDTRSSNWVPMTAMRNAKGKYDEL
DKDMMGKDLEIGAPDLQIEEPSKNDKITADPTANEIAEIEYQKNDEQLGDKQLELNG
EKLNAKTGAVTSSSNPPMERVNFDIANGSSKMSDMKDKAAYDIKEMPSLELSLKRM
KDDVESKSHDKKILRHSDLSAFSRYNSSTPNQTPTGNVSSCSPADNSSEVDKTEYVQ
NFQSNSSSPQLNQGSNGSSNYNDVGSTTNNAFMKLENVTDKPPSKSILKYLHQSSAF
QPVQHGGACPQPTVQGKVDPAMAHVIMTQARGVKHRVQVQHHHHHYHLHHHHH
AQNVTQMQEPAEDHDNASKSTAAAAPQCGSSNILSTPYEGIVTNNSCNGSASGSNHA
SNGQNGGNFPTNDQETNVDGDNTIPCESGANGGIGYTNRNGVEQSRNAQREAALNK
FRQKRKERCFEKKVRYHSRKKLAEQRPRVRGQFVRQAVNEIKDEEADS

Figure 773: Amino Acid sequence of SEQ ID NO: 2046. The conserved SHAQKYF class Myb-like DNA-binding domain is underlined.

MSESDDLRHGRGGGSGDGELDGEDSVAEWEFGLPSCDDLAPLSQALIPPDLASAFSI
ALRPSRTAGDVNRASRSTLTGLRRCGSTASSQGFSTNDNFKSFVDDRQSMEVEVEEE
EKEEEEEEEEDGADKSDSRKSRRIETAEEVDSTPRMDDSQEDPSEKTSK<u>RPRLVWTP</u>
<u>QLHKRFVDVVAHLGIKNAVPKTIMQLMNVEGLTRENVASHLQKYRVYLRRMQGMS</u>
SEGLSSSDQLFTSTPVVHSLNYVAGSTGHGDGQMPMPTPVPYGEQPPMMPMPVYAM
GHGYGHMRMQIGDLSGFESNQYVTQQRDWSSNKYGSVASYQQTASNEKRF

Figure 774: Amino Acid sequence of SEQ ID NO: 2047. The conserved Myb DNA-binding domain is underlined and the response regulator receiver domain is in bold.

MMESSKGFSSPRSNGFPAGLRVLVVDDDPTWLKILEKMLKKCSYEVTTCGLARD
ALKLLRERKGGYDIVISDVNMPDMDGFKLLELVGLEMDLPVIMMSVDGETSRV
KKGVQHGACDYLLKPIRMKELRNIWQHVFRKRIHEIKDIESHDGLEDLQVTKSGY
DWVDDGHFFSGEDMLTPGKKRKDLENKHDEKDLTDPSSSTKKARVVWSVDLHQKF
VRAVNQIGYDKVGPKKILDLMNVPWLTRENVASHLQKYRLYLSRLQKENDMRSSY
GGMKHSDLNPQDAARASSHQNSINFQQNDATNGNSKFAGNNLLIQNLNSKNNEIDT
RGTIITEQSGPGISHSLPPLEQEMKFTAFDGITPRSYPWREVPEIQFHQENAGNQPEDCF
GHVAGPIGGLQNHVQVDELLPITSISSRAQLPNPIETKPLNVDYAINSFTQASPVKTRI
DSFPLPTKSHMGNQQAIQPPSINTPIMESQGFNPSCITDLESSRRNFSSTPTESPFTSPDE
ILQVGWLQDYSTCLGLQNIEFPDFGDPTIIPGVPVHLYTALKFDYDQPSDQSELPVINQ
GLFIA

Figure 775: Amino Acid sequence of SEQ ID NO: 2049. The conserved SHAQKYF SEQ ID NO: 3671) class Myb-like DNA-binding domain is underlined.

MELSLDLSLAREPRPVSEFFREVSGIPDRDERLSKLDDYVARLEEEMGKIDPFKRELPL
CMLVLNDAMERLKEERLQCKEMEFIRPNRNSDKDKRAEVENKDSCDQRKWMSSPD
QNLDQYAAEKNPIEPCSYKKKGGAFLPFGLHRAPPKEGKDSSPISRLTLSTPGSMLAS
PDNDNIKKLSFEAPFSTDHEKLQKSPQQAQQHRLQQHQLRKQRRCWSPELHRRFVE
ALEQLGGAQVATPKQIRELMQVEGLTNDEVKSHLQKYRLHVRRIPSPSAAVENGLSL
VQERSGVDHSELRTSESDSPQGPLLACASARAASSAGGGSAEMTDEEENSEGHSWIT
VLGEKITAH

Figure 776: Amino Acid sequence of SEQ ID NO: 2050. The response regulator receiver domain is underlined.

MPIVQMTNNRPGTEGLAEQNHHKNDDNKDIRDGIRGDGQELAEEDELQIYGDVEGA
SDRKVEATEPQDFVHAHSVIPRSQQQSEEPSVHWERFLPLRSLKVLLVENDDSTRQV
VGALLRNCGYEVTAAANGLQAWKILEDLTNRIDLVLTEVVMPCVTGIGLLCKIMSH
KTWKNVPVIMMSSHDSMNIVFQCLSKGAVDFLVKPIRKNELKNLWQHVWRKCHSS
SGSGSESGIRTQKSTKSKSCEDSDNNTGSNDEDDSESIGVRDGSDNGSGTQSSWTKRA
VEIDSPRKASSWEQLADPPDSTCAQVIHARPDTRSSNWVPMTAMRNAKGKYDELDM
MGKDLEIGAPDLQIEEPSKNDKITADPTANEIAEIEYQKNDEQLGDKQLELNSEKLNA
KAGAVTSSSNPPMERVNFDIANGSSKMSDMKDKAAYDIKEMPSLELSLKRMKDDVE
SKSHDKKILRHSDLSAFSRYNSSTPNQTPTGNVSSCSPADNSSEVDKTEYVQNFQSNS
SSPQLNQGSNGSSNYNDVGSTTNNAFMKLENVTDKPPSKSILKYLHQSSAFQPVQHG
GACPQPTVQGKVDPAMAHVIMTQARGVKHRVQVQHHHHHYHLHHHHHAQNVTQ
MQEPAEDHDNASKSTAAAAPQCGSSNILSTPYEGIVTNNSCNGSASGSNHASNGQNG
GNFPTNDQETNVDGDNTIPCESGANGGIGYTNRNGVEQSRNAQREAALNKFRQKRK
ERCFEKKVRYHSRKKLAEQRPRVRGQFVRQAVNEIKDEEADS

Figure 777: Amino Acid sequence of SEQ ID NO: 2051. The conserved SHAQKYF SEQ ID NO: 3671) class Myb-like DNA-binding domain is underlined.

MGSCGRSGTVRQYVRSKV<u>PRLRWTPELHQCFVHAIQRLGGQDKATPKLVLQLMDV
RGLTISHVKSHLQMYRSMR</u>SDLGRSDRGCGQQKRRAAEDDDPDRDGGCVEEVNDD
EGPPHAFAKPVHHSRFACSSPPCKRSRTEKVATTTTTTSAVAEQAPYGFEVGGVDGF
RWHTPCMPRDLHSFNDPLECAAKEESKFPLIAKLQDRMQMPRKGLKLTDWRSFPLE
EYEVSQGCELSLSLSLQCHSIHRSNGSSTSEISEAFSSCSRSRECSGPCSDKSSVNLDLSI
ALCGS

Figure 778: Amino Acid sequence of SEQ ID NO: 2052. The conserved response regulator receiver domain is underlined.

MELTSDVEDTQQQQQLPEGGGGDKKQEEEVGQH<u>FHVLAVDDSHVERKLLERLLKD
SSYEVTCVDSGDKALRYLGLLDDHTNLHAQDGFDNSSAAASASSSLLQPSLQEGTKV
NLIMTDFCMPGMSGYDLLRRVKGSYWKDVPVVVMSSENVPSRINRCLEGGADEFLL
KPVQLSDLEKLQPYILKSLNNPC</u>EDIKGDGIDDSEDDEIETRNYGEDNTNKCNSNTNN
VAKRKAMSAEPTDRRPKIKGLAVVYNKNQELIG

Figure 779: Amino Acid sequence of SEQ ID NO: 2053. The conserved GRAS family domain is underlined.

MFMDPQYAGYSGPFSGFNFHDQTLAPFSNPYEELANHLLLDDPESDLSVHFPSFASDP
EPCNSAVSPSFSVDGDFLSDYGDTSDPTLKYINQMLMEEDIDDKPCMFHDPLALQAA
EKSLYDALCPKDRPSQNQSPLYMDSPDDNCSGSSNGYCGSSTITSSTASGGNSVDFPG
TGDYCESRPSIFQPHIPENFVFQATAIPSRQSGHEFRKNVITKAKGMLGSGSAMGEFM
LPNLFADSNSMLFFQKGFEEASRFIPKGNPLSIDTEKRMPHLVSKRETARAAVKAENS
EPELSYLYEIKGNKKHEREDAEFEYQRSTKQPAVCVEENELADIFDRVLLCAPTGNKP
DSKSPGSRFEDASNNGASQNVQK<u>NLQSPALSAEQLCVKKPMSDKKEVVDLRNLLCS
CAQAVAVEDRKNANQYLKQIRQHSSPFGDGSQRLAHSFAEALKARMDCTGAQVYT
ELGSKRKSATEMLKAYRAYLSVFPFQRFAIIYSNHMILSISEKATKLHIIDFGILYGFQ
WPALIHCLARRPGGPPKLRITGIELPQSGFRPAERVQETGRRLAKYCERFKVPFEYNAI
AQKWETIRIEDLKISKDEVVAVNCLFRFKNLLDETVIINSPRDQVLKLVHRIRPRIFVH
SILNGSFNACFFVSRFREVLFHYSALFDAFDAKLPREHPMRLVFEREFFSREALNVIAC</u>
EGTERVERPETYKQWQIRNTRAGFKPLPLDPVIMKKLKSKLKEGYLDDFVVDKDGQ
WMLQGWKGRILYASSCWEPV

Figure 780: Amino Acid sequence of SEQ ID NO: 2054. The conserved GRAS family domain is underlined.

MSSGFSGGSGGGGPEFYTAAGGMSARSIASAMSSVNGNAASQSPFRSQPQFGAGIFL
EPNSQMAPQPAQPQPGLVGKRTLMEFQAQQQQQQHQHQHQHNQALSNLILRSVRS
KISPRSSPISHLDFSAAVSSPDVMSSLSALSSPAGFSAQRYGLPILQQLRPQPIHLGNGA
IHVSNQALGGVSFANVLQNRANPHQAEPENKMMNRLQELEKQLLDDDEEGDGDAV
SVITNANSEWSETIQSLISPGQKQISPSPTSSSSSSSPSSSLSVPSPVPICSRQSLMEAATA
IYEGRVDVASEILTRLSAVPNPKGNSEPKLMEYMLSALKSRVSPADNPPPVAELFTKD
HVSSTQSLYELSPCFKLGFMAANLMILEAASEQPSTNKLHVIDFDVGQEGQYINLLHA
LSTRQPGIPSILKITTLADGFNGEERLRMVRDRLSELAAQIGVRLVFNIVSQKVSELSR
DSLGCEPDEVLAVNLAFKLYRMPDESVSMENPRDELLRRVKGLAPRVVTLVEQEMN
GNTAPFATRAGEALGYYGALLESLESTVPRDSSDRGRAEEGLSRKLGNSVACEGRDR
VERCEVFGKWRARMGMAGFELKPLGQHVAESMKARLESGNRVNPGFTVKEENGG
VCFGWLGRTLTVASAWR

Figure 781: Amino Acid sequence of SEQ ID NO: 2055. The conserved GRAS family domain is underlined.

MESHPLYRYSETGAGLSFTSSHPTVPSLPNRLFGHSKFEIRESPISPFSTNFDCETLTVL
SDNQEQYSSTDNYSGVSSSYNSSLETTSGFQRSSPSQDGCRDSLLSCSGRPTSLQNEH
HSQNTAYTLQELEDVLMDDGQEVRVTDTSIGEHVWDQNPRGSQFSCPEDSVAFIQSQ
SGKSVHAEKHKEAIEELLVQDVPPGDLKQLLIACAKSLSDNDMHKFEKLIEKARRAV
SISGEPIQRLGAYMIEGLVARKEESGSNIYHTLRCREPEGKDLLSYMHILYEICPYLKF
GYMAANGAIAEACKNEDRIHIIDFQIAQGTQWTTLLQALAARPSGPPYVRITGIDDPV
NRYARGAGLEAVAGRLAVISEKFKIPVEFNGLPEFAPDVTRDMLDVRPGEALAVNFP
LQLHHTPDESVDITNPRDGLLRMVKSLSPKVITLIEQESNTNTTPFLTRFVETLDYYLA
MFESIDVTLPRDRKERINVEQHCLARDIVNIIACEGKERVERHELFGKWKSRLTMAGF
RQYPLSSYVNSVIRNLLRYYSENYTLVEKDGGMLLGWKDRFLVSASAWY

Figure 782: Amino Acid sequence of SEQ ID NO: 2056. The conserved GRAS family domain is underlined.

MPSFQKQHSSASVLSFYQQPPQMIEPRYLSNYEQIDGGMNRGLAGQGFDSSFQNYDE
QIFTLDSSTSASGLASYDSGSNISTSPDGTPFVKSFHSDQHLSVENVSGSPLSVSSITDY
GNDELRDKLRELEMSLLGPESDIRDYQSSCFKNSSHNIFPTSMWHSSRVRDMMPKPD
LKQVVIACARAISDADTSSAAALMDMLEQMVSVMGDPIQRLGAYLLEGLRAKLKFS
GSIIYRKLKCEEPTSSELLTNMQVLYQICPYWKFAYVSTNVIITKAMENEQRIHIVDFQ
ITQGSQWVTFIQALAQRPGGPPLLRITGIDDSDSVHARGAGLEIVGQKLSEIAESCNVP
FEFHDAAVSLSEVELQNLMIRPGDALAVNCPYILHHIPDESVSTQNHRDRVLRLIKSL
SPRVVTLVEQESNTNTSSFFPRFIETFDYYKAMFESIDVARPRNDKQRISAEQNCVAR
DIVNMVACDGPERMERHELFGKWRSRFQMAGFNQLPVDASVTRAVLDMLKQYHG
NYRIEEREGALYLGWINRAMSTLSVWR

Figure 783: Amino Acid sequence of SEQ ID NO: 2057. The conserved GRAS family domain is underlined.

MESNFTGFTHAADDFETNSLAHPANSDHPSNLLDGFDINNLYVDFNSTEITSLLYQTE
PAYDNPSAAVNLDGDFDFPSTDVSSKDASLQHSTISNGSPSQGGESFSPPSDYSNSTDP
VLRYIHQMLEEENVEEQPWISPDDFALQDTEKSLYDLLSENSTFSPEPAVQFDINQFID
SPSSNSYENSSDQGGDGTTDTRTNCSQFSGPNSPDNPEGKNQAVLQGPYPGNGVLPS
NMGTSSQLHTNPMSSLQHQDEFSDSFPSDLLVSNMFSNSNSILQFNKGLEEARKFLPS
SIQLTINQEDYKSAPNVREPGENGTDDGKSVKSRSESGSWGRKNHERDDESFEEGRA
NKQSASYTEDGELSEMLDKVLLGCGLGGQMSGCTPENM<u>SQSKGPPGPKGGRVRRK
KGNKSTADLRSLLILCAQAVSANDFRTAYELLKQIRQDSSASGDGSQRLAHYFANGL
EARLAGSAGDRQTFFYSSELQKRTVADKLKAYQLHLSACPFKKLPILFANVVLLKIA
ATAKVLHIIDFGISFGFQWPILIQELSKRDGGPPELRITGIEIPQSGFRPAERIEETGRRLA
KYCERFKVPFEFHAIPSRNWECIRVEDLKIQSGEIVAVNCLSRFKNLYDETVEVDCPR
DAVLRLIRSIKPDVFVHGISNGSYNAPFFLTRFREALFHLSAIYDMLDATVPSDNDQR
VVVEREFYGREIMNVVACEGLERIERPETYKQWQVRVARAGFTQLPLDQEVMEMA
RTKMSRHYPKDFVLAEESKWMLLGWRGRIISACTCWV</u>PI

Figure 784: Amino Acid sequence of SEQ ID NO: 2058. The conserved GRAS family domain is underlined.

MDRPPDKLDNFIDGYVLVDGDDAAFSILREDDLVSELTIDDTFNDFTYSCTCAPHLG
ADLGKEPAEDYDFSDAALKYINQMLMEEDIEEKSVACHEASAIEAAEKSFYEVIGER
YPPAADQHPSPNQTNESSCGGSDSVIKLVESEPNYESEEHTVLTTVSQSISSSVAQSLD
DVRVGISTAGHAESPVNAISLSELIGSESVMQFKGNSEETRESLAFGNEILVDPERGEF
SFNEQTEEPTSLVPNEETDENMFANLGGNRGKKNPLQEDVNLEVGRMSKYLSVYTE
STVRSEIFDMVLLNPKESEATLREALRNMMQNGKSKVPNEGKAHGKKQGRRKRDV
<u>VDLRTLLTLCAQAVTMDDRGSAGELLKQIRRHASPTGDGMQRMAHYFANGLQARL
AGSGSQIFKALMARPRSAVDVLKAYHLLLTICPFMKLSHYFSNKTILNVAREAPKLHI
IDFGILYGFQWPGLIERLSSSPSGPPELRITLIDLPQPGFKPDEIVEETGRRLVSYAKTFN
VPFKFNTIVKGWDAIKVEELNIHSDEILVVNCIHRFHNILDDTVLAESPRDVVLNLIKK
MNPDVFIQAVVNGNHGVPFFVSRFREALFHFSAVFDILEATVPRDDPERLLLEQEILG
KQAMNVIACEGSDRIERPETYKSSHVRNLRAGFRQLPLDKDVVSLAKDKLKSCYHK
DFEIEEDGQWLLQGWKGRIIYALSTWRPDC</u>

Figure 785: Amino Acid sequence of SEQ ID NO: 2059. The conserved GRAS family domain is underlined.

MELHQLFGCGLTDAGLWCSSSHPAVTSISNRSLKSLKFDIGSSPCLPFSSQVESEALPP
PRDIREQQSSAENLSISGASRNHTLETNSSLVCSKSDFCVDPLSDRLTSCSDLTSLSGSL
NSSPRMKFAAKELEATFNDVVTSPYVSYWKGSIPLVQGQKPNRRSQECYRLRSIQPQ
ASVASRHSQFNELEKWHKAIDELLVRSPPEDKTRHLLIECAKALSENDTEKFDKLIKK
AWNAASIHGGQVWHLGSYLVEGLMARRKSLGTTVFHVPKCEEPQSKDWLTYMHV
LYEICPYLKFGYMAANGAIADACRDADRIHIIDFQIAQGTQWVTLLQALAARPGGAP
RVRITGIDDPVLRYTRRVGSEEVGRMLAVVSEQFKIPVEFRGLSVSSPDVTRDMLDIR
PGEALAVNFPLQLYRTPDESVDTNNPRDGLLRMVKSLSPKVITLIEQESNTNTSPFLSR
FVETLDYYSAMFESIDMALPRDGNDQIDPVRHCLKRDIINIIACEGKERVGRHELFGK
WRSRLQMAGFSQYPLNAHVNSVIGTLLRRYSENFTAEEKEGAMLLGWKQRSLISVS
AWH

Figure 786: Amino Acid sequence of SEQ ID NO: 2060. The conserved GRAS family domain is underlined.

MSLIRSTELSATPYASSEMLGSKKHQMMYVSETYSGEDYDPKYFIDSPSEETINPSSY
GMSRNLYHTQGSSINTENPFSTSESELMDGQSLDCVEYTEDKMRLKLQELERALLDD
GADEEEDNMYVDGQWVDQLQINSHDSPKESSSSDSNLSSISTNREVSQPPSRTPKQLL
LDCATAISEGNIREASIIIDRVRQIVSIQGDPPQRIAAYMVEGLAARMGASGKFLYKAL
KCKEPPSSDRLAAMQILFEVCPCFRFGFMAANGAIIEAFRGEKRVHIVDFDISQGSQYI
TLLQTLASLPGQRPYLRLTGVDDPESVQRPIGGLKNIGQRLEKLAEALNIPFEFRAVAS
RTPLVTPGMLDLQPREALVVNFAFQLHHMPDESVSMINERDQLLRMVKSLNPKLVT
VVEQNVNTNTAPFLVRFGEAYSYYSAVFDSLDATLPRESQDRVNVERQCLARDIINV
VACEGEERIERYEVAGKWRARMMMAGFASCPMSKSVTESIINLIRQYSERYKIKDD
MGALHFGWEEKSLIVASAWR

Figure 787: Amino Acid sequence of SEQ ID NO: 2061. The conserved GRAS family domain is underlined.

MIMEPRVTRFSGSLSAFKLDDETLLPFSDQRANFANGFDRAGPSPDLGFAHKPFFPSD
PRYCDSAPSSLVSAEADLPSDDSDFSETVFRYINHMLLEEDMEENPSTFHDPLALQAA
EKSLYEALSDPYPSEANSSPPFMDSPDNNYSGNSSDYGKSSPSSNTSGSNFADHQWL
GDLGDGRNNLPRSSVTGDFIFQSTVNAHVQPSFSSRNSFLSNGNRTKASLGSGPLFLN
FSTESQSVLQFQRGVEEASKFLPQGTQLFIDLEKSSVNSWFKERKSLNVVKVEKDESD
LLPLNGISGKKNHQREDSEFEDERSNKQTAVYVDDTELSEMMDKLLVCHIKGKSRDS
NADESSKKEVSKSLQQNRQTHTADGGKFHNKKPTPTSNMTEMVDLRTLLILCAQAV
SSDDRRTANDYLRQIRQHASPSGDGSQRLAHYFANGLEARLEGTGSQVYAALGSKK
TSAVDLLKAYHVYRTAFPFQRVANMFVGDMIMHLAEKATTLHIIDFGISNGFQWPAF
ISRLSRRTGGPPKLRITGIELPQRGFRPAEKVQETGRHLAQFCKRFNVPFEYNAIAQK
WDTIKIGDIKIRNGETIVVNTMFRFKNLLDETVVLNNPRDSVLNLIRKIRPHLFVQAIV
NGSFGAPFFVTRFREALFHYSALFDAFDTNLGRDNQMRLLYEKEFFGREAINVIACEG
TERVERPETYKQWQIRNMRAGFKQLPLGPAVMKRLRSKLEQFHDDFVVDEDGQWM
LQGWKGRILFASSWWVPI

Figure 788: Amino Acid sequence of SEQ ID NO: 2062. The conserved GRAS family domain is underlined.

MIMEPRVTRFSGSLSAFKLDDETLLPFSDQRANFANGFDRAGPSPDLGFAHKPFFPSD
PRYCDSAPSSLVSAEADLPSDDSDFSETVFRYINHMLLEEDMEENPSTFHDPLALQAA
EKSLYEALSEPYPSEANSSPPFMDSPDNNYSGNSSDYGKSSPSSNTSGSNFADHQWLG
DLGDGRNNLPRSSVTGDFIFQSTVNAHVQPSFSSRNSFLSNGNRTKASLGSGPLFLNF
STESQSVLQFQRGVEEASKFLPQGTQLFIDLEKSSVNSWFKERKSLNVVKVEKDESDL
LPLNGISGKKNHQREDSEFEDERSNKQTAVYVDDTELSEMMDKLLVCHIKGKSRDS
NADESSKKEVSKSLQQNRQTHTADGGKFHNKKPTPTSNMTEMVDLRTLLILCAQAV
SSDDRRTANDYLRQIRQHASPSGDGSQRLAHYFANGLEARLEGTGSQVYAALGSKK
TSAVDLLKAYHVYRTAFPFQRVANMFVGDMIMHLAEKATTLHIIDFGISNGFQWPAF
ISRLSRRTGGPPKLRITGIELPQRGFRPAEKVQETGRHLAQFCKRFNVPFEYNAIAQK
WDTIKIGDIKIRNGETIVVNTMFRFKNLLDETVVLNNPRDSVLNLIRKIRPHLFVQAIV
NGSFGAPFFVTRFREALFHYSALFDAFDTNLGRDNQMRLLYEKEFFGREAINVIACEG
TERVERPETYKQWQIRNMRAGFKQLPLGPAVMKRLRSKLGAVP

Figure 789: Amino Acid sequence of SEQ ID NO: 2063. The conserved GRAS family domain is underlined.

MQTSHNRQNSASIHGLYHQPVQDIDPYCSSNFQIMENNVSPDIGSQGTNFSIQGYDGQ
YFTLDSAPAVSSFGSYDSPSAVSVASNRSPFSTQGSHSYVSDAQHSSDYLYGSPISGSS
VANGGPQMWDKLRELENSLLGPESDISDSCNCCLNSGSHQFPSTGQWNVNQMIEMIP
KLDLKDMLIFCAQAVAEADMPKTAALMEVLERMVSVSGDPIQRLGAYLLEGLRARL
ESSGSIIYRKLKCKEPTGSELMSYMSILYQICPYWKFAYESANVVIGEAIKYESRIHIID
FQIAQGSQWIPIIQGLAGRTGGPPLIRITGVDDSQSAHARGGGLDIVGKRLEKVAELC
GVPFEFHAAAMCGSQVEREDLRVRPGEAIAVNFPFVLHHMPDESVSTDNHRDRLLR
LVKSLSPKVVTLVEQESKTNTSPFYTRFIETLDYYTAMFESIDVACRRDDKQRISAEQ
HCVARDIVNMIACEETERVERHELLGKWRSRFRMAGFQQFPLSSAVTDAVRNLLRE
YNENYRIEEKDGALYLWWRNRAMATSSAWW

Figure 790: Amino Acid sequence of SEQ ID NO: 2064. The conserved GRAS family domain is underlined.

MDPLFFDSSACIKVDDRPIDSHAFSPSPDRYPSLTDGFFLDDPFLDLKSSDSAFLSNKV
DPANDLSSKSIDLGIGDLMFPSTSGISDGGPFGPSLSLRSALPPLGDTDSSDPVLKYISQ
MLLEENMEEQPWEFADQVALQNAEKSLYNALGQQHSEVSDQSPSQLDLSHYIKSPT
SSLSGSSSACGSRDATSVTVSSSDSAVANILYTIKEHNHAVQENSDLDFQSNVDSSSR
LLSNSSSSITNYDDGSEESLHELLVKSIFSDSESMVQLKKGLEEASKFLPTNSQLGINPE
DSKPPLETEKGTPRMLINEEINVRCLSDGFKGFRNHERDEDAFEEGRANKQTALYTEE
SEFSDLFDRVLLCNENGEAMCSGDKSVETGLSKDI<u>RPQRKKRGSNRGRGRGKKQGS
ENTVDLSTLLILCAQAISTSDFRTANKLLKQIRENSSPSGDGSQRLAHYFANGLEARL
VGNETQTQHFYSSLVARTTSAADILKAYHLHISTCPFVKLSICFGNYMILRLAEKATT
LHIIDFGIGFGFQWPILIQKLSSRSEGPCKLRITGIELPQAGFRPSERLEETGCRLERYCE
RFNVPFEFNCIASKNWESIKLEDLKIQSNETVAVNSSSRFGNLLDETVGDNCPRDAVL
NLIWQIKPDIFVHVVSNGYHNAPFFVTRFRKALFHLSAVYDMFDAILDGDSNERLVIE
REFHGREIMNVVACEGSERVQRPETYKQWQVRHIRAGFKAIPLDQELMTLFRGKMK
ECYHKDFVFNDDGYWMLQGWRGRILYGASCWVPT</u>

Figure 791: Amino Acid sequence of SEQ ID NO: 2065. The conserved HMG1/2 (high mobility group) boxes are underlined.

MKGGKAKAETTRVDASLKRKGAGTQRAGKKTAKKEKAVKDPNK<u>PKRPASAFFIFM
EDFRVQYKQKHPNNKSVAAVGKAGGDKWKSMSEAEKAPFAAKAEKRKDEYNKK
MNAYNKKS</u>AEGTNGADDEESDKSKSEVNDEDDEDGDDSAEVSARCCRWFK

Figure 792: Amino Acid sequence of SEQ ID NO: 2066. The conserved HMG1/2 (high mobility group) box family domain is underlined.

MKTTKGKGPARSSREALKPADDRMVGKRKAAARPESKRKVKKDKQAKKDPN<u>KPK
RPPSAFFVFLEEFRKTFKKENPNIKAVSAVGKAGGEKWKSMSQAEKAPYEAKAAKK
KTEYEKLMNAYNKK</u>QESVDEDGDEESERSKSEVNDEDEASAEEAQEDEEEEEDDD
DDDDED

Figure 793: Amino Acid sequence of SEQ ID NO: 2067. The conserved homeobox domain is underlined and the lipid-binding START family domain is in bold.

MMAVTSACKDKMGI<u>DNGKYVRYTPEQVEALERLYHECPKPSSLRRQQLIRECPILSN
IEPKQIKVWFQNRRCREKQRKEASRLQAVNRKLTAMNKLLMEENDRLQKQVSQLV</u>
YENSYFRQQTQNATLATTDTSCESVVTSGQHHLTPQHPPRDASPAGLLSIAEETLTE
**FLSKATGTAVEWVQLPGMKPGPDSIGIIAISHGCTGVAARACGLVGLEPSRVAEI
LKDRPSWYRDCRAVDVANVLSSGNGGTVELLYMQLYAPTTLAPARDFWLLRY
TSVMEDGSLVVCERSINNTQNGPSMPPVQHFVRAEMLPSGYLIRPCEGGGSIIHI
VDHMDLEPWSVPEVLRPLYESSTLLAQRTTMAALRNLRQISQEVSQPNVTGWGR
RPAALRALRHRLSKGFNEAVNGFMDDGWSMLESDGVDDVTLLINSSPAKMAGVNIS
YASGFPSMTSAVLCAKASMLLQNVPPAILLRFLREHRSEWADSSIDAYSAAAIKASPC
NMPGTRIGGFGSQVILPLAHTIEHEEFMEVVKLENMGHYRDDMIMPSDIFLLQLCNG
VDENAVGTCAELIFAPIDASFSDDAPIIPSGFRIIPLDPGSDASSPNRTLDLASALDVGPT
GNKAVGDNSGHSGNTKSVMTIAFQFAFELHLQENVASMARQYLRSIIASVQRVALA
LSPTNLGCHASLRPPPGSPEAHTLARWICQSYRSFLGVALLKNEAADSLLKNLWHHS
DAILCCSLRAAPVFTFANQAGLDMLETTLIALQDITLEKIFDDNGRKTLCSEFPQIMQQ
GFMCLQGGICLSSMGRPISYERAVAWKVLNEEETAHCICFMFVNWSFV**

Figure 794: Amino Acid sequence of SEQ ID NO: 2068. The conserved homeobox family domain is underlined with the conserved homeobox domain signature in bold/underline, and the homeobox-associated leucine zipper (HALZ) is in bold.

MGIDDLCNTGLVLSLGLGTPFKIEAQRQAKQRLNFEPSLTLCLSGTTKATRDEQPPAD
HLYRQASPHSHNSLSAVSSFSSPRVKRERDLSSEEAEVETRVSSKASDEDDDGA<u>NAR
KKLRLTKEQSALLEESFKQHSTLNPKQKQALARQLNLRPRQVEVWFQNRRARTKL</u>
<u>KQTEVDCEFLKKCCETLTDENRRLQKELQELKALKLAQPFYMHMP</u>AATLTMCP
SCERIGAGPSVDGAAPTKGPFSMTTKSHLYSHHFTNPSAAC

Figure 795: Amino Acid sequence of SEQ ID NO: 2069. The conserved homeobox domain is underlined,The ELK domain is in italics and the KNOX 1 and 2 domains are in bold.

MEEYGQMNENSSTGSRGNNSFLYASPVLGPSSSGNSNYGRGNSSGGHFYSQSGDHC
FQSEAPPHPVVKTEATTSHHGHAQKFHHYSLVRDHHDPSASHHHHHQHHQHQQLQ
TASESSREV**DAMKAKIIAHPQYSNLLEAYMDCQKVGAPPEVVAKLSVARQEFES
RQRSSVASADGSKDPELDQFMEAYYDMLVKYRDELTRPLQEAMDFMRRIETQL
NLLSNNGPVRVFNSDEKCEGVGSSEEDQDNSGGETELPEIDPRAEDR***ELKNHLLRKYS
GYLSSLKQELS*<u>KKKKKGKLPKEARQKLLSWWELHYKWPYPSETEKVALAESTGLDQ
KQINNWFINHVIECWVKSMATQCKKYF</u>

Figure 796: Amino Acid sequence of SEQ ID NO: 2070. The conserved homeobox domain is underlined with the homeobox domain signature in bold/underline. The homeobox-associated leucine zipper is in bold. The N-terminus of the HD-ZIP protein domain is in italics.

*MGERDDLGLSLSLSFPQSHLHQQQQQQQQQQRQSLQLNLMPSLVPSSASSAQSGFNLQK
RSCNDAFPSSSDRNSEARSFLRGIDVNREPSAGAAADYGEDEAGVSSPNSMASTVSGKRSE
RDHQ*SQTNGDDLDNERASSRGGGSDEEDGDMSRKKLRLSKDQSAVLEESFKEHNTL
NPKQKLALAKQLGLRPRQVEVWFQNRRARTKLKQTEVDCEYLKRCCESLTEEN
RRLQKEVQELRALKLSPQFYMHLSPPTTLTMCPSCERVAAPSPPSAVGRPLAAVPA
HPRPVPLINPWAPAAAPLAHAPFDALRSCS

Figure 797: Amino Acid sequence of SEQ ID NO: 2071. The conserved homeobox domain is underlined with the homeobox domain signature in bold. The lipid-binding START family domain is in bold/italics.

MFQPNMFDSHHHLLDITGARSSESEVLKMREIEDFETKSGTETMEPDPSGDDVQDPN
NDDNSNNNGQRQKRKRYHRHTQRQIQELEAFFKESPHPDDKQRKELSRELGLEPLQ
VKFWFQNKRTQMKAQHERHENAILKAENEKLRAENMRYREALSTATCPNCGGPA
ALGEMSFDEQHLRIENARLKEEIDRISVIASKYVGKPLASNYPHLPPHMSSRSPDQFPA
QSGLVGEMYGGIDLRRSVSMPSEADKPLIV*ELAVAAMEELIRMAQGGEPLWIPAGSG
QPSEILNEDEYFRIFPRGIGPKPLGFKSEASRESAVVIMNHINLVEILMDEHQWSGVF
CGIVSRAMTIEVLSTGVAGNYNGALQVMTAEFQVPSPLVPSRENYFVRYCKQHGDGT
WAVVDVSLDNIRGNPILRSRRRPSGCLIQELPNGYSKVTWVEHVEVDDRAVHSIYRPL
VNCGLAFGAKRWVATLDRQCER*LASSMANNIPSGDLLITSPEGRRSMLKLAERMVLS
FCSGVGASTAHAWTTLSATGSDNNVRVMTRKSMDEPGRPPGIVLSAATSFWLPVPP
KRVFDFLRDENSRNEWDILSNGGQVQEMAHIANGRDPGNSVSLLRVNNANSSQSNM
LILQESCTDSVGAYVIYAPVDIVAMNVVLNGGDPDYVALLPSGFAILPDGPEFCGGG
GILEIGSGGSLLTVAFQILVDTVPSAKLSLGSVATVNNLIKCTVERIKASVSCDNP

Figure 798: Amino Acid sequence of SEQ ID NO: 2072. The conserved homeobox domain is underlined, the ELK domain is in italics and the KNOX 1 and 2 domains are in bold.

MAYNHGQMPQEQVPFHHYSDQGGHHQGRDGVHKFFSASILRPQNFLRLDSEPSAHA
DDASAAAAASYNNDDGAGEEEMVEDDDGGGGGDYES**ARHKAEILSHPLYEQL
LNAHVSCLKIATPVDQLPRIDAQLTQSQRVVAKYSVLGNGGVVDGKELDQFMT
HYVLLLCSFKEQLQQHVRVHAMEAVMACWELEQALQSLTGVSPGEGTGATMS
DDDEDQDDSDAKLFDGSFDGHDSMGFGPLVPTESERSLMERVRQ**ELKHELKQGYKE
KIVDIREEIL*RKRRAGKLPGDTTSLLKAWWQTHSKWPYPTEEDKARLVQETGLQLKQ
INNWFINQRKRNWHSNPSSSTVPKSKRKR

Figure 799: Amino Acid sequence of SEQ ID NO: 2073. The conserved homeobox domain is underlined.

MSTYYTSSSDQRDAAPVLYLREHAPTSHAEEPLLPGNNMTYVTSGFFSSALTGNPQQ
QSNGMDMLSVGGLDTMPQHQAMFSGLGGSQMSDHGLAGWRDGRNEMLFMQPMA
SHSTVQDGQNMQGQGLSLSLGTHIPSGIHIPSSQYRSQNLGLTAFLSPNSSKSAESNSR
NGSTVDEQPRSAEFFPQSLVGANQDLNTGNFSVNGMSNMSRMLSNSRYLRAAQQLL
DEVVNVRKALKQSDSEKIKKSEEGDEDSKKDVVSNPQESDGNSAGDLSQAERQELQ
SKLAKLSSMLDEVDRRYKQYYYQMQIVVSSFDVIAGPGAAKPYTALALQTISRHFRC
LRDAISTQIQATRKSLGEQDASGSSKGVGIPRLRFLDQQLRQQRALQQLGMMQQHA
<u>WRPQRGLPESSVSILRAWLFEHFLHPYPKDSDKILLARQTGLTRSQVSNWFINARVRL
WKPMVEEM</u>YKEEIGDAEMDSNSSSDTAKPKTGDIKSSMEDRVEEVQQSSTATQRCS
SGQLMDSSFDRTPDVEMAGHSVGFNYLNGRHRDVEAEYGQMKLNGEQAGVDDCG
LFQNSMVQSGSNNDRFMAAAAAYQMAELGRFGGGSGVSLTLGLQHCEGGTLPVST
GAHSGFLAMRGDDMYNQAASSIGTETTEFESINIGNQQQRFGSTQLLHDFVA

Figure 800: Amino Acid sequence of SEQ ID NO: 2074. The conserved homeobox domain is underlined.

MEWEKQEQHHPHHHHHPHHHAHQQQHHHQQQQPQQQQQAKEAQQQQGGEGMG
NGTAAGNGGGVLYVKVMTDEQLETLRKQIAVYASICEQLVEMHKNLTAQQDLAGV
RLGNLYCDPLMTTGGHKIT<u>ARQRWTPTPLQLQILERIFNEGNGTPSKQKIKEITTELSQ
HGQISETNVYNWFQNRRARSKRK</u>MQNATGNNTESEAEAEVESPKEMKTKPEIFQSQ
QNPVSRNEDLCFQSPEISSDLHFADSQTKVESMVYPDGSLRSRNRNLGQLSFYDAMM
SNSGGLAGNEHLGGKMEVPGAYGLYHSAEDFGMSG

Figure 801: Amino Acid sequence of SEQ ID NO: 2075. The conserved homeobox family domain is underlined and the PHD zinc finger-like domain is in bold.

MHSRKNLAQKEDFLKAESGSEVLASLILRNRRRKKHKQKLQSSVKARGSTLAKKRA
NNSIRKRLVRRNSSDKDKLINLKAFHNKKIEIVPEKLSSPPSSERELPIASDENVQNTDE
DVKVNKLRRKRKKKMRKHFSKLDEASRLQRRTRYLLIKMKLEQNLIDAYSGEGWK
GQSREKIKPTKELQRARKQILNCKLGIRDAIRQLDSISSVGSIEDSVIAPDGSVHHEHIF
**CAKCKTNETSSDNDIILCDGTCNCAFHQKCLDPPLETESIPPGDQGWFCRLCEC
KMEIIESTNAHLGTHFSLDSNWQDIFEEEAALPDGGIQVLDLDEKWPSDDSEDDDYD**
PEKMTNTGINCAGNDDSQSYDTSSSTSLSWSLDGEILSGPTISGKEGLNYPESIAGSDV
LMDTDTDTVCGPRQRNAVDYKQLYNEMFGKDTPACEQASEDEDWGPNKRRRRERE
TDAASTLMTLCESEKNNPFIDQASEGDKKLSAEARMRRRIFRIPPTAVEKLRQVFAEN
ELPSRSVKENLAKEFGLEPEKVSKWFKNARYMALKTRKAGGADQPPKSPQKHKESE
LAKMMKGAAPILSKDASTDIEFHSSLNTEKVIQQKSTKPIHGKGSPMVPEHSYMENFE
FDDNMSLKQIKLLKGKPKDRKRVDFAASEGLREREAQLRELCKIRSRLDSLRKRTLT
FQSSESKASDEFNTCRSRVVYVPVAEIKERA

Figure 802: Amino Acid sequence of SEQ ID NO: 3652. The conserved homeobox domain is underlined withThe conserved homeobox domain signature in bold/underline, and the homeobox-associated leucine zipper (HALZ) in bold.

MCPIDSGRSFDTSLSLGLGCYGDPEDHEIKIKKPLAKLSGNSTCLTIGLPGGEACGLGS
ASGDEVRNIPSRSASSFSNSSSAKREKAEQGEEEAVERGTGSPRATINIEDEDEFS<u>PRK
KLRLSKAQSSILEESFKAHTTLNTKQKHDLANRLNLRPRQVEVWFQNRRARTKLK</u>
QTEVECEMLKKCCETLKEENRRLKKELQELKSLKPTASVYRQIPAAALPLCPSC
ERIAHPEFPFSTESRLWPAHPSAAC

Figure 803: Amino Acid sequence of SEQ ID NO: 2077. The conserved homeobox domain is underlined.

MGIATPPLPPISSHTKTHHHHSIAISNPTKSMSQDYHHPSIFAFSNNGFERPDVAAASA
ASDQEQQHHVAQQICRDKLRVQGFDQPPPPQLVGMEEEPGGLPAYETAGMLSEMFN
FPPGGAAAAELLEQPMASGYRAARPSLPTSEWYGSKNPGVYRRGESNMSQQHHHA
HHHHQQQQQNQISNINAESAAAMQLFLMNPQARSLSPPTPHHHHHHPPPTSSSTLQM
LLPNPSPPPSLQGFHVSGSGSAAPNYGTGMIPPAQFTWVPDGGAATAAQLNNPSEISG
AAVVEGQGLSLSLSSSLQHLEAAKAEELRMGDSGLLFFNQAAGGGSANSSASASAV
AASVQYHHQFKNLGVHNLQSHHHQVHVGYGSSPSSSSLGVVNVLRNSRYLKAAQE
LLEEFCSVGRGHFKKGKFGRNTSSSNPSSNPSNNNTSSASAVGGGASSSSSKDVPPLS
AADRMEHQRRKVKLLSMLDEVERRYNHYCEQMQMVVNMFDLVMGYGAAVPYTA
LAQKAMSRHFRCLKDAIAAQLKHSCELLGEKDGAGSSGITKGETPRLKLLDQSLRQQ
RAFHQMGMMEQEA<u>WRPQRGLPERSVNILRAWLFEHFLHPYPSDADKHLLARQTGL
SRNQVSNWFINARVRLWKPMVEE</u>MYQQESKEGDEDDDHQAERSESSRNNLSTSGH
AQTPTPSSFTPPPINNNTNSNNASTPTRRSEINAPESDPSLTPAINRHPFSETQATTLLQA
TTAMISSAVQVAGPAHIDDPCRRSIGGSTGLGGATDIGSALIRFGTAAAATGDVSLTL
GLRHAGNVPEKSSFSVTDLGGC

Figure 804: Amino Acid sequence of SEQ ID NO: 2078. The conserved homeobox domain is underlined with the conserved homeobox signature 1 boxed, and the conserved homeobox-associated leucine zipper (HALZ) double underlined with the leucine residues in bold.

MCPIDSGRSFDTSLSLGLGCYGDPEDHEIKIKKPLAKLSGNSTCLTIGLPGGEACGLGS
ASGDEVRNIPSRSASSFSNSSSAKREKAEQGEEEAVERGTGSPRATINIEDEDEFS<u>PRK
KLRLSKAQSSILEESFKAHTTLNTKQKHDLANRLNLRPRQVEVWFQNRRARTKLKQ</u>
TEVECEMLKKCCETLKEENRRLKKELQELKSLKPTASVYRQIPAAALPLCPSCER
IAHPEFPFSTESRLWPAHPSAAC

Figure 805: Amino Acid sequence of SEQ ID NO: 2079. The conserved heat shock factor (HSF)-type DNA-binding domain is underlined and the conserved heat shock factor (HSF)-type DNA-binding domain signature is boxed.

MDGSQGKSNA<u>APAPFLVKTYEMVDDPQTDFLVSWSESGSSFVVWSPPEFSGELLPKY</u>
<u>FKHNNFSSFVRQLNTYGFRKIDPDQWEFANEEFIRGEKHLLNNIYRRKPIHSHSGQG</u>
<u>ARLSDTEKQMYEEEIKRLRHEKSSLQLELQRYQGDNQDVDFQIQLLRKQFQNMEQK</u>
QTHLITVLAQLMQKPVFASLFTQQSDSPTKKRRLAELDHLHDSDDKSGLESLKFQKE
KFNGVPFSLLDLDSVEKLEQSLHFLENLLQGVDNTSGAEQHDFGAISLPWPAGFTER
KESLDDSDRHIRPWSPGSPPSPKDVALSPELALGTDHLESPETSSVCLNMDISLKSSVI
DVNMEPVCVPDVENLKEQILEKMPGAPTAVNDVFWEQFLTEAPCASDSQEVESERR
EGSGSRSPMKLANRGKFWWNSHLGNDFTKHVGSLASEGRS

Figure 806: Amino Acid sequence of SEQ ID NO: 2080. The conserved heat shock factor (HSF)-type DNA-binding domain is underlined.

MNPEEERYPKSPPGSPDRGRGKGKAPAGAGSSFSAALQPETPSFVMGSEALPSGSFFD
MESIGLSGSPLPLMEFEAFSPLNTSSSFDLFFEVKPEPVLETTRPLGPPFGAGAVETEEA
GFPARGGDMETTVGAPQPLERLQGTPV<u>PPFLSKTFDLVDDRSLDPIISWGSSGESFVV</u>
<u>WDPVEFARSVLPRNFKHGNFSSFVRQLNTYVGICWNTAFIGCCSLSVNAFFSLCLFLL</u>
<u>LYFDVFLFHFLLHRCAFSFVSCLTLL</u>

Figure 807: Amino Acid sequence of SEQ ID NO: 2081. The conserved heat shock factor (HSF)-type DNA-binding family domain is underlined.

MAPPPPPPLEQRGDSPAGESQRSTP<u>TPFLTKTYQLVDDPAVDDVISWNDDGSAFVVW</u>
<u>NPTVFARDLLPKYFKHNNFSSFVRQLNTYGFRKLVPDRWEFSNDCFRRGEKRLLCEI</u>
<u>QRRKVSPSPTAAAVAVVPDSVATLPTAIPTAMPVISPSSSGDEQVMSSQHSSPPSACG</u>
<u>QNCTAEIMDENERLRKENAFLSRELTQMKSLCNNILSLMSGYAPNGRPQEASSRPVA</u>
<u>RALDLMPVKRPTGGGGGGGGDGDDEEEEEEEDEEEDGEGSPKLFGVALGMKRGR</u>
EIREGEVAVMSGSDAMLRLQQPGSGGVKFEPSDGDQRAISFPSGIA

Figure 808: Amino Acid sequence of SEQ ID NO: 2082. The conserved heat shock factor (HSF)-type DNA-binding family domain is underlined and the HSF-type DNA-binding domain signature is in bold.

MDGSQGKSNA<u>APAPFLVKTYEMVDDPQTDFLVSWSESGSSFVVWSPPEFSGELLPKY</u>
<u>FKHNNFSSFVRQLNTYGFRKIDPDQWEFANEEFIRGEKHLLNNIYRRKPIHSHSGQG</u>
<u>ARLSDSEKQMYEEEIKRLRHEKSSLQSELQRYQGDNQDVDFQIQLLRKQFQNMEQK</u>
QTHLITVLAQLMQKPVFASLFTQQSDSPTKKRRLAELDHLHDSDDKSGLESLKFQKE
KFNGVPFSLLDLDSVEKLEQSLHFLENLLQGVDNTSGAEQHDFGAISLPWPAGFTER
KESLDDSDRHIRPWSPGSPPSPKDVALSPELALGTDHLESPETSSVCLNMDISLKSSVI
DVNMEPVCVPDVENLKEQILEKMPGAPTAVNDVFWEQFLTEAPCASDSQEVESERR
EGSGSRSPMKLANRGKFWWNSHLGNDFTKHVGSLASEGRS

Figure 809: Amino Acid sequence of SEQ ID NO: 2083. The conserved heat shock factor (HSF)-type DNA-binding family domain is underlined and the HSF-type DNA-binding domain signature is in bold.

MAAPPAEQSGSASGGESQRSVP<u>TPFLTKTYQLVDDPAIDAVISWNGDGSSFIVWNPT</u>
<u>VFARDLLPKYFKHNNFSSFVRQLNTYGFRKVVPDRWEFSNDCFRRGEKRLLREIHR</u>
<u>RKISASPPAPAIVAAGRPRASPSNSGDEQGISSWSSPPSACGRNCASEIMDENERLRRE</u>
<u>NVLLSRELSRMKTLCSSIFSLMSNYANGGVRAEAAGEKKPLEPLGGNPEAEAAAAA</u>
AAESPRLFGVPIGAKRGREEEVRTEIKLEPLDCQRNGGRSRAEPWMKQCHRSNQRVF
N

Figure 810: Amino Acid sequence of SEQ ID NO: 2084. The conserved jumonji C (jmjC) domain is underlined, the jumonji N (jmjN) domain is in bold and the C5HC2-type zinc finger is in bold/underline.

MNLCWFAWDLKLRSNFNGNWQMGTKRPKPEDLSVPPGFASLTSFLLKRAQEADAE
PAVAHASTNRRPWVLHHESGTRHGARDSDSAKHEAEAVVVQAGGDSENAITCIFEE
APVFRPTKEEFGDPLAYLTSLHQRAEAYGICRVVPPPSWKPLCQSTEKNIWGSAR
FRTQVQRLDLLLNTHLPRETVKCNGNADCKDQNIFTRHPCEDGRLCTEGIQWECGPE
YTLETFKKYADDFQENYFLKKDYDMKSDDDVQNIECEYRQICENPTNKIEVLCSDAL
DSRTFGSGFSSTFNSGWNLNDLPRLSGSLLSFESFSTCSILAP<u>KLHVGMCFATSLWKC</u>
<u>EEHCLYSVCYTHIGAPTIWYCIPGRYRAKFEAIVKKYSMELLSVQHGLNVFSHISPSTL</u>
<u>KSQGIPVYRCAQNPGELVVIFPGAYKSGFSCGFNCVESVNV</u>APLDWLSHGQNIVELY
REKRRKTMISHDKLLLGGAREAARAQWELLLLKKETADNLRWKHACGKDGILVKA
LKSRVKWESLRRKYLCNSSQSKKMDQNFDASSKRE<u>CGICHFDLHLSAVSCKCSRD</u>
<u>KYSCLDHATQICSCAWTNKVFLFRYEVGELNLLIE</u>ALEGKLSAVYKWAKALGLA
FKTSTEDLLVSSVLVSKSTSDAEPTDSGQKVSTSASITSRAHIKAELKEDLIKKMSSDG
LRGEVNNDFGKAESSSHSHRHIIGVLSESASVSVSSDSEDEITNFVSHSGVKAAESNN
DMASTKQSIVDSPTSTVKKAPSFGKLAPGKLMAKDARSCSPLNVIVLSDDDND

Figure 811: Amino Acid sequence of SEQ ID NO: 2085. The conserved jumonji C (jmjC) domain is underlined.

MDHSRLASGNAEDNVGIPDDMRCKRSDGKQWRCNAMCMPDKTVCEKHYYQAKK
RAANSALRASMKKAKRKSIAESDIYLESKNDDFDMPLINMKTADHPLPTSGKKSKNK
VSKNRVQHSPETTPPQSSSRNFRRSVDNSQRELTEFEENWRPYKTPTGNSSRNRSQRS
YDTSPMTEYSERSTDSSEDTGGHICHHCRRNSRDKVIWCLKCDRRGYCDSCISQWYS
DISLEDLQKACPACRGACSCKVCLRGEHLIKMRIREIPVLDKLQYLYCLLSAVLPVIR
QIHYEQCSEIELEKRLRGPDIDLPRVKLSADEQMCCNICRIPIVDYHRHCTNCPFDMCL
HCCQDLREASRDRARETSANDQIGGSTQDKESVDYVKGPKVRLKFTDNFPDWRAGS
DDSIPCPPKKYGGCGYPSLNLTRIFKMNWVAKLVKNVEELVSGCKVNNSANQQNDG
SSQSNFGQEASIPIKEGKKGSLYCPTSHDIRAQGISEFRKHWFKGEPVLVKQVWDHSC
ISSWDPVLIRRGIQDMADEKMKYENKKVRAVDCLKSSEIDIDLDQFIKGYSEGHIHEN
GLPKMLRLKDWPSPGASEEFLLYQRTEFISKLPLLEYIHSKWGILNLAAKVPHYSLQN
DVGPKIYISYGTKEELGKGDSVTNLHFNMRDLVYLLAHTCEMKCKSWDKTKLGKN
RRSTGQSILKQMHGNLDSGGDGRHLPDQHAGRYNILEDHGAHLVTNADERIEDQEM
GMPSLVEEKNANLELLNRDDEGGCGNNTSGVHWDIFQRQDVPKLINYMQKHWKEL
GMPGSLDDIATYPLFDDVIFLDTQHMRKLREEFGKGISVLLHFMLFVEPWSFVQHLG
QAVFVPAGCPFQLRNLQSNVQLGLDFVSPESLGEAVRLAEEIRCLPNDHESKLQILEV
GKISLYAASSAIKEVQKLVLDPKFGAELGFEDPNLTSEVSANLEKITKRKQVACS

Figure 812: Amino Acid sequence of SEQ ID NO: 2087. The conserved jumonji C (jmjC) domain is underlined.

MDHSRLASGNAEDNVGIPDDMRCKRSDGKQWRCNAMCMPDKTVCEKHYYQAKK
RAANSALRASMKKAKRKSVAESDIYLESKNDDFDMPLINMKTADHPLPISGKKSKN
KVSKNRVQHSPETTPPRSSSRNFGRSVDNSQRELTEFEENWRPYKTPTGNSSRNRSQR
SYDTSPMTEYSERSTDSSEDTGGHICHHCRRNSRDKVIWCLKCDRRGYCDSCISQWY
SDISLEDLQKACPACRGACSCKVCLRGEHLIKVMRIREIPVLDKLQYLYCLLSAVLPV
IRQIHYEQCSEFELFFSTGPDTDPPRVKLSADEQMCWFNICRIPIVDYHRHCTNCPFDM
CLHCCQDLREASRDRVRETSADDQIGGSTQDKESVDYVKGPKVRLKFTDNFPDWRA
GSDDSIPCPPKKYGGCGYPSLNLTRIFKMNWVAKLVKNVEELVGGCKVNDSANQQN
DGSSQSNFGQEASIPMKEGKKGSLYCPTSHDIRAQGISEFRKHWFKGEPVLVKQVWD
HSCISSWDPVLIRRGIQDMADEKMKYENKKVRAVDCLKSSEIDIDLDQFIKGYSEGHI
HENGLPKMLKLKDWPSPGASEEFLLYQRTEFISKLPLLEYIHSKWGILNLAAKVPHYS
LQNDVGPKIYISYGTKEELGKGDSVTNLHFNMRDLVYLLAHTCEMKCKSWDKTKL
GKNRRSTGQSILKQMHGNLDSGGDGRHLPDQHAGRYNILEDHGAHLVTNADERIED
QEMGMPSLVEEKNANLELLNRDDEGGCGDNTSGVHWDIFQRQDVPKLINYMQKH
WKELGMPGSLDDIATYPLFDDVIFLDTQHMRKLREEFGVEPWSFVQHLGQAVFVPA
GCPFQLRNLQSNVQLGLDFVSPESLGEAVRLAEEIRCLPNDHESKLQILEVGKISLYA
ASSAIKEVQKLVLDPKLGAELGFEDPNLTSEVSANLEKITKRKQVACS

Figure 813: Amino Acid sequence of SEQ ID NO: 2088. The conserved MADS-box SEQ ID NO: 3668) transcription factor domain is underlined.The K-box transcription factor domain is in bold.

MAKEKIKIKKIDNLTARQVTFSKRRRGLIKKAEELSVLCDADVSLIVFSATGKLYDF
SSSRQMKGEDLEGLNVEELDQLEKKLEAGLSLVIKNKEEKTWNEINKLQRKEA
QLIKQNKQLKHEMKMILHQEKSVTVNSESVKDVYISRNSMPPLDGDSPNPSS

Figure 814: Amino Acid sequence of SEQ ID NO: 3653. The conserved Transcrition factor, MADS-box SEQ ID NO: 3668) domain identified using InterProScan is underlined.

MVFPTQATPEESPQRKMGRGKIEIKRIENTTNRQVTFCKRRNGLLKKAYELSVLCEA
EVALIVFSSRGRLYEYANDSVKATIERYKKACSDSSSSGSVSEANVQFYQQESAKLQ
QQINNMQNNNRQLVGDSIAGMNMKDMKTTEQKLEKAIAKIRAKKNELLFAEIEYM
QKREIDLHNNNQVLRAKIAESERTQHADMNLMPGGANYDFMQPSSSQPFDSRNYFQ
VNVL

Figure 815: Amino Acid sequence of SEQ ID NO: 2090. The conserved MADS box SEQ ID NO: 3668) domain is underlined and MADS box SEQ ID NO: 3668) domain signature is in bold. The conserved K box is in bold/italics.

MGRGKIEIKRIENSNNRQVTYSKRRNGLIKKAKEISVLCDAQVSVIIFGSSGKMH
EYCSSNTSLVDILDQ*YHTQCGKRLWDAKQENLSNELDRIKKENDNLQIQLRHLKGED
ITSLNHRELIILEDTLENGLGCVRDQKDEVLMTHRRNQKQLEEDAKELHFYAQQKD
MMM*AETGRAGNDGYHQRMKADFGPSTYHVQPIQPNLQRRF

Figure 816: Amino Acid sequence of SEQ ID NO: 2091. The conserved MADS box SEQ ID NO: 3668) domain is underlined and MADS box domain signature is in bold. The conserved K box is in bold/italics.

MGRGRVELKRIENKINRQVTFAKRRNGLLKKAYELSVLCDAEVALIIFSHRGKL
YEFCSSSSMLKTLERYQKCN*YGAPEPSISTREAQLELSSQQEYLKLKARYEALQRTQR
NLLGEELGPLSSKELESLERQLDSSLKQIRSTRTQYMLDQLTDLQRKEQHLNEANRT
LKQRLME*GYQATALQMNPAAAEEMVYGGRHLAPPHHGHDAFFHPLDCEPTLQIGY
PQDPSASVVTAGPSSSYMPGWLP

Figure 817: Amino Acid sequence of SEQ ID NO: 2092. The conserved Transcrition factor, MADS-box SEQ ID NO: 3668) domain identified using InterProScan is underlined.

MGRGKIEIKRIENTTNRQVTFCKRRNGLLKKAYELSVLCDAEVALIVFSSRGRLYEYS
NNSIRSTIERYKKANSDSSNTSTVTEINAQYYQQESAKLRQQIQMLQNSNRHLMGDS
LSSLSVKELKQLENRLERGITRIRSKKHEMLLTEIEYLQKKEIELENESVFLRTKIAEVD
RIQQGNMVAGPQVNVMEALASRNFFPSNMVEGGTVYSHSDKKVLHLG

Figure 818: Amino Acid sequence of SEQ ID NO: 2095. The conserved MADS box SEQ ID NO: 3668) domain is underlined and the conserved K box in bold/italics.

MAREKIQIKKITNATARQVTFSKRRRGLFKKAEELSVLCDADVALIVFSSSGKLFEYC
SSSMKEILERHHSHSENLGK*LDQPSLKLQLVENGDYSRLSKEVAEKGHQLRQMRGEE*
*LQGLNIDELQQLEKSLEAGLNRVIEKKGEKIMKEITDLQQKGAKLMEENKRLKQQVT*
*EI*LGRKTTATDSETIINEEGLSSESVTNVCSSSSGPPQEDDSSDISLKLGLPYNG

Figure 819: Amino Acid sequence of SEQ ID NO: 2098. The conserved MADS-box SEQ ID NO: 3668) transcription factor domain is underlined.The K-box transcription factor domain is in bold.

MGREKINIKKIDNLMARRVTFSKRRRGLIKKARELSVLCDADVSLIIFSATGKLHEFSS
SSMEDTVTRYVLHSNIVEKPVQPCLPLQKDSSNLEMLRKEVNDKAYKLRQMRG
EDLERLDVEGLRQLEKKLEAGLSLVIKTEEERASTKINELQGKEAQLIKENKQL
KQKADEGRGSGGGGRGEIGTIREQSRGRTEPRAQD

Figure 820: Amino Acid sequence of SEQ ID NO: 2099. The conserved MADS box SEQ ID NO: 3668) domain is underlined and MADS box domain signature is in bold. The conserved K box is in bold/italics.

MGRGRVQLKRIENKISRQVTFSKRRTGLLKKAHEISVLCDADVALIVFSTKGKL
FEFSTDSCMESILERYER*YTYAERQQVATDSPQVQGSWSLEYPKLVARIEVLQRNIRN*
*LSGEELDPLSLRELQYLEQQLDTALKRIRTRKVVDFSAAKKEKSLQEQNNVLSKKIKE*
NEKVMRESGQWEQQTPAPTTSSFMLQPTLPLPSLTIGNTFQTPHVLGGAEQEERSQA
RPANTLMPPWMIRRSNE

Figure 821: Amino Acid sequence of SEQ ID NO: 3654. The conserved SHAQKYF class Myb-like DNA-binding domain is in bold.

MYGRAAEWSRYEDKVFEHALVAVAEDSPDRWQLIGNRLNRSASQVFEHYQRLVED
IDAIESGRVEPPSYRDDHPASCGQIAFETKPRIKEAEKKKGNPWTEEEHRRLFLLGL
QTYGKGDWRSISRHFVLTRTPTQVASHAQKFYMRQMSLGKKERKRNSIHDITTV
DTPPVPASVNDSFNPPQAGNAQDDPSYDYPKANNFQQMQPCQPAPFMNQLLDQGG
GSIGYENLSYFL

Figure 822: Amino Acid sequence of SEQ ID NO: 3655. The conserved SHAQKYF class Myb-like DNA-binding domain is underlined.

MDTYSSGEDLLIKQTRKPYTITK<u>QRERWTEDEHNRFLEALKLHGRAWQRIEEHIGTK
TAVQIRSHAQKFFSKLEKEAIVKGVP</u>VGQTLDIKIPPPRPKRKPSNPYPRKTGAITPTLS
VGAKDGGILSVSPSNCEKLDSETAPFLERASGGEKLANSKENQDDNCSEVFNLPQEA
HCSSISSTNRSVVPTPVGIQNSCTFRKFVPSLKEDNGPRKVSNSENSDRSHEKSVQCR
MDGYDGPPADEMQTAHNFPRHVPVHVLDANHTKCTQAPLQDVSFQDSAFDPTGEV
KARLNLFPNQTPSAAGENQKEAPRMDHQSFPAFHPPFTPVHHNEDDYRSFLHLSSTFS
SLIVSTLLQNPAAHVAASFAASLWPYPNVENSVVDSAVCTQGTFPCRPSSSPPSMAAL
AAATVAAATAWWAAHGLLPLCAPLHTGFTCNPTSATAVHSLNTSQTPGVEKERREC
TFENPCSQEHLDPEHSEALQAQNSASKSPLGALSDSEDSGGARLDTRSKAADHEKAA
VETDSQQNQSKGGKPVDRSSCGSNTPSSSEVETDALEKQEKGNETLKDPDPNQSILE
YFNRRCRSTSNVTDSWKEVSEGGRLAFQALFSRNVLPQSFSPPRDMKNKGQQKENV
EEGEQNNGEVDKDVSTLDLNRNMCISCSFHQGSERSGVIDDGEEGLLTIGLGQGKLR
THRTGFKPYKRCSVEAKETRAANVGSQSEEQGPKRIRLEGEPSM

Figure 823: Amino Acid sequence of SEQ ID NO: 2102. The conserved Myb DNA-binding domains are underlined.

MGRSPCCEGNGLKK<u>GPWSSEEDKKLLDFIQQHGHGSWISLPKRAGLNRCGKSCRLR
WINYLRPDIK</u><u>RGSFSPEEEQTILHLHSVLGNKWSAIATRLPGRTDNEIKNYWNTHLKK</u>
KLIRMGFDPVTHRRRTDVFSSSLSQLIALANLSKLIDSRPLDESALALQSDALQLANSL
QYLQGLLQPPASATASNNNLFSQTSCITEATQGYTAYDPIKEDPDLNSLLSSTARLFSE
GIAGFSQPLQDNNFIAHHHLVPNYLTNTPPQVPFSFQTSLNNHVDRTAATQCLSMVN
GIDHCLDSTDSALWGDYDDLDLLLPPSLTEASAVTDRGDARSGGSSGGSPSSSTSPWS
DIFFGDLAGH

Figure 824: Amino Acid sequence of SEQ ID NO: 3656. The conserved Myb DNA-binding domains are underlined.

MVQEVR<u>KGPWTDQEDFQLVCFVGLFGDRRWDFIAKVSGLNRTGKSCRLRWVNYLH
PGLK</u><u>RGKMTPQEERLVLELHSKWGNRWSRIARKLPGRTDNEIKNYWRTHMRKEAQ</u>
EKKHALSSSSASSNISSSSSNNPTVDSLTTQETGKESFYGTGGPGDMLTSTEQNIEEQG
KSESACSFDDIWKEIALADGYGILPVYDGYSEESCNFSCPPMASPTMEYNSDPLWLTD
EEESKMFPINQFIPDYEHGGAYITG

Figure 825: Amino Acid sequence of SEQ ID NO: 2104. The conserved Myb DNA-binding domains are underlined.

MVRAPCCDKANVK<u>RGPWSPEEDATLVNYINKHGTGGNWIALPRKAGLKRCGKSCR
LRWLNYLRPDIK</u><u>HGGFTEEEDHVICTLFFTIGSRWSVIASKLPGRTDNDVKNYWNTK</u>
LKKKLMKQLASLKTVPESNFDYQVCAQNSASIDPETKNREYAANSMGFPKQNFNPGI
PTSNSSLLCPPSLTEVSDFSHVPSSTPEVSSHSDSCSVVMKSEYSGSANGSSEQDQVLL
DFDFDSMLNDFGFQDQSS

Figure 826: Amino Acid sequence of SEQ ID NO: 2105. The conserved Myb-like DNA-binding domains are underlined.

MGRHSCCYKQKLR<u>KGLWSPEEDEKLARHIVKYGHGCWSSVPKLAGLQRCGKSCRL
RWINYLRPDLKRGTFSQQEEDLIIDLHAVLGNRWSQIASQLPGRTDNEIKNLWNSSIK</u>
KKLIQKGIDPNTHKPLSEVKNGREGEKTPKSGNFGNRTSGGFSSMYNLEFDAPKSEER
KPISQDAEPYSLTGSLSLKIHHPDTSKSINPAPARKLFSEKSADLSEKIPFEPTRIFPFQQ
LSYGSSADYSFDPYLNHNFMLSDSKSALHSTSAPAILPQSHSFSSLTAQPHDSLKPHFG
LFSNGKIRSSESQSSLFPWDLHAEKEEDETHQPNFSGNESEDLKWSDYLNMPFLIANP
GQGQEKQAPPNGVVSDARFISELSCVEGNNQQQELPSQGSDIYCKGIRRLAAAFGNY

Figure 827: Amino Acid sequence of SEQ ID NO: 2106. The conserved Myb DNA-binding domains are underlined.

MGRAPCCEKVGLK<u>RGRWTAEEDEILTNYIQAHGEGSWRSLPKNAGLLRCGKSCRLR
WINYLRSDLKRGNITAEEEKLIVQLHGTLGGLWSLIAGHLPGRTDNEIKNYWNSHLS</u>
RKIYVARPSTSTRVEPSLPTPMNAVKIAGTGKRRGRTSRSSMRKSSFTSMPPERPNHS
TVPKSEKGKEAQAPIKGQVGGSQVMSSEPSWVPNKKTAAQESNKDVVHGSRIDTDA
GLNNEVAAEAEGLFLGPCEWVDREIMRLNCMLHIEDAGALKLEGENGVVGRFEESE
NEFAVMEKLMPVTEETESSIWSSKSNAESSTGEWYVSSSSMNYNKYNNDSGFDEWF
DWDWAGGVGCGSNQWENEDKTLSWLCDSGNGEAENASDSTAVMKSETIM

Figure 828: Amino Acid sequence of SEQ ID NO: 2107. The conserved SHAQKYF class Myb-like DNA-binding domain is in bold.

MAGEAQNEVAVSSALFTVPNRPSKVGSQLEAVDNLKELQVLENDQTPKVRKPYTIS
KQREKWTDEEHERFLEALKLYGRGWRQIEEHVGTKTAVQIRSHAQKFFSKVAR
GVSGSSEGVIKPIEIPPPRPKRKPMHPYPRKSVDSKEVKLSYQQERSPSPISSVADENTG
SPTSVLSAHGSDMLGSASLHQQNRCSSPTSCTTDVPSIGLAVIEKQPEIFKEEDKGCLS
STQMPSGLTLGNLPSMNCDLSSRNTSSPEEIGGTEAPSIKLFGRTVLVTEIQKPDHQEA
GIKKSPVQKTGEDDSVTEDEGLGKPLSSVEFDMQLSLGLACGNNGFLHSGAHAATA
MKLQKEDVESSRFTSDCFLPWWPLYQGPPFIYVTPSDSTLIQGPLDSHKDRKMEVEEI
IKETSSETNTVAKKTEGYGDNNVENNVDGVFPKCQKHLERRTHPGDCKKGFVPYKR
CLAERDVKSPVIVSEERQAQRTRVCS

Figure 829: Amino Acid sequence of SEQ ID NO: 2108. The conserved RNA-binding region RNP-1 (RNA recognition motif) family domains are underlined.
MARKRKQEPTPSASADASQPPKRQQQQQLIKQEQQEAAAREQHAVDYIEVEVEEEV
EEEVEEEVEEEEEEEVEEEEEEEEEVVEEEEEEGEEEDNQTANEDDDDDEPIQNLL
EPFSKDQLISLLFEAAAQHRDVADRIRQMADVDPVHR<u>KIFVHGLGWDATAETLTSAF
KQYGEIENCKAVCDKVSGKSKGYGFILFKSRRGARNALKEPQKKIGNRMTACQLASI</u>
GPVPTHAGAQSAPLQLPQQQQQQVSEYTQRK<u>IYVSNVGADLNPKKLTEFFAKFGEIE
EGPLGLDKSTGKPKGFCLFVYKTVESAKKALEEPHKSFEGHVLHCQKAVDGPKPGK</u>
SQHTQHQNASNHSQRNDSAGFAGAAAAGLGQLNPAGIGFGQGAAAAQALNPALGQ
ALTALFATQGAGLGLTNLLGTLGSATAVNPAMPPAGHGLQAAYGNQMNISPGLIGG
GYGSQAGYANQQMGQGAGSRGHHAGQFSGSGPYMGGH Figure 830: Amino Acid sequence of SEQ ID NO: 3657. The conserved Myb DNA-binding domains are underlined.

MKERQRWRAEEDALLRAYVKQYGPREWHLVSQRMNTPLNRDAKSCLERWKNYLK
PGIKKGSLSEEEQRLVIQLQAKHGNKWKKIAAEIPGRTAKRLGKWWEVFKEKQQRE
QKENKGALPIDEGKYDHILENFAEKLVKERSTPALLMATANGGFIHTDSPALAPTLLP
PWLSNSNGTPTLRPPSPSVTLSLSPATVPASQPIPWLQADRGLDSGSLSLTGLPNHGPL
PTSGENILMSELAECCKELEEGHRAWAAHKKEAAWRLKRLELQLESEKACRRREKM
EEIEAKINTLREEQKASLDKIETEYREQLAGLRKDAESKEQKLAEQWTAKHVQLSKLI
EQIGFRPRIADHDRQ

Figure 831: Amino Acid sequence of SEQ ID NO: 2110. The conserved Myb DNA-binding domain is underlined.

MSRSCSQCGNNGHNSRTCMDGGGAGGGGGGCGGEGTGGIMLFGVRLTADGSAFR
KSASMNNLSQYEHSPESSNVVDAGYASDDVVHPSGRSRERKRGVPWTEEEHRLFLL
GLQKVGKGDWRGISRNFVKTRTPTQVASHAQKYFLRRTNQNRRRRSSLFDITTDSY
FGVSSSTMEEGHHQAHQVPSFPLSLPPAVSPGTGEKLLESLRLRKEGCQSKPTPSKPIR
PVPILPIPPSSKMAALDLNKATAASEPAEPWPLSLKLATAKPSDDQQAAAAPAPATTP
HSSPTNSIISVA

Figure 832: Amino Acid sequence of SEQ ID NO: 2111. The conserved Myb DNA-binding domains are underlined and the Myb DNA-binding domain repeat signature 2 is in bold.

MDKKPDDDNGKSQDVEVRKGPWTMEEDLILINYIANHGEGSWNSLAKAAGLKRTG
KSCRLRWLNYLRPDVRRGNITTEEQLLIMELHAKWGNRWSKIAKHLPGRTDNEIK
NFWRTRIQKHIKQAEAFSGQSSEMSDQASTSHMSSMPEPMETYDSPPSFQGNNNME
PLPVNLSVESNEAYWSMDDLWSMQLLNGD

Figure 833: Amino Acid sequence of SEQ ID NO: 2112. The conserved Myb DNA-binding domains are underlined.

MGRHSCCVKQKLRKGLWSPEEDEKLFNYITRFGVGCWSSVPKLAGLQRCGKSCRLR
WINYLRPDLKRGMFSQEEEDLIVSLHKVLGNRWAQIAAQLPGRTDNEIKNFWNSCL
KKKLMKQGIDPATHQPISEVQLIKEEKCAKNESLQVPQLKGLTPAVSSSRAHEPAFLI
SDTCYEGGALIEPSRESVDNNNYMSRPVFDSLPYFEFQSGVDMVGFNSNLLSQYHDP
PRTIDQSHLDISSNFEFSSMPSLTNFDHPGATMSGSEFSNNSTRMSPFFFHEAKDQCS
TNNSSSIGNYTGFQVNSSVENAAFSWCSSENKLDCLFQYQANGTSKSEELKPQGSWQ
EDQLHIGPVNSSSEDFGSFQLTSLSDDLTAANFDIFQQM

Figure 834: Amino Acid sequence of SEQ ID NO: 2113. The conserved SHAQKYF SEQ ID NO: 3671) class Myb-like DNA-binding domain is underlined.

MGRKCSHCGFMGHNSRTCASIRRRDASFGGGGRVKLFGVQLEAAYPCGVASRPPLK
KSLSMDCLMPSVRVLTSSSPLSSATNSSLSLRAACDVGDRLLRDESPNKAANSPSND
GYASDGFLGRAQER<u>KKGLPWTEEEHRTFLVGLETLGKGDWRGISKKFVGTRTPTQV
ASHAQKYFLRQKSLLPRRSKRRPSLFD</u>VGMERCSARHHGQIPKPSESFTPICLFSPQFG
STGRDSRARMVLLASPRTCSFRDREIPSSNLANHASSVSGRPASNPNLELTLASPNHQ
LDQASSIRVT

Figure 835: Amino Acid sequence of SEQ ID NO: 2114. The conserved Myb DNA-binding domain is underlined.

MTVQDQDGSAHSSNMIVGSNEMSLSDSLHSITSISLKEQFSCANDYAPKVRKPYTITK
<u>QRERWTEEEHKKFLEALKLYGRAWRRIEEHVGTKTAVQIRSHAQKFFSKVVKDPTD
GKVETIEIPPPRPKRKPMHPYPRKLLAHPINKESLPQEQPIRSGSPNFSVSELENQSPMS</u>
VLSTLGSDGLGSSGASTPSGSSSPSSSGGAACRAGLSLFESPAEENGPITSEKLELHAR
GCEASGGAMEEAPSRTLKLFGMTVSVTDSHWQSSSAIKSESKEMKLQDPLSQDTLSA
TSPAKTNRVLNLVQPRDTSTDRMEAGPAPSAPWLNLYGNLTISLSPIRNKVAPRSTCG
DINKNGIPESRNGVTSNEFHSGFDLKLSFLSKPSSTSVAPELMTRQERRGRGFMPYKR
CMAEKETQPSGATGLEREVQRVRLSLECASSL

Figure 836: Amino Acid sequence of SEQ ID NO: 2115. The conserved Myb DNA-binding domains are underlined.

MGRPPCCDKTGVK<u>KGPWTPEEDIVLVSYIQEHGPGNWRSVPTNTGLLRCSKSCRLR
WTNYLRPGIKRGSFTDQEEKMIVHLQALLGNRWAAIASYLPQRTDNDIKNYWNTHL</u>
KKKLKKLQGQANPDDDDHNHHPQGFNATSHSNPKGQWERKLQTDIHTAKQALYEA
LSLDNQHSFLNETTTALGDGGGVCDRPPHQESSYASSTKNIARLLEGWMKSSPISGKI
KVETAARSANVSNKMAAAAGSRSTSEGGVAGVATPECLDSLFSFNSSNSDVSQSVSA
DENNVNLTPETSTIFQEESKPGLESNDNHQVPIKLLEKWLLDDAAAQALQDDYLMD
MALDQDALF

Figure 837: Amino Acid sequence of SEQ ID NO: 2116. The conserved No apical meristem (NAM) domain is underlined.

MRDVKEKEEKDDGKMLK<u>LPPGFRFSPTDEELVLHFLHPKKQQASLSPLYAHLVPDL
KSHHHDPWDLHGKALSNGSHYFYFSRMMNNRITENGYWKDLDMEEPVFGEAGEIIG
MKKSLTFHIGEAPTGQETNWVMQEYHLV</u>SFHELANSTQVSANIPQKC

Figure 838: Amino Acid sequence of SEQ ID NO: 2117. The conserved No apical meristem (NAM) domain is underlined.

MKKAQLA<u>LPAGFRFHPTDDELVTDYLIRKCASQPISAPIIAEIDLYKFDPWDLPEMAL
YGEKEWYFFSPRDRKYPNGSRPNRAAGTGYWKATGADKPIGRPKTLGIKKALVFYA
GKAPRGVKTNWIMHEYRLANVDRSAGKKKNSRLDDWVLCRIYNKKGTVEKHFPSA</u>
LNKTAESPEMDTKPQIVMPAALNPYTPPQMTVDHMYMDSSESMPRLHTESSCCSEQ
VVSPNLSSCEKEVQSEAKWEDWENNLDFMDDFLDDPFPQGQLQSDQFSTLQDMSAY
LQKPF

Figure 839: Amino Acid sequence of SEQ ID NO: 2118. The conserved No apical meristem (NAM) domain is underlined.

MKRAQLE<u>LPAGFRFHPTDDELVNDYLIRKCASHAISVPFIAEIDLYKFDPWVLPEMAL
YGEKEWYFFSPRDRKYPNGSRPNRAAGTGYWKATGADKPIGRPKTLGIKKALVFYA
GKAPRGVKTNWIMHEYRLANIDRSAGKKKNSLQLDDWVLCRIHNKKGTIEKHSPST</u>
LNETADFPEMEIKPQIVTPAALNPYTSPQYADSPMTTDHMYTDSSEFLPKLHTDSSCS
EHAVSRDLAWEKEVQSEAKWDDWEKALDFQFDSVDNFLDDAFANEQYQLDQFSPL
QDMSMYLQKSF

Figure 840: Amino Acid sequence of SEQ ID NO: 2119. The conserved No apical meristem (NAM) domain is underlined.

MSNISMVGAK<u>LPPGFRFHPKDDELVCDYLMKKMTRSDSLLMIEVDLNKCEPWEIPET
ACVGGKEWYFYSQRDRKYATGLRTNRATASGYWKATGKDRAVLRKGTLVGMRKT
LVFYQGRAPKGRKTDWVMHEFRVEGPHGPPNITKISSLKEDWVLCRVFFKSVEVAT</u>
KPSTGIVSCYDNRGTSSLPSLMDSFITFDQAHPQPNLISNIEQVPCFSIFSPSQANPIHVE
PSMPARTILNASAFGAMPDFSSCNNLDSYACDRKVLKAVLNQLTEMDSPSLGDQGSS
ESFLSEVAMPNNMWNHF

Figure 841: Amino Acid sequence of SEQ ID NO: 2120. The conserved No apical meristem (NAM) domain is underlined.

MPCLIPVDVFYEHIDCF<u>LPVGYRFRPTDEELINHFLRRHILGYRDDPCIIPETPFVHKFD
PWHLPRLFRERSIVRSKEAEWWFLSRLLFKTQKNSKYDRQTPSGHWKTTGQEKKIN
AKSTNRLIGTMRNLVFIENEGSSAKETVWVMHEYCLHDNYGANFLDQQKFVLCRLI</u>
NKRDEFIDDSTSVEAGSISLLMNLGNDKAWSNIPENIIEATMDQLAEALCPPMNLNLS
SNPHLVDMGAPSHVHIANDNLDQSDQQGDVVDGIETDGSIDDILDAIDWNMDEICQ
QRSGTEPETDNGQGWGLPADRPIEQGEHADRLRQPTIRLVDDRPREETSIHAQDNSQ
EQNIAHIFMIQPIEEYPEINCLTRAPVPTRASRGRDRVQLHNGHGLASKAKVTGLVEN
YGEINCLTREPVTIQASRGRDRVHLQNKPSVRLVSKVKDKESKGEKDKAAANISKNV
FSMRELKACLEQTQEIEQSSKSKSSVFPASSAKSPIMAPDKCSQGSVSSANSNRTKHF
KSKSFQTEAKPNRKVKPSSKTR

Figure 842: Amino Acid sequence of SEQ ID NO: 2121. The conserved No apical meristem (NAM) family domain is underlined.

METRIYPMNILPAENELTKIVLFLQQ<u>AIEGFRFCPTEEELLNHLKLTVSGCRESFCIIPTL
ENIYEINPWDLPAKFSEKSIIPSKDQEWWFICPQTQSQRISRKTPCGSSWNITGKHKDI
KAKNDNKKIGSRIILVFHDGQNSKGTRSKWVMHELHPHPDNMGYVLCCLKMKQHG
KADNQEPSNQVRENQPNDAAMAMDGDIPSIPQFHCPEVSSSEQNKVIAELSKKNYSK</u>
SDRSCQNKTKSLALIHEDNNPFSQSDGSYQNNTNSPALIHKDSHPFSQSDGSYQNNTN
SLALIHQDNHPFSQSEGSYQNNTNSLALIHEDKHPFSPNQKHLAWTKNSSSTANSSGS
CLAVSEPSIHELHFPHPFPNFDDTSGTSNFNGEQADKSCYSMDCENPEQLPFAEVRKI
RMLQRSNFFFLFQSLEICNYIWDVHVFLNNSIRSRKCRTN

Figure 843: Amino Acid sequence of SEQ ID NO: 2122. The conserved No apical meristem (NAM) family domain is underlined.

MAKLNQIRAIGSMSK<u>LPPGFVFEPTDEEILFEYLRRKIFALPLPASIIPELINLSNLDPWD
LLGNGEQGRYFFSNLAGANNAVIRATSCGYWKAQGVPKQISPSSSDAHNRMIVGMK
KTLVYHRGRPPHGSRTSWVMHEYRLVPSPSAARGPQLNSWVSELGRWVMCRVFVK</u>
TTSSSSHSDSTSMDVLSSSSSSSGSCLTEDSSSGDEEQTSEWFCS

Figure 844: Amino Acid sequence of SEQ ID NO: 2123. The conserved No apical meristem (NAM) family domain is underlined.

MAESTEA<u>WPVGLRFKPTENELISHHLTKKLKGEMETICVIPELYIYNWEPPELFARYK
ELSSIPSDGSECFFFCPRGRKRKRKTECGFWKETYSKRVIQAPDTGEEIGLRRGLVYH
KGRQRNSQRTNLGMTEYHLNSNVSDSEISDPAAMVLCHIINRKSKKAKSPTAGTSTD</u>
LSGPRNLNDSQNEETQDTSERASPGVTVEFPLNETSNLNFPGQNVPIPDQQPQTTKEQ
CLSHDIYEHDEPSDGYCSLPYSSSDYIDLGDLFNFDESIN

Figure 845: Amino Acid sequence of SEQ ID NO: 2124. The conserved No apical meristem (NAM) domain is underlined.

M<u>ISNKKLRFDVIGFLNIYHYDPRELPGLAKIGEREWYFFVPRDRKHGSGGRPNRTTK
HGFWKATGSDRKIVSLSDHKRVLGLRKTLVFYEGRAPRGTKTDWVMNEYRLPDDSS
PKEMVLCKIYRKATSLKVLEQRAAMGEGMNKAATAAVAHLSPPSPFSPMETSSSFNT</u>
QQYDLMPSMRESKIVFKQELLEEAEDEQEVQGFITSPPQDLFVNKVMSKGSSSSLQM
PTGKEKLPELQLPKMPADWTQDNFWTQFNSPWLQNLNTPYLTF

Figure 846: Amino Acid sequence of SEQ ID NO: 2125. The conserved No apical meristem (NAM) domain is underlined.

MAA<u>WPVGLRFEPTEDELVDHHLRGKLKGKLEAFCLIPELYIYSCEPPDLFISYNELSAI
PSDGRECFFFCPCGDKIPNNRRSNNRMTELGFWKDTCKKRVIRSLVTGKQIGIRKILV
YYEGRQPKGRKTDVVMHEYHLNSSVSDSKISGQMAFVLCHIIDRKRKKARSAKACA</u>
SASSSTISTPNDSGNGRSDEVSTEASEEVTIETQNQNEILISSMPDDNGPIIPQQDHMHE
EQSPLYDGCPFIDGHSDELYDLLYSPSNGMEILDLWNVPTDELVCQSFLPGEEYDGLT
FT

Figure 847: Amino Acid sequence of SEQ ID NO: 2126. The conserved No apical meristem (NAM) family domain is underlined.

METRMSPMNLVPAEKIVTEMALLLQQ<u>AIVGYRFHPTEEELINYLKSKATGCRETLSII
PTLENIYESNPWDLPAKFNEKSIIRSRDQEWWFICPQTQNQRIGRKTPCGSSWKITGK
HKDIKAENDGKKIGFKITLVFLDGRNSKGTRSNWVLHEFHLHADDMGFVLCFLKMK
QDEKADNQEPSIQALRNQPNHAAMATNGDFSSTPQFQCPKVSFSELIKNGTKSVAQIP
EDNHHSSPNLEHLTWTKNSSSMGNSSGRGLAVSPTNDELNFPCHFLNVDVCSAIEAQ
TEKMYRVNLFFQ</u>

Figure 848: Amino Acid sequence of SEQ ID NO: 2127. The conserved No apical meristem (NAM) family domain is underlined.

MEKVSFVKNGVLR<u>LPPGFRFHPTDEELVVQYLKRKVFACPLPASFIPEVDVCKADPW
DLPGDAEQERYFFSTREAKYPNGNRSNRATVSGYWKATGIDRRVVSSRSHQLVLGL
KKTLVFYRGKAPHGSKTDWIMHEYRLVDGLAPGTALPPKMNLNQSPEVPRENWVL
CRIFFKRRSTKNDGHNHNIESFRTTNEVSKVRGNGPVFYDFMARHKTDLNLTPCTSSS
GSSGVTELSLRGGPEEHEESSSCNSFSLSRRIP</u>

Figure 849: Amino Acid sequence of SEQ ID NO: 2128. The conserved No apical meristem (NAM) domain is underlined.

MGRDKGKS<u>LAPGFRFHPTDEELIRYYLKRKVSGKPLRFDAISEVDVYKCEPWDLPDK
SKLKSRDLEWYFFSVLDKKYGNGSKTNRATENGYWKTTGKDRAIYHYSRTVGMKK
TLVYHNGRAPRGQRTNWVMHEYRLTDEELEKAGIPQDAFVLCRIFQKSGSGPKNGE</u>
QYGAPFIEEEWEDDDVALFPDQEQMVVVHDEYVEADDLDQSIEVGTEPGDAPVPLN
FYHGETSQGTEHSNDLNEDEQKPLIDTNAIQASLQQQDEQFFVLPEQYRTEMKAIEN
GYIGQSDDNANPVDANYLLDEPYLDVAGDDYYLQTNDLANLLGEDAADFDVEDYL
TFFDADDENLLPYESSQPPPENLLSDHALHAEHINGENEEAPLAGNLPSESCSKDCAS
TSKPHLDSKDPESSIKYPFMKAASQMLGSFPAPPAFAAEFPVKDAALRLNSAAQPSSS
VHVTAGMIRIRNMNLVGSGMDWSIGKNGELNIVLSFGMSQADISPTDSGLRSRKTPS
VASWTWCFLFFWIILLSVGVKVGTSIYSR

Figure 850: Amino Acid sequence of SEQ ID NO: 2129. The conserved SBP plant protein domain is underlined.

MEWNAKPPLQWEWENLMMFGSKATETSKPLRATDWGIEAEELIDPGSLFLYENGGG
SSSCTSIDPGYTSVSKSSKSASVNSSSTDELKISKFSVEAHEGFSLQSSKKELAVNDFTG
MSPALEPSVCSGEPLLSLKLGKRIYFENTIDKDHVKTQDLPSVMKSPDTPAKRNKSNC
QGTSAP<u>RCQVEGCNLDLSSAKDYHRKHRVCESHSKCPKVIVSGIERRFCQQCSRFHG
LSEFDEKKRSCRKRLSDHNARRRKPPPD</u>VTQLNPARLSALFYGGMQQLNPVLSRAPA
IHTRSTASFKWADTQDTKLIEKGPKLPIGGGVGECITIPSNGIPDTLKSTGLGKSYNEL
LSSKGMPVKTTGGGMTCYIFCALQLHFVAFIS

Figure 851: Amino Acid sequence of SEQ ID NO: 2130. The conserved SBP plant protein domain is underlined.

MDSSSNGSLKRARAPGFGSQVA<u>SCLVDGCDSDLSKCRDYHRRHKVCELHSKTPKVII
RGQEQRFCQQCSRFHSLAEFDDVKRSCRKRLDGHNRRRRKPQPDPLSLTAGRFLPSH</u>
QGTRFSPFSGPQMFPASALASCSWPGVVKVEDDTTSYNTPQLINFNERNLSFPGSTSS
HFKGHIQFPFLQGTSAAHLGASICKPALNPNSTTGTGGNGNNARSSSSGLNRVVASER
ALSLLSSPPAENSEKGLSRMMQLVPSTSAQSLTTDLRYNRLGLGKPGNPGMDSESTG
SGELHYHGIFQSEHAGLSANGQHQTPSFSWE

Figure 852: Amino Acid sequence of SEQ ID NO: 2131. The conserved SBP plant protein family domain is underlined.

MESWSYFSEGKALVSDEPVSPFDLLGRSKNAVANWELRSPPSFGNSVVVSGQEADV
GQGFGQLGFQEIIRKQVHPKSPRHVLTDKFDDGNGANQILAALDSFGGEDESTSNLS
VSGVDSNTQDSLLIDLKLGRFGESREVPGAKFPQGGKKVLSSSESSTPPKRARSVGSN
<u>CHTHYCQVFGCNKDLSSSKDYHKRHKVCEVHSKTAQVVVNGVEQRFCQQCSRFHL
LAEFDDGKRSCRKRLSVHNERRRKPHVGVQSGSVGRMLQSYNGSGLERNLLAPTSF</u>
LCQDTLAGEKFLNSGPYGMNNWYEHIKAEDGIGLGPPSAIPTPNRHPNAISLISPYKFE
RQFALFDGGRVKSTASGISSKNNQVPRELGGQNSSHSSFQNTSFGSEDFAVFDTASTV
QGISGIIESGRALSLLSSLSQNSSSHSRIPMAQSLVMAGTDYHFSLCGATDKLVDMSSH
ASVGVELKKLSSSVMDSAERNLPGHPLVSDLEITDGILGGSGFVNSKDNLSPEGGATT
MNLLQLSSQLQRVEDQRQSIHLKEQNDVFGCHSIT

Figure 853: Amino Acid sequence of SEQ ID NO: 2132. The conserved SBP plant protein domain is underlined.

MEPPPSPSSPHLLPSMDLHAPPLLDGAAADAADCVWDFGDLLDFTADDALISPWDEP
PALDNPASVPSDPDPDPAPEDPPAGGAAPPAATRVRKRDPRLVCSNFLAGRVPCACP
ELDAKMAEAEEEEAAAEGLHTKKRARAPRRAGTGQGIA<u>RCQVPSCKADIQELKGYH
RRHRVCLRCANASAVLLEGDRKRYCQQCGKFHFLSDFDEGKRSCRRKLERHNNRRR
RKPADSGSGLVKESQQDIHSEDVGCDDEDGKDTLCLSGQSVEKEASLEPEDGGASPL</u>
GSAPECQIISTDSIASAVSRETQMESRKDNSKFALSPSCGDNRSAYSSVCPTGRISFKL
YDWNPAEFPRRLRHQIFHWLASMPVELEGYIRPGCVILTVFIAMPKFMWGKLYEDPI
SYINEFILRPGRLLSGRGTMYIFLNDMVFHLKEDETSVTKVEGGFRTPRLHYVHPMVF
EAGKPMDLVACGSDLLQPVENQSGLSNFIPVLIGNKEVCSEMRMLQQRVDKSLLNE
GPQISDIVMSQIHVGLSHRDKPHFLSSSWISHGCCGAFSQRQATLSEFILDIAWLLKEP
ASENLDHSFSVLEIQRFSSLLSFLMQHDSSTILEKILQRLDFLMENIELTSEISSGNNDA
DIRSFNTQIDQAREFLRKHQSSKRAVLHSEHSRRKEECSHQGFSQNDVLSAVTNANQ
DMEKGESYRVELMTGYTYSHKNEAAPLLDVELVMNGNLLKEKPRSRMLLSSVLRSR
PTLFAVATVAVCFGVCAVLLHPNKVGEFAVSIHRSLFDRP

Figure 854: Amino Acid sequence of SEQ ID NO: 2134. The conserved Myb DNA-binding domains are underlined.

MDEQYGLPDLRQLIATRTTQFSSLLHLEPPLPPAPPPRTTIHTSFSPSSPPSSSHYEPTVN
MLSTALANTNAHSAHPFATATPPPSALTGAFDIFECGSYRSDMIGAAGTSGI<u>SSSRWP
RQETLTLLEIRSRLDPKFKEANQKGPLWDEVSRIMSEEHGYNRSGKKCREKFENLYK
Y</u>YKKTKEGKAGRQDGKNYRFFRQLEAIYGESTTANRKPSSDNSSLVSNINFYPAPNNI
SSHAFQDQALQREMSLSFSNSSSHELETASSSENNEEDLSAIAFMMNSSHSSEKKKRL
VSESDSSKRSKKGWKEKVKHFVDSQMRDIIEKQEAWMENMLKTIELKEQERVCREM
EWKREETARFDCERELWAKQRVWIEARDTALMEALRKFTGQELAILSPPKDRNIAK
EEE<u>RNTSSFSEPEILTLIQLITSLEPGFQECGLLREGFWELISAKMACLGYNRSAGECQE
KWENVRNSFRKITEWNKKQREDFSRSQNLFFHQLHNS</u>

Figure 855: Amino Acid sequence of SEQ ID NO: 2136. The conserved Tubby domain is underlined.

MTPTKKTIPRQFSYNTLYVNPLTDARHVRSCSEGIALEGHSNHSPVKLGDHRKENAH
PNQERDAADGDDKENAVPKSWSAAISKHSSNLKSLSTGKALNLKPSSLQFCMQMQD
KDPNLGSKLRDPIGSENSHSVNIWDYSDSESAPASSWSTLPNRTLLC<u>RPLPVDIGRCTC
VIVREKSIDGVSGGTLYSLYTNEGKGRQDRKLAVAFCKRRNGKSIFTIAQSVKGLLSN
GDDSYIGAVTANVMGSKYHIWDQGVSLDSVARGTKALLAVVTFVPTIATWTGSHRI
MRAYIPKHQSMQLKNTTQVPHISGLPKDWEERRDRVHQLVSRVPHYNKISQQYELD
FRDRGRAGLKIQRSVKNFQLNLEENGKQTILQLGRVGKSKYVMDYRYPLTGYQAFC
ICLASINTKLCCTV</u>

Figure 856: Amino Acid sequence of SEQ ID NO: 2138. The conserved WRKY DNA binding domain is underlined.

MAVELMLGYRNDTTFSAKMEETAVKEAASGLESVGKLIKLLSHSQIQHPPAQEAPPL
DLDRDCRAVADDAVSKFKNVISLLGRTRTGHARFRRAPVQSALDKLPGQHPHQPKI
YYATPIQQIPPTPAPVPALPLGHYGGSAVISKSNGVVGERRDSSTTISFSDASFPFGSSL
TADNISGNVNYNNVNERHVVVKQQQCSSSSTFQITSSSISGKPPLSSSSSLKRKCSSET
LGSGRCASSSGRCHCSKKRKLRLKRVVRVPAISLKMA<u>DIPPDEYSWRKYGQKPIKGS
PHPRGYYKCSSVRGCPARKHVERASDDPAMLIVTYEGEHNHSL</u>SVVDSTSLILESS

Figure 857: Amino Acid sequence of SEQ ID NO: 2139. The conserved DNA-binding WRKY domain SEQ ID NO: 3670) is underlined.

MEGERGSSSSSVPNYDLQVTFSGASHGIHEIGFVPFEDQNQVLGFLTPAPPLMAAGEG
ATAAATTTTSRVGLGHHNGLVARSSWNNDQVGAHDPKAVSDENCSANPSEGNNSW
WRSSTAAAEKGKMKVRRKLREPRFCFQTRSEVDVLDDGYKWRKYGQKVVKNSLH
PRSYYRCTHSNCRVKKRVERLSEDCRMVITTYEGRHNHSPCDDSNSSEHEGFNSF

Figure 858: Amino Acid sequence of SEQ ID NO: 2140. The conserved DNA-binding WRKY domain SEQ ID NO: 3670) is underlined.

MSDSPNLRSPDSQDMDFNDQSDFELSEFLKIDEWLGDDPASMVHGAPANYFYQSNE
ADDSIGSSSNPEGPSRHAEGGKEKKEVKERFAFKTKSEVEILDDGFKWRKYGKKMV
KNSPNPRNYYRCSVEGCPVKKRVERDRDDPRYVITTYEGIHNHQGPF

Figure 859: Amino Acid sequence of SEQ ID NO: 2141. The conserved WRKY SEQ ID NO: 3670) family domain is underlined.

MEEVEEANRAAVESSHRVLSLLSQPQDQVQCRNLMLETGDAVFRFKRVVSLLNTCL
GHARVRKLKKLPTPLPQKALLDNPIVRTDQSSKSLQLLPPNYPENAIQELNTHHKASL
SLGNPNLELSSNGKSPLHLAQQAPSAHYHFLQQQQQQQKLQFQQQMKHQAEMMYH
RSNSGISLNFDSSSCTPTMSSTRSFISSLSIDGSVANLDANAFHLIGAARSSDQNSQHKR
KCSGRGEDGSMKCGSSSRCHCSKKRKHRVKRSIKVPAISNKLADIPPDDYSWRKYGQ
KPIKGSPHPRGYYKCSSMRGCPARKHVERCLEDPSMLIVTYEGDHNHPRVPSQSANT

Figure 860: Amino Acid sequence of SEQ ID NO: 1295. The conserved Pathogenesis-related transcriptional factor and ERF family domain is underlined.

MEVTQGMSTNILNVLEFIRHHLLEEEDELDIMHHLYDSGIECMSSSLSFSPGGDYLRA
TSSGSCQNMSSKSTSEENENEYTQAQDSSSSSSVCAVMRAEALNVKPQAREEQNGE
MKQIRARQYRGVRRRPWGKFAAEIRDPAKKGSRIWLGTFDTAEEAALAYDRAAFRI
RGARALVNFPLAIASNSEKGSAAGHMVHKRKRKTKRKEKETVKDKEKGEGNRDST
L

Figure 861: Amino Acid sequence of SEQ ID NO: 1314. The conserved Pathogenesis-related transcriptional factor and ERF family domain is underlined.

MCGGAIISDFVAASRSRRLSTRDLLPDFDKVAELFINGGAVSKSSGKSGSLGEGYVVF
DEGYKQKNKPSNNIFNSKKEFSSGGESKAILPVKDFEKPAAKNAGRKRMNLYRGIRQ
RPWGKWAAEIRDPRKGVRVWLGTFNTAEEAARAYDAEAKKIRGKKAKLNFTDDSC
SVEMDSSKKMSRKEVKYCTKTPDLLQGFNMISNFKPSYSPKRDLLEGYCINGQMEPS
LKDVCRSALQNYGYDDMEYGDSLFLKPRAPFQSNSNVSTVQSSEQSNLSQTLQKSYS
CELCSHNYSEVSNFMSTACNDVANFEPVKSCHPGGHFHSDQSSISLDGAHFPWAHET
KTPEITSEYDDTYESPFVAIKPPVNGVVKDRSVHTMDVSGGTQTFCVNSSMEVNDGT
QRSAVNIPIQVNSGTECYKTEDNIMQLQFSKQISALESYFGLPDSPNNKATMDGSTEV
AGHAPGSFPHEECSLKPWFFEDFPNSSSDYQSNLSDM

Figure 862: Amino Acid sequence of SEQ ID NO: 1318. The conserved transcriptional factor B3 family domain is underlined and the AUX/IAA family domain is in bold.

MAYAENLRNFGFGANNGGSNQSNSSNGGVDGYSSMSNEGGLVMGQIGGPHGYPNS
SPSAQDALYEELWHACAGPLVTLPRIGERVFYFPQGHMEQVEASTNQGADQHMPLF
NLPYKILCRVINVQLKAEPDTDEVFSQITLLPEAEQDESSVEKEPLTPLPPKPLVYSFC
KTLTASDTSTHGGFSVLRRHADECLPPLDMSQQPPSQDLVAKDLHGVEWRFRH
IFRGQPRRHLLTTGWSVFVSSKRLVAGDAFIFLRGENGELRVGVRRAMRQQNN
VPSSVISSHSMHLGVIATASHAVTTKTMFSVYYKPRTSPSEFIIPYDQYMESMKINFSV
GMRFKMKFEGEEVPEQRFTGTIVGISDADPVNWPNSKWRCLKVQWDEISAIARPERV
SPWKLEPSLTPVAVNPLPVARGKRPRPNILPSSSDLSVHDKAPVDSTQVHRFPRVLQG
QEVMTLGGSLGDGELESGQKMVAWGGSKLDDVKAEGMGCQRRLVSENWMPPLRH
DSLYSDTFSSFQPVGEVQEFRGSLTNSILEDGQQPKLSRKQFQDQEGKIVDGSGLWS
MSFPNSLQLCESNRKMSATSAAQSHKQSGNVRWTGGLNGHPQFSNIGMEASVGNW
PMHMISPCQSEVSGAHGGVDRNAARTMQVNNMGATEQQPSFDLWEMSKGAEVVS
RQIDSNCKLFGFHLIDNST<ins>GGGDPNPSKIRASVNEEELHVAAHASTETHLLSVEPDQQ</ins>
<ins>SEQTKTAKSDAPAGSCEQEKTSPRSSQETQCRASAQSNSTRSCTKVHKQGSALGRAV</ins>
<ins>DLTKFEGYTELIRELDLMFNFEGQLQDANKGWQVVYTDDEGDMMLVGDDPWQEF</ins>
<ins>CSIVRKIFIYTREEVEKMTPRTPPNMKLPGHAEEEKVARETPTR</ins>

Figure 863: Amino Acid sequence of SEQ ID NO: 1322. The conserved AUX/IAA family domain is underlined.

MPATNAKSEVDSKVSSQQPQHQNQHHHQHQPPLPLMYPWANAVQVPNTWQVSLE
QQQQQHRGSYGAFPTQAAARVMVGNVMAAAAGSITLNEAPH<ins>GIPSESRAKSSQESV</ins>
<ins>SASAMRPPMPPPAPSERQQKNPTGNEALTPPSNGNGNSAASRVSPVVGWPPIRSFRK</ins>
<ins>NLAPQPKPDIEDPTDASGNSYASTDPGQSFGDSMFVKVNMDGVPIGRKIDLKAYDSY</ins>
<ins>DKLSQALEEMFKRFINVQDSGQRQPTNPSSKNDQPTLLSGTDYVLTYEDNEGDRML</ins>
<ins>VGDVPWDMFVSTVKRLRIMKSSEARGLAPRHPLKPQGQVTQ</ins>

Figure 864: Amino Acid sequence of SEQ ID NO: 1347. The conserved basic-leucine zipper (bZIP) transcription factor domain is underlined and the basic-leucine zipper (bZIP) transcription factor domain signature is in bold.

MNSTTTQFVSSRRMGMYDPIHQIGMWDENFKQNGNPNAPPALIIPMHANLDNQSED
TSHGSQDTAGKYEQETS<ins>KPYDKVQRRLAQNREAARKSRLRKKAYVQQLEASRLKL</ins>
<ins>MQLEQEVDRARQQGVYMASGVDSAYPGYGGCLNSGIVAFEMEYGHWIDEQNRQIC</ins>
ELRAALNDHRTDVELRILVESGMNHYLELFRMKAVASKADVFYVMSGMWRTSSER
FFLWIGGFRPSELLKVLMPQLDPLSDQQWAFVSNLRQACQQAEDALKQGLDKLQLN
LAEAVASGHLGEGNYIPQVATALEKLEALVSFVNQADHLRQETLLQMSNHLTTRQA
ARGLLALGEYFQRLRALSTLWATRPREPA Figure 865: Amino Acid sequence of SEQ ID NO: 1350. The conserved basic-leucine zipper (bZIP) transcription factor domain is underlined and the basic-leucine zipper (bZIP) transcription factor domain signature is in bold.

MDTEEMDTPTKTTKTPTSQEQTSTSTPVAYPEWAAPIQALYNSGKTPLPPGYFHSAV
ASSPQAHPYMWGLQHMMPPYGTPPPPYVAMYSHGAMYTHPSMPAGAHLYGSYGM
SSSGVSNEVTAGAVTASVEGETKSSQAKDRSPLKSTKGSLGSLSMLTGKTNETGKET
TANGVFSQSGESGSEGSSEGSDGNSPNGSQSGQKTRFEQGSTEADESQNGNATSRNG
QIANTDRASGGQVTTINSSPAMGAVPMSLPGTSGTATAPMTNLNIGMDYWCVTAPT
PLSNMRGQLPLSPTTSTIIPAQNMPAMGTELSLQD<u>ERELKR**QRRKQSNRESARRSRM
RKQAECEELARR**VEELKSENLALRTELTRLQEECEKLTAKNNSL</u>TEKLKNVHDNESR
ETRVKDELENADTEQ

Figure 866: Amino Acid sequence of SEQ ID NO: 1356. The conserved B-box zinc finger family domains are underlined.

<u>MRIQCDACEQATASVICCADEAALCRECDIKVHKANKLASKHKRLSLLETSRKLSRC
DICQDRAAIVFCLEDRAMLCQDCDESVHSRDTLAAKHQRFLATGIRVGLNALSSESP</u>
GSSEFDKQPSSISNPTAPTHATPRMGSTHSSSAKSIPLGEPCWSMDELLPISDFESKGDP
EGLGEFDWEVDGLDHLGLFEQQQEQEEALACRVPELCPTGPAGGRPNFTVKGKSKA
EIPTVPDFDEACIVPDIGSLDTHEFYPTPQLKRARRSSFEAW

Figure 867: Amino Acid sequence of SEQ ID NO: 1381. The conserved C2H2-type zinc finger family domains are underlined and the zinc finger C2H2 type domain signatures are in bold.

MKGSETQELAMTFRLLAASTPGSGVTSDFLSIPWQELTMSQIEKMLEETKKMLFLNE
K<u>VHDCSECGKRFATPSSLKDHLNEHSGDKPYNCKFEDCAMRFKSKQLLCRHLKKH
ECAHKCMFEGCGKRFAFRERLIVHQKIHSNERPL**VCPWEGCGKRFKWTNSLQG
HKRTHTGEKPFQCTYQGCGRHFGYKVDLTRHLRTH**</u>NGQPARGSH

Figure 868: Amino Acid sequence of SEQ ID NO: 1391. The conserved C-x8-C-x5-C-x3-H SEQ ID NO: 3667) type zinc finger is underlined.

MQVGSLNGTKLGMEFLNFGTGKRPTQM<u>ADVKPCLYFARGFCKHGSNCRFSHAENY</u>
LSVPVSASSSPSGSVSDEPISSGSLERLELELQELLRAKRTPISIASLPQLYYERYGRTLQ
AEGYLTESQRHGKAGYSLTKLLARLKNTVRLIDRPHGQHAVVLAEDAPRFTEYRSER
SDITAGLIAGSRQIYLTFPAESTFTEEDVSNYFRTYGPVQDVRIPYQQKRMFGFVTFVY
SETVKIILAKGNPHYVCGARVLVKPYREKGKHGDRKSTEKLDHSKYMAAAYNLDL
DYDLQLGPRIDTSEVMRRQLLAEEQEQAIEMERTRLAELHLFNQVSKITTVNNAIVTH
EQHNDFDDAKATDQDLNDFSLTDHFSYLLEVLNSDSMSGEKPKNNNTSDQDSSHGH
NLPDSPFTTPRASYTANNISAAT

Figure 869: Amino Acid sequence of SEQ ID NO: 1412. The conserved transcription factor CBF/NF-Y/archaeal histone family domain is underlined.

MDEQSAMQHMPMHYRATPYPNAQLQPNIAHGAFQQPSIHGHPHALSSHHNQLPYQ
QQIHQHQRQLHHHQQQQIEVFWANQMQEIEQAVDFRNHSLPLARIKKIMKSDDENV
RMISAEAPVVFAKACEMFINELTLRAWIHTEENKRRTLQKNDIAAAIARTDIFDFLIDI
VPRDELKEDQVINLGNPRSVLSVGSSSTNAAAAAAAANSFPYYYLPNQHSVPHGVFV
GKPMDPTIYMQQPQSPVAYMPNIWQWGHVQADQSRSPNPAS

Figure 870: Amino Acid sequence of SEQ ID NO: 1422. The conserved transcription factor CBF/NF-Y/archaeal histone family domain is underlined.

MKKKLDTRFPASRIKKIMQADEDIGKIAQAVPLLVSKSLELFLQDLCDRTYEITLQRG
AKTVSASHLKQCVHRYNVFDFLREIVNKVPDMGGSDAATGEERNGGRRRKAQEGD
ENESDEDEVKRARMGAHHGSGRGRGRRGRGRGSRGGSSGRNGITVEKFEDEDLDLS
SEHSEKQEKVSEIFTDVNTETRETKVAVNLVSTPVVRDFDLNMELDESGVVASMPTQ
PVVKLEHHPSDAANVPVIVKEADEFPSDVPIVQHPIKQEEQYPNWSHSDVDNVAIDS
MQFHVHSDRIVDQDEDDYDEDG

Figure 871: Amino Acid sequence of SEQ ID NO: 1423. The conserved transcription factor E2F/dimerisation partner (TDP) family domain is underlined.

MTQVQFDLQTILILSMLFVGASHSQSSAMFPAGSIQSMSNGVGLVSAPFLISNVPNNK
NCLQRDLINELHEAGIYDYAQSLGIIQNGVIVVQNELWPGAGAYSLPISNGTPTTYPQ
FNPCPSVPLVSVDTGSNGSSSRGSDGAMARLASDNIMARLNHLDAEGDEFESPGTVG
RKRRRIHRSSIGVTGGRGLRHFSMKVCKKVESKGWTTYNEVASELVAEFVNPNSTHL
SQDQQQFDEKNIRRRVYDALNVLMAMDIISKEKKEIRWKGLPTTNLSDIERLKTERK
RLTNRIDKKRAYLQELKEQITGLQNLVQRNERVYESGNSPSGGVTLPFILVKTRPHAT
VDIEISEDMQLVHFDFNSTPFELHDDAFVLKAMRFCKTPDSNGPVDEKPDNEFMKNY
SILSTMHRGTSSPHSTRTSDTDSYSLSSIPGKICSSSPDPGIIKTRIKNENFI

Figure 872: Amino Acid sequence of SEQ ID NO: 1429. The conserved Myb DNA-binding domain is underlined.

MKEEDWLAKWEEELPSPEELMPLTQNLITPDLAAAFKIHTSSASASAPTESGSVFPGS
GQQQQRPGGEPPKRIELEEEESSVGGVTENVGEEPARTLKRPRLVWTPQLHKRFVDA
VAHLGIKNAVPKTIMQLMNVEGLTRENVASHLQKYRLYLKRMQGLSSEGPSACDQL
FASTPVPPSHFLHRDDMVVPLVPMGIGVPGLSHGHMVAGPPHYGGFDPRFLTTLSRQ
QQQQQPPPPQRLAPSAATPRGEYVMVEDLSSTATPPRQVLTLFPTGDN

Figure 873: Amino Acid sequence of SEQ ID NO: 3658. The conserved Myb DNA-binding domain identified using InterProScan is underlined.

MVSVNPNPAQGFYFFDPANTRIHGVNAGSAAEGGGAAPPYAEDPSKKVRKPY<u>TITKS
RESWTEQEHDKFLEALHLFDRDWKKIEAFVGSKTVIQIRSHAQKYFLKVQKNGTSEH</u>
VPPPRPKRKAAHPYPQKAPKAPVVSQVNGPFQVSSAFLEPGHIVRPDGSALLGNSRTS
VALSSWSHNSVPAMSASQGTKDVGISGPPVPSNCCNSSSNDSTPRSWPNAQAIEPLD
QQKHLRVMPDFAQVYRFIGSVFDPDAGGHLQRLKQMDPINLETVVLLMKNLSANLT
SPEFEKYQHGLFASYEGGPEKSKSGGSFKLLPEKSGSLILSA

Figure 874: Amino Acid sequence of SEQ ID NO: 3659. The conserved Myb DNA-binding domain identified using InterProScan is underlined.

MASRKEVDRIKGPWSPEEDEALRLLVQKHGPRNW<u>SLISKSIPGRSGKSCRLRWCNQL
SPQVEHRAFTPEEDDIIVRAHARFGNKWATIARLLSGRTDNAIKNHWNSTLKRKCSPP</u>
LSPLAEEGNNRAFDAAAGYDGDLSPRERPAKRSASAGPCLSPGSPSGSGMSDSSVHF
VYRPVAKTGPVVPPPVEATAAAVSSTEDPPTSLSLSLPGAADACEVSTRVPAEPTQPA
TRPISLLPMASDPAPTPACAPPQAVALPEYPRYSGNNNSSSIFPYPPPSPRVGADFSPFK
AEFMAVMQEMIRAEVRNYMAGMCSQAAAADIRNAVVKRIGIGKIE

Figure 875: Amino Acid sequence of SEQ ID NO: 1432. The conserved Myb DNA-binding domain is underlined.

MRRQKLPGLSYCEGNTMVSLNSFPASMASGESWNPACSSHLLPQNLSPNCFMPSDY
SVFPSSSSNKELSNSTFVQPNATSHMIMPGSTTLCTNLQSSKPITSQQQQPPFDSLPLIY
PPSKSPVQSQQSGVCEAAFLRDSTKSTSQDVGMGDLFPDFLIFPPNALECSQPLENIDA
TRIAPQYDPNQSEWHTWADRLDSSDDALCPGFWKEPANVDNNPKTGLNTINQTSTV
STTNVGSHQTQLQPQLCQQIFAPTVGTHLAPSPTACATTTSSK<u>TRLKWTPELHERFVE
AVNQLGGAERATPKGVLKFMDSEGLTIYHVKSHLQKYRMAKYIPKHADGMEDKTR</u>
NSFDTSASFDLKTGMQITEALRLQMDVQKKLHEQLETQRTLQLQIEEYGKRLQKML
EEQQKTGRKIECDPKAADDQSKSDAVGGSTPE

Figure 876: Amino Acid sequence of SEQ ID NO: 1433. The conserved SHAQKYF SEQ ID NO: 3671) class Myb-like DNA-binding domain is underlined.

MFQNKKFSTAGLVPQRFHGSEQRGAGPLGVTSGSSGSPVTSGGSGSA<u>KQRLRWTPD
LHDRFVEAINQLGGADRATPKGVLKVMGVQGLTIYHVKSHLQKYRLAKYIPESLEG</u>
GKSDKKKGNEIISNLEATSGTQIAEALQMQMEVQKRLHEQLEVQRQLQLRIEAQGRY
LQKIIEEQQKMGTAKHETLSSPETSPPRYGEPGDITDKAFPDSQSPGKSGRQRQDGNA
AMPSVDIAQTDQSADVAYGRDGPQLQASSYAYRVGDGMTSSDSPKFGSPSKRSRLN
NDTGQPKQENLSSHPRDQQQTLPMSYSSQASHLKVGEVPGSIYQNRVVGLVGKIETR
PSQSTADLQAEQSPGKLSRNNLDCISHAQEFHRPLCAKTASDSIRFVSPGSQIQVPASS
LPASSHDEFSSALDGHDGCHNVSSSQVSLFGPWA

Figure 877: Amino Acid sequence of SEQ ID NO: 1434. The conserved SHAQKYF SEQ ID NO: 3671) class Myb-like DNA-binding domain is underlined.

MNSFVPNFNSQPENRNPTSKLIPQTEKMYQVKKPTMECHSERPVMLQEINVPTETGL
VLSTDPKPRLRWTAELHERFVDAVTKLGGPDKATPKAVRTRMGVEGLTLYHLKSHL
QKYRLGKQPHKEVNVDTSRDGSSHGGPVAGYGSTACRVPEVQVACNSVSSIIPANM
TETLQITEALRMQMEVQRRLHEQLEVQRHLQLRIEAQGKYLQSILEKARETLAGYNV
GSIGLEATRAELSELASKVKSECFNSTFSALTFSTMPEIPGLFPESQIAHQQSQAADCS
AYSCLTSNESSEKSPTENLQAGGRKRPRSAYDNKVQFWQDEIREDIRLQELTGEENLS
SPSSRTKDSSIVFHERANSDIVQAEENGNRLSDKKGKEYEMNGVLVDPPITRTLAFSS
ALSLQENSQMYESSKVYTNQDKTRSKGYNKFSKMTQGFGLEFQR

Figure 878: Amino Acid sequence of SEQ ID NO: 1436. The conserved Myb DNA-binding domain is underlined.

MTMGSPSELTLGCRLSATSYSSVLKAINLASDQFERTRRLDEYLKGLEDERRKIEAFK
RELPYCMHLLNDAIAASKEQLADCQPSVQAPKPTQQTGLQFEEEQYNRPVLEEFIPIK
KRCDESGDESQENNQNDSKRTKFANGEKPNWMVSAQLWSQNSESVECKKEKTSSPE
EPLKQHDSQLRSDQEQLFPTNSNLFSDSKQRTGGAFLPFSRERQSNPSVSARSNTVKA
PPDLALSSVEQEVGSTFRCSETAPMNNVTITALNRSKEPTETTVPTPQKEAAAKPNGA
VSVVPTPAASNATQSGGQSQRKARRCWSPELHRRFVNALQQLGGSQATPKQIRELM
KVDGLTNDEVKSHLQKYRLHTRRPSPSPPTPASQAPQLVVLGGIWVPPEYAVATHQG
PGLYSTVSNTTSSHSQSHYCQSPMPQEHYSQMNMSSQLQLPQPGYCEQQQTPSQSLS
SPQGPLQLTGQSSGARGTSVDGGREESVGEDGKSESSSWKGEENAKNVEARNMGRG
LSLRKQPLQSVDGDEEDSRGSETTLKF

Figure 879: Amino Acid sequence of SEQ ID NO: 1447. The conserved HMG1/2 (high mobility group) box family domain is underlined, and the structure-specific recognition protein family domain is in bold.

MADGHQFNNILLVGRGGTNPGQLRIHSGGIVWRRQGGGKVVDVAKNEVKSLSWTR
VPRGYQLGVKLKAGLNIKLAGFREQDVGNLTNFMTNTIGLAPEDKQLSVSGRNWGE
VDLDGNMLSFLVGSKQAFEVSLADVSQAQLQGRNDVLLEFHVDDTTGANEKDSLIE
LSFHIPNTNTTFTGDESRPPAQILRDKIMQMADVGVGPSGESVVVFEDVAVLTPRGR
**YTVELHLSFLRLQGQANDFKIQYSSVVRLFLLPRSNQPHTFVVISLDPPIRKGQTF
YPHIVLQFATEELAERELSISEELLNSKFKDRLEPSYKGLSHEVFIQILRGLSGAK
VTRPGKFRSCQDGYAVRASLKAEDGVLYPLEKSFFFLPKPPTLILHEEIEYLEFE
RHGAAGTSSMSSHYFDLIIKLKSEQEHQFRNIQRNEYHNLFSFINTKGLKIINLGA
TETIGGVAAALQNSDDEAVDPHLERIKNLRDGGAGAEDSDEEDEDFVAENDDAGSP
TDESEEEGSDASESAEVKQPAKKEVKKKKAVAPKATETKKKKKDDEEEGGKKKQR
RKKKDPNA**PKKAMTGFMFFSQVERENLKKSDPGMAFTDVGRTLGERWKKMSAEEK
APYESKARADKERYKFAMADYKSGPTNVDSGNESDSE

Figure 880: Amino Acid sequence of SEQ ID NO: 3660. The conserved Myb DNA-binding domain identified using InterProScan is underlined.

MTRRCSHCCNKGHNSRTCPVRGGGGDGGGAAAAPSSSSPSTSSSGAAAAAAASASG
GGVKLFGVRLTDGSIMKKSASVGCLSAAHYHSSSSAAASPNPGSSPIDGSDGYLSDDP
APGSRSSNRR<u>VERKKGNPWTEEEHRRFLIGLQKLGKGDWRGIARDFVTTRTPTQVAS
HAQKYY</u>IRQSNAGRRKRRSSLFDMAPDMATADQPSHPEETFLPPLVRLNDDTNSTTS
TSMGLDLERTPMETSHPETSEGGGDVAMESIDQVPLVPCYFPYYLPLPFPMWPPNMA
PPEDGRVVETSHHRVLKPIPVIPKEPLNIDQIVGMSQLSLAENEPAPLSLKFLGETSRQS
AFIKAPSSVNESDLDNCKDGATQAA

Figure 881: Amino Acid sequence of SEQ ID NO: 1452. The conserved ZF-HD class homeobox domain is underlined and the ZF-HD homeobox protein Cys/His-rich dimerization domain is in bold.

MFCGGDGEGLMLEQRALGHMMDLGNTQHMPVSMSAPYGVYPSGNGNGNAAIIMV
LPHDESSSNPLNPQNPINPRNPMEAASAPLA**TKVLRYRECQRNHAANIGGHALDGC
GEFMPAEDDTLKCAACGCHRNFHRREVEGDE**QPPSNCECCLRKKRGGGSSSGPG
SPAAPYYPLPLPHGSSAPHMLMALSSGLTESDDPDGNTHNNSNNNLSHHHHRGM<u>KK
RFRTKFSQDQKEKMHLFAEKMGWRMQKQDEAIVQQFCNEIGVGKGVLKVWMHNN
KHTLGKKS</u>

Figure 882: Amino Acid sequence of SEQ ID NO: 3661. The conserved Myb DNA-binding domain identified using InterProScan is underlined.

MRKPDASGKNSSNSNANKLRKGL<u>WSPEEDDKLMNYMLNNGQGCWSDVARNAGLQ
RCGKSCRLRWINYLRPDLKRGAFSPQEEELIIHLHSILGNRWSQIAARLPGRTDNEIKN
FWNST</u>IKKRLKNSSSSSCRHSPNTSDSSLSSDVKDVMGGLISLQEQGLMPLYMDSLSS
VQALALNQVIDPLLPSLNQGLDLPGLSGYCDANSNYCAVQGGVSGEFGRFGGVVGC
GSNGDQLYVPPLESISIENVKTENTYDSEHNSSNDLSNFNYTTDDVVDNIGNFNDYGR
IESMAGLGNLWNGGEEMKVGEWDLEELMKDVSSFSSADFQVIQ

Figure 883: Amino Acid sequence of SEQ ID NO: 1481. The conserved Floricaula/leafy protein family domain is underlined.

<u>MDAEHFPVGFFRWDQRPAPVVAAAAPTTTVFNKDHGRPLEVILPMNGRKDLKSLE
DLFKEYGVRYVTLAKMTEMGFTVNTLVNMTEEEIEDLMKTLVELYHMDLLIGERYG
IKSAIRAEKKRLQDSLEMQRLEILSEAERKRILHDDQNTFAAAMASEGTSKELRANDP
LIFPESTSADHAPMNIASCKDSTLILQNSNQAQFCGSGLIGVPEHSSESDERKADTNKQ
KRRRSKEPGEDGEDRPREHPFIVTEPGELARGKKNGLDYLFDLYEQCGKFLLEVQRI
AKEKGEKCPTKVTNQVFRHAKHNGAVYINKPKMRHYVHCYALHCLDSEQSNHLRR
LYKERGENVGAWRQACYYPLVAIARENNWDIEGIFNRNEKLKIWYVPTKLRQLCHM
ERSKECQ</u>

Figure 884: Amino Acid sequence of SEQ ID NO: 1482. The conserved Floricaula/leafy protein family domain is underlined.

<u>MDPESFSAAFFKWDQRPPALAPPQMQRSAGLEAQRIFHDFGVPNAAAMAASNNSSS
CRKELNCLEELFRNYGVRYITLTKMVDMGFTVNTLVNMTEQELDDLVRTLVEIYRV
ELLVGEKYGIKSAIRAEKRRLEEAERKRMEQLFVDVDGKRKIDENALDTLSQEGLSV
EEPQGDNAIILSQNNTSANFPLNLNAGMDPVLILQNSGHLGTTVSGLIGMPDTNYGSE
QTKACKKQKRRRSKDSGEDGEERQREHPFIVTEPGELARGKKNGLDYLFDLYEQCG
KFLLDVQHIAKERGEKCPTKVTNQVFRHAKHSGAGYINKPKMRHYVHCYALHCLDI
EQSNRLRRAYKERGENVGAWRQACYYPLVAMAKDNGWDIEGVFNKHEKLRIWYV
PTKLRQLCHLEKSKQSHL</u>

Figure 885: Amino Acid sequence of SEQ ID NO: 1505. The conserved MADS box SEQ ID NO: 3668) domain is underlined and MADS box SEQ ID NO: 3668) domain signature is in bold. The conserved K box is in bold/italics.

<u>MGRGKIEIKRIENTTNRQVTFCKRRNGLLKKAYELSVLCDAEVALIVFSSRGRLY
EFANHSVKRTIERYKKTC</u>***VDNNHGGAISESNSQYWQQEAGKLRQQIEILQNANRHL
MGDGLTALNIKELKQLEVRLEKGISRVRSKKNEMLLEEIDIMQRREHILIQENEILRS
KIAE***CQNSHNTNMLSAPEYDALPAFDSRNFLHANLIDAAHHYAHQEQTTLQLG

Figure 886: Amino Acid sequence of SEQ ID NO: 1514. The conserved MADS-box SEQ ID NO: 3668) transcription factor family domain is underlined and the K-box transcription factor family domain is in bold.

MGRGKIEIKAIENPTNRQVTFSKRKAGLKKKAHELSVLCNAQVALIIFSATGKIFKYSS
SSMREIIDRYQRTEKTKLWDSEDQHMFSMIERTKSENETLRSTLRYMRGEDLDL
**LNDTNKMANLEKILETATARVRRRKNELMAKQSDDLERTVDFLQHQNEQLLK
VLECHSRMGNPVHGYSASPPLCYQVEQQQPQHQHQQHIPLHILMPDVPVKPSQPNL
QDSGYPQPDLQLGYDQLIPLLSIFS**

Figure 887: Amino Acid sequence of SEQ ID NO: 1523. The conserved Myb DNA-binding domains are underlined and the Myb DNA-binding domain repeat signature 2 is in bold.

MGRSSCYSKQGHS<u>RGIWTPMEDMILSEYIRIHGSDGWKNIAKRAGLKRRGKGCRLR
WLNYLRPDIKRGNISPDEEDLIIRLHGLLGNRWSLIAGRLPGRTDNEIKNYWHTHM</u>
SKKLYPSMNDSQPKSSQKLRRRAKSPVPVNPVFKATAVRIKPAMRLPGIVRENGYN
DAGSSNLISYEAFRLCNVKEIRKSSWGDLLVNDSIGYEESDLIALGLADNPVETSATN
PLSPMWSLADQQSPHYDHFEEDAATLAESSFYLNEKSSQDCNLLPSLSDCSTGFTSEG
LYREMVELYDNAEHDDWIHEFGYLEK

Figure 888: Amino Acid sequence of SEQ ID NO: 1525. The conserved MIP family domain is underlined and the MIP family signature is in bold.

MGRSPCCAKEGLNRGAWTKTEDIILSEY<u>IRIHGDGGWRSLPKKAGLKRCGKSCRLR</u>
<u>WLNYLRPDIKRGDISPAEEELIIRLHRLLGNRWSLIAGRLPGRTDNEIKNYWNTRLSK</u>
<u>KLLLSMNKSQCKSRKNLKSKAKPSPIQNRVFKTTPVKITTTVRLSGTATPNGSMNGY</u>
<u>GRSNPSSDKASKLCNVKETTNSSKSWCEHLGIDTDATISTSSMSSLPLERSPHSYYFG</u>
<u>ADAAPLAESLLDLNELGLTVSDDQRIEEF</u>YDHTQHLDWIHELDYAEGPSPQSLSLLLL
ESDDEREERLGDHGQIP

Figure 889: Amino Acid sequence of SEQ ID NO: 1549. The conserved Myb DNA-binding domains are underlined and the Myb DNA-binding domain repeat signature 2 is in bold.

MGRSPCCDKVGVK<u>KGPWTPEEDIALVSYIQEHGPGNWRLIPVRTGLLRCSKSCRLR</u>
<u>WTNYLRPGIRRGNFTPYEDNIIIHLQALLGNRWAAIASYLPQRTDNDIKNYWNTHL</u>
KKRLTKQQTMIAGNELNHDDSIRRSSFSSDDYRSSRGQWETKLQTDIHRAKKALFEA
LNMRDPSSSLQTSGTTLDSTFMERNSNSSYAVSMENLTKLLEGWKQSSPNEIKASSN
TINPLEGNQSQSSQYSAEVPISCDSEIDCLHDVDNGSLAWVSPFNSSQDYGDDGGSLH
DFDLYQSDSYQNTMDSNLPFSVLENWLMEETN

Figure 890: Amino Acid sequence of SEQ ID NO: 1563. The conserved Myb DNA-binding domains are underlined and the Myb DNA-binding domain repeat signature 2 is in bold.

MGRAPCCDKANVK<u>RGPWSPEEDTILKNFVEKHGTGGNWIALPRKAGLKRCGKSCRL</u>
<u>RWLNYLRPDIKHGDFSEEEDDIICTLYTSIGSRWSIIAAQLPGRTDNDIKNYWNTRL</u>
KKKLLGKCSKDNDNQQIRRLLAKEAAKGAGIRGLYNGDHNISSETAAISASNTQSSS
ESLTETATAANAMNSPYSALETGKVPGSNSSESKAAGFNATHSPNTHYYEQGFSQFM
SQADQYSSLTHMLLRLENNESDCSTDNIQSLGIDTIPSEVPFYASTAMNVKAEAMERP
SSDPQLNQARNSVPALWETCTSNSTSGGNNYQFSTLINDDTGNFSYGLSADMDEFIV
YRNYGGNGSISQVKEEPDYSTAEAYWASQLAEPAKSSGLTTTCPNYSYILPSSEGGM
GSGTTPQGLFQEGIIY

Figure 891: Amino Acid sequence of SEQ ID NO: 1566. The conserved Myb DNA-binding domains are underlined.

M<u>KERQRWRSEEDSLLLSYVKRYGPREWNLISERMNRALDRDPKSCAERWKNYLKP</u>
<u>GIKKGSLSEDEQRLVISLQAKYGNRWKKIAAQVPGTTAKRLSKWWEVYREKQDKIK</u>
DRNERTIADSATKIEEGKYDHILETFAEKYMQKQKQLATSSGCNLPTIAAMPSGLPPPI
SFSMPTSSTPDFIHFAIPSASTPTTCSFGAPTPCLPPWMSNRPNSAHGSGAEPFLHSSPL
SKSSPSSSSSPSVTLSLSPSSSTPVMSANTASACSSWKQDTAKQSSENNVSGDSEAAK
DKNRGISHVQMPSMDPSNSASSHQAAGGQGVIMQEISLFFQHCRELEERQQSWSVH
KKETSWRLKRLEQQLEAEKARKRREKMEEIESKVRALREEENSYLDRLESDYREQLS
RIHRDAEIKEARMMEMWTAKHVQITKFFEQMVHRHDPHKSI

Figure 892: Amino Acid sequence of SEQ ID NO: 1567. The conserved Myb DNA-binding domains are underlined and the Myb DNA-binding domain repeat signature 2 is in bold.

MGRTPCCEKNIGLKKGPWTPEEDQKLIDYIQSHGHGSWRALPKRAGLLRCGKSCRL
RWTNYLRPDIKRGQFSFEEEQTIIELHAVLGNKWSTIAGHLPGRTDNEIKNYWNTH
LKKRLLQMGIDPVTHRPRTDLLAFPNIQSSIFNTPGFGHMAQWESARLEAEARLTGE
YLRQALFMAGNGSATADLFMRPCKSEFGNDQFNLTKNMGNPPWIQQPGMALDYKG
AVPQSLEQFLQTNVCSASDINGGGCLSHEGGFSITRFASPCSTLDGIQIKTEPQSLCGP
QVVKNDSQFLHSEGDLRKQAMLDMNVGSNVLSNMNAESKVSFGHNGIITDQEYNN
LGQIDNNNHLSHAATTLWPVEGQLQAIASDSMPGLISSTSCTSNNIYSQPGLIPLLNST
TSSMGDTNSYREAQPEQNQDQASKQYWSTMLKAAGTIPASHIISARQ

Figure 893: Amino Acid sequence of SEQ ID NO: 1568. The conserved Myb DNA-binding domains are underlined and the Myb DNA-binding domain repeat signature 2 is in bold.

MGRAPCCEKVGLKKGPWTPEEDQKLVTYIQEHGHGSWRALPQKAGLLRCGKSCRL
RWANYLRPDIKRGKFTVQEEQTIIQLHALLGNRWSAIATHLPKRTDNEIKNYWNTH
LKKRLLQMGIDPVTHKPKSESIMVPGVQSSNGSSNLSHMAQWESARLEAESRLARES
KLRARGLWSAQLRNVNASSDLFSRLRRASPGFESDREESKIPGLSSPLGFDCMKITQK
WDKFQDLRSGTKLDQCNLSVLGGSLGSYTPLENEDRASKTSYLGLLQQAMCPSAQG
SKILFNEAKKLVESQKNRQTNATATLHWSTYHIDQSENCDEKKPTIVSEKAHSDVQS
CSHEENVEPADSHHELLLSSVMLNDGNCSSARSDVSELTKTEQGADASYDKVGNSD
NILSEFQHIHYDEISSSGGLKSGSSYDGFNADMLLDLVVTPPNGYSTAGCGDNRSLSG
LSVDDNKEYWSNMFSVCNSLPNGNHSGVQGIF

Figure 894: Amino Acid sequence of SEQ ID NO: 1577. The conserved No apical meristem (NAM) family domain is underlined.

MGTLALPPGFRFHPTDEELISCYLKGKLDHGLKEAEIEVISEVDLYRNEPWDLPEKSL
LPSGDMEWYFFSPRDRKYPNGSRTNRATEAGYWKATGRDRKVYSRANTVGIKKTL
VFYRGRAPQGERTDWIMHEYRLEENECEAGPCLQVDAMPDTPRIQCESACLPSVESE
LRYIPVNISFPQYGVPNGHLDAYFEEERMLEEMLCVASQDYTNSKAYHTSLGDTCAD
ILNGGYIKVKNLIPSTGEVENHDSCLWEVPYPSFDHEETGIQLCSRSPVLQSHKQGFSF
EGTAARGVCMQFHKMEDSSEINEKDVTVRHSQNMRNDWYVSGQEREQLHFDRFAG
KKWDSEVRIKLNKL

Figure 895: Amino Acid sequence of SEQ ID NO: 1601. The conserved SBP plant protein family domain is underlined.

MQTSRGHNRPCMSSHNTDRPKPRNLRMTSELVEGSLESASSRNSSTLLDSPRLYWQD
QFVDPCSMWTLGYSSDHTTLEQPSGVIEKRGKLVHGCYFMKEEKGLFPARMELNYS
GPGSTAYSGGASEETCHGNTFCRTEISSFTGSQIPQCQSEGCKANLSSAKHYHRRHKV
CEFHSKAPTVVVGGQIQRFCQQCSRFHQTSEFDGGKRSCRKRLADHNRRRRKPKPSQ
CTTSQCQAGTTNLQDDDKKTKGLSGHAAAGIQIIPNMISSTNTTLPLITSAPLLSSGTM
MMFPNNYRGQIPVPQGTSNDKTSCVEFLHANIPQMV

Figure 896: Amino Acid sequence of SEQ ID NO: 1604. The conserved SBP plant protein family domain is underlined.

MNPPESTENEGDQISWVWDHSQHHHHHHQSHQSHNHNPGGGASGVVAAMSIGLET
RQFQGGGGRVLEYDWGSSPVLLSGGQGIPAQDTEERKPQIISAAAAGSVMDTIQYSG
NGNGNVNLAVNGMLSSGFGHNIISPNSMGNLLMSSSSAGTRNTYGGHNHHQQHHH
HHNNHHVLDSIRSSAPSPLLYSGGNSALSGFGSGVYADSTRAALEEHRNHILGLMGM
DQKNVFHNIVKREDLCGAGDFQTRIGLNLGLGGRTYFSSEDNIVNRLYKRPRAISPGS
QVP<u>RCQAEGCKADLSTAKHYHRRHKVCELHSKAATVVSGGLTQRFCQQCSRFHVLS
EFDEGKRSCRKRLADHNRRRRKPQPN</u>AVVTVSNTESSSALKTTDQDQDTNSGSNQSS
LQQPEVQISRSEPPGLLTGISLSQSLPLVLQTSKGQEQYLQQTGPNLSLGGEIALDYPR
HSSGGENYNGLEIPIPWLRPAGSGSEFGGSEKNSSNGQLSESGNGGGSSSTVQVFTSIQ
NLLPLQSSTELGTSEWMVNGNLSGSSSRGQHYGSADLNLQTSLEGQQMLSLLEKDV
RSSNTDRHNTEDAVEYFSQQQGLNSKNSIDGHSEHRNQLSSSFPGIQSLRTLSQSLYQ
NIL

Figure 897: Amino Acid sequence of SEQ ID NO: 3662. The conserved Homeobox domain identified using InterProScan is underlined.

MMMSGGRMYGGPNVLVTANENISRSADALEALLSSPVFNGSRSVANLEEVIGNVSK
RSFYNSFDQEETGDEDLDDCIHPPE<u>KKRRLTADQVQFLERSFEIENKLEPERKIQLAKE
LGLQPRQVAVWFQNRRARWKTKQLERDYDILKSRYENLRVDYDSLLKEKDKLRAE</u>
VTFLTDKLHDSDHEALTKDSESADKKVYPQPASHSDCVGEPERSTAAKDTPPGCKHE
DLLSSGTDSSGVLDEDSPHHVDCGHSSLDHVNSHLFEADQSDLSHAEEEEEEGMSE
KLLPQTYTYHHLLKVEDGAYPDASIAYNDMFVLEDQVQLPWWD

Figure 898: Amino Acid sequence of SEQ ID NO: 1613. No conserved domain identified.

MEEPLQIINSSPIQQQHDHDDDDHGHGHEEEVIPHPLLPPPGDTCIVPYIMPVSTSTAE
KHPPQPTNIAFNGPETEEDDKKRDREHKKRSKNWTRVETLKLIKLRTEFEPRFSRSGR
KTELWDEIAESLRKEQFFRDAQQCRDKWEKLMAGFKDVREGLKDRNDNPYYEDLH
PLLSGKCLRRENLKKEGDSTHNEKWDKLMAAYKDVIDGKREEGDLSYFVELRAIVG
GRPDEGKVQIESMP

Figure 899: Amino Acid sequence of SEQ ID NO: 1625. The conserved Tubby family domain is underlined and the Tub family signature 2 is in bold.

MALKYIIQEMRDGMESISRRSFEIKLYRGRSQSSVRDEMVQREAETEKDEEQQHVNW
SNMLPELLTEMIQRVEESEGAWPGRKNVVSCASVCKSWRDITKEIVKAPDLSGKLTF
PSSLKQ<u>PGARDPPMQCFIKRRKETSTYYLYLGLTPTFMENGKFLLAARRFRHPTSTEY
IISLDADDLSQGSNAYVGKLSSDFLGTKFTIYDSQPPHNGARLSSNRAGRRVASKQVS
PRVPAGSYNVGQVAYKFNLLGSRGPRRMQCLLHSVQFSTMEHIGKVSTCKEVSDSTI
DKSISTLNGEGSSKFSESSDIPVGKCAPIILKNKAPRWHEQLQCWCLNFHGRVTVASV
KNFQLVAAIDPSRPGAQVDQDAVLLQFGKVGKDMFTMDYRYPLSAFQ**AFAICLTSF
GTKLACE**</u>

Figure 900: Amino Acid sequence of SEQ ID NO: 1627. The conserved Tubby family domain is underlined and the Tub family signature 2 is in bold. The cyclin-like F-box domain is in italics.

MSFRSILQDVRDGIGSISRRSLDVKFSYSLRSRSHSAVHDSHYRSQVSLPQ*SCWANMP PELLRDVISRIEASEGAWPARKYVVACSGVCRSWRAITKEIVQTPQLSG*KLTFPISLRQPGP RDFLIQCFIKRDRATSSYHLYLGLTATLSENGKFLLAARKSRRPTCTDYIVSLDAEDM SRGSNRYIGKLRSNFLGTKFTIYDSQPPCTGAIASTSRGSRRVGSKQVSPRVPAGSYV VAHIAYELNVLGTRGPRRMQCLMDAVPASAMEAGGSAPTPTECPLSSLDSLATLPHL GLKSEVIETSFFSGPIINSNWKEGPLLLKNKAPRWHEQLQCWCLNFKGRVTVPSVKN FQLVAATEPTQPAAQSDHDKVILQFGKVGKDTFTMDYRYPLSAFQAFAICLSSFDTK LACE

Figure 901: Amino Acid sequence of SEQ ID NO: 2142. The conserved transcriptional factor B3 family domain is underlined.

MSASKACFNTKCGATSTEKWRAGWILRSGEFAELCNSCGFVYEQMRFCETFHSDDA GWRICSTCQKPVHCGCIASVYSFTHLDAGGIECINCSRKSDSHTSASNQIQQMVPILSL SQKSVSPIKSSSKHIGGITVPGQWLQVPISGGSLTSQIEVTPTKNTCEFQRSDTIVLPVE KHDNGQFSIFGLKLTDGDIRKNSQIGEPKGEIPEGFSKRSSIHEERENGEDFCLDRKET CPRIFTEEGFTKRLQESELQIRVMGTNKFVQDEHYEPDVLKISKEKVCTMEAPASACL NVPLRPFNPKEISDNSSTLITGVDRYQCNPMETKEQNQGISTCSQLQQQCQFIPRPPDG SPNTDSQLGNGVRCQMRVAQIPSEGRSQNLQTRYRPRITDQELQKICGDSNSIVKPL FEKTLSASDAGRIGRLVLPKACAEAYFPSISQPEGVPLKIQDANGKDWVFQFRFWPN NNSRMYVLEGVTPYIQSMQLQAGDTVIFSQLEPEGQIIMGFRKASNTTSKQEAQPSTT PNEASPNMGSDPGIFEKMSTDSNISEIPFHSRKRNRKSLVKALTSQISNAGFSLYRKEY KSRESSSFQSLLFRNKMQNHNLSSKRKRLQIDNEDALDLKVTWEEAQDFLCPPLTAV PSVVIIEGHEFEEYEVPPIFGKRTTFTTNQSRASCSVPHEGSSDDLEYLLHHSIDPRKKK DGKGQKGVDVSSGLDALANAATLGEKTTTSSIAATTRHPRHRPGCTCIVCIQPPSGK GPKHKPTCTCNVCTTVKRRFKTLMMRRKERQSEIEAENTRKKHNVVEEEGDVISGK KRLSDIDFHNENGLMKEDPDLTCKKRLTKVGNSIGNELKLASDVNLQAFCKDDKGG KEEYIVSKGQLDLNNQPDREEELDQRECDEQPSPEIGQTSMVNLLHDATLPLHMYLK QHGLPTLTYPPRINPTLQLQQTSGEERVEEQTSVQNEDHIKEEEFFPNRTQNDTHSIFV

Figure 902: Amino Acid sequence of SEQ ID NO: 2143. The conserved Pathogenesis-related transcriptional factor and ERF family domain is underlined.

MAGAMQMRNSKPELFDNEDLVGVSGSSSCFSWADQEQIQMRLRGSNSARNVPEMS ACAPTISGSWSELLMNGCNNAGDAAWYPSFQGSEANNQQQYAFVPDRAMDMGLQS MPSSQMGSSQLGVNSSQPLSISEIYEQIQANIQMQKKQQMDHLQLQLLLAKSHHSQQ VLGSPAYHYQQQQQQLKQLRDLSLSRNLLGARAQPMKLSAKNDSKLGIARPAKLYR GVRQRHWGKWVAEIRLPRNRTRLWLGTFDTAEEAAFAYDTAAYQLRGEYARLNFP DLRYLLLSNSDNGSHNVLSPPGNALSVLKSSVDAKLQAICQRLSQENSSENRLMAHS ANNEALENVKCEVSGSSNSSTICGAESASMSPSKCEVDSSTLQKAPSFSIFAELDECLT KMPSLDPEVIEDVLSS

Figure 903: Amino Acid sequence of SEQ ID NO: 2144. The conserved Pathogenesis-related transcriptional factor and ERF family domain is underlined.

MAVDTMQMARAGLKMEIGGVGVGGGCEETAASAVK<u>ETHFRGVRKRPWGRFAAEI
RDPWKKTRLWLGTFDTAEEAARAYDNAARNLRGPKAKTNFAIHDDSAALFNSGGG</u>
RAVPSQRQEWPSRPTFCSKQEPSEISNLSAIPAHPSVPGNDQVSSRVMENRAASTKRQ
KLLFGIHLLESSHNLQQEEDAVIYSSSRRQPPFLLDLNLPPAANDVD

Figure 904: Amino Acid sequence of SEQ ID NO: 2145. The conserved Pathogenesis-related transcriptional factor and ERF family domain is underlined.

MKKEVDPAIVVKRSREAETEELGS<u>KRFRGVRRRSWGKWVAEIRMLRCRSRVWLGS
YHTAEQAARAYDAASFCLRGPAAFLNFPESPPAQFLPYPLRPLHDIHLSPQQIRTIAAN</u>
YATMTPSSTSISTSTSGLQPQQSKPMDTSTLEEAGGEGSASVTTHVDSAKIGPRKMVF
PNLNDTLDDEFGDFLER

Figure 905: Amino Acid sequence of SEQ ID NO: 2146. The conserved Pathogenesis-related transcriptional factor and ERF family domain is underlined.

MDKEASSIPETMVTLATLSGASSKSASTVKSGVKRIPTQNRAASSSPQERTLKLK<u>IPTY
KGVRRRSWGKWVSEIKEPKKKSKVWLGSFDTPEMAARAYDVAEFYLKGKKQALLN
FPEMIDHLLQPLSLSPHDIQVAAEEAAVAFYFSEQERKSPRNPPVSNEPPSSHQLLTVIS</u>
SGFEATAVELPGEADTSNYSSSACTPTEGVGESESTVVEDDSFKSFHLFTNWAEAPLL
SPRPLFMVHEEEHNLEEGFLWSGF

Figure 906: Amino Acid sequence of SEQ ID NO: 2147. The conserved Pathogenesis-related transcriptional factor and ERF domain is underlined.

MAVETMRMSRVRLGSCEDESRAVK<u>ETHFRGVRKRPWGRFAAEIRDPWKKTRVWLG
TFDTAEEAARAYDTAARRLRGHKAKTNFSVTADDHNNAGAPALSWTQALHPQQPD</u>
LNAAAFAFVSNKRREVSSGSDRLEFESPNNSLHAAASEQAASSSPRRAPFLLDLNFPP
TADQENESAAPWN

Figure 907: Amino Acid sequence of SEQ ID NO: 2148. The conserved Pathogenesis-related transcriptional factor and ERF family domain is underlined.

MNVPVMGRTGGRSVLPKKVVEYKTVITKKFEEESLAHGGEFEGKRIPRRVKVISTDP
DATDSSSDEENGDGSGQPLYSGRVKRHIQEINIELPDGLPSCSEIEREEFRWMKKSSRS
NRRRQRIQAKPSSARLPAENEIESSSKYALRNVQKRDKKCNKKDDVFES<u>GKKFKGVR
QRPWGKWAAEIRGNDKGERFWLGTFETAEDAARAYDNAARKLRGLAAETNFPDTT
TS</u>ATRHKRAPRTSKESKPSPITPPGYH

Figure 908: Amino Acid sequence of SEQ ID NO: 2149. The conserved Pathogenesis-related transcriptional factor and ERF family domain is underlined.

MSSSSLRNNTVKGKHVATEPQRRRKVRSRNHGCTTVVETLAKWQELNSQVESSKDG
AKRLRKAPAKGSKKGCMKGKGGPDNG<u>RCNYRGVRQRTWGKWVAEIREPNRGSRL
WLGTFSSAEEAARAYDQAARVMYGSCARLNLPDISASKESS</u>VTSTSTTRVTCQSQEC
STSQQYEVSSEWKDSKIHSALDTDIGGQVPSSQSPGVDAVYEAGVEERNDDRISETD
QRYGSEMCLGVEAAQSDLPSKVEISDVVPDSALDLPVKSETNECTLPHILVPKDEPQD
VDGKNAFDLSQATLLRFRDEPQADLPSAAVTGALSNSEVQPISIKGELNESAEPLDSF
QDIQLQDLDEMFDPDELLNMMSGNDNKSELSEADTFNTLYFSSPWPQEQLLDGVLPS
CDPSSSPTLQYLQIQSPDNRLLQNPILDEGEQLHLDDRNFKDLGQLQPFNLDSFQQPE
YHVVKHVRLDDRQPLHPKVLDDGHFASFPYPYNNQGYQTEDARTRQVLSPEPMLTG
GLQGMQDARMFQDIFPSYN

Figure 909: Amino Acid sequence of SEQ ID NO: 2150. The conserved Pathogenesis-related transcriptional factor and ERF domains are underlined.

MKRIAADGESQSCFVSGSGSTKPRVKRVRRCVPKDKSQNATPGRR<u>SSVYRGVTRHR
WTGRYEAHLWDKNCWNQGQNKKGRQVYLGAYDDEEAAAHTYDLAALKYWGTE
TILNFPLNTYAKELEEMQSVSKEEYLASLRRRSSGFSRGVSKYRGVARHHHNGRWE
ARIGRVLGNKYLYLGTFSTQEEAARAYDMAAIEYRGLNAVTNFDLSRYMSRLRPAK</u>
DIINSDGDDVVVSNGDDSGSSLLVPAGVPIETSNNTDDDNMSSLLLLQQPPQLSWTPP
QLEEKESSSAAPEDPTDDLDHLFSQSSKFKEIMEIRSSGHGHGHKVPGVELEDLHNVE
TANFAEDLEMFFSNSSNMLGSDAELSLNVDSPGSAMNNNMFCQPDHLHLQMPFDM
HDLCSGEFLDLDHHGQQPELEYPLIDPISSFPNFAVRTCS

Figure 910: Amino Acid sequence of SEQ ID NO: 2151. The conserved Pathogenesis-related transcriptional factor and ERF family domain is underlined.

MACAPAVSDSPAENASPPFHLLLRVNNPTRMIRLDMKKLAAPYNPIACPCSALMITM
DGTGRNFDNGADGIRNRDAR<u>PRTYRGVRRRSWGKWVSEIREPGKRKRIWLGSFQTA
EMAARAYDVAALSLKGRSALPNFPDSVHTLPRPSSLNPRDIQLAAAQAAAELTQPM</u>
VSTDISSWQPQDQNLYDSNNNVNNDSVSASASDHDNHELSSVSMTSRDRFSLNEELL
ALHSPNWVMDMGCAGSDFLVSSPANCFNETDEYNYVLEPNGLDQEILPSSIFF

Figure 911: Amino Acid sequence of SEQ ID NO: 2152. The conserved Pathogenesis-related transcriptional factor and ERF domain is underlined.

MQSLFAESSEFMCSLKEDWLSVFTQNNDSEDHDLLMLLMGNNDSGHPQEILKQHPA
PAEKREEEHRESAEGKRY<u>SKHYRGVRRRPWGKFAAEIRDSRVRRWLGTFDTEKEAA
LAYDMAAFKMRGNRASLNFPVDVVTAALARGEQGSRFCSPYDEKFRRRLNGKRFK</u>
ETTEPEEQPPLKWRRHNLDTEQIEQRAGWEDGQICNGPASEVLELQDLGADYLEKLL
LLSCSSSSPSSATAVHEEEFVCW

Figure 912: Amino Acid sequence of SEQ ID NO: 2153. The conserved Pathogenesis-related transcriptional factor and ERF family domain is underlined.

MASTSGSMQGIYVSSSMGMASNRNEDWWDIKAVNSQQSSSRLLEASTPRPSTNQAP
SSYPRREDRPQTAESRVQAGNLSERDDSSSSLFHNNSSSSSSSSHLISFPAHYPQVISSIS
SSPSSSTLHQHGSEFFYLNQVTQAYPTHHSTHQAISFPQQQICFTNLQSPAQQQQLQF
QSGFPLVSFNNQQNLQQQQYQQQLVRQWSDALNLSPRGQLMKHGKHHDRRGFALA
RP<u>MKLYRGVRQRHWGKWVAEIRLPRNRTRLWLGTFDTAEDAALAYDHEAYKLRG
ENARLNFPHLFLNKGSTSPKACSVAAAPEEGNLQQKSDGGRNSTTSSTSTSALTANA</u>
AHQLGSPAAEGISDTAQAKSMDVEVKTDLDISAYEANTNLAPPAESGSEDFVKNEPQ
DLQFHTWPASPEYNIWGDLDENWLNSVPALETDMTWDVLFHNPIDSYVEGVDSDH
KLETQGQASPEHHSPPQQMYVWKDCK

Figure 913: Amino Acid sequence of SEQ ID NO: 2154. The conserved Pathogenesis-related transcriptional factor and ERF family domain is underlined.

MENFPDQEPDNAISLPHEDRG<u>SRQFKGIRQRKWGSWVSEIRMPRSRKKIWLGSYTTP
EQAARPAVRGRNADFNFSVPDIP</u>TASPLSREQIQHAAAEYALGQAPSSFPSFAGQLSI
MRFFGSFSGGFFWSKSGSNLLESQV

Figure 914: Amino Acid sequence of SEQ ID NO: 2155. The conserved Pathogenesis-related transcriptional factor and ERF domain is underlined.

MAITSQQHHMNALPYNERSEK<u>RPKFKGIRMRKWGSWGSEIRMPKTRTKIWLGSYET
AEQAARAYDAALYCLRGPNAKFNFPDTVPSIPSAFSLSRHQIQLAAARYARDELPSTS</u>
PSQHSNNINNGVSLASPSRSCRVSETELWSNSEQISEEQNFWASLLDSSECLNYQNFPS
IDDTSTLDFIPTWQDEQDRYISLDLWNF

Figure 915: Amino Acid sequence of SEQ ID NO: 2156. The conserved transcriptional factor B3 family domain is underlined.

MRTGFSQQHREGEKRSLNSELWHACAGPLVSLPAVGSRVVYFPQGHSEQVAASTNK
EVDAHIPNYPNLPPQLICQLHNVTLQADVETDEVYAQMTLQPLNTQEQKESYLAPDI
GTQSRQPTN<u>YFCKTLTASDTSTHGGFSIPRRAAEKVFPPLDFTQQPPVQELVARDLHD
NEWKFRHIYRGQPKRHLLTTGWSVFVSAKRLSAGDAVLFIRNEKGQLLLGIRRANRS</u>
QTVMPSSVLSSDSMHIGVLAAAAHAASTNCRFTIFYNPRASPSEFVIPLSKYEKAVYH
TRVSIGMRFRMLFETEESTVRRYMGTITGIGDLDPARWPNSQWRSIKVGWDESTAGE
RQPRVSLWEIEPLTTFLMYPPPYPLGLKRSWPQLQGITSLYGSDDGSFRRPFMSERGD
NGEQGLQTLNFQTISMDPWMQMQQRFEPSLSGIQSTAYHGMPTTVLQQTGNLNQSK
QLKFQQQQPVQSEQLQCRPQVQSQRNVIEQQQQHQLQQQVFNLEQHQPQNHLLQQ
QLQQQTLQQQAVHQQLQNAINEQQQSSFQHQQNKQQAFQVPNVVNSFTQLSTSQSQ
SPLSDISSVTSRPVFTNTGATIASPKSSSSASPLQSILDSLTSEGASTYLSVPRPSQSVVQ
QPAETWSCVTQDQQVAAPWFSSKRMSTNQIPCLPSGQTEASLSTGSHRILSQTEPKSQ
TNVPAQSMPLPQFPLRDCPTEQEGVQSDSQSNLLFGVNIDNPTLAISDTVSSARNVGN
GAYVASSFSVTDLLNVPPCAPVSGFSMNSNMGVSGGLDESGFSQPPPNFAKMNAPTR
TFTKVYKLGSVGRSVDVTRFRGYPDLRAELDRMFGLEGQLENPRSSWQLVFVDKEK
DVLLLGDDPWEEFVNNVRFIKILSPPEVQQMSQEDMEFWSSIPTQQQTSSSSEDCVAR
NSSRNISSVLTSTGSLEY

Figure 916: Amino Acid sequence of SEQ ID NO: 2157. The conserved transcriptional factor B3 family domain is underlined.

MRTGFSQQHREGEKRSLNSELWHACAGPLVSLPAVGSRVVYFPQGHSEQVAASTNK
EVDAHIPNYPNLPPQLICQLHNVTLQADVETDEVYAQMTLQPLNTQEQKESYLAPDI
GTQSRQPTN<u>YFCKTLTASDTSTHGGFSIPRRAAEKVFPPLDFTQQPPVQELVARDLHD
NEWKFRHIYRGQPKRHLLTTGWSVFVSAKRLSAGDAVLFIRNEKGQLLLGIRRANRS</u>
QTVMPSSVLSSDSMHIGVLAAAAHAASTNCRFTIFYNPRASPSEFVIPLSKYEKAVYH
TRVSIGMRFRMLFETEESTVRRYMGTITGIGDLDPARWPNSQWRSIKVGWDESTAGE
RQPRVSLWEIEPLTTFLMYPPPYPLGLKRSWPQLQGITSLYGSDDGSFRRPFMSERGD
NGEQGLQTLNFQTISMDPWMQMQQRFEPSLSGIQSTAYHGMPTTVLQQTGNLNQSK
QLKFQQQQPVQSEQLQCRPQVQSQRNVIEQQQQHQLQQQVFNLEQHQPQNHLLQQ
QLQQQTLQQQAVHQQLQNAINEQQQSSFQHQQNKQQAFQVPNVVNSFTQLSTSQSQ
SPLSDISSVTSRPVFTNTGATIASPKSSSSASPLQSILDSLTSEGASTYLSVPRPSQSVVQ
QPAETWSCVTQDQQVAAPWFSSKRMSTNQIPCLPSGQTEASLSTGSHRILSQTEPKSQ
TNVPAQSMPLPQFPLRDCPTEQEGVQSDSQSNLLFGVNIDNPTLAISDTVSSARNVGN
GAYVASSFSVTDLLNVPPCAPVSGFSMNSNMGVSGGLDESGFSQPPPNFAKMNAPTR
TFTKVYKLGSVGRSVDVTRFRGYPDLRAELDRMFGLEGQLENPRSSWQLVFVDKEK
DVLLLGDDPWEEFVNNVRFIKILSPPEVQQMSQEDMEFWSSIPTQQQTSSSSEDCVAR
NSSRNISSVLTSTGSLEY

Figure 917: Amino Acid sequence of SEQ ID NO: 2158. The conserved transcriptional factor B3 family domain is underlined.

MRLSSSGFGQQPPEGERRCLNSELWHACAGPLVSLPAGGSKVVYFPQGHSEQVAAS
TNKEVDAHIPNYPNLPAQLICQLHNVTMHADVETDEVYAQMTLQPLNAQEQKDCY
LGSDLGTPSKQPTN<u>YFCKTLTASDTSTHGGFSVPRRAAEKVFPPLDFTQQPPAQELTA
RDLHDNEWKFRHIFRGQPKRHLLTTGWSVFVSAKRLAAGDSVLFIWNEKGQLLLGI
RRANRPQA</u>VMPSLVLSSDSMHIGLLAAAAQSAATNSRFTIFYNPRASPSEFVIPLAKY
VKAVYHTRVSIGMRFRMLFETEESSVRRYMGTITGISDLDQVRWPNSHWRSVKVGW
DESTAGERQPRVSLWEIEPLTTFPMYSSPYPLRLKRPWPQGISSLHGIKEDDGGINTPF
MWMRDDGGDRSVQALNFQGMGMNHWMQQRFDSSLLGMQPDVYQAMAAAALQE
MRSVDPSKQLLQFQQQHHLQPQQFQCRSSPQLQRHIFQQQQAPQQNILQQQAQNLQ
EQSPQNHLLQHQLQQNSSQHHLLQQQLQHCFNDQQQPLSEQQQCQQPFQVPNVGG
ALSQIPSSQSQPAITLPSSMCPKPLFADSNGNLSSAMTIPTISTLQNILGSSSGGENSNYL
NLPSTSSVVHQPVGMLTGHGIPRDCQISSTSWVQKLLSNNLVPCHPGGQVEHLPSGG
QCVVPQTESLGQSNIPSSSMPMSLPQFASRECPPEQEGIHSDSQSHLLFGVNIDSSSLIV
PNTVSNMRSIGSSTDAVMQFGVSNYLNAPPCASGSNISLNSDISASACLDESGLLPPAE
NLGQMNAPTRTFIKVYKQGSVGRSLDISRFSSYPELRSELARMFGLEVGQLEDPLRSG
WQLVFVDKEKDALLLGDDPWEEFVNNVWFIKILSPPEVQQMTQEGLELLSSFPTQRQ
ASSSEDYVTRQDSRNLSSAITSVGSLDY

Figure 918: Amino Acid sequence of SEQ ID NO: 2159. The conserved transcriptional factor B3 family domain is underlined.

MRLSSSGFSQQSQEGERRSLNSELWHACAGPLVSLPAIGSRVVYFPQGHSEQVAAST
NKEVDAHIPNYPNLPPQLICQLHNVTMHADVETDEVYAQMTLQPFNLQEQREPSSLV
PELGAPSKQPTN<u>YFCKTLTASDTSTHGGFSVPRRAAEKVFPPLDFTQQPPVQELIARD
LHDNEWKFRHIYRGQPKRHLLTTGWSVFVSAKRLVAGDSVLFIRNENGKLLLGIRRA
NRSQT</u>VMPSLVLSSDSMHIGVLAAAAHATATNSRFTVFYNPRASPSEFVIPLAKYEK
AIYHTRISAGMRFRMLFETEESSVRRYMGTITGFGDLDPARWPNSQWRSVKVGWDE
STAGERQPRVSLWEIEPLTTFLMYPPPYPLRLKRPWPQLQGMSSIPGINDDDCKMMK
SIMWTGGDNGEQHLQGLNFQGLGMDPWMQMQDRFDSSVAGVQPDMYKSMAAAA
LQEIRSVDSSKQLLQLQPQQPVQSQQLHCVPQPLVHRQIFQHQQYPQHILQQRAQNL
QQQQQSQQNIHQQQAQSTQQQQPHHHILQQQALNVLPQQTPQHVTQHAQNVQQQI
QQQSSQHQVLQQLQQSYVEQKQSTSQQVQCQQQTFKISHVAGALSQTPVSLSDSPIS
LPSNVSSQPVLADSNANIASHASLSTACPLQSILHSLASDESSHYPNMQRAIQPRMPQP
SRNLTGPLSQDRQAASASCHSSRRVSNNQMESCPPAGQVESPLPSGGQSIVSQTQPTG
LSGGLDENGLLQCTPSLSQLNPPTRTFTKVYKLGSIGRSVDVTRFSGYHELRSELACM
FGLEGQLEDPCRSGWQLVFIDKENDVLLLGDDPWEEFVNSVRSIRILSPPEVLQMTQE
GMEWLNSISVQQQTSSSSEECVTGQDSRNISSCITSDRSLDY

Figure 919: Amino Acid sequence of SEQ ID NO: 2160. The conserved transcriptional factor B3 family domain is underlined.

MEIDLNSPDEYSNGRLNSSEELALSKSSICMELWHACAGPLISLPRKGTLVVYFPQGH
LEQASTSLKQQQMRPYELPPQIFCRVLNVNLHADQETDEVYAQVTLVPEPEPLEDAV
GDKEEEDEDVLNKPTPH<u>MFCKTLTASDTSTHGGFSVPRRAAEDCFPPLDYTQQRPSQ</u>
<u>ELLAKDLHGVEWKFRHIYRGQPRRHLLTTGWSVFVSHKGLVSGDAVLFLRGENGEL</u>
<u>RLGIRRATRQKSGILSSVLSNQNAHLSVLAAAASAVATKSMFHVFYNPRTSPAEFIIPY</u>
QKYVKSCKQPLSIGMRFKMRFETEDTAERRYTGMITAIGDADPARWPGSKWRFLKV
EWDEHAANEQQERVSAWEIEPSIAGAGLNVSSGTRTKRLRTTLLSTPVDVAIPDGSRL
SDFEESVRFQKVLQGQENMSFKAPSRNDGVGFMKCPILERKGCNAVAEGFETARTE
NAIWSSLERSDISSRLLDFGESIRFQKVLQGQEILPSKASLTSAGVDLMKFQHWDCKG
YHAEGSEGAMHGHKSWPSLGRPNVAPFSDVLSNKGKFGNAYGSDKIRSVEYSCEQF
SNTNTPHLKVFTKPHSGGNHATCTVNSQNLATIPRASPLSSIFGSRTRNDSELCVQGT
YPMCRMNVFQKNDLYGDYSQTFNRDLSAQFDIPKMAVGWQASSVSHCDSDNTQPA
GYTAGLSSSEPSKKQEKLIEVFLKQHQLPIGFHSTETDRGEIQGKQSCKLFGFSLIEEPA
CMDDVISSSIPHGDITQEGLPAIYGHGTVHSSISQNQDNLLKSSADRSGPPEALKGSAQ
QKTFQAVSGLSTLVQTPGRRRTKVHKQGNVVGRAVDLSKLDGYDQLICELERLFDM
EGLLNDPKKGWQVLYTDNEDDMMLVGDDPWQEFCNIACKILIYTHDEVQKMTPSM
FSDDANSSEEQPSTVEVSKSSIDNQDSSSPLMTGNQ

Figure 920: Amino Acid sequence of SEQ ID NO: 2161. The conserved transcriptional factor B3 family domain is underlined.

MEIDLNSPDEYSNGRLNSSEELALSKSSICMELWHACAGPLISLPRKGTLVVYFPQGH
LEQASTSLKQQQMRPYELPPQIFCRVLNVNLHADQETDEVYAQVTLVPEPEPLEDAV
GDKEEEDEDVLNKPTPH<u>MFCKTLTASDTSTHGGFSVPRRAAEDCFPPLDYTQQRPSQ</u>
<u>ELLAKDLHGVEWKFRHIYRGQPRRHLLTTGWSVFVSHKGLVSGDAVLFLRGENGEL</u>
<u>RLGIRRATRQKSGILSSVLSNQNAHLSVLAAAASAVATKSMFHVFYNPRTSPAEFIIPY</u>
QKYVKSCKQPLSIGMRFKMRFETEDTAERRYTGMITAIGDADPARWPGSKWRFLKV
EWDEHAANEQQERVSAWEIEPSIAGAGLNVSSGTRTKRLRTTLLSTPVDVAIPDGSRL
SDFEESVRFQKVLQGQENMSFKAPSRNDGVGFMKCPILERKGCNAVAEGFETARTE
NAIWSSLERSDISSRLLDFGESIRFQKVLQGQEILPSKASLTSAGVDLMKFQHWDCKG
YHAEGSEGAMHGHKSWPSLGRPNVAPFSDVLSNKGKFGNAYGSDKIRSVEYSCEQF
SNTNTPHLKVFTKPHSGGNHATCTVNSQNLATIPRASPLSSIFGSRTRNDSELCVQGT
YPMCRMNVFQKNDLYGDYSQTFNRDLSAQFDIPKMAVGWQASSVSHCDSDNTQPA
GYTAGLSSSEPSKKQEKLIEVFLKQHQLPIGFHSTETDRGEIQGKQSCKLFGFSLIEEPA
CMDDVISSSIPHGDITQEGLPAIYGHGTVHSSISQNQDNLLKSSADRSGPPEALKGSAQ
QKTFQAVSGLSTLVQTPGRRRTKVHKQGNVVGRAVDLSKLDGYDQLICELERLFDM
EGLLNDPKKGWQVLYTDNEDDMMLVGDDPWQEFCNIACKILIYTHDEVQKMTPSM
FSDDANSSEEQPSTVEVSKSSIDNQDSSSPLMTGNQ

Figure 921: Amino Acid sequence of SEQ ID NO: 2162. The conserved transcriptional factor B3 family domain is underlined.

MRTGFSQQHREGEKRSLNSELWHACAGPLVSLPAVGSRVVYFPQGHSEQVAASTNK
EVDAHIPNYPNLPPQLICQLHNVTLQADVETDEVYAQMTLQPLNTQEQKESYLAPDI
GTQSRQPTNYFCKTLTASDTSTHGGFSIPRRAAEKVFPPLDFTQQPPVQELVARDLHD
NEWKFRHIYRGQPKRHLLTTGWSVFVSAKRLSAGDAVLFIRNEKGQLLLGIRRANRS
QTVMPSSVLSSDSMHIGVLAAAAHAASTNCRFTIFYNPRASPSEFVIPLSKYEKAVYH
TRVSIGMRFRMLFETEESTVRRYMGTITGIGDLDPARWPNSQWRSIKVGWDESTAGE
RQPRVSLWEIEPLTTFLMYPPPYPLGLKRSWPQLQGITSLYGSDDGSFRRPFMSERGD
NGEQGLQTLNFQTISMDPWMQMQQRFEPSLSGIQSTAYHGMPTTVLQQTGNLNQSK
QLKFQQQQPVQSEQLQCRPQVQSQRNVIEQQQQHQLQQQVFNLEQHQPQNHLLQQ
QLQQQTLQQQAVHQQLQNAINEQQQSSFQHQQNKQQAFQVPNVVNSFTQLSTSQSQ
SPLSDISSVTSRPVFTNTGATIASPKSSSSASPLQSILDSLTSEGASTYLSVPRPSQSVVQ
QPAETWSCVTQDQQVAAPWFSSKRMSTNQIPCLPSGQTEASLSTGSHRILSQTEPKSQ
TNVPAQSMPLPQFPLRDCPTEQEGVQSDSQSNLLFGVNIDNPTLAISDTVSSARNVGN
GAYVASSFSVTDLLNVPPCAPVSGFSMNSNMGVSGGLDESGFSQPPPNFAKMNAPTR
TFTKVYKLGSVGRSVDVTRFRGYPDLRAELDRMFGLEGQLENPRSSWQLVFVDKEK
DVLLLGDDPWEEFVNNVRFIKILSPPEVQQMSQEDMEFWSSIPTQQQTSSSSEDCVAR
NSSRNISSVLTSTGSLEY

Figure 922: Amino Acid sequence of SEQ ID NO: 2163. The conserved transcriptional factor B3 family domain is underlined.

MPSQSTNSTQNSFSGGIGTDASESLLYEELWHACAGPLVTMPRVGERAFYFPQGHIE
QVEASTNQGVDQHMPLYNLPSKILCRVINVQFRAEPETDEVFAQITLLPEGDQNESSH
DSGAAPPQPRKSNVHSFCKTLTASDTSTHGGFSVLRRHADECLPPLDMSQQPPSQEL
VARDLHGMEWRFRHIFRGQPRRHLLTTGWSVFVSSKRLVAGDAFIFLRGESGELRVG
VRRAMRQQTNMPSSVLSSHSMHLGVIATASHAVSTRTIFTVYYKPRTSPSEFIIPYDK
YMEAVNSSLSVGMRFKMRFEGEESPERRFTGTIIGMGEVDNVRWPESKWRSLKVQW
DETSVVPRPERVSPWEIETFVASSAALNPLPAPRTKKPRPNLVSSSQELMIHGSGKTAT
DSSQVHRLPRVLQGQEMRTFGGSLGDSEVESSQKPLMWGSSVDQKQDSVGSRGRLA
SEYWVSQCRQDTVYSDSYSVIQGARDTQQLCGPTACQNMEIFQRLKPPPKQFQDEEN
GIIDRSGTKLQLSSSWSVMPSDNPHELTESDLKLSVTSNPSHKQAGLGKWSGLDPPPL
LSDVGSKESEGNWFVSLISQPQVDFSGTHAPGQLERNPARSHGTSNLGMAVQQSTLQ
SREMLEEKGVLSGARSADCKLFGFHLIENSVGELTPSTIRGLAAGEDIHVSVPNITVHE
AQSESDPHFEPSSMAKMDMPAAITDEEKSSQKSSKETHSRPQTNSTRSCTKVHKQGS
ALGRAVDLTKFEGYTELIRELEQMFNIEGELEDPSKGWQVVYTDNEGDMMLVGDDP
WQEFCSIVRKIYIYTREEVEKMTPQTPSAKLKGCSEEPVTRETSRSSDRQDSSIAGVTA
ERSSDA

Figure 923: Amino Acid sequence of SEQ ID NO: 2164. The conserved ARID (AT-rich interaction domain) protein domain is underlined.

MNMGEHFASSPQILSLFPQNPIVMEEQRDVQGSGSMQNGSELAEYHLGSSMGLFQG
YPYSQQVYPSPLAEHEALLANRTYFCALFNEFHAGLGTSLTVPNIGGEELDLHLLYR
QVTACGGLEQVIKERRWKEIATALKLPSSIITYSFVLRKHYIDLLYHFEQVHYFGARG
QLAPPPGPLPAPRPSTKSMDNGITCQLLVDPKQPAKKRKNIVDPAQLFGVDPGAYVG
QTVTGAVDQRFENGYLVTVVVGSEKLKGVLYHVPTETTVQQYAVVPGLMSNVGCD
ALGLEVQVTKKRKERVHNRDPSAPRLSKNGYKFFYVEQCSRLKKTYAQTDREIVKT
VNDLWNKLSDNEKMQYIERSQQDKKRSKTQMMAYKERIKLQERSEGYNGDKTSEV
VGPKIEGNVTAPFFHDNSYDYHVSLEAGADANSFHSHQQRGISSEVSGIPVADHGAY
SGEGDKSVYSVCFPPPEISAPNFGGSSLPQTYVGSSDQFFYQTQSSAFQSSFMPYSMTP
DQIYWMQGGQSFNSQDGQTLSLYPQNPFI

Figure 924: Amino Acid sequence of SEQ ID NO: 2165. The conserved HMG1/2 (high mobility group) box is underlined and the ARID (AT-rich interaction domain) protein domain is in bold.

MQMQVFGGGGGDAHQVYPEPLA**THREVVADRDLFLATLIKFHAALGTRLSIPKIG
GRDLDLHYLYKEVSGRGGLQMVIKERKWKEIALALDFPPTTTSASYVLRKFYSN
FLHHYEQVYLFGVKGHLVPPPAPPANPCPPAHSSEVEHMQSTSEDPEPEMRKRKID
SAQALGVDPASSIGSTVMGSIDGKFEHGYLITVMVGTRKMKGVLYHIPPTGARPQGA
SVSTFMNNIITGAEALQIENQIGRRRKKKEMSRKDPNA**<u>PRQNRSGYTFFFAEQRAKLK
STEPDKNREISKMIGDLWNHLPEDKKSPYQERGLQDKERYKREMREYRERIRFNGEQ</u>
VVDGANLHQTGLHLGRNDNVTKNDVCDTA

Figure 925: Amino Acid sequence of SEQ ID NO: 2166. The conserved HMG1/2 (high mobility group) box family domain is underlined and the ARID (AT-rich interaction domain) protein domain is in bold.

MQPQAQEDPPQEFHEYPQIQFPLGSMGTLEVPKNHRKMPFEGLSLFPENTEQIGEEQN
EQQLGRGHVEEVEGQQQLATSGYHVPPGINIFSPPIAEHDTLLASPDLFEEALGTFH
**GSLGRRLTVPHIEGQELDLHAFYREVTACGGLEQVIRDRRWREVARALNFPGSI
INPSFVLRKHYIDLLYHFEKIYYFKAHGQLPYPPGPLPAPLPIVKSIDDKIAYQIPVG
SAQSVKKRRKIDPTQLFGVNPGASVGHITTGAIDGKFDNGYFITVVVGSEKLHGILYH
VPTENASPQFATIPGLIRSVGSELDALGLQVQVNKKKKETPSKKDPNA**<u>PRPAKKSYNF
FYAEQCARLKKNHSQTHRELARMVADLWNNLSDNEKLPYIEQSRRERERYKREME
DYKKRLRVEAHGE</u>VNIGSDTVDVVGQENEGPDVNTFYQDGSHDYHVSLDTDADMN
SFHMHQQQEADVPVAEPQIYSNQADGDVYSVVLPEPQVSEFQLETSGCLTQTYGAS
GDGYSYQNATLLPNVCQPGFVSCPMSSDQVHWVQEGSHPFCVQEDPQV

Figure 926: Amino Acid sequence of SEQ ID NO: 2167. The conserved AUX/IAA family domain is underlined.

MSSNINVYIEEGLSKAPTPASSTIADGSSQNNPGGLKEHDYIGLSEVSSSIESSVVSCDG
EENNMNLKETELRLGLPGSLSPARDSSELNLLSPLNIRTEVEEKNLFPVEKQQHSTKD
GVAEEKNGQDKYIIQPSGMGRNMMTVSPKNIVTGSKRGFSEAMESRNCFPDSRNNG
FSAEGKWVFPAQVGGVIVAGSEVELPKTTTQGKFLPQGLASAPGASTMMQGPTSWH
TG<u>GLDHSGSSFMCSRSSNGTNLNGKSIKDGVASTGVKDIAQSKMPQERSRTESQHGT
NQKQVPSANNPGMAPAAKAQVVGWPPIRSFRKNSLAAPKSNDEDDVKSGSSALYV
KVSMDGAPYLRKIDLKLYNCYLELSSALEKMFSCFTIGQCGSHGVPGRDGLSESKLM
DLLHGSEYVLTYEDRDGDWMLVGDVPWEMFTDSCKRLRIMKGSEAIGLAPRAMEK</u>
CKNRN

Figure 927: Amino Acid sequence of SEQ ID NO: 2168. The conserved AUX/IAA family domain is underlined.

MNSFNSREFSQVVQDYNYRALHAASKGIASGAKRGFSDALGVNLMRDSGFGLPESD
SKLLNSQPRNFIFPWAVPQQYGPANAWLTWEQKSKQNLQHYSKALATS<u>GIPDDKT
NNRFGEGAISTQNTQSVVKASQESQRPPAPVAASEKIQTPAEPDRAPNQSGTPSRAPP
VVGWPPIRSFRKNLAAQPKVAAAPSCNPPPPAADQGEKKINTMFVKVNVDGVPIGR
KIDLKAYDSYEKLTVALDEMFRVAINAQTSDANPLPENNNNQASLLNGRDYVFVYE
DNEGDRMLVGDVPWDMFVKSVKRLRVMKSSDVRRLANRTQ</u>

Figure 928: Amino Acid sequence of SEQ ID NO: 2169. The basic helix-loop-helix (bHLH) dimerization domain is underlined.

MPWAGRNSNPVRPPPGNEEGGLCNRIADKSHKELPRPNESLFCQQIDLKDTMNHCVP
NWDMENGIIQSSDFPPMAKVNWDYVQPQKRSTMLEHDIEELLWENGQVVNKVVKR
PFPTQLSKTLQNDDAVLPGKPSPVGKDNTLESVVHAMSSANASSIHEDVMDSWLHY
PLDDSLEKEYCSDFFVGIPGTNVHMLRDSLSGQMNNVPAEKVSNLHAQKESSLSSEN
NSAPWTGVFAGMVNGTNAAGPSKTGKESPPKSIISDKAMALGAGRASGIISQSGTDT
FAKVRTTNQLPVSKWHTDVQGSSSSNDDQPPCKKTATQLSSSPLSMPPPKMQATDL
ASMKPSRTKLVNFSHFSRPAATMKANLQSIGSASGLSTTGIQNRLDKIRMDGNAAAE
PSIIESNSTGMTTIGSSSGANSQAQDIGSCQTHQNPPVGKNLDVATCSEDVTDSSPKVS
EQVLRQNSDAGRSLASCGTEKCGDAGDGPEPTITSSSGGSGNSAGRAGKEATNTSKR
KSRDVEDSECQSEDVEYESAEAKKPAPSRTTTSKRSR<u>AAEVHNLSERRRRDRINEKM
RALQELIPHCNKSDKASMLDEAIEYLKTLQLQVQIMSMGGGMGMPPFVFPGGMQHF</u>
QVPQMAHLSPMGMGIGMGYSMGMLDMAATSGRPVMSLPSMHVSALPGSTIHCQA
ALPLSGMPGPSLPMSRLPGPGLQVSGLPVSTLPVSGLPGTTQPGLVSTSASGSTDLQD
HMQNANVMGHYKHYMNHHQMQGLPQVLNGNLYNSSMAQPAPQNPVQSDGRGAH
NTVSASGKAGTTGKHYDLLFFLFVEKMNFYITLLIRNKFTSFATSES

Figure 929: Amino Acid sequence of SEQ ID NO: 2170. The conserved basic helix-loop-helix (bHLH) dimerization family domain is underlined.

MDARMQSHYYEDQHSQMWMDEFPGHLDWDDSDPEIMQLSKPANKVNNYVVEA<u>A
ASKNLHSERKRRKKLNDTLYTLRSVVPKISKMDKQSIIGDAISHVLDLQKNIQEIEGEI
KGLCSSNEGDDDTQTPTDIKKPLTKPSLEKRCTESSDAKKSVDKFKVKRRKASETKIV
EICKAGKDGIYQVRIECKKDAGLLVDLMRALESVPLEIVNSNLCRFHEAIHGTFYVRS
LKNVGADELEDMIRQTIASDCSS</u>

Figure 930: Amino Acid sequence of SEQ ID NO: 2171. The conserved basic helix-loop-helix (bHLH) dimerization family domain is underlined.

MDTRMQRAGEVSKCHYYEDEHDKLWMDEIAGHFEWDDSDPQIMRLPKPGNKVNN
YVVEA<u>AASKNLHSERKRRKKLNDTLYTLRSVVPNISKMDKQSIIGDAINHVLDLQKK
IAEIEGEIKGLCNSNKGDDPHIRTPPTKPNLEDRSATESESGDAKKWVNKLKDGKVLE
AKIVEINKAGKDGMYQVRMECNKDASALVDLTRAVESVPLEIVNSNICRFHQAIHCT
LYVRSLENAGAHELGDMILQTIASNCST</u>

Figure 931: Amino Acid sequence of SEQ ID NO: 2173. The basic helix-loop-helix (bHLH) dimerization domain is underlined.

MLSRMNVNGGMWGLEDATDLHCNNDENLNLPTFKAMLDAEEWFTSHSNTNHNDI
ATASINNANSHPEGPCFNIDMKDFGCYSSLVNPNPEPPNMLLQHAMNSCSSSPTSIFSL
DPSQVQSFLAGGSHHHQHHLHHHHAPQLSDVVGSSPFQELACEGLVSSNNASSNSSS
NSYLYGGLSGGIFRQLSPSFAGSSPRTNAATPTPNLSSPHSQVGGSITSNLSPRMMPAS
NLNLSDTGLFAGNNHNTNNSNNNLSNLLGLSSLVSPRLPAPLNFSSPKMLRPLEICAP
VGAQPTLFQKRAALRHTSLSPCATTPCIEVLDEESPNGNSNSNVKGKRKLMSVGADK
KEEEDVDESNDGSGVQYDSDDVGGNNNSSYKVDQIGEDGLASAGGTGNAAAVNNN
SNGGGDKGKKKGLP<u>AKNLMAERRRRKKLNDRLYMLRSVVPKISKMDRASILGDAIE
YLKELLQKINDLHNELESTSQGPVLPGTSNFHPLTPTTPSLPCRVKEECPTSLPSPNAQ</u>
PARVEVRMREGHALNIHMFCARRPGLLLSTMRALDGLGLDVQQAVISCFNGFALDV
FRAEQAKEGEIAPEEIKAVLLHTASCHTAI

Figure 932: Amino Acid sequence of SEQ ID NO: 2174. The conserved basic helix-loop-helix (bHLH) dimerization family domain is underlined.

MGAETAAALKFWNDEDKDMVKAVLGPNAFEHLIMSFLSCEGLVAGVSDSALQQKL
QFLVEFSSSITWTYSIFWQLSRSKAGDYVLGWGDGYFKEPKHGDEMTRRFNESETEQ
RMKKKVLQKLHIFFGGAKDDDFAMGLDNVSDTEMFYLTSMYYSFPRGVGVPGRAL
GSGQYIWLKDAHRTSNSISSRSFVARSGGIQTILCVPTDNGVVELGSIDSIKENKEFVQ
MIRSIFNDHRVQQLGHSRGSALSQSPARVPDILPLSREKEGHARAVVPFKLFEYGDHQ
KAVAQDYSKVFGQDLKSGKTRTLVDHKFVSSKMESRFLHPVFRAPNEHQHEYYLND
DKIFYGSNKKGFQSITLNQVCNSKGGDIYNSRHDYHQQKQEIGFVIPNNDIGSQHVHH
NNFKCSKEENKIKEQQHQQQQSQMEFSGTSSIVSFRPCMAESEHSDAEASCKDDKSP
LVDERRPRKRGRKPANGREEPLNHVEAERQRREKLNQRFYALRAVVPKISKMDKAS
LLGDAIAYIQELQKKLKDMEKEKETQENTSHAPSVAPQNMLAVANTNSIPDVDVQT
VNGDAVIRVTCPRECHPVARVMLALQEMQLNVQQADMSTAKEMILHTFVVKLNGA
QELTKEKLVAAISG

Figure 933: Amino Acid sequence of SEQ ID NO: 2175. The conserved basic helix-loop-helix (bHLH) dimerization family domain is underlined.

MDTFMASSTSSAVDQGFSQETLQQRLQILVETASIVWTYAIFWQVSYDSSGAIQLCW
GDGYYKGSRNAEEDERLRMRSRLTVSPAEQELRKKVLRDLHSMISGSDEVNQQDNS
GVSVDEEVTDAEWFYLISMMQSFLSGFGVPGMAFSSGAPVWIVGAERLQVSNCDRA
RQAYELGIQTLVCVPIQGGVVEFGSTEVIVENWLFLEQVNNSFKCNLNQMHDNPFQI
QSLWPAETLSVKSSNTMQSAQCIEPVSNPEIQSMNSALARELPVTGKQKASVFAEHSS
LVVTDDKPLLQTLTQETEAFEAPAIHIAETVGPQTRTLGFKGSEKNEIKPAIKEDTIGL
PSNPPGIVIGGLRSSIESELSDVEPSASIKDSTSALVERKPRKRGRKPANGREEPLNHVE
AERQRREKLNQKFYELRAVVPNVSKMDKASLLGDAAAYIKDLFSKQQDLESERVD
MQVQIDTIKKELLMNSLKLAAKEAKDLSSIDLKGFSQGKFPGLNSEVRIVGREAIIRIQ
CTKHNHPVARLMIALQELDLEVLHASISTVKDSLIIQTVIVKMTRGLYTEDQLHALLC
KKVAESLN

Figure 934: Amino Acid sequence of SEQ ID NO: 2176. The conserved basic helix-loop-helix (bHLH) dimerization family domain is underlined.
MMAQRLDILGGNDSSISEHQQTNAHSDLTSKDTVNHRKRKCLSNPKVKVADALSIPL
KIKETNEAERNGKHYKVGESTKDKDDLKDKLEECNSAETAESCPKQTVDNVKPSSV
PVKQDYIHVRARRGQATDSHSLAERVRREKISERMKLLQDLVPGCNKVTGKAVMLD
EIINYVQALQCQVEFLSMKLAAVNPQMDYNVEGGYLTRDVLQPHCSSVSKMFAPET
TATTSQINQLQKTPLQHGMQCRADRQEVAIRGMMDTQLTCMNGYADPTFQLQMSQ
GWDDVFQNVVDIGLDQNRSTSLKSHGFHGLLPTGHMKVEL Figure 935: Amino Acid sequence of SEQ ID NO: 2178. The conserved basic helix-loop-helix (bHLH) dimerization family domain is underlined.

MDTFMASSTSSAVDQGFSQETLQQRLQILVETASIVWTYAIFWQVSYDSSGAIQLCW
GDGYYKGSRNAEEDERLRMRSRLTVSPAEQELRKKVLRDLHSMISGSDEVNQQDNS
GVSVDEEVTDAEWFYLISMMQSFLSGFGVPGMAFSSGAPVWIVGAERLQVSNCDRA
RQAYELGIQTLVCVPIQGGVVEFGSTEVIVENWLFLEQVNNSFKCNLNQMHDNPFQI
QSLWPAETLSVKSSNTMQSAQCIEPVSNPEIQSMNSALARELPVTGKQKASVFAEHSS
LVVTDDKPLLQTLTQETEAFEAPAIHIAETVGPQTRTLGFKGSEKNEIKPAIKEDTIGL
PSNPPGIVIGGLRSSIESELSDVEPSASIKDSTSALVERKPRKRGRKPANGREEPLNHVE
AERQRREKLNQKFYELRAVVPNVSKMDKASLLGDAAAYIKDLFSKQQDLESERVD
MQVQIDTIKKELLMNSLKLAAKEAKDLSSIDLKGFSQGKFPGLNSEVRIVGREAIIRIQ
CTKHNHPVARLMIALQELDLEVLHASISTVKDSLIIQTVIVKMTRGLYTEDQLHALLC
KKVAESPN

Figure 936: Amino Acid sequence of SEQ ID NO: 2179. The conserved basic helix-loop-helix (bHLH) dimerization family domain is underlined.

MDQVTDGSHSAQRLLYSLQQPQEQQSEVTLLPDNPDNMNAMDMCMLDRQRKGPN
AQPQLNWPQQQQFLRTNSNSEQIHGPFISLLKTSEMLSDGIITSEWQQLAEQNGHLLP
ANPGYAMNLGGSMSCQESALRQTLSRSMSSPNGPLNLHTDWSNLSNNTKTMYGVE
NEAIGRSVLKAPACLGPFPSDPGFTERAAKYSSLNGKNWNARLLTSERASVGEMETS
SLEFLSDVARNEPQVACSNDSESKKAFCRTASCPPTVENAAAETEKSSVLVEESAVSE
KSSAGDIKTSNNNAVKKRKSGRNSAQNHRAADSEESKEKRTKAVHSGDKEKEDVM
AKTEQCNSDNSVEFSPKPARENPKPLENQKQDYIHVRARRGQATDSHSLAERVRREK
ISARMKYLQDLVPGCNKVTGRAVMLDEIINYVQSLQRQVEFLSMKLAAVNPSLEFNI
DNFLAREMMMPIPPPGNFSSLEGMSPNAAPYIHIHQMLQQQQQQQQASLQAGACTG
LDVPTLDTSTSLHRPGSAEMFADAANFQGHAPSTWDSELQNVFSMGLVQDRQPPFPS
EGLPGHLEPNHMKMEM

Figure 937: Amino Acid sequence of SEQ ID NO: 2180. The basic helix-loop-helix (bHLH) dimerization domain is underlined.

MDSKMFQLDQMDQFGLEPADMNTFNMTAVSPEELLQLDSACPSLFGGLMQFDSNN
KHNNSDSSPCQSPDGPVFPAFEGLNFCNNLSINTNYVLQRGNAAGSCDSINDTDTNSN
ISPAGSEDLRKSNSCNSSEATQDHKKVANLDLVLDLDLDMPAVHAAPAMAQVQPRF
NYFPRLQGSMNTDPAPHNEGNNNGMGAMREMIFRVAAMQPIQIDPESIKRPKRRNV
RISKDPQSVAARHRRERISERIRILQRLVPGGTKMDTASMLDEAVHYVKFLKKQVQA
LERAHHAKAPACWTSNSFSQGALINPANISNLNFSAFNSMTNPNLSNGLQFSAVTSNT
IMPLDRSGVS

Figure 938: Amino Acid sequence of SEQ ID NO: 2181. The basic helix-loop-helix (bHLH) dimerization domain is underlined.

MVCIPTPNGVVELGSMDLVCENWALLQQAKNSFTFSSNPWEDNGNGNFSNNNNHN
NNYGTNNQSLWVPGSPFLTQESILGDLSFLNNEENHNRNSSAQKPPSMIEENRNPLPP
FTAQKQVAMEENRVPLSFPTQKSAVLDERTSFNLVQKSGISEAAHNPLPFLPKPPPVG
GFDEKSNPMAYSTVPKPAIIDENCSSLLSQKSSICSEILNPFPYVAGPKSIDFSESCNSYT
VPSLQKTSIESSNQNTLQSAAVQKPNIADQNGNPNPNPNQLLFSVQKTCVSDQSKAFS
RDLLLEDDKPKPLLNIQNNNSQRHTLSFSNGYSQNLVEEKMVKPLSIDDEKPNSLPTI
SSGAVFGGVRSSVESDHSDVEAASFKEANQAVIEKRPRKRGRKPANGRE<u>EPLNHVEA
ERQRREKLNQRFYALRAVVPNVSKMDKASLLGDAVAYINELQSRVQEIEAEKKELQ</u>
AQIEVTKKESSSSHSAFSGTNLGFIKDQSGSSQKPDVKRFGTKECSAIDLEVRILGPEA
MIRIQSAKKNHPAARLMTSLQDLELEVHHASVSTVDELMLQNVIVKLPSSLYPEEQL
NAVLLKKLSDPKFK

Figure 939: Amino Acid sequence of SEQ ID NO: 2182. The conserved basic helix-loop-helix (bHLH) dimerization family domain is underlined.

MELPQPQLPFEGSKPPHDFLSLYGDSSSNRVEHRSSQANSTHLKTQDFLQPLERGGKN
SNTKGLEVSSAETSAATPASSVEHVLPGGIGTYTISHISGYSQMNGKSEIPVVHVNVA
ETKPEVTRAASSTNYGGGAFTLWEERLRVVDGNRTSDGPATSDFSKEYLEKSGYWP
AVRAKADLSFPAKTAFSLSSVETSQQQLPSSSKQRLQTGPGFVEMIKSIKTISEDDEDE
EDEYVDRSREGRKEGSSQKGDPPPKADGRSSDQKANT<u>PRSKHSATEQRRRSKINDRF
QMLRDLVPNSDQKRDKASFLLEVIEYIQVLQEK</u>VRKYETTEQSWNQERMKTMVWD
LCKKSPGHGEVPVDGSRIGVGIPSDSKQNNEVGDPARSKVTSNALRYENGTAGADV
HPTSQNLLQPNKPTPVIPGCAPSYKEKENIGAFNKSIPPTLSMQQCVYSPFGRSYIHSA
NPKGQATSEIHSLQGIQGMTPMCIPANAYNFDKEKDVDTATPVQLSHFQGNTVTVA
KTTSGHESQWSELRSSQVSPIQQYSGQNGGILLKDEAADTKSASKSENQHSSAYLNSS
PRLSQYVPQSEAELASRQPQPPCSSPDQQRASEARPATSEQEELVIQGGVINVSSVYSQ
GLLDTLTQALQNSGLDLSQANISVQIDLGRRGGTSGTTTNIKEHSHNHEESSQNHQLH
GQSRAAETSSECEQPPKRPKIERDV

Figure 940: Amino Acid sequence of SEQ ID NO: 2183. The conserved basic helix-loop-helix (bHLH) dimerization family domain is underlined.
MLERSGSLNIHLAAPQERLRSLVGPKRWDYVIYWKLSDDQRCLDWTGCCCSGADQS
GQGLQNPSPESHLFFSPRYFEGGSCRDVMFQHPKCTTCEILADFPTSIPLDSGIQGQVF
LSGQPRWMNFPNIGDPDAGQEAVQTQVLIPVRNGIVELFVSKPVAENAALMQFVFTQ
CDPWLPQMYDTNNLFGASPAPSLGGCGFGSVSEAAGTLPWLPAATGDSSVPWDAER
ALSESQLSIHMVTPHLNFLGQQLQPQVAASGQIKQKNDFYEGSADSINHAEKPPAMH
MDPVSLQDIQQAGLPMRNNSLPRGHGLTESPHTSGLSKEVQKDVKQEISRADSSDC
TDQMEDDDDQKAAGRSGRR<u>HLSKNLVAERKRRKKLNERLYALRALVPKITKMDRA
SILGDAIEYIKELQQQVKELQEELDEIDVQAGNPTTPPNLENGGQTTLDEETHARCAA</u>
KTDLTKGPGNATEETVQTMQIDVNQVDAHVFNLRIFSEKRVGGFVKLMQAMDALG
LDILNANITSYRGLVLNVFNAELRDKEVVQAGAAQLRDSLLEMTLHPDILRTGEGTA
ASDHQQRHIQQTT Figure 941: Amino Acid sequence of SEQ ID NO: 2184. The conserved basic helix-loop-helix (bHLH) dimerization family domain is underlined.

MTSNMSDPSWLHSPFFPYNDDGNKFDVESVSSNSNPFLSIYNADHHAHGFNSSESHK
SETLAVLSNPPLLQTICNSSPPSDGQACTRLPGSVPA<u>GKNNHKMIERQRRKEMKVLFS
RLRSLLPEENIRGKRAASEQLLEAVNYVRYLQQKIEDLSAQRDKQKVNSDQNAKVSF</u>
RKFCNKTQPFGGSDRECPAVNIKSVGSGVQIWTNCLEHEIVYSEILLALEDGGLEVVS
ASSSAVKNRVYHTIHAKVFDHSTFNIENLYQKLWHLINAHHNKNQDLRITEARA

Figure 942: Amino Acid sequence of SEQ ID NO: 2185. The conserved basic helix-loop-helix (bHLH) dimerization family domain is underlined.

MSYVKMLNSRAQPISTGLSIPSLSVGHTDVNGIQISFSQYPMDSEKMPQMQQQTNNV
DFMDLDYKPPLCNVSQADGVMALTERGSSNNFQGPTGLMRYHSAPSSFFSSLGEEEN
NNIISEYFSGNSSNPLQSNTKPLQQNQSSILSFHLRENEPAKHLGERNEYLKRNARQLP
SLKRSAGNVSREDLGKHHPLDAILENVPDVSQDSFGTSQMSLMSQVQVSEPSGQHID
SSYQMNSVCCDTLDQSGGRMGNAYSSTSKNTLIRHSSSPAGLLSELVAEGRGTFESG
MQNGANFTARKRAKELDMKLMQGLNNSDHQKVEAGIRGASALTNHPYNLPRSTSS
ELAMEEFLQDAVPCKVRAKRGCA<u>THPRSIAERVRRTRISERMRKLQELVPNSDKQTV
NIADMLDEAVEYVKSLQKQVQELAENRAKCTCTHNPDCAYKT</u>

Figure 943: Amino Acid sequence of SEQ ID NO: 2186. The conserved basic-leucine zipper (bZIP) transcription factor domain is underlined and the basic-leucine zipper (bZIP) transcription factor domain signature is in bold.

MGIDKNSVVPIQPLQFSREVYHMGSTQYDNMNFSANLNAPGAKTAVSTKKSVPMSE
DKSCPIQDSLHHHRGNGEGISHSWSISACAAAEDQQVI<u>DAKKQ**KRMLSNRESARRS
RLRKQLRLNELNAQVAYLKAENGQIQNKLNIASQQ**YAQITEENYLLKIEAVKLSHEF</u>
QGLHYIITAQSGSAYKTMSIETGNCSAAHLSSESGIIPNSFTSPDFLF

Figure 944: Amino Acid sequence of SEQ ID NO: 2187. The conserved basic-leucine zipper (bZIP) transcription factor domain is underlined and the basic-leucine zipper (bZIP) transcription factor domain signature is in bold.

MGTGEMGTPAKTTKASTPQEQPPTSTAMLYPDWAAAFQAYYNSGTTPPPPPAYFHS
SVASSPQPHPYMWGGQPLMPPYGTLPPPYAAMYHHGSMYAHPSMPPGAHPFAPYV
MTSSLSTTEGAPVGTTSGADAEGKPSEPKDQTLLKRSKGSLGSLNMLTGKINEADKG
TGGGGNGALSISGESGSEGSSERSDETSQNGSEATQKKGFELNSTKAAEAQNTTTSY
NAHGGSAFGASGVQTVNATVNLAIAAVPISVAGKSATVAGSKTNLNMGMDYWSGS
TTATSTMRGKRPAVPRTTAMVPAPQSISLMVPCDGVPTELWDE<u>RELKRQ**RRKQSNR
ESARRSRLRKQAECEDLAKRVDILKAENASLRKELNRLGEECKKL**STENAFLHKKL</u>
CKAPEEETRDTRSEKDGEAGTGEQHEQQNEDTDSGAVESMQRDGRREETSFNLDGK
NQPLDNRNQAVSVSAG

Figure 945: Amino Acid sequence of SEQ ID NO: 2188. The conserved basic-leucine zipper (bZIP) transcription factor family domain is underlined.

MRSSASHSVDIQMQDSASSPVPKSLPSNTQLSTMSPHHFSTDVNRMPDIPPRNRGHRR
AHSEIAVRLPDDISFDRELGVVGSDCPTLSDEADDDLFSMYIDMDKFTGFSTSSTQAM
AATTQSGSEGGLTPPFQPTHHSRSVSMDGVFSGFQNNNGGSAPGGITSDKPRARHQH
SQSMDGFPSIKPELLLSTAEASLAETKKAMSAAKLADLAL<u>IDPKRAKRIWANRQSAA
RSKERKMRYISELERKVQTLQTEATTLSAQLTMLQRDTTGLTNENSELKLRLQSMEQ</u>
QVHLRDALNDALREEVQRLKLATGQGLTSGGHLMNYCNSSFTSSQPFFQTPLQSSHT
YLAAQQLQQLHLQSQQSALNLRNGGTGSSQGHRDNLSEFSMTAEGLPVSTSQEAGC
NF

Figure 946: Amino Acid sequence of SEQ ID NO: 2189. The conserved basic-leucine zipper (bZIP) transcription factor family domain is underlined.

MEGLGDGYEAFVGRLKMDMATSNAPKTATGNSLSNPSQSQQLQQARYVGYPSSTN
AFTVTREAKPALSDSSGNSVAMDVTMQEPVSSSGTVGVTEPSGNLGHSQNFSTDVN
RMPDVPPRRGGHRRAQSEIAFRLPDDIMFDGDLGFAGFDMPTVSDDATEAEDLISMY
MDMEKLTSFGEPLNSAAGEGSKLPSGAETNRPPHHSRSLSVDAVFSGFEGNMEDTKG
NLGTMGPSRPRHRHSNSMDGSSSSQLNQLSSESLESKKAMAAKKLQELAL<u>IDPKRAK
RILANRQSAVRSKERKMRYISELERRVQTLQTEATTLSAQLTLLQRDTTGLTTENNEL</u>
KLRLQAMEQQAQLRDALNEALREKVQRLKIATGQLSSNNTNAFNMSATAQQLPLNR
SFFPPTQHSHRLNQQFQPFQHSASPMNNQPLMGQSQVHQNFPQYGPAGQLQVLVGS
QGGPAVESEVSSSSVNHPGSSAF

Figure 947: Amino Acid sequence of SEQ ID NO: 2190. The conserved basic-leucine zipper (bZIP) transcription factor domain is underlined and the basic-leucine zipper (bZIP) transcription factor domain signature is in bold.

MASQRDGDNSGGNRGQKTNLPQVLKNPPFHTIGSNVVDSNCNSFKGWSDFPFPNN
NSKHQFFPSVGYLAHFQPPWNDDLIKSPLESPTKKTSHRRSASDSLPFLEAPTDCFAD
GDELDCRQDVSLPLTESMDSENLEEIQPMSIFSDVEAFQKQKDQADGSTVTAPSISGS
LVSLSDHNSFKDPLMLESKLNASSQFRSEPEDASICKGEQDDQPVKIEWSETTPPDL<u>K
VDKKRIKRIIANRQSAQRSRIRKLHYISELEESVTALEVEVSTLSPQVAFLDHRRAKL
NIDNSILKERIAALVQEKIFKDEHSEALKTELQRLEQLYQQQQQMQCRQQRLEHAISS</u>
NAAFDFQQH

Figure 948: Amino Acid sequence of 044463/0191 SEQ ID NO: /2191. The conserved basic-leucine zipper (bZIP) transcription factor domain is underlined and the basic-leucine zipper (bZIP) transcription factor domain signature is in bold.

MAHHGASDNSAANWGYTSSSSKLPQLPPKSPSFGIVGQDSSNNNIMYMGWPNFSFQ
GNSLKHQRTPSVGYLSSHGQPPWMDDLLDSPSENPAKKGPHHRRSASDSLAFLENPV
ASAPIEEIAEEDEFDCRSAASIPSKGSQDFDRLDEDQLMSMFADIEPFHKQQNQSNQP
VSNNPHAALSTALDNRCSERQTISENPSTPSDHNSINETSMEEKVMTVSGQFKSEPEV
QSVCKSEQPLQQPVKIEMPTSSSTMELDP<u>NIDPKRVKRILANRQSAQRSRVRKLQYI</u>
<u>SELERSVNALQTEVSTLSPQVAYLDHQRVLLNVDNGSLKQRIAALAQDKLFKDAHC</u>
EALKKEVQRLRQLYQEQQQQNMQKEVAAPSTGSYDLQQQQFGKLEHNSSPQMMEQ
KTDHVSDSSSNLLKSGPGISDHRENNAANNHTSSGSQMLKGIMTSSCLMGDGNKCLE
ERMMGGMSSDYMVHNT

Figure 949: Amino Acid sequence of SEQ ID NO: 2193. The conserved B-box zinc finger family domains are underlined.

<u>MKMKVQCDVCEKAEATFLCCADEAALCSACDNNVHAANKLASKHQRVSLINPSSQ</u>
<u>SPKCDICQEKTGYFFCLEDRALLCRQCDVSIHSLNNLVAAHQRFLVTGVKVGLEPSN</u>
TISPSTKTSTQSSDITNKKPQTLRNGPTEVSASLHQGVQKGIGGGGISRRGTVSEYFSD
LLPLWRMDEFLNLPELDNGYGFGEAGSSRADNANFVEEWPANSFSTEEDNSENCLA
QVPEMASPPTASGLYWPRKIICQPKEGKRREDLTIFGFDDASLVPDIGCRSSPPDSPLS
KRRRLHA

Figure 950: Amino Acid sequence of SEQ ID NO: 2194. The conserved DOF-type zinc finger domain is underlined.

MVLSSIQVCMDSDWPQSVMHERTLKPLEEMMPACSRPMMEQSGLKPP<u>PPDQPLKCP</u>
<u>RCDSANTKFCYYNNYSLSQPRHFCKTCKRYWTRGGTLRNVPVGGGCRKNKRAKRTI</u>
DHACAQMNEASTSVNELNINGSAPLGHSQLANSMFYGLPAGSATTHDGIHNLSLATR
LADQRALYGNDSEFLRTFFDPRSCNLSPLNGLSSLNALNSFKPTFPGLNFNSNPNRTE
ALTRAVRDIDASFFESLPTQISEVPLPVLNSTNCDDLSPYSLSLQEGINNGNTNRYSEA
NQWRAIEQQKLAEGSDPVQVGLTPFSEMENSNNSRNDLNLKVVTSLPSCVKVEGQD
NRLNITPEWPVPSEALFEAASDSAYWNGGVWPELTNYGSSVGSLI

Figure 951: Amino Acid sequence of SEQ ID NO: 2195. The conserved GATA-type zinc finger is underlined.

MQGHVEGGVGGHPEAQGGEPRHLQLQYIHEHGHSLHHSDDNGLGEEQDDGDGEND
SMEGDIPSSGCNLGDSQKIVPVRSQATNQLTLSYQGEVYVFDSVPPEKVQSVLLLLG
GREIPPGLSGMPIHGHHHQKVLADIPQRLNQPQRIASLTRFREKRKDRCFDKKIRYSV
RKEVALRMQRNKGQFTSTKSNSEDLGSSAAKWDPSQGWHPDSNGN<u>QQEVVCLHCG</u>
<u>IGERSTPMMRRGPAGPRSLCNACGLMWANKGVLRDLSKNPSSLGSQNQPSSSHEQN</u>
DGRGGSHEVEVGDRNHSVTVPTNEHISS

Figure 952: Amino Acid sequence of SEQ ID NO: 2196. The conserved B-box zinc finger family domains are underlined.

<u>MRTLCDSCEAAAAQFFCAADEAALCAKCDEKVHGCNKLASRHVRLQLRESWSIPRC</u>
<u>DICETAAAFLHCSIDGSSLCLQCDMDVHVGGKRTH</u>VRYLLLGQRVELTNGSHIRDEH
GNPKTMETARAWQKKYCQEHYRNGDPSHNNISNGNIHNVASCNKENVQSNGQKD

Figure 953: Amino Acid sequence of SEQ ID NO: 2197. The conserved DOF-type zinc finger domain is underlined.

MKDPGFKLFGKTIPMRDGEKNDGLSGSKLGHENTDNTTGTPARVAQVSDKDVGKEI
GPELGREGPHNSNPEETRSVTVISDCGEDECKKSDEDLEREGGSTAIESDLKSENLEE
KEAKASENEDKMLK<u>KPDKLLPCPRCDSLDTKFCYYNNYNVNQPRHFCKNCQRYWT</u>
<u>AGGTMRNVPVGAGRRKNKHSTS</u>HYRHMMMAEGLATARADAPDGAAHHQVIPNAH
SSSSRVLKGSQIQLLPLEVESAGGSILNFGQDFRLCESMSTGLNLADQTVVTRKAFKI
KDDEKGPLMCGENRDDTSCESSTTTEKDVASKNFHTIPQMDQGSMVGWPSSVPPQQ
HYYGGAPWAYGWNFCWGGRSATGCPSGIAYAAESGNTSAGPWNNGTSGAGPPGM
WAAGIPWPFVPGPYWASPTGWGAGTWNMPFSTVASPVTGGLSSCPPSSSAGSSGSPT
LGKHSRDIPQSEDKPDGCLWVPKTVRIDDPDEAARSSIWTTLGIGNKPESITTGGIFKA
FQPKTEEKDSVKASTQGLRSNPAAFSRSMAFQEST

Figure 954: Amino Acid sequence of SEQ ID NO: 2198. The conserved B-box zinc finger family domain is underlined.

MSSCLTMEK<u>HSLKECELCNKLQAKMVCESDKANLCWVCDVKVHSANFIVARHVRK</u>
<u>LL</u>CHFCQSPTEWQASGVRPSPTLSLCNKCFSAKHSARKHQFDENDHHVVTFTPSSAS
SRCGENDDDARGQHQRYGNGNSARKHQQDGNDNQVFPFTPSLEAAASASSGTGETL
VMPMHNTGDFERAATSENCSEWH

Figure 955: Amino Acid sequence of SEQ ID NO: 2199. The conserved B-box zinc finger family domain is underlined.

MKAKKGMVAKAIG<u>GRTARPCDVCLRERARWYCAADEAYLCEKCDGAVHSANAVA</u>
<u>RRHERVRF</u>AAGCAKVEAGFNDGLIFPGTRKRARSSRPHPHGAGPRSFKSKVGSVKDE
LVADPAAVPVPADSSAGDINLNLRADDDDYDEDDDDLLPQVPTFVPMAEELCGSRP
RDVVECPVFEQYKYGVELKGDCGGADLGSCDLDQLLNSETDLSGFGVDMDMDVES
IIGHGLDEGLGVLGFSTVNWDEKRVLQCRDVKINEGQDPEQQKDGDSGPTGLLNNR
TIKAEEDKDRSDDLCSKPKDEGDHHVALKAKQEPDEPDQSWDTIELDLDQYHEDEE
EELEDGTGFGDQYCMAQGASDDQGHDYQDIKIEFDPSSILIAGQAMYSETKLVSLSL
NYEDVLTAWSDRGSPWASLHDCNSEGGGCQDAGLVPELGLSYNGAQLNIIGGGGG
QEDSCRNAGGGREARVLRYREKRRTRLFSKKIRYEVRKLNAEKRPRMKGRFVKRTP
GMFCD

Figure 956: Amino Acid sequence of SEQ ID NO: 2201. The conserved zinc finger C2H2 type domain signature is underlined.

MGGAAAAAEDDDRLPVESPTLELAKKEELVCSGSSSKESLKRQREADLEVEANCKQ
YCNGKVIVDEENAGAGRKSDNRVELGSLPFYMLPPTKPSGRPGVYRILHQQDHEDG
ENQSSGNESSMGEEVAQQSLPRDLESGFDQGSGGDENGLSGSRGKALKLFGFEFRGS
EGGSFEGTNGSDQPQDGTNILTAGEASTEPVEEELVIEAKNGDSGKLEDVGSPVEAGE
SGSTSNCLGSSAQENRKYE<u>CQYCCREFANSQALGGHQNAHK</u>KERQQAKRAHLLAT
RSAAASANRSGATAWCGNINGNLYHRNFLFNNSYFTRMQVFQEDFPTFQTPQAVAA
PSIPHYIFSYQQQQQAPVQSSLPGLMVSSQCGQFGLNEVRQVPIYGDNVNNYSFNPAT
ALPQPPVPIPTSLHSSGLSRIRQASWSIPPPCRSGEWQSDHAAPVVMPVERKSSSDKFG
LELDLQLRIGPNANPNSHFE

Figure 957: Amino Acid sequence of SEQ ID NO: 2202. The conserved C2H2-type zinc finger family domain is underlined and the zinc finger C2H2 type domain signature is in bold.

MNDAYLNRWGSALFFGQMAEISPEPGTPCSSANSARLLHGSSSPSQSISQQSHYKSPL
PPVLRGTNNKRARRPAGTPDPEAEVVSLSPKTLMESDK<u>YVCEICEQGFQRDQNLQ
MHRRRHKVPWKLLKRETTDARIKRVFVCPEPTCLHHNPSHALGDLVGIKKHFRRKH</u>
SSNKQWTCEKCSKAYAVQSDYKAHIKTCGTRGHTCDCGRVFSRVESFIEHQDDCTT
TKDKMVDDDYQLSMPCSFTGINSGNTVINATESTALFTATMWRGIENERLDPNWSS
MEQRQELQLMPSKQQGTSETSEFPQPYSKPADEKSSPRLQLSIGLGSEITEKKLEENEI
RINEEIEQQKQLAMRLACDEMAYADHVRRVAKRQLELADIELERAKKIREEAHAEL
DKARFLKEKATREISEAAITPLEITCRSCQRQFQWPLQYQSPSLNGFLSSINSNKGGAD
DENCHGNVFPEVSMMRYMQFSNPAVIEIDKGSQDKMQMSLSKPNGQLYGAHVSRT
LSSSVTSSTKIEPCN

Figure 958: Amino Acid sequence of SEQ ID NO: 2203. The conserved C2H2-type zinc finger family domain is underlined and the zinc finger C2H2 type domain signature is in bold.

MSSSPKLSSVVSKDQDHQHNMLHPHQEQQQTTAAAATNTGQNNTTVKRKRNLPGT
PDPDAEIIALSPKTLMATNR<u>FVCEVCNKGFQREQNLQLHRRGHNLPWKLRQRTTK
EIRRRVYLCPEPTCVHHDPSRALGDLTGIKKHFCRKHGEKKWKCEKCAKRYAVQSD</u>
WKAHSKTCGTREYRCDCGTLFSRRDSFITHRAFCDALAEESARIPTGLVGGHLYNNS
VLSLQGQTAGSPMSIMTAPSSSAFRPSQSFNHGGGGLNSSMFFTQSPKAIQGFLQDYD
GNNSQGMGHEKPNLSGLMHLPAGASNNNPVNLTYPNLFTSTASHADLQPNAGAMD
FTGNGAQSIFTNNNGNDHNAVGTQDQNHGGISLPNLYSQQHVGQSSSSTSQPQMSAT
ALLQKAAQMGSTASNSSMLRGFNISNAIPPSGSSNHNNNNNNITMPFSGNNNLRSLE
NEGLVHDMILNSLAAQGSGTMQFGLNNMNQPTYAGGNYSVADHSEHLSSETERNT
QTYGNHGSGPVQTKMQGSNQMLMLSGMGNHNVPRNEDGGIAGDGLTRDFLGVGG
ASSAGFPFRSHRAAAAPPHDNMTSRDSETNSGSYNNNSNNNKNNNNNHHHHQQWE
SLR

Figure 959: Amino Acid sequence of 044463/0191 SEQ ID NO: /2205. The conserved C2H2-type zinc finger family domain is underlined and the zinc finger C2H2 type domain signature is in bold.

MSNLTSASGEASVSSGTRGDVKPVQQLTVNAAANTSSQQTTIKRKRSLPGTPDPDAE
VIALSPRTLMTTNR<u>FVCEICNKGFQRDQNLQLHRRGHNLPWKLKQRNSKEIRKRV
YICPEKSCVHHDPARALGDLTGVKKHFCRKHGEKKWKCDKCSKRYAVQSDWKAHS
KTCGTREYRCDCGTLFSRRDSFITHRAFCDALAEESARVSAGITVGGVQLPGNNSLSA</u>
GALQAGASSMPVMRGVIGGGVGSASSFRPGGSGIPPLGAAQFPFSMRSSRMGGLPES
GLSLVSNTNAGPSSRPRLSLWPENSDQMMGGAQQHNSHQQHIQPMNSMDVNPSAFF
AQSPKPIQAMLGLSEYDDSQAGKGANLAGFLPMSSSNSGTLYSNLLTSGSLNVSNGI
NTDFGVTNWTDRSGSAASRRSLSTSAGLTTSSSSNTNNNINVDSLYSSNNSTNAQPQ
QHQQQTYISQMSATALLQKAAQMGATASNSPIFGVFGMAGSDMGLGLSWHDSAPG
GQENQQRAAGMGEMVSGLDHNSHPFSISTSHGGHTGSHFVGNTRSPEHAGLQDLMN
SLSGAPGSGYFTGGVLNNAQYGGNVGDSSNNFGRMINISANASDNNQRMNSLSND
IGSFSQKSMGIQPGRNHQNLVLPAMGGLNPRTVEQEGGDGLTRDFLGVGHAAGGLG
RTHLSQREFANISSLGSGIDLVPYTNQRDNSQSVGTADAGLSPNKSWDAS

Figure 960: Amino Acid sequence of SEQ ID NO: 2206. The conserved C2H2-type zinc finger domains are underlined.

MPVDSARLLEIAGMDSTRAGLQGFKTVDPRFDPEGRQEEGFFVEDSNPIGSGEYHVG
EGFSGQMQAFSDLQREEVAGNGGGQYFDWPLPASTLEGLLQGSSNNLSAWPAMAAI
LTSAAQAETSTNVLLANLSVLQQKAQQLEALVQEGRHDQPASEVISSILSELIVTAAS
VLFSVQNREIAKPASVDVQPVPDTAACVEIQAENRTPPVGVGFGKSPNPNGASDVGF
EGGIDLQEEKFVVDIKTGVEEETNSPDDRR<u>YEIIEINEDDILAEHTHFCEICGKGFRRD
ANVRMHMRAH</u>GDEYKTNQALMSRPPEQGIKLPADSSSAPKARRYSCPFERCRRNQN
HLNFMPLKSITSLRNHYKRSHCPKM<u>YTCHKCNKQFSVVGDLKTHGKHCGHNPWRC
SCGTTFTRKDKLFGHVALFQGHKPLL</u>PDQELARPPAPKRLKATSNGGATTAQSAGD
DDDGSIAEFLTGDLSGLADNKFQGYGTGDDDLFFAPKVSQMGHRQNEVPIESRFSES
DFWADFSGEFSDACK

Figure 961: Amino Acid sequence of SEQ ID NO: 2207. The conserved C2H2-type zinc finger family domains are underlined and the zinc finger C2H2 type domain signatures are in bold.

MERRGQEVMSSNLGIPFENSRAMEALEQQHPYPNPQEHEEQAGQNKPKSTKSAGVK
WIKEWVPQETVLNNGKCYFLKWVTEDTLKTLKEKQEEKELEPETLPPRV<u>F**LCSYEG
CGKTFTDAGALRKHSHVHGEKQHVCHYEGCGRKFLDSSKLKRHFLIH**TGEKHF
TCPHEGCGKAFSLDFNLRAHMRTHSQENYH**ICPFEECGKRYAHEYKLKAHIKST
HEKNLANAVKLPPQTEREFSHPKAPTSLYGSVPSDRPFACPYEGCDKCYIHEYKLN
LHLRREH**</u>AGYAIEENGRHGSDSEDEMDQGSDQDGNGRNTGIMTGSGRGRLRVNSK
TSSATNLHRKFLNAAAVDLNTKTSSRAVVESKEPGKGHPREDSEETEEEEQEDTDNE
GWGHGTETDDDDEDDNDDDDDADEEETEDDMD

Figure 962: Amino Acid sequence of SEQ ID NO: 2208. The conserved C2H2-type zinc finger domain is underlined and the zinc finger C2H2 type domain signature is in bold.

MMAGQVMEPPSTSTKSEGENDESKFSLLGQQFRRYGSTAQNQGQSSQPSSMSFSHPP
MAHNQVPLNSHGQQSLVNSSHGGSDGINGGSISDVRHQHMPPLQGYNLAYGAHRT
NQNIGESSGSSGNTSQACNPQVLLNTLSVLQRKIQQLQSLVQLMAQEDRQSGQSSAM
MAQQQIVTTSVASIISQLMVAAAGMLPLSQEPGLNLSSMTTAGDLQLGHLLRDGLGL
GLNAFQKNDAGNSAMGPVNGPGDANNIFSLEGGSGGSSTGATLATSHTVQPQNPLG
TSNSTHGIGTSINVGSSDGKALRGVSEANDCDNGSDIANQAGDSLFTSQRSGGPGSGD
DNDFSGNGRDEDDDGEGESLSPGCYDIVEMDAVEILAEHTHFCEICGKGFKRDANL
RMHMRGHGDEYKTPAALARPDKAQDSAPAKPRRYSCPFVGCKRNKKHKKFQPLK
TMLCVKNHYRRSHCPKMYTCNRCKNKKFSVVADLKTHEKHCGRDKWQCSCGTTFS
RKDKLFGHIALFQGHRPVSSPNDMEGAAPQDQLVNDGGAPKIGNSVSGFANSCGNV
SGILAGTEVVGSIHSNSNAPSIGPGANGTVLESSNDAVHSQIGLKNIGFSEDGNSHSVG
VDSSNQMSGFPQAFTFQSLLSNNFLQQGRGN

Figure 963: Amino Acid sequence of SEQ ID NO: 2209. The conserved C2H2-type zinc finger domains are underlined.

MMGHSLESPKPEGIENGIKNKNLSRSSSPSPSPNGMMEIVRSKTSRKKSRVTRSQINDF
HANTNPVMGDDEDEDQGTANPGRRNRYHV<u>CRHCNRAFSSGRALGGHIRIHGTSFKG</u>
VRAAVAAVATDSSNNSSSKSLFKGAEVDGSEDEDEDEEEDEEDSSASSHREQELSNG
CSPKMVSLYTLRNNPKRSSILMDPEFTLELTGSGGAKRNCWQESNSGVFPYSESGSEL
KGLVAPQFGSWSVTRNRSSREPRKQRQRQRHGKEVAADDRDTANLLVMLAGRANG
ERESTEESVYDSKTLLVSNLESQGSIEDSGSEEEARILQKKKRKRRPRNGHEGGEVGK
EDEFDVGKNIHR<u>CNTCKKVFNSHQALGGHRASHRK</u>VKGCFAAEGKGEGEGEGEGSL
MMESDAAGNTAGMNDIWPPPKEEEGGGTVTMTMSHLTQEESPEQQQQQQSFSQKS
GRPHQ<u>CSICQRVFLSGQALGGHKRCH</u>WMGDRVTETATSVISKQESGGRVRNWRGEE
LLDLNQPPPVDEDGLRAAFDM

Figure 964: Amino Acid sequence of SEQ ID NO: 2210. The conserved C-x8-C-x5-C-x3-H SEQ ID NO: 3667) type zinc finger is underlined.

MSCGYESNGDAAAFVQKDARGEMPGIRLNNAFVGSSSPRLEDVFCALQKYLPSNNE
DEESLPAVDAYSCDEFRMYEFKVRRCMRGRSHDWTECPFAHPGEKARRRDPRRFH<u>Y</u>
<u>SGTACPDFRKGTCRRGDACEFAHG</u>VFECWLHPARYRTQPCKDGRSCKRRVCFFAHT
PQQLRLLPGLSSPSSNSRSSTALHVASALKNYSLSASAAAYDGSPLRQALEGIVSSSTP
GGSLISSPTSTLVGHSQSPPPLSPPLSPSASPPLSPEPGWSNTYRVGLQKAVLNRQIPGH
RRHVERIASMPSEASRGLVSPRLMTLSDTTSQQQPMGELINSLQSLRMKESSVPSWLQ
VQPQMVNGGGGHVSPRISNLRHCVVQSLPCTPTHSETADDVGDWFEEPVQRVESGK
DLRAKIYARLTRENLNQDSSPSIESPDVGWVNELVK

Figure 965: Amino Acid sequence of SEQ ID NO: 2212. The conserved RNA-binding region RNP-1 (RNA recognition motif) family domain is underlined and the C-x8-C-x5-C-x3-H SEQ ID NO: 3667) type zinc finger is in bold.

MDLHDATPIVFSRIQSLEPENVSKIMGYLLLQDNGDQEIIRLACGSDALLQSWISKAK
KDLGLVITTAPYNSHLPLHHISHVNNNSLARPAFASPALVSPNRPGAVYWGASSHLQ
AQQQERQLSFSLPTLSLQPHDQLRMEDHNNVYINYRPNSLQPLHISSNEKLQQATPA
AISYEKLPNYSHEQLILRDDYQLRDQLSFFNDSLNPHTMFPAIDYLFPDQMVGYVNS
NKLGIDHLNSITTVNSDNLSLTPSAIAPDVTESSPAPSWKPCMYFARGYCKHGSNCR
FLHGYPRQDNTLPLSLSGSPTGSRNSDEAFQGGSLERLEVELQELLRGKRAPVSIASL
PQLYYEKYGKTLQAEGYLTESQRHGKAGYSLTKLLARLKNTVTLIDRPHGQHALVL
AEDAHKFMTYKSGVDDLGGVNSGSRQIYLTFPAESTFTEEDVSNYFRTYGPVHDVRI
PYQQKRMFGFVTFTYPETVKIVLAKGNPHYVCGARVLVKPYREKGKLGDRKNPDR
GEQYAKYAPFNHFDAKDYDHMHLGPRIMDNSDAIRRHMEEQDQVIELERKRLAELH
FADAQRVHLAAAESHISFASTPLVVSHALENRFTNGFPQSEIESKASEDLNNFPSTDHF
GYLLEVLENNEDEPKQDNDDQESYGHNLPESPFSNLNGSNIKTVLYTSEKTVGNMPT
ISKALAQASSTSVIDKELTCSICLGT

Figure 966: Amino Acid sequence of SEQ ID NO: 2213. The conserved C-x8-C-x5-C-x3-H SEQ ID NO: 3667) type zinc finger is underlined and the ankyrin family domain is in bold.

MKEMAEYCSPALLELAANNDLSGFKQAVEEGGSSVNERGLWYGRQIGSGQKMVLE
QRTPLMVAALYGSLDVLSYMLSGGRVDVNQSCGSDMSTALHCAAAGGSILAIETV
GMLIKAGADVNFMNAGGRKPADVIMVSPKLAHFKNVLEDLLIMGSNSPMKIPCRV
SGSGFYLPEGGGCFFDEHGCVVSVPTSSPLFSSPDATSPATVNSPLSSPPTSLDTPKNL
CDCGQKKEFAVDSSLPDIKNSIYSTDEFRMYSFKVRPCSRAYSHDWTECPFVHPGEN
ARRRDPRKYHYSCVPCPDFRKGACRRGDVCEYAHGVFECWLHPAQYRTRLCKDGT
NCSRRVCFFAHTPEELRPLYPPACSSMLSQRTTMTSSDKMAVMHPLAPGSASSVLM
MSSSNSSQSSFPNSPVSPLSSANTSSHSSFGGGSWAHPNLPTLHLSNGALQASRLRTA
VNARDMHPDCSIESGDYEGQLLNEFAYLSTQARGNGPMATVSSSGNTPCRPRKFRA
HNVAPTNLEDLFASEVFSPKMTASESAFLSEIQSHKSAQLSPQLQSQMLSSFNTQVYP
QGSTQGQMHMQHGGVDCQSPSVFLSPPPVQLASYSLSSLGPLSSLTGELERQNSNGS
PLSPIMSTAADSRAVAFSQRDKGSSRSGDLGGATTWSEWGSPTGKVNWGIRGEELQ
KFRKSASFGIRSSDEPDLSWVQKLFKEAPMESMDRGTMGRSMDIANSVQMEATDLG
GWISQINPDQVAPLTL

Figure 967: Amino Acid sequence of SEQ ID NO: 2214. The conserved C-x8-C-x5-C-x3-H SEQ ID NO: 3667) type zinc finger is underlined.

MCGGPEHLKPASPHEGEDKVKMAENQSIKVKELSESCSSLHELAANNDLIGFKKAM
EEEGSKIDEVNFWYGRQNGSNQMVLEQRTPLMVAALYGSVDALSYILSIYVTCGAD
VNQACGSDNSTALHCAAVGGSACAVETVKLLLHAGSDVNRLDAYGRRPADVIMVS
PKLTEIKAKLEEMLNAAGSCQTSPAKLPNIVSGPPGFESKGMESMSPLPLLPLSLSLEA
SNNRSGCVNSPTSSPKSMEALKGFGDVNEKKEYPVDPSFPDIKNSIYTTDEFRMFSFK
VRPCSRAYSHDWTECPFVHPGENARRRDPRRYH<u>YSCVPCPDFRKGTCRRSDVCEYA
HG</u>VFECWLHPAQYRTRLCKDGTNCSRRVCFFAHTSEELRPLIVSTGSAVPSPRASSSL
DMTSVMSPLAPGSPSSVSMMSPFLSNPQQGSVLTPPMSPSASSVNGYGGWPQPNVPT
LHLPGSNVQTSRLRAELNARDMPVEDSPRISDYEGQQLLNDFSPLSTQARLNAAAAV
ISGGGNTTTRSGKYKSHGINTVAPTNLEDLFASEVTSPRVAVLEPSIFSQMSPQMQAH
KTAQAYMQIQNQMLPPINTQAFSQGITQMQQAAIEPQSPGHSLMQSPFQSSSYGLGSP
GRMSPRCVDVERHNTCGSPLSPAMAATINSRMAMAAFVQREKRSHSSRDLGANVNP
SSWSDWGSPTGKVDWGVQGEELSKLRKSASFGPRSYEEPDLSWVQTLVKETTPEGK
DGGNVSCSGETPHKGQIENVDHSVLGAWIEQMQLDQIVA

Figure 968: Amino Acid sequence of SEQ ID NO: 2215. The conserved C-x8-C-x5-C-x3-H SEQ ID NO: 3667) type zinc finger family domains are underlined.

MIDGMLFVQGQREGESPFSFTTTTHGGLQGSYTDGERTMHDNCPLSSSSSPRVPGDA
LEETVLQISIQTLDTLEEIGFYSGPYPERP<u>GEQDCAYYMRTGLCGYGRHCHFNHPPNV
KLDTQYMSELPERFGQPECKYFMKTGACKYGATCKYHHPHDRDGPRVQLNYLGLP
MRQGEKECPYYTRTGSCKFGATCKFHHSEPT</u>ALLPDSGSPVYAAAELPLSPASGSSYP
AGLTSWFLQGAPYVSDPHLQGSPTYMPVILSSQQSTPSVQPGWNTCHGPTSPLSSPEG
KQQLGAGTVYSSSYMTDSSSSPEGKQQLGAGTVYSSSYMTDSSSSSHMHGALSSPVQ
GSSTAMEHPGVQCQVAAPQREAFPKRLDQPQCQHYMKTGCCKYGTTCRYHNPQER
VALSPCCMLSSQGLPLRP<u>GQPTCPFYSRYGICKFGPICKFDHPL</u>TGPNCNPAAFSSSEQ
QTTSYPKGGSSGAHCQSTSEEFSKQDLKATDQYSKAEEASSLKQKSTEEGAGDRLAA
KSPSTSGAAI

Figure 969: Amino Acid sequence of SEQ ID NO: 2216. The conserved C-x8-C-x5-C-x3-H SEQ ID NO: 3667) type zinc finger domains are underlined.

MGSEVSNKPAFDPNWSFQPAVTSATQNFNEAMQMPLQARDSSNLSEAFSGPYPERP
GVADCAFYNRTGSCAFGLNCHFNHPPNRKQVPQTCELPEKVGQLECQFYLKGTCKF
GTLCKFKHCNDKAGSAGQAEFNFLGLPIRQGEKECPFYMRIGSCKYGVACKFNHPEP
TEEGMASSVSSFPVDATTRSSSASSFEMPYSPAHLSRPSPRIPHAPGAHLQEHTVNMH
AMNPSPPQGIPPMRGWNIDNHGSANTLSSSEGKLPIGVSFMNTQTEDLTGLQAVTKR
DVFPERPGQPECQHYLRTGECKFGAACRYHHPKRTDHPSSCMPGQMGIPLPSGAVRS
FPSSEEKRYYPGVDFRNTAVQCNNLAEINKQFFPPRTAPFSSETMPPPIMQTQASATQ
KQTFPERPGQFECPHFLRTGECRFGVMCQYNHPKEWFAKSSESMFNPTGPPVHYVPV
APMSSSEEKQHTAGIGLLNGTKQTTDLAVGSLPSVLTSAESICSAAKTIPTPQPWEFAT
KKETFPERPGQPDCAHYLKTGDCSFGAACRYNHPKEIIEQCMLSEMGLPLRPGKPTC
VFYSRCGICKFGPRCKFDHPITGHTSNRSVPLNSELPVDPYSSCTSAADMQASSASSLS
SQRCQRLT

Figure 970: Amino Acid sequence of SEQ ID NO: 2217. The conserved transcription factor CBF/NF-Y/archaeal histone family domain is underlined. and the CBF-A/NF-YB subunit signature is in bold.

MAENYGSPDSSPRSENESGGGHMGGSDFSVKEQDRFLPIANVGRIMKKALPANGKV
SKDAKETVQECVSEFISFITGEASDKCQREKRKTINGDDLLWAMTTLGFEDYVEPL
KIYLHKYREMEGEKVSMAKQGDPTPSKEGNNAINGSSIENPNANAYSGLNPGGYNR
VQSQSLPHMQQAAYGQPPGGMVYGHHGHIMGAYNMTAPNSSGGNSSGQQQQQAP
RGQW

Figure 971: Amino Acid sequence of SEQ ID NO: 2218. The conserved CCAAT-binding transcription factor, subunit B, domain is underlined.

MTVREFLQREEGSKLIMQGADCKEHRESEGQPNISSAVPAMPWWNGFGSQFPQSAW
CAPVKPLFVDHPNRVPGPVKQVATQSQQLEQPSTQVAVQSQSEGEAMLAGTRRMP
MSNQLGYSGANGEKQHQHQPTKSIIGSAPTEYLVPHAQLDFNHSIACAAYPYADPYF
GGILAAYPAQAMIHPNMLGVQQARMPLPLDMTEEEPVYVNAKQYHGILRRRQLRA
KAESENKLIKTRKPYLHESRHLHAMKRARGCGGRFLNTKKLEDSKANVDNGKTPEG
HTAQAGSSSGSEVLQSENGNGNSTQELHGACGMSGSEVTSIAQSSENGTTYQYSHTN
GAYLNHYQHPHFHISAFHPLSSGGEEGSSAKGGSIISGGSQQRVVVIQ

Figure 972: Amino Acid sequence of SEQ ID NO: 2219. The conserved CCAAT-binding transcription factor, subunit B, domain is underlined.

MENTPTHTVSGIDGSAPDEQQPQADPVQQEAPPPGMIPPPAMTLLPPEFVMPHTQLEL
GQTMVRAAYPYPDPYFGGIVAAYGPQAVIHPHMLGVPHAGVPLPSDAIEEPVYVNA
KQYNGILRRRQSRAKAESENKLIKNRKPYLHESRHLHALKRARGCGGRFLNAKKPD
EVSQENNSNGSIVLVSSVDKPAAEKKNSSQQNTDS

Figure 973: Amino Acid sequence of SEQ ID NO: 2220. The conserved CCAAT-binding transcription factor, subunit B, domain is underlined.

MMQNVTTKLGPESSQIDEQQKPPIQQQQVPSTGILSAHAESVMRQAQLELGPFHVNL
KTGNAFWQAQAAYPYPEPFYGSYVATYGAQAMIPPHMFGVQQAGLPLPPSDMVEE
PPVYVNAKQYRGILRRRQSRAKAESENKLIKCRKPYLHESRHRHALRRARGCGGRFL
NTKNDGSNEKDVSGDNDSHDSTGQSNKVLNPDSGKDGTSHDLNGIQHIGNLAPIGN
GISAHSGTVSPGQVGVGESVSNGSHYTYNQRRGFHSSAFHPLSVSTTESGQVGGVVS
SGGHHTAVATQ

Figure 974: Amino Acid sequence of SEQ ID NO: 2221. The conserved Tesmin/TSO1-like CXC domains are underlined.

MFPQQGGGRAGGGVVSPPGGGVKQEQQGDLPSRKSVRQLDFTSTSMYGDSSTSSDT
ALRTSQQPSSIKQGSPRGSFSGPLTDSKEGTP<u>KKSRQCNCKNSRCLKLYCECFASGIYC
DGCNCVNCYNNVDHETVRREAVDAILERNPNAFRPKIASSPTPVRDNREDMGEQLLP
AKHNKGCHCKKSGCLKKYCECFQGNILCSENCKCIDCKNYENSEERKALYQSDITGS</u>
LNYPQPVSNASVSGTTAPVGYSSPSPSKKRKTQEVLFHQTPKEHASRQTSQALQGST
MKNISSTVNASNPPLSTVNGTGALGIPSSKVIYRSLLADVVQTDTVKGLCQLLVIASR
EAANACGAQTSLENGPLDKQAAKGNSLTNNKDSPESSTQNEFRSEQIRDDRLETDRG
YKVAAGASSTNCAEEAEFDSGANFSKQRAMSPGTLALMCDEQDTLFTAPSSPSGGC
KKPCSHHTTQTFAEQERIILSEFRDCLRSIIDVGKRRATQYSTEAAMTMKRNQQPDLN
PQLSRPVPVSKTVTVPLSVPPSASSGALVTEVNASSSGSLRNGDKSDAVVTFQQKL

Figure 975: Amino Acid sequence of SEQ ID NO: 2222. The conserved transcription factor E2F/dimerisation partner (TDP) family domain is underlined.

MLPRGSIRRATGPRSGIRSRRTAANSVVSDSPYNNNNLRKDISIEFHEASIHKYAEGFG
ITQNGANANGMNVDGNKSTLQQGEGEYPSNAIAGRCSGTSASAPGQSISVESGSGGS
LSRGSEAAIATPSRNNQMARVQHLDIHQEDLDSPETAGTRKRKRVPRVNGGEKGGR
<u>GLRQFSMKVSQKVESKGRTTYNEVADELVAEYANLDSTLVSPDRQQYDEKNIRRRV
YDALNVLMAMEIISKEKKEIHWKGLPKTSINDVEQLKAEKLLLKSRIEKKASYFHELE
EQIIGLQNLVKRNEHRYSSGNTPSGGVSLPFILVQTHPRATVEIEISEDMQLVHFDFNS
TPFGLHDDAYVLKEMNFCKRPFSTGADSGHEDCCNGTALAECKSPESNVCQNLIPSH
SPLPSVGASYPMSSTPGRTYSTPPVPGILKARVKHENMT</u>

Figure 976: Amino Acid sequence of SEQ ID NO: 2223. The conserved transcription factor E2F/dimerisation partner (TDP) family domain is underlined.

MLPRGPSRRGSSTTGPRSGVRSRKVTLTQSHVANNPNNNRSYSSISNSNGVQNDPIHE
AGTHGYAEGLGIVQNGAIATPIGMEIVEYNPDAAKEEGEYPSTTSNGMVGGYSGNLT
SLPGQSVSMDSGSNCSPSRGSDVVMATPGPSSAIARLHHLDGQGEDFESPDTVGTRK
KKRGPRAIGGEKGGR<u>GLRQFSMKVCQKVESKGRTTYNEVADELVAEYANPNSALIS
PDQQQYDEKNIRRRVYDALNVLMAMDIISKDKKEIQWKGLPSTSPNDLEDLKAKRM
GLRGRIEKKMGYLQELEDQIIGLQNLVKRNERLYGSGNTPSGGVALPFILVQTRPQAT
VEIEISEDMQLVHFDFNSTPFELHDDAYVLKAMGFCEKPFTDGMDVTGHDSFANGT
GFGENNMTITNMYRHSLPSHLRTTGGSFSMPSATGKNCTSPPVPGILKARVKHE</u>

Figure 977: Amino Acid sequence of SEQ ID NO: 2224. The conserved Pathogenesis-related transcriptional factor and ERF family domain is underlined.

MESNELPSGQGYVEADTGAGNTTLSGTGGRRYNRSKLAKRAKIGPQTPGSNIGSPLG
NAPTPISSCRYDSSLGLLTKKFISLVKQADDGILDLNKAADTLEVQKRRIYDITNVLEG
IGLIEKRLKNRICWKGLSVSRPGEVEDEATVLQAEVDSLNLEECKLDDCIRDMQERL
RILSEDDRNRRWLYVTDEDIKKLPCFQNDTLIAIKAPHGTTLEVPDPDEAVEYPQRRY
QILLRSTMGPIDVYLVSQFEENIEEMNPVDLATELVPSGICPAEGVTISSVQEGATFVE
MECQGHETRQPCTELTSPQDSAGGIMRIVPSDANIDADYWLLSDSGVGITDMWRTET
NSTWDEVIELNPTDFGIGEGSPCPQTPPSSSVF

Figure 978: Amino Acid sequence of SEQ ID NO: 2225. The conserved ethylene insensitive 3 family domain is underlined.

MGIYDEIGYPGNLDLLSVPLEGDSMCENEGEVMHDDGLSEDDIDVDELEKQMWKD
RIRLRRIKEQRKGKYHSDTAKQRQSQEQARRKKMSRAQDGILKYMLKMMEVCKAQ
GFVYGIIPEKGKPVSGASDNLRAWWKEKVRFDRNGPAAITKYQAEHATPGANESNM
VVAPTPHTLQELQDTTLGSLLSALMQHCDPPQRRYPLEKGISPPWWPTTHEDWWPQ
LGLPKGQGPPPYKKPHDLKKAWKVGVLTAVIKHMSPDIAKIRKLVRQSKCLQDKMT
AKESATWLAVVNQEEALARQKNPNACPPTNASVTTHAGSLTFSSGSEYDVEGFEDD
PNSIYTNNDVQDCKPQDLDLLNSEVQECKPQDFDHFNVGISNEGVSALQVGDNVDFI
RKRKLSQESPLEDQKVYTCPHEQCPYHERQLGFSDQSLRNAHQSTCAYRTDLQGMG
YQRPEPQESKSLFCISTGQPKQLQVQGKVSIFPSEKEGQTTSNGNVNLNPLGTTSSAIP
TGNQQPISELLALYDGLHQNKTATLGNLKMMNGHNQLEVNMHPASQGGEVFKITPD
DNFFGQGVIAGNNGNDFGSNMQLVMREGLNLDQSRVYDQPFIHHCQEMNGDMKFV
SAYNNIPIDYAVPETVSKYDNSIWYFGA

Figure 979: Amino Acid sequence of SEQ ID NO: 2226. The conserved ethylene insensitive 3 family domain is underlined.

MERPEEFGFSGNLDFLPFITEAGGGGGGRDSMGENVGDALREEYVSDDEVDVDEL
EKRMWKDRIRLRRLKEQRKGSDVVDDAKQRQSQEQARRKKMSRAQDGILKYMLK
MMEVCKAQGFVYGIIPEKGKPVSGASDNLRAWWKEKVRFDRNGPAAISKYQVEHS
APGKDEFNTIIVSTPHTLHELQDTTLGSLLSALMQHCDPPQRRYPLEKGVPPPWWPTG
NEDWWQQGGLPKGQILPYKKPHDLKKAWKVGVLTAVIKHMSPDIAKIRKLVRQSK
CLQDKMTAKESATWLSVVNQEEALARQQNPNTCLLTSAEGFGHAITLTSSSSSEYDV
EGVDDVPDSACPKHDGQGDEAQDFDLFNMADAKDTLWSIGNGEDASMTRKRKLPE
ELLMQDQKIYTCPYEQCQHHERKNGFLDLNSRNAHQSNCPYRTDVQGMEFQRLECE
TNASTFYTSVAQPDHPHLQEKGVSESKSGGQLASLGNQTIHPLNTGSFIMPPKTQQHI
NELLALYDSSVQQNKASTNGTTQFVSGNNPLEIITEPGFPKEDFSRITPEDVFYGQVV
VLGNNNSECSISMHQSSGSMHHSSGSLHQSGGSMQQSIREGIFCDESKVFDQPFQPQS
REMIRNLGFGLPCDVSFGSVESFHRGSNNRSTNGDKIWYFGA

Figure 980: Amino Acid sequence of SEQ ID NO: 2228. The conserved SHAQKYF SEQ ID NO: 3671) class Myb-like DNA-binding domain is underlined.

MGSSAELTLNCGPSVTSASNVFKSFSVVGDHLEKMRRHEEYIKGLEEERSKIEAFKRE
LPFCMQLLNDAIDACKEQLAECERTSPHEDVQNAPNTSGRPVLEEFIPIKKSSQATEN
KPEENHVSKKARFNNSDKPNWMISANLWNPDPESIDSRKGGGISMEESLKKQDSQH
QEHSLPSNAKLFSDSKHRVRGAFQPFSKESHVIAPRPVRSTVERTLPNLALSSAEREV
DSSLVANETVSLNATTTTNNRISRSKETKEVHTPVHEKETVSVIDGANTSPTTPNTSPA
QTQRKSRRCWSPELHRRFINALHQLGGSQVATPKQIRELMKVDGLTNDEVKSHLQK
FRLHTRRPSPSPPTSNPQAPQLVVVGGIWVPPEYAAHAAAAQQGQGGLYNPIPTTV
SCPPLSHYCQPSISQGHEYYCQINPAASKSQLHHSVSLYCDQQQEQRQQTPSQSQNSP
QGPFQCNGQSSGARGTSADAGREESVGKDAESDSSSWKAEDYVETTEVMNMGRGL
SLRKQPHKFLNEDDGDAADNRARDQTGKQALVGR

Figure 981: Amino Acid sequence of SEQ ID NO: 2229. The conserved Myb DNA-binding domain is underlined and the conserved response regulator receiver family domain is in bold.

**MPIANFTPIGLNVLVGDDDPLCLLALERMLRQCNYNVTTCSRVPQAISMVKENR
DRFDLIMSEVYLPDEDGFRLLEIVGLGLDLPVIVMSTNGDTSVVMKGITHGACD
YFVKPIRIEELRNIWQHVVRRR**GRESLKDDLGECEDREVSDSPDTSSKKRKDTSSG
DYSDEVIDDISSLKRA<u>RVHWTVQLHQQFVIAVNQLGIEKAVPKKIVEIMKVQGLSRE
NVASHLQKYRL</u>YLKRLSGAISEPHPVASFQAADDSISGGMMKLQQGEKGVASSSGA
KGLNLGTGVSSSLGVRGLDPSTLKSLQQYRAYQQKLVANRAQIFGGIGVRPPKYSDT
AKVPESMGGSKSGLQRMSSVDMGLLWKAQRDQTADENKKQGIANLQNLPQKRSNS
SEQRRFRGSHPKHSRTRTMTDLPMIFQSAKPEVTFQKTPPAKSMLQDVDELQPMEDI
SWLDNTFKPESPRAAVISFDSFVQDFEGSSLSAATIEESNRHAFASTDFEGQRKAGVE
NEEFFSSGSTDISDYLVDDLMPHPR

Figure 982: Amino Acid sequence of SEQ ID NO: 2230. The conserved response regulator receiver family domain is underlined.

MGKGSISNSDAGSSVLDRSC<u>VRILLCDKDPTNSQQLLELLRKCSYQVTAVSTAREVV
SVLNTEGREIDLILAEVDLPKSKGFKMLKYITRSTCLQRIPIVMMSAQDEVAVVMKCL
KLGAADYLVKPLRINELLNLWMHMWRRR</u>RMLGLADKNIISKNLGHDLDMLVSDLS
DSNTNSTNLFSDDTNDKKVRSHAGPEISTQVTPSECELQSHDSPKLELSLKRSSEGSPE
EPEPGSLAGKFLSYPKRSELKFGGASAFLTYVNASVQANRTPNQISVGENKASQQET
AIPEKHGVMGPPSTDNRPIGLSHSSEAVKSSNRTEFIPCEEHCRDRLETRSCNVSMSPE
IPIGQVAPAGEQFPMVQGGLPNEGSGMNNHDISSLPAPHFLPGMMNHSMSASMQFC
HGVHHDVGPRGAPRLIPFHTFQPCHGMPVNATMPYYPYGFVVAPATIGSSHAWPGM
ANLSVSEPKITQVERREAALNKFRQKRKDRCFDKKIRYVSRKRLAEQRPRIRGQFVR
QTNDMEAAGANGVVYGVDSSEYEDDGYVHGSGELRLTSSPESLAGDTENAI

Figure 983: Amino Acid sequence of SEQ ID NO: 2231. The conserved SHAQKYF SEQ ID NO: 3671) class Myb-like DNA-binding domain is underlined.

MMSSQKGESLWHKDPAIEPHHAIQAISTTIAFQTSNTSKSEGPTFPKDNSSFQRLVPQS
VSSNSPEPVDSNQENPFPRSSLPSSSKKLNSSPMSSNIIPASSNVIDPEHISSTSSTFCTDL
HFSPSISQHHPPGILPFLPHPSESSLRASVMPPSQSAFSQSLFSGDYMKQSYGDTHSGD
PLQDIFNFPDVASECSQRNQVAASSGIVGQDHTKPDEWQDWPEQLPSDDDSLVASW
TNLLVVDSGEEPGLNTIYPAATLPSTGSVSQLQQDLCAPAGGNQVASSSTSSGTGTSN
KPRLRWTPELHERFIEAVKKLHGAEKATPKGVLKLMNVEGLTIYHVKSHLQKYRIA
KYMPDQREGKTSCSAAGKEDNKRNSSDDLSTLDLKAGMQITEALRLQMEMQKKLH
EQLEVQRALQLKIEEHGKYLQKMFEEQQKNR

Figure 984: Amino Acid sequence of SEQ ID NO: 2232. The conserved SHAQKYF SEQ ID NO: 3671) class Myb-like DNA-binding domain is underlined.

MYQQQHANKKNNMSMQVSSGDAALVLTTDPKPRLRWTVELHDRFVDAVNQLGGP
DKATPKTIMKVMGVKGLTLYHLKSHLQKFRLGKQPHKELNDHKDGERGSRFSEGH
GASTSSSRMMGQEMNEGFHISEALRMQMEVQRRLHEHLEVQRHLQIRIEAQGKYMQ
SILENACQTLACQTGPSAGTETRRQELPDLASKVSNDFFRTPPRSTVNYPSLTEMNAF
RGEHNHIRQQTQLTDCSVDSCLTSNETFGKMIEENVQGVSKKRPMSFYCDNDTSIWE
KDGKGDDVRVHELSNELSNACLGQKETFKGEQRPSSSSVKIESERNSASDVFETRGS
QLQEPASSSKTDKDLRNSPKLERPAPKKNPNCCR

Figure 985: Amino Acid sequence of SEQ ID NO: 2233. The conserved SHAQKYF SEQ ID NO: 3671) class Myb-like DNA-binding domain is underlined and the response regulator receiver domain is in bold.

**MVSVAEWKDFPKGLRVLVLDEDSEAAAEIKSRLEGFEYVVSTFSNETEALAVLAN
ETNSFHVALVEVSTGNSCGGFRFLQTACNIPTVMMSNRSCLSTTMKCIALGASE
FLQKPISEDKLKNIWQHVVHKAFSESGTVLSKSLKPVKATIVSMLQLGHEHDNVKS**
KSSQNGDSSVGNKAEADALHKVQSCMPTRTDSIKQESSIEPCNSEKFPAPSTPQLEQG
GRSPCEEDKTLRLDDTTNLMVGPAHPDTNCGDETIREVRLDAEATSTWSSQVDSPAS
VKKESQDMSRISLKARISTQSGVKPADLTRDQLGNGITSRGTCLHSGQETADVHVVS
ASGITEEEVGSAEGSKSDDENIETEAILSSYVCIEENVDSSTENIKEKRNSAEHGCKKS
NISSSKKKFKVEWTMDLHRRFVQAVEQLGVDQAIPSRILDLMKVDGLTRHNVASHL
QKYRSHRRHILPRDDELASRRYWQHFDPAWTRTKQDESWSRTGNPASGPILAYSPV
QLHSTPHGTPVGPPLHVWGHPTIDQSGSHMWQQLQVGTPTTWQAQDGSFWKHPGV
YADAWGCPTVGMPFYPQPMMKLPSNHGHRSTPKPNSTMQGVSVQYPATLDPLNES
LLWEKSINEHPPKEVIDEAFKEALNNPWTPLPLGLKPPSMESVMAELQRQGINKIPPP
AS

Figure 986: Amino Acid sequence of SEQ ID NO: 2234. The conserved GRAS family domain is underlined.

MSTISYNSHAPSFQFYQNPSSDWLLHNKAMDIQSHHQHQQFLFWEPTPLLPANHKLN
PFTAFPPTSLESIELSKSDADYTSLWDSGQIDQKQHISALILRASERDYLENKVDFCDN
VSVSTVTDEKYVLDGLYQGFDEEGGIVPSKAFGELPFPFFDDGIDVISFLGNNQNPCSP
SDHSEAVGSIGSCSSASLNSIDKFGNEFVLRDEYPSEFEAVLGLQVPLLGQQDLLQILV
KCAEALSEGHHGLVRSMVSKLQEFSSPLGDPLQRISFYVSEVLKNHSFSVVNQEEND
EESSLEYDLAYQAFYQLLPYHKFLHFTSNQAIQEAVDNASNIHIIDLEIRQGLQWPSFI
QSLAHRPGGPPKLLKITAIGQDEKRLKQTGRRLLEFAESMEIAFAFHPVVVDLENLDE
SALNIEAHETIAVNCSVVLHRLLCKSGKIHGLLALLRKLNPAVLTVMEIECNQSMPST
VGRFLQCLIFHRAVFNSIEAIVEKNNPDRVLIERVYVAPNISNVLVHDKENSGMYACI
DSWRKFLRHSGFKDSPLSNYSKCQANLLLGMYPNDSFKLHQDGVSITLAWQDTPIVS
VSVWTC

Figure 987: Amino Acid sequence of SEQ ID NO: 2235. The conserved GRAS family domain is underlined.

MSILRPLESSGSSSSEGCLNVGRNNRVGTPPLINPSNVMKLHCRPELNGVTSNPRAQL
GPFTSEIHSQLLSKRSLSDFEMQALFRTVRQRNHSTPILPLSSADSVVLSHSSASLSQSV
SSYPYHRHQLNISPYSQGYICNPASLSTVSDSNVDKLLSLPALQNASALEKPASNQNF
ANNRTFILPKLKSPDAHRVAIDNAKMDDYQEGIRHKLQELERELLSDNDDAFIVSALS
PEQSSHLDREWVDTIQNLLSEEAVLLSTISGESQGYHNSNKENPTSQASRSQPEDQKH
SFSSQPEPKTSATQPRIDAASSSRKLLVECATAISEGDKDSALSIIKKLMQVISVYGDP
MQRLTAYMVEGLVARLGPSAQSLYNTLKWKETPIKSDILSATRLLYKVCPYIEFGCV
AAISTILEALKEEENVHIIDFEIGEGSQYVTLIYKLAARVGGPPKLRITAVDDPEPISRSV
GDLYMLQEKLKEIAVQVGVHLEFHIIPQKAADVQPYMLGCRPGEALAVNFAFQLHH
MPDESVSTRNPRDQLLRMVKGLSPKVVTVVEREMNTNTAPFLPRFMEALNYYSAVF
ESLDVSLERENRDRFNIEKQCLARDIVNIVACEDAERIERYEVAGKWRARMTMAGFT
VYPINTSVDNSIRPLFESRGNNYRLKAEKGALHLGWLDKVLVVVSAWHLESHSMIK

Figure 988: Amino Acid sequence of SEQ ID NO: 2236. The conserved GRAS family domain is underlined.

MNGMLSRTSGNSLPPAQLKHQILQSKTSPDQAQKRHCKSSVWQRSRSGGEIEPTSVL
DIRSPSPTSTLSSSLGGSSESAGAVAAVSSGLLCEAVSDGGGGGSGSGSGGAETLLLES
SGKEAFNNGGGSTGSPARWYSNRGGSGNGGREGFGWRLNNGEQQPGGGGMVEGK
SEVKKEDPQQHSRAEEWGSGGGAGTAGGMDDLESMLFESGAAPPDQSLMRWLLGE
IEDPKDLPPPQIKSATSGGSTSAPQFVDPSIEPNFADPGAFAFSNNNLSDVIAPPQHASV
PSSFRPSYATLPNLPQQQFIPPPPPPPPPPPPFAYNGPMPTPFGPNAYHPEVLFSGPAV
YGSNPVQHLGPDFPRFNMAADPNRNNNNLLFDMPHPPPPKRFGLEHQLWQQTFKQQ
EYMSMMKPQQQQELLQSLHRRQQFLHQAPPPSPHHQLRQKAVVNHTFKVGGSGAV
ADEVHVIVEQLLKAAEAVELGNLDHAQAILARLNQHLSPLGKPLQRAAFYFKEALAS
RILNTTATNTGGDNRNATVTGTATSNISSPLDMVHKISAYKSFSEASPLAQFAHFTAN
QAFLEALEGAEAIHIIDFEIGLGGQWASFLQELAVKLGGAPPVRITALGSSASSSLELH
LTRDNLCNFAKQLNVPFEFELLHFDHIESLTLEREAVAVNLSLLPSTFSSPDSISRLLR
LVKNLAPRAVVVVDAETTATAAAASAATTSSASFVHHFLEALQFYSFLFDSLDAVNI
NMEAVHKIEKFLLAPKIDATISSAAAPPWKTLFAAAGFSPVAFSNFTETQAEYLIQRL
HSRGFEVEKAHAALLLGWQGRPLVSATAWRCGPPP

Figure 989: Amino Acid sequence of SEQ ID NO: 2237. The conserved GRAS family domain is underlined.

MGEPCLMGNEYPLQGIKAEEAVLQQTHFNEATDSQLSEFFCGNSDIGPYSFFGDNAG
HTISPFALNPTSTALFPPSNALITPNIHGPNPPPLSFTPDFKTFKVPLDEKHPELQLPYGP
NPSYPEKNVVFPMPAAPRGHVGVAHEGFPEFEKSLYWQQIQQREFQPAWKTMINRS
VRDPLFSAVKQEWPGRTHQGRVDLDEVQKSAILQQLLNATNYVELGSLDIVQAILAR
LNQYVSPRGKALQRATYYFKEALGGLRSLQQTNSKSYLSPLQLVHKINACKNFSEISP
IPYFANFTANQVLLEALEAVDKIHIIDFDMGLGGQWASFLQEIALRPGGPPALRLTAV
GYESMEMHLIRENLCTFAENLNIPFTFQVVEIPQNEDLNRSMLNLKEGETIAVNYSLG
MQGLLSKDSIASILHLINRLRPKIVVVVDHENEQAGSSFAQKFMEALQFYALLFESLE
AVHMNMETIEMIEKFVMAPRICNVVEAAYRRHREGENLPNWRSMFQASGFTPMMM
SNFTHKQAESLSRSRQQRFGFCFEAVKKQQEQILLLGWQRQILVSVSAWIVNNVV

Figure 990: Amino Acid sequence of SEQ ID NO: 2238. The conserved GRAS family domain is underlined.

MNVQFETEPTATTQSSQYVLDHPHKAFGTCLPDPGPSVASNISLEQSSGSHEWIHGTP
KTSYQNFPCSPQEVISYGLGHCTQAHECYTSDKYRMSDGSVQSSPLHDNDSLQSQRS
THEALPYSTGHSFYSSPSVQSCSSNGSPASPQVSQNYPSGRHYLHSPQEPYGPAGSGY
SGTEQEEDLKYMLQELETALLVSESDDPDIGSICEEQGFPEYSEWNIENMHDTTDNYC
QSSLSVYPKPEQVEVSSMTLNHVKVEIVNE<u>VDMGTICSSTINSSEEQKQELEFDIPYGD</u>
<u>VKELLIACAKAVADSDNDSIKIGKLIAEIRQVVSISGDPMQRLGAYMVEGLVARLASS</u>
<u>GAIIYKTLRCKEPSSPELLSYMQVLFEVCPYFKFGYMAANGAIAEAFKDEDRVHIIDF</u>
<u>QIAQGSQWVTLIQALAARPRGPPHVSITGIDDPVSNYARGGGLELVGKRLSKLAEICN</u>
<u>VPFEFHPVPVMGPDVQVNMLKYQAGDALAVNFSFQLHHMPDESVNTSNHRDRIIRM</u>
<u>AKGLAPKVLTLVEQESNTNTAPFFSRFMETLSYYTAIFESLDVTLTRESKERISVEQHC</u>
<u>LARDIVNIIACEGAERVERHELMGKWKSRFTMAGFKPYPLSSIVNSTIKSLLEGYCEN</u>
<u>YTLLERDDTLYLGWLNRPLIAAAAFQ</u>

Figure 991: Amino Acid sequence of SEQ ID NO: 2239. The conserved HMG1/2 (high mobility group) box family domains are underlined.

MATCVEKMSDENKPTRKGGRKAAVKPKTVPVIENTVASPAGKKPKEDQKFPSSSPDI
LMEDEAQKENRVVSTPKPVGRSRKKSALQNVSNLIPPPVTNSLQEELEAVRIRLQKL
NMEKEKTDKLLEERDALLREKEAELQLKAKAQEKLQLELKKLQKLKGFNPVMSHPL
GQSLRMSELAKEEEKKKKKDPNR<u>PKKPSPAYILWCQEQWNQVKSENPNVVFKDM</u>
<u>GAILGAKWKALSAEEKKPYEEKYEAEKEAYLQVVGQEKRETEALKLLHDEQKQKT</u>
ALELLEQYLQYQKDAEGNEKSKRKEKDPSK<u>PKHPVTAFFAFTNERRAALLAENHNV</u>
<u>LQIAKILGEEWKNMTKEERAPYEQIAAEAKEKYMGEMELYKQQKAEEAASASKEEE</u>
ELRKLEREQGLQLLRKKEKTETLKKTMKIKLNQKKQLKEKNSDPNR<u>PKKPPTSFLLF</u>
<u>SKETRKKLVQERPGINNTTINALISLKWKELDTAEKQKWADEAAVAMMQYKKEVE</u>
<u>EYNKSHLKEQQQQTQQHISFDRDEMKVDGTLPAPITN</u>

Figure 992: Amino Acid sequence of SEQ ID NO: 2240. The conserved homeobox family domain is underlined with the conserved homeobox domain signature in bold/underline, and the homeobox-associated leucine zipper (HALZ) is in bold.

MEEAKNKQRGLERLKTLASDDMTGLALGVGLSMAMPEIARHGDDQKSAPLQLEPL
TFRPIATAARAETAPAPSAPFLWFMSKNCREEVTVAESNLSGIVRGGGIDMNRVPAT
NESEYSSVFQADALRTIDTGSVVVKRERERTFELEAERDRTCDVSSRTSDEEEIGSTR
<u>KKLRLSKEQSALLEESFLEHSTLNPKQKNALAKELNLQPRQVEVWFQNRRARTKL</u>
KQTEVDCEVLKRCCENLTEENRRLQKELQELRALKAVPPQCVIGQDNYYMPLP
ATTLTMCPSCERVATMENSRNLSFSKSRISQFAQKSAAC

Figure 993: Amino Acid sequence of SEQ ID NO: 2241. The conserved homeobox family domain is underlined.

MSEVFDLGSMEDKGFV<u>EQKRRLKTPSQVEALENIYAEHKYPTESMKAKLSRELGLSE
KQVQRWFRHRRLKDKK</u>GKKEEPDSNEELDAGSGSNLQQQQHLVRTEMGRSEKKRL
LGISDYPSAVLAAELNDHDMLKRNQRVMEEDPHHAGTVSTSQDTSSLQSKSSYEMD
ALRNGNYVEMKGSNSKKSKGQVMHMGMEHTYPPQHFAVATEDQYIAKGLKQAGG
SNSKQAKNWNRFKAKDSENHRFVNNHDYPSAVLAAELTDRELLKGNHDIVEDPYVS
LSQERSSLQSGSSYEMEARRLPSKSLNSFEIEARSKRREKEGLHMVVEPIYWQQAVEH
QAISAVKAQLGRLFREDGPILGVEFDPLPPDAFGYR

Figure 994: Amino Acid sequence of SEQ ID NO: 2242. The conserved POX family domain is underlined.

MQLRNTPTMTSEMHSFIPSGIELLAFSSKNPFLDNSEAEASSRSSVMGTSYQGLGNPG
ANLGNWKSFNVPQNRSNTGWTAPSIVVPNNIQQHHGGLSSYSGQILPNPIVVARGGS
MQASSSGDIRKSDMDVASQNPHHQSDGTHLFLMNPKYPNEYPEGTSTAAANMTENR
PTSGLAPPGFEAQKNILEFAHFPTQIPTIISEASPSLREPSHGAGSDLPGSENMQHSQLM
LAQFNNTVNWANRYIGSQSWNREPFIDQNKVDESFRSHEYGSKGQDGSGQRLSLSLS
SHQPSEIHLPDMGNQTNVLQFGGDAKSKLGDFFNSAHGTDGLAYNISSYPRNGIPGK
GTMDSIQGGGRSAVLQYLKDGSTGAL<u>SSYGISLKNSRYLKAAQQILYEFCNVGRGVE
TRTSPKQKSAMGVNAIPGSSGTRSHEFGAKTETGMMNQPLYSGDRFELQRRKAKLV
SMLDEVDRRYRNYCDQMHLVVSSFESVSTVGAAAPYTALALKAMSRHFRCLKDAIT
GQLQVTIKALGEKGSVVPGTSRGETPRLGFLERSIRQQRAFHHLGLMEQHPWRPQRG</u>
LPERSVSVLRAWLFEHFLHPYPTDADKHILAKQTGLTRSQVSNWFINARVRLWKPM
VEEMYMEELKEEKVDQVTHNSEAERSAGTNNDEKTMFTSGEPGNKCTANSEEAAF
KLDHSSSTTSQTAQAEISSGNVTLHLQSKDPEMAVARETNSEPLNSSMNTSHVGDIK
VDEAPGYNIFDQDKGFRNELYAGKYQTADHSGMAVDFSSYNNSTASTSVAAYSHG
DLNPRHFPSSGVSLTLGLRHSGGLSYNPLSEQKYDNNIYFSRVHDDADPNNQYSMLD
NEVSPGNGFMQEQDLQYRNYIVNGSRLLHDFVG

Figure 995: Amino Acid sequence of SEQ ID NO: 2244. The conserved PHD finger zinc finger domain is underlined.

MGRNRAQKATNGHKMNTEKVENSNQQSNLVNGDASLTSQTMRQSNNKISGSSSHH
VAPAKMNSRKSEIQESVSNAKENEPTVNPVTGDNHVESDKPELDQKTGRCATKAGK
STSMVGKKYILRSLSSSVRVLRSRENKSPKDLPKIEGHSTEISAEQSQRRRKKHKKKT
HVVQDELSRTRKHIKYLLLRIGFQQNMIDAYSNEGWKGQSQEKIRPEKELQKAASKI
LQCKLAIREAFHRLDSLCLEGSLPESDFDSEGQINSEDI<u>FCAKCGSKELVLDNDIVLCD
GACDRGFHQKCLEPPLETANIPPEGEGWLCPECDCK</u>VDCFDLVNDHFGTNFEIGDSW
EKVFAEAVVSADGDENPFDLEGMPSDDSEDDDYDPESPEKPDSNQQEKGSSSEEDDS
TSDAENSNKSSSDDEGSESDDSSDVSSEDSQEHFPEYLADSGKRKSKMTRGKKCLES
SELPVISDLDESGNITSSVSGRRHRQDIDYKKLHDEMFGLTASDQDSMSEDDEEWGP
RKRPRKGKQFDVEQNVSTVSKLTQLNKESVMKKKGKGPNVDSSEDFKQSKFNLCRE
YDAETENEEHKISKKAEHGEGGPVEDVAASGFKASLKENQQEQLGSAPVSAKQKVF
SRLPTPAIEKFRVVFGENNFPPRSLKEGLAKEFDISFKQVDKWFDNARHFSRHQDRSK
QVDNSDGSNESSIIKDDNITSERVKVPGSAGKGIKDTNIVLSAERGKRKGGKKHGIKD
LKGPTSTGDKAKRQRRRN

Figure 996: Amino Acid sequence of SEQ ID NO: 2246. The conserved homeobox family domains are underlined and the PHD zinc finger-like domain is in bold.

MPKAGKGSSGSLRKKQALSNTASELRPKAAIQKTNNAGSISGRMRERKPRLHVQMIA
SILTKKRTGEASESRNDSELEDKQYLSNSSKTNANFVAGKLVKKTLKKAPRLNLIKN
DSQKKPSKSSASRSYAAQKPERPQQRKIRRTKWKGDSKNITKVKTVRTSNIDGLKRK
QQRRKKKKAQNVPQDEVSRAKRRIKYLLLKMKLEQNLIDAYSGEGWKGQSREKI
KPEKELQRAEKQILQCKLGIREAVHQLDLLSSEGSIADAVIDPEGRVFHEHI**FCAKCK
MTDALPDNDIILCDGACNRGFHQKCLDPPLATENIPPGDQGWLCKVCECKLESL**
EAINAHLGTQFTVDNSWEGIFADAARIANGESTATGNGEEWPSDDSEDDDYDPEKQE
IRDETGYENNMSDSGKSSGWSESYNETDNESDASLTDNLNEYISKGKKRSRDTDEKN
GQEAIIDLDTDENDGSDMPVSGRRQRRDVDYKKLHDEMFGKDGPCEDEVSEDEDW
GPNRRRRRAKQPDTNTTKDSSNEEKEHVRKEADEKVAEHSQSSIKDKK<u>HIVRLPANA
VEKLRKVFAENELPSRSYKENLSQQLGLTFRKVHMWFKNARYMSLKSRK</u>EMPRNE
NCNETNLMGEGDMGPKKKIPKEKKAESTCLLSSVRAEYKSRNTKRKHRRKNIKAPL
SISSRSER<u>KRTMCRLPANAVERFRQVFAENELPSMSCKMALSKQLDLPYRQVHMWF
KNARYMSLKKKK</u>MNRLKESAPVISSHTRRLEVESSKPNPQIKEPDDAGNSYLTEMEK
LGNIELKLENMRKILETVCPKRGTDFSNDKNQEGIANLLSEELLVYVPVVELREKSLQ
VAPVR

Figure 997: Amino Acid sequence of SEQ ID NO: 2247. The conserved homeobox domain is underlined and the homeobox domain signature is in bold. The conserved POX domain is in italics.

MSQQSPASMDQLPLQTHVAQQIRRDKLRIQGFQHPSSPKSHISSGHSKQAIPAYEECS
AGYLQGYPGHIDQDNIKNVFPGHNIHMISSNNYNLPAASDSRVLPPQNTGHFHTQSP
QRNPLVGTIHSGQSLTPNFDGQVNASKSGSWGSGGPQFGMMNNNAFLNLPSLTVNS
NAMTADLFAASSIQTSSFGSNGREGSMATYFPGSSIQADTMQTLYLRNRGIVGYTDS
LASGNMVLVNNTTGSSLATHNFSGNGQQQQHFVGITVPTASPSQHSSVGAIENSSTE
QQSANSSLLTSRLEAHAYDSWQAGGNELTFLQTTDAASSNQSLCGQLNNSVSLGSLP
VAERSQVRMRPPSMSSIEEEQSGILPSGLRLQLDPPTTATGQRQGLSLCLFPKHASTV
QLPPFQNHSTELDINCPGIAQTASEDNSFRIDRDARDGMMGGGFSNSLQSPGVSKQIH
SSYRGV*TGFPNVLRGSKFLKAAQELLDEVVNLSKFGKSEPAKHHKSQTLFGTAADKWNT
AKETSIKNGITDTSAGFLNSAEETNISHNTEISMAERRELQIKKAKLVAMLDEVDQKYKQYY
QQMQIVVSSFETVTGFGTAKTYTSLALGTISRHFRCLRDAIVG*QICASSKSLGEEDMAGN
GKGETSRLRFVDQQLRQQRAFQQLGMIQQPA<u>WRPQRGLPERAVSVLRAWLFEHFLH
PYPKDADKHMLARQAGLTRSQVSNWFINARVRLWKPMVEEIYMEEIKEAELGHSS</u>
AEKDYKKSGDSKADTKSEEGSENSQNSEDQKHTKTTQLETDAEDVVCEQQNISVSS
GLKSEHSPDMRYGRSQAFSIEGVSNDDVSHDVRDEGVTPGKFKKARSGIEGSTYQFS
PNMSSIVGFKMEGSCQNDKFNDERHSSENYILVHSGMALADSGGSGCLNRYDGQEA
FTPKFSGSGGVSLTLGLQHSDGLSLSGTQQRCNSSEGRNHGLGNVSHDYCNISGTAA
AHAANAYESINLEKRKRFATHLLQTL

Figure 998: Amino Acid sequence of SEQ ID NO: 2248. The conserved heat shock factor (HSF)-type DNA-binding family domain is underlined and the HSF-type DNA-binding domain signature is in bold.

MANTAEQKNKETTVLAVEGHRS<u>IPAPFLIKTYQLVDDSSTDDIISWNKEGNTFIVWRP
AEFARDLLPNYFKHNNFSSFVRQLNTYGFRKIVPDRWEFANDCFRKGEKQLLCEIH
RRKSVQQSSAAPASRCVSPVNSVEEQALSSTSSPVSSHAEAALVNCGQNSTSGLHGE
NEKLRKDNLLLMSELAQMKKQCNDLLLFLSKCVNITPDNLSNILIAAS</u>QTNCRDENL
KALPLDASTLAKLANKSVFSENHEKKRPPNLLTELCRSNVKDSDTAVKSTGGREANS
DGHENDNKTATPMLFGVPLISGKKRPIPEAPASSSCVSKGPPLKGIKTDMPHEETPWL
KVCSSRGGKVYN

Figure 999: Amino Acid sequence of SEQ ID NO: 2249. The conserved heat shock factor (HSF)-type DNA-binding family domain is underlined.

MVSDGAVRDAGRLV<u>PAPFLVKMYRLVDDPSTNHIVSWGENNNSFVVWRPKEFSAS
VLPCYFNHANFSSFVRQLNNYGFRKTFRGQCEFSNKLFEKGKQYLLCHIHRRRASNS
SPMPMEYGKSSLLFPIILPTQHSNVLAAPLPSSLSGLAEKETFRKNDSSLLSEIPRLHNI
CSRDIKFLGRNPSLIDTDRSKIDNVSPGSSMAD</u>VTEEMRMIPQKLFGVLLC

Figure 1000: Amino Acid sequence of SEQ ID NO: 2250. The conserved jumonji C (jmjC) family domain is underlined.

MTIKVSGKIRRVDGREISYPEFRDKYMKANEPVLLTGLMDDWRACRDWVSPDGQPN
LSFFSLNFAKSRVQVADCDRKEFTDQKRLGMTVAEYIEYWHNLNSRFYDTDCDGNR
NYSSVLYLKDWHFVKEYPDYNAYTTPTFFLDDWLNLYLDSYRIHGIEGVDEDCECD
VSCSDYR<u>FVYMGPKGTWTPLHADVFRSYSWSANVCGKKVWHFLSPSQSHLLYDRY
MKQTVYDIYGDVSATQFPGFSETYWLECIQERNEIIFVPSGWFHQVKNVEDTISINHN
WFNACNISWVWNLLVKDYNETQEYIEDIRSIADDFESLCQRNLAANTGMNFDDFFVF
ISRMALANFTQLIDIMHSWERRYSRNGMEASQIEKFQQILFNLVSIRNVGQNMASIHY
FDGYSKEYKFYIKDVARLFVEMGMSKDINNHDLDDALEKKCHVSQITNLKIPNFDIV
DEADIKTSVSVLEGSEKPICDKNSSKVQIRFCNNLSSSMPQNERTEAVCGNLLVDGFL
TKDCQVTVTNPKHLFQIIDDVIASVKEKALCLGYDLIQT</u>

Figure 1001: Amino Acid sequence of SEQ ID NO: 2252. The conserved LIM zinc-binding protein domains are underlined and the LIM domain signature is in bold.

MAFAGTQQK<u>CKACEKTVYVVDQLTADGSVFHKACFRCHHCNGTLKLSNYSSFE
GVLYCKPHFDQLFKRTGSLDKSFEGTPKAVKNEKLNDGEIKTPNRVSALFSGTQEKC
LACGNTVYPIEKVSVEGVGYHKACFKCMHGGCVISPSNYIAIEGRLYCKHHHAQLFK</u>
EKGNYSQLIKTPSVKEVSENSVHE

Figure 1002: Amino Acid sequence of SEQ ID NO: 2255. The conserved MADS box SEQ ID NO: 3668) domain is underlined.

MEI<u>KRIQNPSRRQVTFSKRKNGLLKKAFELSVLCDAEVALIIFSETGKICEFASHDDM</u>
ATILEKYRIYTETDGNMESSSVQSVKYYSRTGLRTCLVIQSQDPTAEYLLGQKIGTTP
TPIGNGNLQAVRLESTKMLLEPLHRLKKADARLNLSQGVLDEVVGEELGVLPGMDS
VFAVGALERLIQFIGGTTSYTKELDRKFDMIIYDGISCEETLRMVGAAERSRWYMRY
LRKLAEKTDTGRVTAPSLLKLVEASLKPDSTVDSGWRTAAEIWDIADNMLEKGSRA
FADPLKFSCYLVMDPSNCMSVNAALRYWGCAIQAGAHVSGAFYPASPSYSSINMSID
DTFFPLVTASVPFLSMDSTINWDIALKDMNADAKKLLTMNNGSGRNISSVTFDQTKK
TVTLFLPGFDKSEIKLSQWRGGSELLVESGDQRRVITLPSKMLGKVAGAKFENRNLV
VTLK

Figure 1003: Amino Acid sequence of SEQ ID NO: 2256. The conserved MADS box SEQ ID NO: 3668) domain is underlined and the conserved MADS box signature 1 is in bold.

MVRGKTQM<u>RRIENATSRQVTFSKRRNGLLKKAYELSVLCDAEVALIVFSPRGK
VHEFA</u>SPSMQMVLDKYQKYSQESGISNRTKEKNTQERMLTEQNVFLRKMCAGSQD
DSDLTTPAIHLESIRMEHSEVETQLVMRPPHVQKNHLSTYSVH

Figure 1004: Amino Acid sequence of SEQ ID NO: 2257. The conserved Myb DNA-binding domains are underlined and the Myb DNA-binding domain repeat signature 2 is in bold.

MGRTPRCDQMGLKKGPWTPEEDQILISYINKHGHGNWRALPKQAGLMRCGKSCRL
RWTNYLRPDIKRGNFSLKEEQTIIHLHQILGNRWSAIASHLPGRTDNEIKNVWNTHL
KKRLLQIGVDPVTHAPRGYNVSNCYTAVNIRDHHGEQADHQLQSHVCVSEPVKKTF
QKEGNSIESLARQPLQEAKAPQDHGASSNSPVIHKTPDDQNMMSSDQHEAYYSLNSS
GNNYTYSSDSSRVLSTKPMELVSESPFGACSATNKEQNNSGKVAAVMPYDYSKTSE
KKMLAVDYTSLLQSSYTDSLKFILDDDGEDSNSSEYHVNWKPLAGNQQNFVSLGSG
EFREDDKPVVQQADPEVSVGYDSSMLNSNVEFWRHELSLWPTTESNTMGEPAVAYS
SSNGAAPPVIGQQKKVKVEPSGTNFSVEQFLELADHTMGTNMECKSNIYDRWPDMN
LADQDQGMEYWVNLLRQVGPLPFLETIAPPDL

Figure 1005: Amino Acid sequence of SEQ ID NO: 2258. The conserved Myb DNA-binding domains are underlined and the Myb DNA-binding domain repeat signature 2 is in bold.

MGRSPCPPKEALNRGAWTGMEDTILTEYIRVHGSGGWKDISKRAGLKRCAKSCRLR
WLNYLRPDIKRGNISPEEEELIIRLHRLLGNRWSLIAGRLPGRTDNEIKNYWNTHMS
KKPWLSMDESQSNTSQNLKTRSKSPVPVQNHVFKTTALKINPAARFSGTVSADGYSG
DGCSNHISNEAFNFCNVKETRKFSWRELLMNDSIRDEESGNTAFATTNNPVEAEATN
SLSFMSDLADQESPNRDHFQGDAITLSNSLLYLNEKSFPNCNLLPSPSDCSTDFASEEF
YRGMEEFYDNVQDEDWIREFDY

Figure 1006: Amino Acid sequence of 044463/0191 SEQ ID NO: /2259. The conserved Myb DNA-binding domains are underlined and the Myb DNA-binding domain repeat signature 2 is in bold.

MGRSPCCSKEGLNRGAWTKREDMILSEYIRIHGDGGWRNMPKRAGLKRCGKSCRLR
WLNYLRPDIKRGNISPDEEELIIRLHRLLGNRWSLIAGRLPGRTDNEIKNYWNTHM
SKKLLPLNESQPKTLPVPKRRSQSPSPLQNRVFKANPVKITTVVSPSDIGRPKGYSNRR
SDETTNSSKSRYQLLVNDSDSITGSESKPIPSANADNHVATEAAMSSLADQQSLESNH
FYAAAMADSLLYLNELSSPDSDLLSYPSNCSTDFGLEEFYSVPTTETNGFEDMCSDQR
NMERVDNSTVAEKQVMEEIFHNTERLDWIHEIDYLQKSSSQQLSFLLLEAEDEWEER
ATGKAVPENTEQIP

Figure 1007: Amino Acid sequence of SEQ ID NO: 2260. The conserved Myb DNA-binding domains are underlined.

MAAVVLGSEAASASASASASASASASASASASASAVKEQAIEEVGTLK<u>KGPRTSAED
AILVEYVRKHGEGNWNAVQKHSGLSRCGKSCRLRWANHLRPNLKKGAFTAEEERII
LELHAKLGNKWARMAAHLPGRTDNEIKNYWNTRIKRRQRAGLPLYPPDVQLQNSN</u>
QKAPQTPSEPNNIDLPYESRPSNNPLIFSSKVENGTPSYDGLKHANTNPMPFSGLGNV
SMGPLFYQANPIQRVKRVRDTSFIMGPPSSPFGRMGVNGHMGMNDVSKSLQPGFKA
RVPYPLQAARSDSFVAQGCFPYDPNLSSTSNLPLGGFSSGSHAVMNGTFSSSRLFSGQ
KLELPSSQFAESVQTAGSSINPVLNRSTPLLLPPVPTQTINQVDYSFSTPKNSGLLESMF
QEAQTMGGVKAHSSSNSSIDLQGGSKSSISNPLNNGFPMQIKIKHGDNSDPTTPLDGH
TFSMFSESTPPLGTSPWDDSSSAQSPIGKAMKSEEPNEGYISSGSCGDENVSSMLDLT
ADVLPDTDWNAQISGIEKDQSLLNDALNTMFSDDLGMGVQQMPSETSPSNQTWGLG
SCPWSNMPGVC

Figure 1008: Amino Acid sequence of SEQ ID NO: 2261. The conserved Myb DNA-binding domains are underlined and the SHAQKYF SEQ ID NO: 3671) class Myb-like DNA-binding domain is in bold.

MCPKTVYYAMTRNSPDPPTSSTPA<u>SSRWSREQDMAFEDALAVHDEQCQDRWEKIA
ALVPGKDAAEIKLHYEIL</u>VEDIECIEAGLIPLPSYVSSGEGSADQAVEIQGTKNRSHSA
NFQSGDVNPTRKGGSKADQE**RRKGIAWTEEEHRLFLLGLDKFGKGDWRSISRNC
VISRTPTQVASHAQKYYNRLNSANKDRRRSSIHDITSVNDGDTSTPQGPVTGQENSS**
AGAAGKPPKSLSQPSLPRVVAYGPPVGQPIAGPASSAVGTPIMIPPGHVPYVSSGPFPG
SVVPGTPMNLVPVSYAISQPTIHQ

Figure 1009: Amino Acid sequence of SEQ ID NO: 2262. The conserved Myb DNA-binding domain is underlined.

MDYYDEDPRPRFQLQASSIPAPQQSASIDRKHAAFCIATGILIFSYGCLLPGIWQILLT
WIGLSLAIGPFAPISLTGGDIRVGCGEIIEEPQLETPKLEPERKNYRGKAKRSENSNPEIP
ILNIPRSDEIPEGNKNGEAGAKVSVVSRVSDDGEWTAEDVELLKKQLAKNPPGKPGR
YEAIAEAFRGARSVDSIVKKAKSLGERKLGDDDSFAKFLAQRKISDKIEMNLAEGKD
LADDEEDKGK<u>KFGWSSAEDIALLNALKVFPKDTNMRWEKVAAAVPGKSKTQCMK
RFSELKLNFRNSKASDT</u>

Figure 1010: Amino Acid sequence of 044463/0191 SEQ ID NO: /2263. The conserved SHAQKYF SEQ ID NO: 3671) class Myb-like DNA-binding domain is underlined.

MASFPAVAVPQEERTETVAGRQGIENNGVHYSEQSKSQSIRFPSDEVSSSGDEFTTKV
RKPYTITK<u>QRERWTEEEHHKFLEALKMHGRAWRRIEEHIGTKTAVQIRSHAQKFFSK
L+EREA</u>SAGGVPMGKAQDISIPPPRPKRKPSHPYPRKAGTASQIGPSTNEEENRSLSAV
SSAPDRLCAGSNLGGETQKNAAFAPYNARLRPLQTHDNINLQETNMESSSTSISPSSL
KLFGQTVLVPTNESGLDVNVKGAFQEFKSHKMERQLLDGQIPESSKLEKTKGSLHSV
GVEAKMKVVKSENASGVTSNIPASESGTSMLEGSGESNANLPCREIHTAQQDSDEPL
SELDNNMNSLSREHQASVPVSIYSRHIPVQNVEGEAEECVAINTLNGNGSLSDTTGK
MKAYVQTSQLNVFTPFPGMPGSFNPAYNNLERFGCIPGFVAPGTAPNGSFPPWHLTP
SAALHHPAYAAATLAAAAFWPGLVSGASPVATGDPQPPREGKNGHSFGEDTSAMA
AVTAATVAAASAWWTLHGAIPPPFLHPGIYGPVVAAMAAEAAAVAAAAAASGSSSP
LCKTGPVREARKHEKMITTEEDGEILDAMPASPSANTKGKLSMEQLDDGIPGLSCPK
SGHADGLPEVLPSSSDPNITSCNEESCDVEMQIEKPNFQVEEQDDNAFCINLPEGETTN
SRKVIKERSSSGSNTPSSADPEVDPCLGMNTEVKGNSERDFEFNWVGSGSSDAGGEE
ALASKRTNCILPETLGKTEREKNNLSTKQDGKVDYNGNYVNKDRYQSYGGDAAGH
RSKSGGHLNETWREVSQEGRIAFEALFNQDVLPQSFSHCQNLRDQDKVPKVSRKSFC
NDAKQKPSKTSRDEIQDDAQNMVVNQKQACSGVHAEDCSCAHKIALKPAGSPTQV
KKIQDSEATDNNWSLEKYGESERSLLQNKSVAVDFKPSKSSVISSSGNFRSGRGFVPY
QRCSIEAKKNRLHTRPTQNCQDDEREEKRVRLKQEVEDG

Figure 1011: Amino Acid sequence of SEQ ID NO: 2264. The conserved Myb DNA-binding domains are underlined.

MGRSPGCGSPSKHEEHLK<u>RGGWTAREDKILIEYIKTHGTGQWRGLPRKAGLERSGKS
CRLRWLNYLRPDIKR</u><u>GNISPEEDELLVRLHRLLGNRWTLIAGRLPGRTDNEVKNYW
NTQL</u>SKRVQRGEFEPKFQKPFKERAIPSPSSYGKVVVGTDNYTSQILPLKTRAVRPSA
RAITDGDNLHSYDYDHVPDTNYGINQEGCLKALDDHAMEIDTSKSWCQLLLEDCLG
DSQYNQMEEVNALQPISMTNTSNGTDDQHQHQPHSPSLYQSIILQENDCSSGCD

Figure 1012: Amino Acid sequence of SEQ ID NO: 3663. The conserved Myb DNA-binding domains are underlined and the Myb DNA-binding domain repeat signature 2 is in bold.

MGRSPCCEKAHTNK<u>GAWTKQEDDRLIAHIRAHGEGGWRSLPKAAGLLRCGKSCRL
RWINYLRPDLKR</u><u>GSFTEEEDELIIKLHSFVGNKWSLIAGRLPGRTDNEIKNYWNTHI</u>
KRKLLSKGLDPQTHRPLGQPNNTPVTRPVPEHEIPAFQNPATPEIADLLQHHRLESSPI
KPAASDAEEHPDLNLNLCISLPSNSAPAVNRVSSVDTIVDSNSNSGDGLCWQFL

Figure 1013: Amino Acid sequence of SEQ ID NO: 2266. The conserved Myb DNA-binding domains are underlined and the Myb DNA-binding domain repeat signature 2 is in bold.

MVRSSCYSKQGHRR<u>GIWTPMEDMILSEYIRIHGSDGWKNIAKRAGLKRCGKSCRLR
WLNYLRPDIK</u>R<u>GNISPDEEDLIIRLHGLLGNRWSLIAGRLPGRTDNEIKNYWHTHM</u>
SKKLYPSMNDSQPKSSQKLRRRAKSPVPVPNPVFKATSVRIKPAMRLPGIVRENGYN
DAGSSNLISYEAFRLCNVKEIRKSSWGDLLVNHSIGDEESDLIALGLADNPVETSATN
PLSPMWSLADQQSPHYDHFEEDAATLAESSFYLNEKSSQDCNLLPSLSDCSTGFTSEG
LYREMVELYDNAEHDDWIHEFGYLEK

Figure 1014: Amino Acid sequence of SEQ ID NO: 2267. The conserved Myb DNA-binding domains are underlined and the Myb DNA-binding domain repeat signature 2 is in bold.

MAVGNTKAPGSESSGCGERGQRI<u>KGPWSPEEDAALQKLVEKLGPRNWSLISKGIPGR
SGKSCRLRWCNQLSPQVQHRPFSPEEDRMIMEAHSMHGNK**WATIARLLPGRTDNA
IKNHWNSTL**</u>RRKCLAEKDSSGGGPPSTSAPVPTFTMGGEKRSSADLLSNDDGGSAQ
EDQDQDQDQDQDQEGNMEVESQRFKRRLNYSPESPANSHTNTNTTNSPPVSTAQQQ
IHRPLPLQSAFKSYSNNLDPPTLLSLSLPGSGMKEEDSKTDDRNQNSAPKNQLQQNVE
LNGFAGTQTQTQQLQYTFIPPYFQQPVMTPTSTNGYLKTDDAMVMMSEAVKMAVG
QAVSLVFQASQSQCGSLGAVERSGFSASGGLLDIMREMIAKEVKNYMAMSQPNQCN
QTGGLNCAMDSSLPRKV

Figure 1015: Amino Acid sequence of SEQ ID NO: 2268. The conserved SHAQKYF SEQ ID NO: 3671) class Myb-like DNA-binding domain is underlined.

MVGIMLVGSTMIPAGGAAAVAVTSVEEGGELKKIRKPYTIT<u>KSRESWTEQEHDKFLE
ALQLFDRDWKKIEAFVGSKSVIQIRSHAQKYFLKVQKTGNGEHVPPPRPKRKSARPY</u>
PQKASKLGILASAQNSTSGLPSSTMPGEYGFSLVSQSGDAFTSQDTSSQPVSSWIHHG
VPRGTDTSGLIVADVGNTNVNGRNGNSSDDSSTNEWSLQSTPDQINQEFCLKGTPDF
SEIYKFIGSTFDPGVTGHLKKLKEMAPIDRETIMLLMRNLSINLSSPDFEENKLVSSPC
DMNVGGQRPAVTTIVDGQVV

Figure 1016: Amino Acid sequence of SEQ ID NO: 2269. The conserved Myb DNA-binding domains are underlined and the Myb DNA-binding domain repeat signature 2 is in bold.

MASMKGKSPGHDEPDRI<u>KGPWSPEEDAALQHFVQKYGPRNWSLISKAIPGRSGKSCR
LRWCNQLSPQVEHRPFTPEEDATIVRAHAQHGNK**WATIARMLSGRTDNAIKNHW
NSTL**</u>RRRCQGGGALVIDDEISSGADGFRKRNLSEDADASRKFKKLSLGTTTTTTTEP
STSSASDRSDSSLVFGSPHVYKPVPRPAPLALTSEPNLNLNHHEASCSSTDPPTSLCLS
LPGTDAPARPSVVPIALPLPVTSSPVAPPGYIKAEEAMEWMNSAINTTLTQVLTPFLAP
ARSHGIMPETLGSSGLLAVMQEMVAKEVRDYMSSMQHRNNNNTEFRGCVASPPPPP
MGLRVSNSNALG

Figure 1017: Amino Acid sequence of SEQ ID NO: 2270. The conserved Myb DNA-binding domains are underlined and the Myb DNA-binding domain repeat signature 2 is in bold.

MSFTPGPEKGSPVSSKPEIQKMKK<u>GLWSPEEDKKLVQYMMNNSLIGCSWSYVAKQV
GLQRCGKSCRLRWINYLRPGLKHAAISLQEEQLI</u>IYLHSILGNR<u>WS**QIASHLPGRTDN
EIKNYWNS**YI</u>KKKLNFKQHSLPCSSSSEAASNSRETNIPSQFDHTYNTNSVSANAYD
AYMGPHSAKPSEVLPEGYLRAHDDIFSAMITAENQHSCVQDVVDLKHEQNNEFEIAA
DPTNNQLISCSRLWTDPTSTHTSNSISQAFTFPGLQAQEYSYKSANSSRCDKLVEPWN
TLQSHEMHCSVNNSLGCSITVPSGVEISNSLKEKSESDGHIINENENEIMIHNSSLSASS
VITPWSVGHSYSNAADCSIVCPGDYTSNKAEDYVSQLHESYLPHNSRPQFSAPEILWT
DVDQHFNIQPQDENEGEGHAYLRYGEQNLGVPTHIKIDRLKRYQFPEIGGVQQDCSS
MGNEEGLAALTPTMFRGRKTCRFESEGEA

Figure 1018: Amino Acid sequence of SEQ ID NO: 2271. The conserved Myb DNA-binding domain identified using InterProScan is underlined.

MTGVKVKREGKTNRAQSSHLYLGNDDGLQKLEPVTCSALEETTSDEVKREEKAENK
SQSSSLSVGADHALQKLPPVHGRTGGPTRRS<u>SKGGWTPEEDETLRRAVQCFKGKNW
KKIAEFFTGRTDVQCLHRWQKVLNPELVKGPWTKVEDERIVELVRKYGCKKWSAIA
KHLPGRIGKQCRERWHNHLNPAINKDAWSLEEELSLIRAHQIYGNKWAELAKFLPGR
TDNAIKNHWNSSIKKKLDSYLASGLVKQFPGLTVPKPTIGSASSTGGSFNEVQGGAD
LEEISECSQESTSSHCHLSGSFMGPSSSSVQVGLERSELRKETCKMNSDDELEVHHEPL
WSLNSKTDGFLLLQDGPAGYSNSPIPEAVPPVSSCELNELTESVITGNSCSVGSPKEVS
NAVNVSMSGASGGLESFGFEHGGSTSAAKDMVSSSAFYTCLLLDSTDMVGMSHNLC
APVFVDSLHPISPGSSDMMLNSLVRVGDGICSTEMPSSVLNGGICDGAGCVQVASEF
QHSDEMLQYCKPVIHDLKVDCQDGRSGPDMLNLTFDEKAVNLKVEASNVQAESPIS
ECLFYEPPRLPSLEFPFINCDLINSCSHLQQAYSPLGVRQMIMSSVNCSTPYSIWGSHD
KSPESFLKSAAKSFRNTPSILRKRRRESSTPVQGGQHDKKEASSVDHDSFLSHGSLDE
KENSLKDTSSADFQNSFAEDGVSLPSSKKRIIVSPPYCLKAKSTVPGKSKEKQLLHAF
EGTNYTEVKNGCSVDIGVVGNHQSDIGRSGKDEIHKASIQSSFENVQTGGILLEQNM
NSPLFCTNGNNSYQICGMSYSPLTPKTLFGRRSETPAKRTDHKGTMKSTTVIVQSTYI
DSPNLCEKKRESKSIFLVSSCQTPAMSASKTIDRAIGEDWLNNVPDLDNLSINCCPFSV
DKSLGSPFEWKSPWSLDWTSPLEKHGRDLLLEDMSILTNSADGRDDAVGLMKHLSE
HAASAYAQAEEILSNDEKKLSQTVSSVQA

Figure 1019: Amino Acid sequence of SEQ ID NO: 2272. The conserved Myb DNA-binding domains are underlined and the Myb DNA-binding domain repeat signature 2 is in bold.

MSRAHCCEEMGLKKGPWTPEEDRILISYIKRNGHGKWLALPKQAGLSRCGKSCRLR
WTNYLRPNIKRGNFSLKEEQTIIQLHQILGNRWSTIASHLPGRTDNEIKNVWNTRLK
KRLLQTGVDLANHVPRKCNISCFDGAVSVCDSHEKDTDHQFKSHGCTSESAKKVFK
KEGNNSEPLARQPLQETKALQDQGVIQKTPDDQNMIDSHQHEAPYYNLNSSGNNYS
YSSRSSRVLPMKPMKIVSASPFGLCSAMDYKGKTTSEKLPAPVMPFDNIKTSEKKML
ATVDYTSLLQSSNSDFLKLTLDNGDVNSWNPLAGNQQNFVSLGFEEFQENDRTVVQ
QAYQEGNLAYNSSTLSLWPAAENNLLGEQAVAYSFSNAAAANVSGQQKTVKVEPS
GTNFSVEPFLELADHDSMGMDMESKSNIFDRWPEMNLVDQDDGMDYWVNFMRQV
GPLPFVQIISPPDL

Figure 1020: Amino Acid sequence of SEQ ID NO: 2273. The conserved Myb DNA-binding domains are underlined and the Myb DNA-binding domain repeat signature 2 is in bold.

MGHHSCCNQQKVKRGLWSPEEDEKLINFINNNGYGCWSEVPEKAGLQRCGKSCRLR
WINYLRPNIRRGKFTPEEEKLIISLHSVVGNRWAHIASHLPGRTDNEIKNYWNSWIK
KKLARSRLDSKLHAEQSTSKRPELSQILSKQLNIIEEERILYTHYSNDQSPQPQLFVAG
NSLTVSNQKQEDSKMSQALGHTDISNDHAASSAGMMEKALYSIYQKNGKSNLESFV
HEHKVQGSDSDSELAALAYDSVYIAPCSQPPMEYNSDNLGIAGNRINQYADQQRGL
QGPKNGILTGYNAGELSHIASTSLASEMPATSFPFQNICKSDDMPLLPAIFSDYCSLSIQ
AGSDQHAQTCNYLPQLLEHGEDWGANYSMKYSSNGVSGSVDEIQIPILSNHKNQFPE
LNMDEQEPYLNSSLQWYEVPHSFFHPEHLNNHDGMESMEPISPPHGYVDRQLL

Figure 1021: Amino Acid sequence of SEQ ID NO: 2274. The conserved No apical meristem (NAM) family domain is underlined.

MGTLALPPGFRFHPTDEELISCYLKGKLSHGLKEAEIEVISEVDLYRNEPWDLPEKSLL
PSSDMEWYFFSPRDRKYPNGSRTNRATEAGYWKATGRDRKVYSRAKTVGIKKTLVF
YRGRAPQGERTDWIMHEYRLEENECEAVPCLQNAFVLCRVFKKSGPGTKSGKQYTA
PLGKGDLSPTMKIPSPGYTGDVEVQSEDPSKPVEGIDANLHLPSKISSKIPDDTTEDSA
PLNKWLDILLDDSIPNPSCVAADEDTIHTQVDAMPNTPRIQCESACLPSVENELQDIPV
NISFPQYGVPNGHLDAYFEEERMLEEMLSVASQDYTNSKAYHTSLGDTCDDIFILNG
GYIKIKNLIPSIGELENHDSCLWEVPYSFFDREETGIQLRSCSPVLQSQKQGFSFEGTAA
RGVCMQLHKMEDSSEINEKDATVRDSQNMRNDWYGSGPEMEELHFDRFAGKKWD
SENIRENEDSVPEALPTYMAGQIDGMYTLKIFLTLKKTD

Figure 1022: Amino Acid sequence of SEQ ID NO: 2275. The conserved No apical meristem (NAM) family domain is underlined.

MGTLALPPGFRFHPTDDELISHYLKGKLNNGLKEAELEVIPEVDLYKCEPWDLPEKSS
LPNTDMEWYFFSPRDRKYPNGSRTNRATEAGYWKATGRDRKIYSRASAIGIKKTLVF
YRGRAPQGERTDWVMHEYRLEENDCEAGPCLQNSFVLCHVFKKSELGAKNGDQYT
APVEKDDLSLTKNVRDPLPYHFGDIEVHSEDRSKPVESVDAISSLTPKFSLKILNDTTG
DNATLNTWLDIFLDDSNSNSSCVAPNKDTINTQFDAVLDNPRMQCETACLDESEFPQI
PVDLSFFRYEVQNGYLDTFFEEERMLEEMSFAASQVYNNSKAYHSSLGDVFADILNG
GCIKLKSLMPSIEEMEHHDSGLWEVPNSSLDHVGTGIQISSHSSMLQGHQRGFLFDGT
AARVCLQLHKMEDSEERYEKDLSVRKLQNTSNDMYDGNNCSTCGPETQQLHFDQS
DGQKCDSHVRKINEKNNRENEDSAPEDLSTDMACEIDGTSSQFYCKFDSNQFYSKFD
TSCDVI

Figure 1023: Amino Acid sequence of SEQ ID NO: 2276. The conserved No apical meristem (NAM) family domain is underlined.

MAPISLPPGFGFHPTDEELVAYYLKKKVHGHKIERDIIPEVDLYKCEPWDLPDKICLQ
SKNLQWHFFSPRDRKYPNGSRTNRATEAGYWKATGKDRKVTSQRSTIGTKKTLVFY
MGRAPFGERTDWVMHEYHLDEKECQAAGLQDSFVLCRVVKKNGLGTKSDDQSVA
PTEKNDSDGANNNTLPGILAETFCTGHQSPVLQEGENKSNLKLPSETSSENLNDMNE
ESVERWLDILLDDPDQNCSITSPAELTNNAKVDTAQEIQEVISSPLNWVQDFNWIPAG
VDFNTPGDLEHLQFPNTLETFEEAEIIEEIFHTAQASQEDNIEANSLLLSDYLDEIWGG
EEYRDEYHDTSMVQTGNHTNPEVTGIQLRQRSQICQQELPYQGTAMKRVRMQKYP
VQHSAIEHQQDGCTAYSENDCIYDLQEQHILLDSFNRQNHNSKLWQNMTPLQDPVP
LASARQIDAIREGHSPYHLRGPLANESLVLDIWAFPE

Figure 1024: Amino Acid sequence of SEQ ID NO: 2277. The conserved No apical meristem (NAM) family domain is underlined.

MGRQDAEAQLNLPPGFRFFPTDDELVVHYLCRKAASLPIAVPIIAEVDLYKFDPWQL
PEKALFGEKEWYFFTPRDRKYPNGSRPNRAAGSGYWKATGADKPITAKGSNRRVGI
KKALVFYVGKAPKGNKTNWIMHEYRLADVNRSAKKKGSLRLDDWVLCRIYNKKSS
AEKLAKEQEWSSEEAMEQFHEEIDQKVPGILPTGDTTMNSNIEHSQRTSQDSTKSAPS
PNCRTISKHDSRTSAITSMSYNSNSIFEQNLNISNASSAPMELPELVPFFNPMTNHRTN
YDSADLIPPILLTDSSCSMQSSHDLKSDKEEVQSSCRLEELKQQQRQQQQENAGLNQS
VFTFGFESLQNPFPQLDQIQPSSSNDPFQDYLASLTAPGYLPRSSF

Figure 1025: Amino Acid sequence of SEQ ID NO: 2278. The conserved No apical meristem (NAM) domain is underlined.

MISPELSMNFPISSCSLKRKECKADESSFKHNQDV<u>VMPGFRFHPTEEELLEFYLRRKV
EGKHFNIEVITTVDLYRYDPWELPALASNGEKELFFYVHRDRKYRNGDRPNRVTKSG
YWKATGADRMVHSEVSGCIGLKKTLVFYTGKAPKGKRTSWIMTEYRLPQLETRRIQ</u>
KNELSLCRVRKRSGKSEEGGFGAKEHGKGTETDRTTLNKDNVGPCLHIEMQESGSM
CQWQTCMACNNIRTTVESCNLEIKAGSTDEIVKLEEMPTDIKVMPKSVTGEERYPAQ
MEYRVTDQSEHSQECIYSRRGNICSRVRQPISVNDELELSLTTSLICPREQDLPGMTKD
LYNNNNPSSLVLTNALTDGACLQTFTDKLWEWNPVRSNGSGASC

Figure 1026: Amino Acid sequence of SEQ ID NO: 2279. The conserved No apical meristem (NAM) family domain is underlined.

MGRRDAEADLQ<u>LPPGFRFFPTEEELIVHYLCRKAALLPLPVPIIADVELYKYDPWHLP
EKALFGEKEWYFFTPRDRKYPNGSRPNRAAGSGYWKATGADKPITSTASRGGRKRV
GVKKALVFYVGKAPSGSKTNWLMHEYRLAEINRPARKKDNLRLDDWVLCRIYNRK</u>
ISAEKLALEPKESFNDVPMETIDEKEMKDEPTSTSFNHSAIEQSNPSFDHLRKLGTSPT
CYNAVPPGASPMNSNSCFQNMDFLQNSTTPFSGSTLKAPVQNTAFNPISSSQTNCNST
DLISGLYDDFSCSKPSSFSKPIWDKEEVESSFRLENFSQQQQQPLVNFDLEGLQNPFPH
LGQLDFSDAYQDWFLCS

Figure 1027: Amino Acid sequence of SEQ ID NO: 3664. The conserved plant regulator RWP-RK SEQ ID NO: 3669) domain is underlined and the octicosapeptide/Phox/Bem1p is in bold.

MEQQRQQQQQQSRWPYVEAQVPAPPNLMASADIARLLPEDALLSELMEMDGLMDT
ISEPWPAMASESGFSNFNFSSFIASPDSSSSFYAVCSPSAPFNAQPSGLVRADSGAMYS
LPCNSSGFSPSMVNSSTTSLPQLILQEDVLMASASQDIPDKQIDDVRRSLSPSTSWEQR
ICKDLSSKHQEATFEQSVLDFVASDSSASEQQKQQDIMKGNFRHQLTNRPSGTVNGP
RNDMNFWHLSPSLAERMHAALSFLKENYGVSVLAQVWMPVRQGERFYLTTREQPC
ILGGGLSGYRQVSTAYTFAAEEAPDDFPGLPGRVFMREMPEWTPNVQFYNKNEYLR
VNDARDYNVRGSIAVPVFERDSRKCVAVVELVTTTEKFNFNKDIDNLCHALQKVNL
RSKEIWHHPKSEHQRYSNSKCRETALAEILEVLTAVCQTHKLPLAQTWVPFRHYEIPI
GEVTNTGSYGRMFLALEDQACYVGDHGMQGFRDICAEHRLEKGQGVPGKAFESNQ
PYFANDVKNYNVMDYPLVHHARMFCISAAVAVRLRSTHTGSDDYVLEFFLPKDCN
DSSEQQVLLNSLSITMQRVCRSLRTVSDSELKGDGNRGRDYAQNDCTNFPSVGMLQ
RSHVPAQREPNITSFPDNQFCQEKYLQEGAVGHNSHQRQEYTSKKKLERRRGT<u>TEKN
ISLHILQQYFTGSLKDAAKSIGVCPTTLKRICRQHGIARWPSRKINKVNRSLEKLRGVI</u>
DSVQGADGTLKLNAITSDIMNAASMVQGLQMHSNILPSQGSWALWPSPEDFITRKV
VPVGTAVPLEETTTHQKENLNNTTQTVISTGLESPLSLKAASEVHSGCDIHMQRPSAD
GSISSSKNDLLARHFRESAQQGSLAYMKGQLEITEKDKNVQGFVGHEIMRNSFSSVA
PFGERHQPVTYISDTSDELNSILIAKTRGFAEGIVENCQQVGHQFQGGKHDSKSLKNV
ENGENLSLQDVDYQVTSKHSDFFVLTNSKEPKSADVEVLRQEQNLPGFSAMTNSSA
GSGSSSSSLQGCDSSSPTVSGVDGLQRERHNKDESL**VITVKAKYKEDMVRFKLPLS
SGFSELCEEVAKRFKLVVGTFQLKYQDDDDEWVLLACNADFQECIDVMNFSGG
HAIRLSVRDL**VTVIGSSSGSCGDMLQC

Figure 1028: Amino Acid sequence of SEQ ID NO: 2281. The conserved sugar transporter family domain is underlined, the sugar transport proteins signatures 1 are in bold and the sugar transport proteins signature 2 is in bold/italics.

MKYGENLENDMDGSKQPFLQKSMPEKSRSTHGVFAMFRGSTAIAILCTLIVAMGPLQ
FGFTIGYSSPVQDDITSDLSLTVTQYSLFGSLSNVGAMIGAIA**SGKIADGIGRKGALIV
AAIPSIVGWLAIAVTKNALLLYAGRL***TGFGMGAISFTVPVYIAEIAPKHLR*GALGTL
NQLSITIGIMLAYLFGLFVSWRLLAVIALVPSVLLLIGLFIIPESPRWLAKIGREPAFEAS
LRALRGPDADISVEEYEIRTAVEANQQQNRFRISDLIERRYALPLTIGIGLLLLQQLSGI
NAIMFYGTYIFKSAGVSSSKVANLGLGAIQVVMTAFTAWLMDKAGRRLLLMISAGG
MSICLFLVGLAFLLETHVTGDSDETAYSILALTGVLVYIVSFSLGIGAIPWIIMSEILPV
NVKDVGGSIATLINWLSSFAVTMTVNLLLEWSTSGTFWMYALVAAFTVLFVALWVP
ETKGRTLEEIQSSFQ

Figure 1029: Amino Acid sequence of SEQ ID NO: 2282. The conserved Pathogenesis-related transcriptional factor and ERF family domain is underlined and the transcriptional factor B3 family domain is in bold.

MTTRTGSLMDLDGCCKGQGKRSAALRESEIDSPNVALSLACSPSQKIVSSAATAIHVL
GSQDQFARDESVELRTNEEMKNGCYTEDNQEDEMSSAMTEEFNCSVMGVSENGTQ
PKQETVAFKDLCSARSVEKNLHGLERMGSGISVLSVSGGESEGFEDPRRYSMSTEQA
GKLLSSQYKGVVPQPNGRWGAQIYEKHQRVWLGTFNREEDAARAYDRAALKFRGR
DAMTNFSPVGDGDPEVRFMSGHTKREIVDMLRKHTYDEELDHHGKRIKILAAQSAA
VNNAEASGGVAAHVCQENQGQLEGNGNVASSSSADAGRAGLPHEHLFDKAVTPSD
**VGKLNRLVIPKQYAEKYFPLDVNSSEKGLLLNFEDNTGKVWRFRYSYWNSSQS
YVLTKGWSRFVKDKKLEAGDIVSFHRGSVQSDHLYISWRRRPPGQPRLGVGSQS**
LQSKGPGVVYPLKEPPSMNPFNTVPHAAVVYDAQWMPIFWPSSSHPDAFAQFNSHF
VSPVVNKVDSLWSQSAATPLNSTLPFYFSASPTNQTIQSKFYDINSASCQPTELYLNY
RNSLNRGDEISTNLKPLHPFLNPARASEESETPEHKPSSTLDPATKKGVRLFGVTLPEA
QRLSSQHH

Figure 1030: Amino Acid sequence of SEQ ID NO: 3665. The conserved SBP plant protein family domain is underlined.

MDGKAGPQVATPFFQHQLLSGPLYEPSLGAKRCVEPADSSWTRTNWQHQQQQKSPP
VYEAPKPNWNVNVWDWDSVRFIAKPADLANHREPNPSNIKPQASPEILRLGSNDIGS
NVVNGPSFPDQKRKLDEPPKPFLPGKDSSENDPGNLTLKLGGSSYSYADDTNPSRQN
KRVRSGSPGSAYPMCQVDDCRTDLTSAKDYHRRHKVCETHSKASKALVGSLMQRF
CQQCSRFHPLQEFDEGKRSCRRRLAGHNRRRRKTQPEDALPRGLLAASQENGGLGN
LDIVSLVSILSRLQGNNSSMEKSNGQSSLDGDQVVQLLNRMNSSFPSSQKVAPPSEGF
DLNIAQNLQSPRSEVPKANGSPSTGLTTELLAILSALTGPSHDALALLRNSLATNLKG
NLKAHHQNVLPPSPTPVAQQKPQERDIQNQKTNLIVDSGANNRKINATYQDNSRTHL
PLRLFNSLEEDNSPPNAFTRKYFSSDSSNPTERSPSSSPPVVQNLFPLHSGDESRENDC
VSVCKEDNLTLETSPSNDRCSAYELSKLESRVHNQNFMSGFLHQSLESRTAVVQPSY
TSSSGSDQSPASSNSDSQERTGRIIFKLFGQHPSNFPVALRAQILEWLSHSPSDMESYIR
PGCVILSIFVSMPSANWERLREDLPQRLKLLVEDSRTDFWRCGRVLVQAEQRLASSN
DGKVRFCSSWRSWDAPEIYFVQPVAVVAGQETTITLRGHNLATTGTKILCAYRGKYT
SIDVLPEEEASECIPTDSRVQKFTFSGGPPNVLGRCFIEVEHGFKGNCFPVIVADPIICRE
LQSLESEIEIEFSSDKTSSIKVERSQEHFQGYSAATARDEVIRFLNELGWLFQKSSERQ
AELNVVKDASFLEFSSDRFKFLFIYAVERDMCALLKKLLDIFFEMNAGQEASAPESSK
NLLESNLLHRAVKRNCKQMVDLLLNYAPSPNNMNLLQTKSFIFPPNLTGPGGLTPLH
LAASIRNSEPLVDALTSDPQDVGLQSWSTALDSSGQTPHAYALLRNNHSYNRLVERK
LADRKYGQVSITISNNEPSLDGIAADVNGSHTGSSVLSLQKLPQSCAQCMIFSNKRVR
RITGSPGALYRPYMHSILAIAAVCVCVCLYFHGPPHVGSSGPFKWENVDFGPA

Figure 1031: Amino Acid sequence of SEQ ID NO: 2284. The conserved SBP plant protein family domain is underlined.

MLFPNRGTDVEKRAQWENETVGGGDTLMDDGSVHNGSVYSPGCGSGSTFGYGSSS
RSSVSVDCSLKVEPDLCRIKTGSMESSDMEDRDVDFLDLRSQVGPRTDESERGKSSQ
KREDVELNGGKHCCGTKEHQEPQRCSKDSKFKARTGHAEDKDIENTEKNSSAVTIPV
SACSGESHIGLKLGKRTYFEDISGGGQIRATPIAAFPGPLPTRVKKPHMQSARCQVEG
CNADLTSSKDYHRRHKVCEIHSKSAKVMVAGLEQRFCQQCSRFHVLSEFDDAKRSC
RRRLAGHNERRRKPQPDPMAVNSARFAPSFYDNRHTGLLLDASSFMHPRIFSSSVLD
DRDDFKLGHGKGTWPKIVKSEVPLMFDGHPQTAAVNRPSFTNALSCQSADRLLQLL
QSSKASSVSVLSQGIQHYTQNPANPLTEALTRSFSPETGVIAGLEVATATQNLLGVSD
SGCALSLLSSQSLGSRALGSASLDLATRPGATLEQFMHENHSSMDQISLQGMQHNFS
LANSSQASAGLISNGYPTAMNFIDKVQVG

Figure 1032: Amino Acid sequence of SEQ ID NO: 3666. The conserved SBP plant protein family domain is underlined.

MEAEIGRSHCEDQIYQQQKQQQRQLYASKGYNLMSKGKNIVEDHEWDGNNWEWD
SNLFIARPLSTDRGSGFQGKHLLSDGPRPANGISNDMYNKGGDAYTNGFHSYNMND
ASEKRRKVSVVEEEETAEEEAAACLTLKLGGSDYPVTETDADAASGGSKNGKRSRG
LSASSHHHP<u>MCQVDDCKADLNNAKDYHRRHKVCEMHAKANKALVGRLMQRFCQ</u>
<u>QCSRFHLLQEFDEGKRSCRRRLAGHNRRRRK</u>THPDGIMAGTCLNDDRGSYSLIVNLL
KVLAQLQTSNNSDQTSNQDTVLQLLKKLASSASIPEETNAAAAKQSTAGQPNNKVSL
GGPSENTVPLQNNFLDSHSNAFRKSTEPSICAREQSFVSTQTRNDVLFPHDSAQKTAV
SVVPQYSHKFWQRREGIQEQHVLAGSAPQSLSIESTDKRKSPISNGFDLNNVYNGPEE
LVPRSDGPSTLLLLGGLDSVSRQNAPLCSSWAASDTYQTSPPQISDNSESVSDQSPSSS
QGDGQDRTGRIVFKLFGKNPSEIPQVLRSQILDWLAHSPSDIESYIRPGCVVLTIYLCL
SESLWEEFARGFKISLERLLGVSNSDFWKTGWIFAQLDHQIAFIYNGQVLLDISSNFA
NAPLLLSVTPIAVPAGEKAHIVVKGRNLTSSTSRIICAFQGKHTVQKDSTEYVQDVGV
PFIDGSDDFEGCTQILCRSFSWSPHNVIGRCFIEVEGHDMSGNFFPVIVAEADVCAEIR
TLERYIDMPFNSNQDVTSQNHDLQLKIKREAIKFLHELGWLFQRSCSSQSNLGILPLT
RFSPTRLKWLLEYSTEHDWCSVVRKLLNIVFSSNVNSANWSAITMLIEVGILHIAVRR
NCREMVEFLLTYVPESVAEETMLTAGQGQAELSSNGFVFKPDMPGPAGLTPLHIAAS
MENAEGVLDALTNDPGQIGVKAWTIVRDKTGMTPEDYALLRGHHFYIELVRGKSVK
NVMPEHVSLDIPEPLSQQLSSIKMSVSAPRSTSQAEKIGEGNIQGNKADTELCQKIRW
PGGLSWPGGLRSDQGKIKPLPSHCKLCEQQQLRKYRSRTLIYRPAMLSMMAIATVCV
CVTLLLKGPPEVLFVTAPFRWEVVKFGFM

Figure 1033: Amino Acid sequence of SEQ ID NO: 2286. The conserved TCP family transcription factor family domain is underlined.

MESGGGDHGRPPLKLSSSSQEPTMASASASAYEGRGGLVGSFVPTSSSSRVDSHMNI
ASTQPVDASLAMSMSSATTSNNETQISTSQQEQETVALDP<u>NKKAPAKRSSTKDRHTK</u>
<u>VDGRGRRIRMPATCAARVFQLTRELGHKSDGETIEWLLQHAEPAIIAATGTGTIPANY</u>
<u>STLNVSLRSSNSSISASHHTKALPLAFHGTLGLGPNVDMGARLDHQLRARNEWERAE</u>
<u>NRTSMELAVASNRQSEDRRLQIGGGGGEMGHGGGGDHMLGFHQENLLTDPSEHHH</u>
<u>HMQQGGSEIGLAGGGGG</u>GDSSDSYLRKRFREDLFKEEPTEAPKPLRRQTHEMAGPA
GIPQTRPITPAMWAMASATGLASSGHMPGGFWMLPVSASSSSTPGVMAGGQSEPIW
TFPPTGPSGTATMYRMPAGASIHLAGTTVGSGPTGISTLQAPLHFMPRINISGAGMGL
EFQGGRLSHVPLGSMLLQQQQQQQQQHSSHQLPGAGLGLGGGETHLGMLAAFNAY
NNRSMNSDHQSMDSVHQQQQGADSGDDHPANSQ

Figure 1034: Amino Acid sequence of SEQ ID NO: 2287. The conserved TCP family transcription factor family domain is underlined.

MRNPGMIGYVNPAASKEQKGSNLDSAGSFTQALVMSSGVVGMGSNQGGETNNAEG
SSMVVAARTSQGES<u>GSVVDPSKKPPAKRSSTKDRHTKVDGRGRRIRMPATCAARVF
QLTRELGHKSDGETIEWLLQQAEPSIIAATGTGTIPANFSTLNVSLRGSSSSISAGLKQQ
SYHHHHRALAGLTGGLGAPAGGDSMGHQYRMRMGEWERAEEDTKTHAGAEMGS
THGGASAALMGGGFHLQHQHQQEPNLLNEMGEGEECMNLRKRFREDLFKEGDQEA</u>
SAKPLRGIVQRQSEMMSSPSGIGMGMSMSMPAAAMWAVAPAPPGMSNSGHGGFW
MLQPVSAGSNSNPPPLMAAGPQSEPIWTFPPTGSTGYRMPAGTSIQLGAAAGSGSSLG
RSSNNGNNNNNNGNQSRISSSTGLPFMPRMNLPMGGSCHEVSGSGSTRLGSGAVPFS
SMLLQQGSSTGSIGAATGESHLGMLAALSAYNNRSMSSEHQSLQESVNQQSGVDRS
GEDGHSHQNHANSQ

Figure 1035: Amino Acid sequence of SEQ ID NO: 2288. The conserved Myb DNA-binding domain is underlined.

MQSGGQYGIHDIQQLMMERGPPPRMFALSPDMLPHPMKPPGLHPHLTPHHFMPFPL
DHHFQHSLATHHAQQQAMQEQIGLGDDSSENQSSFANRTAIQAETEDDDDGIEGED
DEDNGDGWATEEILNLLRISSEMHLKFRDPNLQAVAWEDVSRKLAELGYHRSAKAC
KEKIEQVNLTSEKAKDGKSFMQFGELEAVYNGGSRVNNGGVTNAALQEEVVAKSE
QQNKKKRKRKHLTSIKIFLENLVKQLLENQEALHIKFLEAIERRDQERIMREEAWKR
QEMARLTRETELRAQEHALASTREAAIVAFLQKITGEDLKLPEAPVPFHATETQEDH
QAACMDKDLSDP<u>NGKRWPKPEVQALIRLRSNLEPKFQEPGPKGPLWQEISAGMASL
GFTNRSAKRCKEKWENINK</u>YFRKTKDSMKKRPENAKTCPYFQQLDVLYRKGILSSP
NKCNRVDQHSNSSDAILEDQGHGHESNHKDDLREHIQVSRSDSEHIMSVMPAEAEEI
TPANNNDNVYFFRSPDPVDHGHQMTKLKQNLPENNRNTSNSSSPNVESGTTTRNVGI
FPTDNNKTASKMERMAKDMLEAQQQQQKKFLEEFERQEHNQNQHLHQEIRDQEFR
GQQNELKLIQERSHSATQSALMALVDKLTAEIGGDFSIPLPSAKR

Figure 1036: Amino Acid sequence of SEQ ID NO: 2289. No conserved domain identified.

MEEPLQIINSSPIQQQHDHDDDDHGHGHEEEVIPHPLLPPPGDTCIVPYIMPVSTSTAE
KHPPQPTNIAFNGPETEEDDKKRDREHKKRSKNWTRVETLKLIKLRTEFEPRFSRSGR
KTELWDEIAESLRKEQFFRDAQQCRDKWEKLMAGFKDVREGLKDRNDNPYYEDLH
PLLSGKCLRRENLKKEGDSTHNEKWDKLMAAYKDVIDGKREEGDLSYFVELRAIVG
GRPDEGKVQIESMP

Figure 1037: Amino Acid sequence of SEQ ID NO: 2290. No conserved domain identified.

MNEPDEHAAAQLVQKRSHPLAEVVMPISVRPLAEKCGVEAEEERKRAAEHKKQRSK
NWTRAETLKLIRLRAEMEPRFARSGRKSELWEEIAEALRRESVVRDAQRCRDKWEK
LTASYKEVRDGQRDRQDFPFFDELDPLLSLKPQKAAAAAAAAATAATAANFVSAET
PSNFPTDDEMTEEGSPAGKRRKTTPRGLSATDLDAVRELLESLVSRQQRFFVDLLDS
MERKEEIRERIRQEKEEKWRAEERAQRCLFNNTMIILAKKLVDGDSGFCARDPGFCG
AEEFKPKPATGGSDQTDHDGGVIVPNVGGGGGPKKRSKNWKRAEVLRLIKFRAEM
ESRFAKSARRAALWEELAELLGAEGIKRDGKQCREKWDKLMAEFKDVSDGKRDRS
ESPYYAELTATVGTGRSAEAG

Figure 1038: Amino Acid sequence of SEQ ID NO: 2291. No conserved domain identified.

MVAAAEKVGEGSAYNSPCKHLEPSPTPAHQAAQAGNISTDKASSSGVAAGGDDDVF
GVGEDCERLAGGGGGSAGNRWPREETLALLKIRSEMDANFRDANLKGPLWEHVSR
KLEEQGYHRDPKKCKEKFENIHKYYKRSKEGRVGRQDGKNYRFFSQLEALYSNNNN
KPPQISNKAVNDASTIPNGGDRVQAHADPTSTRQDEDHNNLGGNFMVGTTSAGNTD
LNSSEGISFSSDSSEDYDQPRDSNNKKRKRSGTKKLMAFFENLMKQMMEKQEKMQQ
TFLEALEKREEDRMMREEAWKRQEMARLNKDQELRSQERSMAASRDLALVSFLQK
FTGQTLQLDTQLMDSSQIHSQGDQEQEQEQDLHDEQYKDLNCTDPNSKRWPKPEVL
ALIKVRSGMGSRFQETGPKGPLWEEISSQMSALGYSRSSKRCKEKWENINKYYKKTK
ESNKKRPENSKTCPYFYQLDALYRRGMMSNPHKMNQMHDEDLRPDDEDHQDELLE
QVSGSNIRDDSGHGQGADGTGDGEILPVRPLPLPRPHSDSIAPPQTPTSNATVTLFSTP
ENRNADNGSLPKAS

Figure 1039: Amino Acid sequence of SEQ ID NO: 2292. No conserved domain identified.

MDDTDDDARYPPNAYALQYHQSHTSNPFHRPKLPLRPAPHEHTAAFEDEEEDEEEEE
EKDEEEEGNYGDDEADESENHPEAQESGTRGKNIQKTPDKPGVDRFGLRNSSPNLCP
KSNPEYNLGRPEAKGSRDDWSEAATWILLETWGEKYLQAGKKSLKLEQWFEVAKT
VSAASKVFKTDIQCRNRLDTLKKKYKKERQRSPDSKWVYYKYMDALLNSSPWQTG
LPYGMDAGEFVSQVPLRPRICLNNSRFEEVRDGPGDSPSEEEVEEDEDEEEEEEEDED
DGGRTLKRRKEDEDSFRILADSIHRFGEIYERIENSKKRQMLDLEKMRMESDRDLEM
QKRRILEQTQIELAKIKQGSDDIDASVTNMSG

Figure 1040: Amino Acid sequence of SEQ ID NO: 2293. No conserved domains identified.

MVGRGPSTRVQNIFQVSPSSDHQQQQYSSQTQQHQQHHVSKNHQPQQQQQLLRQQ
EHRKDQMVAAAEKVGEGSAYNSPCKHLEPSPTPAHQAAQAGNISTDKASSGVAAG
GDDDVFGVGEDCERLAGGGGGSAGNRWPREETLALLKIRSEMDANFRDANLKGPL
WEHVSRKLEEQGYHRDPKKYKEKFENIHKYYKRSKEGRVGRQDGKNYRFFSQLEA
LYSNNNNKPPQISNKAVNDASTIPNGGDRVQEHADPTSTRQDEDHNNLGGNFMVGT
TSAGNTDLNSSEGISFSSDSSEDYDQPRDSNNKKRKRSGTKKLMAFFENLMKQMME
KQEKMQQTFLEALEKREEDRMMREEAWKRQEMARLNKDQELRSQERSMAASRDL
ALVSFLQKFTGQTLQLDTQLMDSSQIHSQGDQEQEQEQDLHDEQYKDLNCTDPNSK
RWPKPEVLALIKVRSGMGSRFQETGPKGPLWEEISSQMSALGYSRSSKRCKEKWENI
NKYYKKTKESNKKRPENSKTCPYFYQLDALYRRGMMSNPHKMNQMHDEDLRPDD
EDHQDELLEQVSGSNIRDDSGHGQGADGTGDGEILPVRPLPLPRPHSDSIAPPQTPTSN
ATVTLFSTPENRNADNGSLPKDSVKREGLLMKEILGHMQTTPTPQHDPPSALETGSS
GHNNIKKKVGLVHSVMNNLQEQGKKKQKQADLHYSASTRDANSFMEMVQKLTAA
DTLDFNLSASSQ

Figure 1041: Amino Acid sequence of SEQ ID NO: 2294. The conserved Myb DNA-binding domains are underlined MKEKGEGSEIIQAGRPQQFGLPQHQSDSMLPQFLASLTKESPHFQTSQTYENESQQSR
DQTPLQPTTADTKPKDIGEFSSDLPHLVASPISSRPPAVTGTDVVFKQAIHGPDENNN
NNNAADLGDDD<u>AFGGSGGSRWPRQETLALLKIRSEMDAAFRDASLKAPLWDEVSR
KLAELGFHRSAKKCKEKFENVNKYYKRTKAGRSGRQDGKTYKFFNQLEALYGNTD</u>
DTAIVDNNTSRITNIMAASVSSRRVQATPSPPPRPGWLVTTNRSEETQVPERRTSCSY
RFESDEFSTESSDETHDDNNISETRSSRKRKRITTKKMMRFVEKLMERVMEKQEMM
QQRFLEMIDKREQDRMIREEAWRRQENVRLSRESELRSQERALTASRDRALIAFLQK
VTGQTLHLPDQFP<u>VNSQPLSPALPQQIHPRPEEINKDNNDTDSLDPNSKRWPKQEVH
GLIKLRSALEPKFHDSGPKAQLWDQISAEMAAMGYHRSAKRCKEKWENINKYFRKA</u>
KESNRERPGNNNTCPYHQLDALYTKGILRYSNSEKFNRTRDQDQQQEELLEQTTCG
SSRDDQSPGHDGDNEILAIMPPPSITTAPPASNFFSTDQPDGHVNGSQAPAPMKVMFS
SVSEGLLGNSPPKPDATTIMMFQNSSQSAPPLSTTITVEDDKNKHEKQADLDLPYGVF
NDRTVNSASNVSRDSSSTFMAMVVDPPQFNIPGSSHAD Figure 1042: Amino Acid sequence of SEQ ID NO: 2295. The conserved Myb DNA-binding domain is underlined.

MYSTQSPFSSLTHPSISSQSFHIPISSSPQTPLHHHHLHIPISHSQPSLSHPNALTFQPALY
HSPEVQIPQLHQVSEICEPCSISQPLCDIPSLCDQVQVQSVQYAISEAVSHPDSTYSTQN
SSNPDVKGLENDRLEIVKVEEEGDGDDYKKKEKEKEHKK<u>RSKNWTRSETLKLIRLRT
ELEPRFAKGGRKSELWDEIAEALQNDQISRDAQQCRDKWEKLAAGYKGVRDGIRDR
EDNPFFEELHTLLSGKGSRRDRGDKDHHDVQEVELPKGLLCDTGRDSVISETEINTDK
RSCDFRDEEEWEVEIMASKGKKRRRPRYVSVSDLSAVKDLIETVIEKQQEFFKDLLET
VERKEQMREQARQEKEEKWRAEERAERDMFNNAMMTLTQKLVGEGVGKFTAGAP
VFQTLMDGNQALKKRSRNWKRAEVLQLIKIRGEMDSRFLESTRRGLLWDELAERLV
AQGIKRDAKQCREKWDKLMAGYKDVVDDKKDANLSPYYAELTAMLGRENANLQ</u>

Figure 1043: Amino Acid sequence of SEQ ID NO: 2296. The conserved Tubby domain is underlined and the Tub family signature 2 is in bold. The cyclin-like F-box domain is in italics.

MSLRSIMREIKEVRNGIGNISRRRSFDMRVSHNHRARSQATIDDTLSRVLFVQQ*SQWA
NLPPELLHNVIQRLEASEGTWPARKNVVACAGVCKSWREITKEVVKTPEQCG*KL<u>TFPISLK
QPGPRDPPMQCFIKRDRSASTYKLFLGLTPALLVENGKFLFAAKKVRHATSTDYIISL
SSEDFSRASNTYVGKLRSNFLGTKFTIYDSQPPHSGAVVLTSRPSRRFYSKQVSPRVP
AGSYNIANIVYELNVLGTRGPRRMQCTMHSIPASSIQVGGNAPTPTEFPRSLDESFSLP
FSKEPLIDFSSSSLSEIPINVESKDVPLVLKNKAPRWHEQLQCWCLNFKGRVTVASVK
NFQLVASVEPSQLVTQADQDKVILQFGKIGKDIFTMDYRYPLSAFQ**AFAICLSSFDTK
LACE**</u>

Figure 1044: Amino Acid sequence of SEQ ID NO: 2297. The conserved Tubby domain is underlined and the Tub family signature 2 is in bold. The cyclin-like F-box domain is in italics.

MSLRSIMREIKEVRNGIGNISRRRSFDMRVSHNHRARSQATIDDTLSRVLFVQQ*SQWA
NLPPELLHNVIQRLEASEGTWPARKNVVACAGVCKSWREITKEVVKTPEQCG*KLTFPISLK
QPGPRDPPMQCFIKRDRSASTYKLFLGLTPALLVENGKFLFAAKKVRHATSTD<u>YIISL
SSEDFSRASNTYVGKLRSNFLGTKFTIYDSQPPHSGAVVLTSRPSRRFYSKQVSPRVP
AGSYNIANIVYELNVLGTRGPRRMQCTMHSIPASSIQVGGNAPTPTEFPRSLDESFSLP
FSKEPLIDFSSSSLSEIPINVESKDVPLVLKNKAPRWHEQLQCWCLNFKGRVTVASVK
NFQLVASVEPSQLVTQADQDKVILQFGKIGKDIFTMDYRYPLSAFQ**AFAICLSSFDTK
LACE**</u>

Figure 1045: Amino Acid sequence of SEQ ID NO: 2298. The conserved WRKY SEQ ID NO: 3670) domains are underlined.

MAGNEENNKMGFLDWGPLTSPTTLIASMMAEDFSSRSFSQLLAAPQIETPQSQEQNL
KPLSPAGFNGSSSRSGKENDPFSISGGFAAGSVPTSGFGQVHKPPSRTGGGSFAERLA
ARGGFNAPRLNTARFKCLPSVSSPGGVRSPYLTIPPGLSPTTLLDSPVLLSNSQAAQSP
TTGSFPLPPFLHESSLSPPVNSGSDGLKDKSYEDGTSSSFIFKPHVKSGPSSCLSPLGGL
ATFGSSQQQAVGGFQVQTESQTWPQFDSQMPSRSNSQGQAQMYTQIQTQAHAQSHT
QAQNRTDAQVFMQAGNKARSHAAAQVKTQAQDQGQAHVPAQGQAQLWEQAVAN
STGTKDLVAYSLPESPVPNNVIEEAKCVPPLQVAPPLHVDPQDFPSEESVPSEEQEQM
HDSDAQLQLPEGDQKGLAPHTISGRP<u>SEDGFNWRKYGQKQVKGSEYPRSYYKCTHP
NCQVKKKVERSPHGQVTEIVYKGGHNHPKP</u>QPSRRSAVGSAHMIQEGAESTEATTK
VEGGNTWRNTELGLLKDKDAANCSKTWKNELLERSSSASVVTDLSDPSSTAQVQSS
SRLDSLGTPEMSSTIASDDDMEDANDSKSVGDDGDENESDSKRRKKENNTVDIVAAS
RAIREPRVVVQTTSEIDI<u>LDDGYRWRKYGQKVVKGNPNPRSYYKCTNAGCPVRKHV
ERASHDPKAVITTYEGKHNHDVP</u>AARNSSHDNAAKGNGAAPLAMQNNVPAPMNAI
PRPVPQVQDIVSRPVPQVQGIVSRFDRHLDPRNEYVKRAYYEKVVDENLHLQDKNG
GSLDLKMGAGMGFGMFGLANNHTDKRQIAEGHPPFPMQIHSTTSHGLPGIQFSGKPT
VPVQSYFGQAKDNGMRFLRPKEEQNDDSGFGNTLTFNPTPNPSLYQQIMGKLSMGP
SL

Figure 1046: Amino Acid sequence of SEQ ID NO: 2299. The conserved WRKY SEQ ID NO: 3670) family domain is underlined.

MSWNLDIHHHRPSQALSRSSALMDIDSGLGGDFPLISFQEFLQRDEEFHDFGTHVGRP
LSQIPEDQQTRHEAPEEAADFLHSGTPVAATEETRAGGRSGETSTVPGTPNSSLSSSSS
EGHEESSAGIRLGPSKTEQPSEDIISTESSKPTEPEAKKQSRPRKKGQKRNREPRFAFM
TKSDIDH<u>LEDGYRWRKYGQKAVKNSPFPRSYYRCTNGKCFVKKRVERSSEDPSVVIT
TYEGQHTHHSP</u>ALLRGSSSGTSDQLTHFGGAADHHRTASPFNTAQSPSFNLQSLRMA
VQVPQRTNYYGMGSLQAHDPIHRGSSTLQHQQQIIRSIQQQQQQQQHDHSQHQQQH
QLIHSQQMQPPSVDQGLLEDIVPPGMRKNP

Figure 1047: Amino Acid sequence of SEQ ID NO: 2300. The conserved WRKY SEQ ID NO: 3670) family domain is underlined.

MREINNVEEANRAGLDSSYRVLAILAQQRQQQHQDQRHDIITVSDLDMTTKEAISKF
QKVVSLLGARTGHARFRRGPRQSPAYTKACMESPSYCFSQHVSPGLVSPPELSPSPAP
IRQFMPSQNSAPTVFGMNAHHHRQQQLYQQQQQQQQQQQQKLHYSQLQQQQQLN
FQAELMLRNNSFMKFENSISCTPTLSSTKSFMSSLSIDGSVANDKPLLTYHQLMNPVQ
EGGTVSSSKRKCSGKGDEAGGKCRSTGRCHCSKRRKLRVKRSIRVPAISSKLADI<u>PPD
DFSWRKYGQKPIKGSPHPRGYYKCSSVRGCPARKHVERCLEDPSMLIVTYEGEHNHS
RKLSGSPNLVVHP</u>

Figure 1048: Amino Acid sequence of SEQ ID NO: 2301. The conserved WRKY SEQ ID NO: 3670) domains are underlined.

MDYQQEQHPVTSSSHFYFPDQDLDMNSKSFSDLLADNNGDSLIWGANEQKLEFGAA
GGVTRGGNSFAERFAARGGEPLKLSTAKFKTMSPSSLPIPRSPFLSIPPGLSPTTLLDSP
VLLSTAQDMESPTTGTFPLQSFSFQSTAATASLDIVKNEDGSCSSFAFKPLAGSNPSSD
MQPLGNLATFGYNHHQSLKGVQDDARMWTSPIFSQTNETNETGANSSSEPTTTGTT
AMQAVPLQAVRSQAASFEEQQQRPLSDFNQTAIVPPTGIERPSDDGYNWRKYGQKH
VKGSEFPRSYYKCTHPSCPTKKKIERSLDGHVTEIVYKGLHNHTKPQPSRRMGAAAA
AAAAAARLEEGESTEGSGALVKVEDPSSTPPRRQNSNHLESLGTPEQSISASEEDDAR
TQVDKFSGDEDLDEEESDSKRRKKEVNTMDIIGATRTIREPRVVVQTTSDIDILDDGY
RWRKYGQKVVKGNPNPRSYYKCTNAGCSVRKHVERASHDPKAVITTYEGKHNHDV
PAPRNSSHTNAGLGSGQPPVPILQNSVAPSTNGMALTAPGTQETFSHFDRHPDLHNG
YGNNNYMFGRIANESYNSQNGRGLGMSLGAFGLESKHSEIQQAEAPTSFPMQIKPAS
HEYSSIGSGNSGHIYYNQPNERDGLIRPKEEQKGQFLV

Figure 1049: Amino Acid sequence of SEQ ID NO: 2302. The conserved WRKY SEQ ID NO: 3670) family domain is underlined.

MPRIWVVHPQEAQKNISSMDLEGDLGAVVRATRKGCARIDELDFDSCNLLNAGAVL
EPKKEVTVPISISISDTVTYSPFYGCNPSRSNKSLLPSMFENLDHYYHNVEQKPAWCC
GTAPDSSLGKAEKKDAAHDLIMAATTSTITTSNNQEQASGRINVGGVCPRQSLSPVH
VKSPPRSPTRQDDPSAKTPDKVEADCSSSSPIKTESTAERIVSNRATASGTRGGRRNQ
QRRTVSIAATEGSWNKPGGGGVASDLWAWRKYGQKPIKGSPYPRGYYRCSSCKGCP
ARKQVERSHTDPTKLVITYTAEHNHAWPTSNPRNGLALTGSLSSTQKDMMALVVPH
SPQKSDVLPDARGSNPAASPTTAKIEQEKPRSPPATDCLDFNLTEETTDCLVEDHNQT
AGLHMISSNHVNYDDLFAGLGELKDFARYFSDYKSDEETDSTVVDPYNLFNLSSASS
NKTTAD

Figure 1050: Amino Acid sequence of SEQ ID NO: 2303. The conserved WRKY SEQ ID NO: 3670) family domain is underlined.

MGEELLFDRFREHNWRLFSGTDQAGGLLAFRNMMMNGAGRFEHKTTTGIDLSVKL
EEDDDGGRSVQENGSHGGAEKDNGYDNRTAEKDFFHHEVGRLSFRLLPVDGESKAE
DGTADMMSQGPEDEDDKPATNVSTGLRLVNVQAARNAASDRSTVEMEDCASPINS
QETSNPNDMDGEPNSELVVVQKELNRMNEENQRLRFMLNQINSSYNNLQLQLASLM
KQQPQNYGHAVREQVHKEEKLNIFRGITGNNNGEAADDQTQTPIQRQFLEIKDLSRL
NSGTIAHEDSHTSEARRTLTHAENDQEESKALMAFNHIDNKRARDHDSHGLTSKGH
DSPDRTPSPNPSPTHHENVGTPQREGSLDRRSSPGWVPNKMQKIVDQTDATIRKARV
SVRARTESPMISDGCQWRKYGQKMAKGNPCPRAYYRCTMSPCCPVRKQVQRLAED
RSILITTYEGSHNHMLPPAATAMASTTAAAASMLLSGSSTSADNIALNASFMAGALM
QHPCNTSTASISASAPFPTITLDLTHPNQMANAPGHMAASNPRALAGLPAHAMPFV
GMPHQFPTNTPQGALFHGQSIYNAPSMFAPLAGQLQRPQQPMMPTPPKLNIQAGQPP
TPQQQQPSFIDTVSAATAAITSDPNFTAALAAAITSLINNNNNAANAISKPNSSQALNP
SPQVAAHVKSDHTQ

Figure 1051: Amino Acid sequence of SEQ ID NO: 2304. The conserved WRKY SEQ ID NO: 3670) domain is underlined.

MEAVGLSLAGNGSYRELLDTFLKQKCRRKGDFMADAPRVDRLGGIDLSVKLEETEN
EEKLMTDRESENEIKNGVVDFFSEKAVRGLGFEFRPSPGNGAPSVASLGEGLRLGSQ
KTENKEEGPSSSSSKGFNLSLLPAKTGSDRSTVEDGMSPVRSQEPSNPDEGEPKSELM
MLQVELNRMNEENQRLRFMLNYVSKNYGNLQMHLMSVMQQQPPPEKVEEKLNGS
SEGVKVDVAGPVQRQFLDLVPISSHGTDSQHSLSSDTRDADDVEETAKSINNEVLSK
KRDVATANSTDKPRTCDVRVQQQQQQPGTDPAANSSTALNAQEKGHPDSPDHESW
TANKAQKVANKCAVDQTEATIRKARVSVRARSEAPM<u>ISDGCQWRKYGQKMAKGN
PCPRAYYRCTMAVGCPVRKQVQRCAEDRSVLVTTYEGSHNHPL</u>PPAATAMASTTSA
AACMLLSGSTTSNDGGFNSSFMQAAAGSLMSCSPASMATISASAPFPTVTLDLTQNP
NPNMYHRQPSGFPMPLGGFQQLPSHPPQIFSHSLFNTSKFAPLSGQQFDPQQQQVPHF
SGHPMQQQTHMPVPISQYKAPQSSLMDTVSAITADPNFTAALAAAITSIISGQSNNAN
TIPSQAPPCARADNPASAKLLQ

Figure 1052
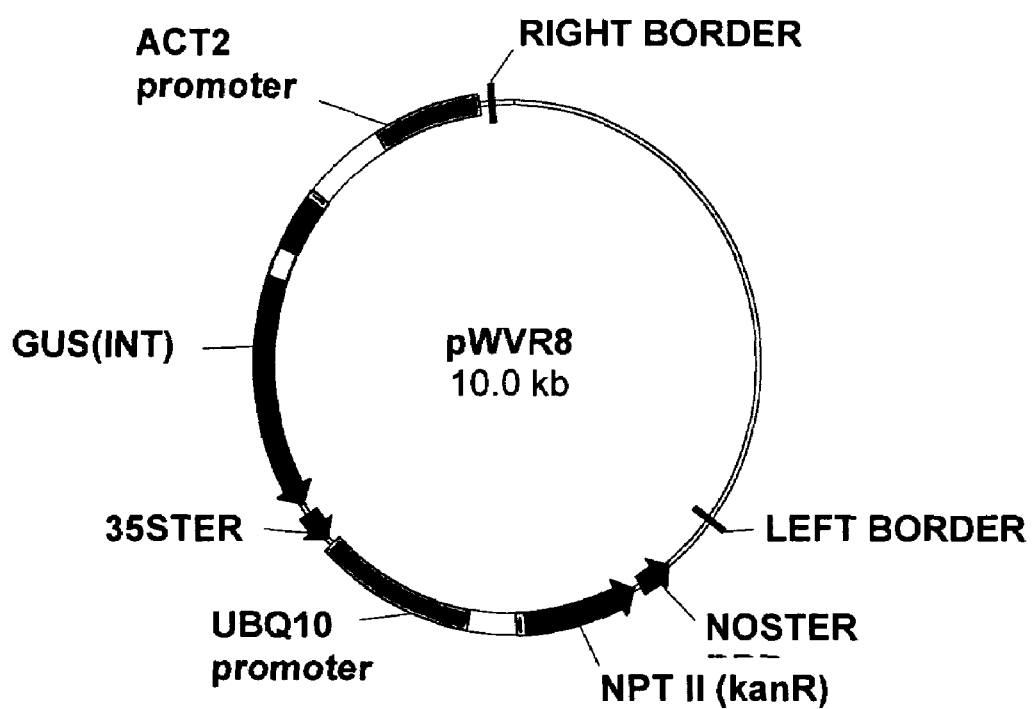

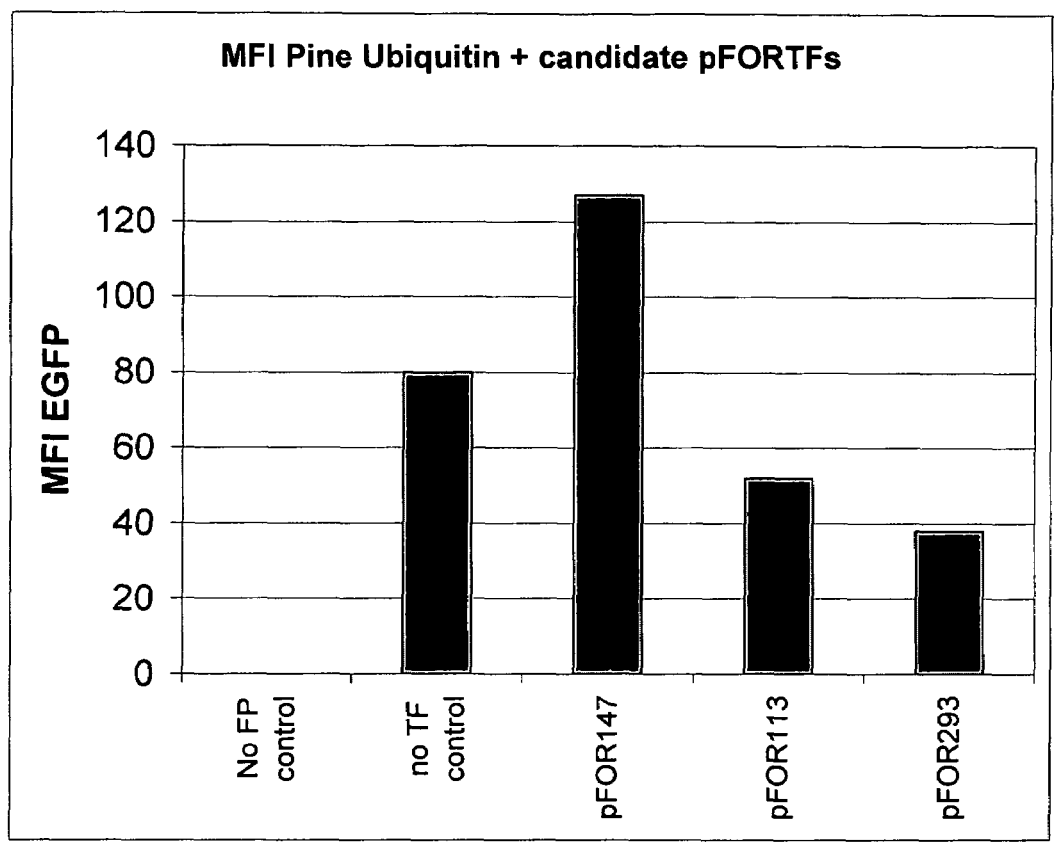
Figure 1053

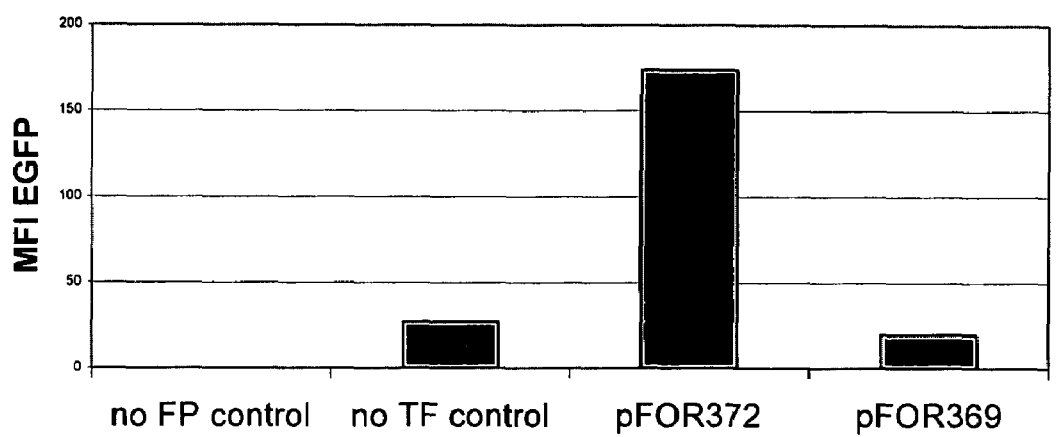
Figure 1054

TRANSCRIPTION FACTORS

BENEFIT OF PROVISIONAL APPLICATION

This application claims the benefit of U.S. Provisional Application No. 60/476,189, filed Jun. 6, 2003.

SEQUENCE LISTING

The instant application contains a "lengthy" Sequence Listing which has been submitted via CD-R in lieu of a printed paper copy, and is hereby incorporated by reference in its entirety. Said CD-R, recorded on Oct. 30, 2004, are labeled "Copy 1" and "Copy 2", respectively, and each contains only one identical 6.71 MB file (44463295.APP).

FIELD OF INVENTION

The present invention relates to polynucleotide sequences isolated from plants that encode transcription factors, together with polypeptides encoded by such polynucleotides. In particular, this invention relates to polynucleotide and polypeptide sequences isolated from *Eucalyptus* and *Pinus* and the use of such polynucleotide and polypeptide sequences for regulating gene transcription and gene expression.

BACKGROUND OF THE INVENTION

During transcription, a single-stranded RNA complementary to the DNA sequence to be transcribed is formed by the action of RNA polymerases. Initiation of transcription in eucaryotic cells is regulated by complex interactions between cis-acting DNA motifs, and trans-acting protein factors. Among the cis-acting regulatory regions are sequences of DNA, termed promoters. A promoter is located close to the transcription initiation site and comprises a nucleotide sequence that associates with an RNA polymerase, either directly or indirectly. Promoters usually consist of proximal (e.g. TATA box) and more distant elements (e.g. CCAAT box). Enhancers are cis-acting DNA motifs which may be situated 5-prime and/or 3-prime from the initiation site.

Both promoters and enhancers are generally composed of several discrete, often redundant, elements each of which may be recognized by one or more trans-acting regulatory proteins, known as transcription factors. Regulation of the complex patterns of gene expression observed both spatially and temporally, in all developing organisms, is thought to arise from the interaction of enhancer- and promoter-bound, general and tissue-preferred transcription factors with DNA (Izawa T, Foster R and Chua N H, 1993, *J. Mol. Biol.* 230: 1131-1144; Menkens A E, Schindler U and Cashmore A R, 1995, *Trends in Biochem Sci* 13:506-510). Developmental decisions in organisms as diverse as *Drosophila melanogaster, Saccaromyces cerevisiae, Arabidopsis thaliana* and *Pinus radiata* are regulated by transcription factors. These DNA-binding regulatory molecules have been shown to control the expression of genes responsible for the differentiation of different cell types, for example, the differentiation of leaf trichomes and xylem tissue in *Arabidopsis thaliana* (Kirik V, Schnittger A, Radchuk V, Adler K, Hulskamp M and Baumlein H, 2001, *Dev Biol.* 235(2):366-77, Baima S, Possenti M, Matteucci A, Wisman E, Altamura M M, Ruberti I and Morelli G., 2001 *Plant Physiol.* 126(2):643-55, formation of endoderm from embryonic cells in *Xenopus laevis* and the initiation of gene expression in response to environmental and phytohormonal stress in plants (Yanagisawa S and Sheen J, 1998, *The Plant Cell* 10:75-89).

Transcription factors generally bind DNA in a sequence-specific manner and either activate or repress transcription initiation. The specific mechanisms of these interactions remain to be fully elucidated. At least three types of separate domains have been identified within transcription factors. One is essential for sequence-specific DNA recognition, one for the activation/repression of transcriptional initiation, and one for the formation of protein-protein interactions (such as dimerization). Studies indicate that many plant transcription factors can be grouped into distinct classes based on their conserved DNA binding domains (Katagiri F and Chua N H, 1992, *Trends Genet.* 8:22-27; Menkens A E, Schindler U and Cashmore A R, 1995, *Trends in Biochem Sci.* 13:506-510; Martin C and Paz-Ares J, 1997, *Trends Genet.* 13:67-73). Each member of these families interacts and binds with distinct DNA sequence motifs that are often found in multiple gene promoters controlled by different regulatory signals.

Several transcription factor families have been identified in plants. For example, nucleotide sequences encoding the following transcription factors families have been identified: Alfin-like, AP2 (APETALA2) and EREBPs (ethylene-responsive element binding proteins), ARF, AUX/IAA, bHLH, bZIP, C2C2 (Zn), C2C2 (Co-like), C2C2 (Dof), C2C2 (GATA), C2C2 (YABBY), C2H2 (Zn), C3H-type, CCAAT, CCAAT HAP3, CCAAT HAP5, CPP (Zn), DRAP1, E2F/DP, GARP, GRAS, HMG-BOX, HOMEO BOX, HSF, Jumanji, LFY, LIM, MADS Box (SEQ ID NO: 3668), MYB, NAC, NIN-like, Polycomb-like, RAV-like, SBP, TCP, TFIID, Transfactor, Trihelix, TUBBY, and WRKY (SEQ ID NO: 3670).

Because transcription factors regulate transcription and orchestrate gene expression in plants and other organisms, control of transcription factor gene expression provides a powerful means for altering plant phenotype. The multigenic control of plant phenotype presents difficulties in determining the genes responsible for phenotypic determination. One major obstacle to identifying genes and gene expression differences that contribute to phenotype in plants is the difficulty with which the expression of more than a handful of genes can be studied concurrently. Another difficulty in identifying and understanding gene expression and the interrelationship of the genes that contribute to plant phenotype is the high degree of sensitivity to environmental factors that plants demonstrate.

There have been recent advances using genome-wide expression profiling. In particular, the use of DNA microarrays has been useful to examine the expression of a large number of genes in a single experiment. Several studies of plant gene responses to developmental and environmental stimuli have been conducted using expression profiling. For example, microarray analysis was employed to study gene expression during fruit ripening in strawberry, Aharoni et al., *Plant Physiol.* 129:1019-1031 (2002), wound response in *Arabodopsis*, Cheong et al., *Plant Physiol.* 129:661-7 (2002), pathogen response in *Arabidopsis*, Schenk et al., *Proc. Nat'l Acad. Sci.* 97:11655-60 (2000), and auxin response in soybean, Thibaud-Nissen et al., *Plant Physiol.* 132:118. Whetten et al., *Plant Mol. Biol.* 47:275-91 (2001) discloses expression profiling of cell wall biosynthetic genes in *Pinus taeda* L. using cDNA probes. Whetten et al. examined genes which were differentially expressed between differentiating juvenile and mature secondary xylem. Additionally, to determine the effect of certain environmental stimuli on gene expression, gene expression in compression wood was compared to normal wood. A total of 156 of the 2300 elements examined showed differential expression. Whetten, supra at 285. Comparison of juvenile wood to mature wood showed 188 elements as differentially expressed. Id. at 286.

Although expression profiling and, in particular, DNA microarrays provide a convenient tool for genome-wide expression analysis, their use has been limited to organisms for which the complete genome sequence or a large cDNA collection is available. See Hertzberg et al., *Proc. Nat'l Acad. Sci.* 98:14732-7 (2001a), Hertzberg et al., *Plant J.,* 25:585 (2001b). For example, Whetten, supra, states, "A more complete analysis of this interesting question awaits the completion of a larger set of both pine and poplar ESTs." Whetten et al. at 286. Furthermore, microarrays comprising cDNA or EST probes may not be able to distinguish genes of the same family because of sequence similarities among the genes. That is, cDNAs or ESTs, when used as microarray probes, may bind to more than one gene of the same family.

Methods of manipulating gene expression to yield a plant with a more desirable phenotype would be facilitated by a better understanding of transcription factor gene expression in various types of plant tissue, at different stages of plant development, and upon stimulation by different environmental cues. The ability to control plant architecture and agronomically important traits would be improved by a better understanding of how cell cycle gene expression effects formation of plant tissues, how cell cycle gene expression causes plant cells to enter or exit cell division, and how plant growth and transcription factor gene are connected. Among the large number of transcription factor genes, the expression of which can change during development of a plant, only a fraction are likely to effect phenotype.

Accordingly, there exists a need for transcription factors that can be used for regulating gene expression in plants.

SUMMARY OF THE INVENTION

Accordingly, there is a need for transcription factor genes and polynucleotides that can be used for regulating gene expression in plants. Additionally, there is a need for tools and methods which can correlate changes in transcription factor gene expression to phenotype. There is also a need for polynucleotides useful in such methods. There is a further need for methods. There is a further need for methods of identifying transcription factor genes and gene products that impact plant phenotype, and that can be manipulated to obtain a desired phenotype.

In one aspect, the invention provides an isolated polynucleotide comprising a nucleic acid sequence that codes for a polypeptide that is capable of at least one of (i) binding to a nucleic acid molecule or (ii) regulating expression of a gene in a plant.

In one embodiment, the polynucleotide is a transcription factor that functions in a plant cell. In another embodiment, the isolated polynucleotide comprises a nucleic acid sequence selected from the group consisting of SEQ ID NO. 1-494, 496-820, 1641-1972, 3588-3592.

In one embodiment the isolated polynucleotide is normally expressed in a species of *Eucalyptus* or *Pinus*. In another embodiment, the polynucleotide is normally expressed in *Eucalyptus grandis*. In another embodiment, the polynucleotide is normally expressed in *Pinus radiata*.

In one embodiment, the isolated polynucleotide is normally expressed in a species of conifer. In another embodiment, the conifer is selected from the group consisting of Eastern white pine, Western white, Sugar pine, Red pine, Pitch pine, Jack pine, Longleaf pine, Shortleaf pine, Loblolly pine, Slash pine, Virginia pine, Ponderosa pine, Jeffrey pine, and Lodgepole pine, Radiata pine and hybrid crosses thereof. In a further embodiment, the conifer is selected from the group consisting of *Abies firma, Cedrus deodara, Cedreus deodara* 'Albospica', *Cedrus deodara* 'Aurea', *Cedrus deodara* 'Kashmir', *Cedrus deodara* 'Shalimar', *Cedrus deodara* 'Silver Mist', *Cedrus deodara* 'White Imp', *Cedrus libani* (ssp. *atlantica*) *glauca, Cedrus libani* (ssp. *atlantica*) *glauca pendula, Cedrus libani* 'Nana', *Cedrus libani pendula, Cedrus libani brevifolia, Cedrus libani* var. *stenacoma, Chamaecyparis lawsoniana, Chamaecyparis nootkatensis* 'Pendula', *Chamaecyparis obtusa* 'Crippsii', *Chamaecyparis pisifera* 'Boulevard', *Chamaecyparis pisifera* 'Filifera Aurea', *Chamaecyparis thyoides* 'Blue Sport', *Cryptomeria japonica* 'Sekkan Sugi', *Cryptomeria japonica* 'Vilminiana', *Cunninghamia lanceolata* 'Glauca', *Cuppressus arizonica* var. *glabra* 'Blue Ice', *Cuppressus arizonica* 'Blue Sapphire', *Ginkgo biloba, Ginkgo biloba* 'Autumn Gold', *Glyptostrobus pensilis, Juniperus chinensis* 'Torulosa', *Juniperus scopulorum* 'Tollesons', *Juniperus virginiana, Larix kaempferi, Metasequoia glyptostroboides, Picea abies, Picea abies* Pendula, *Picea abies* 'Remontii', *Picea glauca* 'Sanders Blue', *Pinus×hakkodensis, Pinus nigra* var. *nigra, Picea omorika, Pinus densiflora* 'Umbraculifera', *Pinus elliottii, Pinus flexilis* 'Vanderwolf Pyramid', *Pinus pinea, Pinus massoniana, Pinus strobus, Pinus strobus* 'Pendula', *Pinus sylvestris* 'French Blue', *Pinus sylvestris* 'Mitsch Weeping', *Pinus taeda, Pinus radiata, Pinus Pinascer, Pinus thunbergiana, Pinus virginiana, Pseudotsuga menziesii, Pseudolarix amabilis, Sequoia sempervirens, Taxodium ascendens, Taxodium distichum, Thuja occidentalis* 'Filiformis', *Tsuga Canadensis* 'Golden Splendor', *×Cuppressocyparis leylandii, ×Cuppressocyparis leylandii* 'Post Sentinal', *×Cuppressocyparis leylandii* 'Caslewellan', *×Cuppressocyparis leylandii* 'Naylors Blue', and hybrid crosses thereof.

In one embodiment, the conifer is a Southern Yellow pine tree. In a further emcbodiment, the Southern Yellow pine is selected from the group consisting of *Pinus taeda, Pinus serotina, Pinus palustris,* and *Pinus elliottii* and hybrids.

In another embodiment, the isolated polynucleotide is normally expressed in a tree selected from the group consisting of chestnut, ash, beech, basswood, birch, black cherry, black walnut/butternut, chinkapin, cottonwood, elm, eucalyptus, hackberry, hickory, holly, locust, magnolia, maple, oak, poplar, acacia, aspen, teak, red alder, royal paulownia, sassafras, sweetgum, sycamore, tupelo, willow, and yellow-poplar, and intra- and inter-species hybrid crosses thereof.

In another embodiment, the polynucleotide is normally expressed in a gymnosperm or an angiosperm. In another embodiment, the polynucleotide expresses a polypeptide that is capable of at least one of (i) binding to a nucleic acid molecule or (ii) regulating expression of a gene in a monocotyledenous plant.

In another embodiment, the monocotyledenous plant is selected from the group consisting of turfgrass, wheat, maize, rice, oat, barley, orchid, iris, lily, onion, sugarcane, and sorghum.

In another embodiment, the turfgrass is selected from the group consisting of *Agrostis* spp., *Poa pratensis, Lolium* spp., Kentucky Bluegrass And Perennial Ryegrass Mix; *Festuca arundinacea, Festuca rubra commutata, Cynodon dactylon, Pennisetum clandestinum, Stenotaphrum secundatum, Zoysia japonica,* and *Dichondra micrantha.*

In one embodiment, the polynucleotide expresses a polypeptide that is is capable of at least one of (i) binding to a nucleic acid molecule or (ii) regulating expression of a gene in a dicotyledenous plant.

In another embodiment, the dicotyledenous plant is selected from the group consisting of cotton, tobacco, *Arabidopsis*, tomato, potato, aspen, eucalyptus, Sweetgum, acacia, poplar, willow, teak, mahogany, chestnut, elm, sugar beet, broccoli, cassaya, sweet potato, pepper, poinsettia, legumes, alfalfa, soybean, carrot, strawberry, lettuce, oak, maple, walnut, rose, mint, squash, daisy, geranium and cactus.

In another embodiment, the polypeptide is capable of upregulating or downregulating the expression of a gene in a plant.

In another embodiment, the gene is endogenous to the plant genome.

In another embodiment, the phenotype of a plant which expresses the isolated polynucleotide in at least one cell, is different from the phenotype of a plant of the same species that does not express the isolated polynucleotide in any of its cells.

In another embodiment, the phenotype of the plant expressing the isolated polynucleotide comprises a difference in lignin quality compared to a plant of the same species that does not express the isolated polynucleotide.

In another embodiment, the difference in lignin quality is characterized by change in the structure of the lignin molecule.

In another embodiment, the phenotype of the plant expressing the isolated polynucleotide comprises a difference in wood composition compared to a plant of the same species that does not express the isolated polynucleotide.

In another embodiment, the phenotype of the plant expressing the isolated polynucleotide comprises a difference in fiber composition compared to a plant of the same species that does not express the isolated polynucleotide.

In another embodiment, the phenotype of the plant expressing the isolated polynucleotide comprises a difference in plant cell division compared to a plant of the same species that does not express the isolated polynucleotide.

In another embodiment, the phenotype of the plant expressing the isolated polynucleotide comprises a difference in plant cell development compared to a plant of the same species that does not express the isolated polynucleotide.

In another aspect, the invention provides the isolated polynucleotide comprising the sequence of any one of SEQ ID NOs. 1-494, 496-820, 1641-1972, 3588-3592 or variant thereof.

In one embodiment, the variant encodes a polypeptide that is capable of at least one of (i) binding to a nucleic acid molecule or (ii) regulating expression of a gene in a plant.

In another aspect, the invention provides a plant transcription factor comprising the amino acid sequence of any one of SEQ ID NOs. 821-1640, 1973-2304, 3593-3666 or variant thereof, wherein said transcription factor is capable of at least one of (i) binding to a nucleic acid molecule or (ii) regulating expression of a gene in a plant.

In one embodiment, the variant has a sequence identity that is greater than or equal to 99%, 98%, 97%, 96%, 95%, 94%, 93%, 92%, 91%, 90%, 89%, 88%, 87%, 86%, 85%, 84%, 83%, 82%, 81%, 80%, 79%, 78%, 77%, 76%, 75%, 74%, 73%, 72%, 71%, 70%, 69%, 68%, 67%, 66%, 65%, 64%, 63%, 62%, 61%, or 60% in sequence to any one of SEQ ID NOs. 1-494, 496-820, 1641-1972, 3588-3592.

In one embodiment, the variant has a sequence identity that is greater than or equal to 99%, 98%, 97%, 96%, 95%, 94%, 93%, 92%, 91%, 90%, 89%, 88%, 87%, 86%, 85%, 84%, 83%, 82%, 81%, 80%, 79%, 78%, 77%, 76%, 75%, 74%, 73%, 72%, 71%, 70%, 69%, 68%, 67%, 66%, 65%, 64%, 63%, 62%, 61%, or 60% in sequence to any one of SEQ ID NOs. 821-1640, 1973-2304, 3593-3666.

In another aspect, the invention provides a DNA construct comprising (i) at least one polynucleotide that has the sequence of any one of SEQ ID NOs. 1-494, 496-820, 1641-1972, 3588-3592 (ii) a promoter, and (iii) a desired nucleic acid, wherein said polynucleotide encodes a plant transcription factor that regulates the activity of said promoter, and wherein said promoter and said desired gene are operably linked.

In another aspect, the invention provides a DNA construct comprising (i) at least one polynucleotide that has the sequence of any one of SEQ ID NOs. 1-494, 496-820, 1641-1972, 3588-3592, (ii) a first promoter, (iii) a second promoter, and (iv) a desired nucleic acid, wherein (a) said polynucleotide encodes a plant transcription factor that regulates the activity of said second promoter, (b) said second promoter and said desired nucleic acid are operably linked, and (c) said polynucleotide is operably linked to and expressed by said first promoter.

In another aspect, the invention provides a DNA construct comprising (i) at least one polynucleotide that has the sequence of any one of SEQ ID NOs. 1-494, 496-820, 1641-1972, 3588-3592 and (ii) a promoter, wherein (a) said polynucleotide encodes a plant transcription factor that regulates the activity of a promoter that is endogenous to a plant cell, and (b) said promoter and said polynucleotide are operably linked.

In one embodiment, the promoter is selected from the group consisting of a constitutive promoter, a strong promoter, or an inducible promoter.

In another embodiment, the promoter is a regulatable promoter.

In another embodiment, the promoter is sensitive to temperature.

In another embodiment, the regulatable promoter is regulated by any one of auxin, ethylene, abscisic acid, wounding, methyl jasmonate or gibberellic acid.

In another embodiment, the promoter is under temporal regulation.

In another embodiment, wherein the promoter is a tissue-specific promoter.

In another embodiment, the promoter is a vascular-preferred promoter.

In another embodiment, the promoter is selected from the group consisting of the nucleic acid sequence identified in any one of SEQ ID NO: 1642 to 1643.

In another embodiment, the desired nucleic acid is a gene.

In another embodiment, the desired nucleic acid is a gene.

In another embodiment, the desired nucleic acid produces an RNA transcript.

In another embodiment, the RNA transcript has an antisense sequence of a gene that is endogenous to a plant cell.

In another embodiment, the RNA transcript induces RNA interference of a gene that is normally expressed in a plant cell.

In another aspect, the invention provides a plant cell comprising a DNA construct that comprises (i) at least one polynucleotide that has the sequence of any one of SEQ ID NOs. 1-494, 496-820, 1641-1972, 3588-3592 (ii) a promoter, and (iii) a desired nucleic acid, wherein said polynucleotide encodes a plant transcription factor that regulates the activity of said promoter, and wherein said promoter and said desired gene are operably linked.

In one embodiment, the invention provides a transgenic plant comprising the plant cell.

In another aspect, the invention provides a plant cell comprising a DNA construct comprising (i) at least one polynucleotide that has the sequence of any one of SEQ ID NOs.

1-494, 496-820, 1641-1972, 3588-3592 (ii) a first promoter, (iii) a second promoter, and (iv) a desired nucleic acid, wherein (a) said polynucleotide encodes a plant transcription factor that regulates the activity of said second promoter, (b) said second promoter and said desired gene are operably linked, and (c) said polynucleotide is operably linked to and expressed by said first promoter. In one embodiment, the invention provides a transgenic plant comprising the plant cell.

In another aspect, the invention provides a plant cell comprising a DNA construct comprising (i) at least one polynucleotide that has the sequence of any one of SEQ ID NOs. 1-494, 496-820, 1641-1972, 3588-3592 and (ii) a promoter, wherein (a) said polynucleotide encodes a plant transcription factor that regulates the activity of a promoter that is endogenous to a plant cell, and (b) said promoter and said polynucleotide are operably linked. In one embodiment, the invention provides a transgenic plant comprising the plant cell.

In another aspect, the invention provides an isolated polynucleotide comprising the sequence encoding the catalytic domain of any one of SEQ ID NOs. 821-1640, 1973-2304, 3593-3666, wherein said polynucleotide codes for a polypeptide that is capable of at least one of (i) binding to a nucleic acid molecule or (ii) regulating expression of a gene in a plant.

In another aspect, the invention provides a method for producing a transgenic plant, comprising (a) transforming a plant cell with a DNA construct that comprises (i) at least one polynucleotide that has the sequence of any one of SEQ ID NOs. 1-494, 496-820, 1641-1972, 3588-3592 (ii) a promoter, and (iii) a desired nucleic acid, wherein said polynucleotide encodes a plant transcription factor that regulates the activity of said promoter, and wherein said promoter and said desired gene are operably linked; (b) culturing said transformed plant cell under conditions that promote growth of a plant, wherein a polypeptide encoded by said polynucleotide and the product of said desired nucleic acid are both expressed in the plant cell, and wherein said plant is a transgenic plant that exhibits a phenotype that is different from a plant of the same species that does not contain said DNA construct. In one embodiment, the plant cell is located within a plant explant tissue.

In another embodiment, the phenotype of the plant expressing the polynucleotide and the desired nucleic acid is characterized by a difference in lignin quality compared to a plant of the same species that does not contain the DNA construct.

In another embodiment, the difference in lignin quality is characterized by change in the structure of the lignin molecule.

In another embodiment, the phenotype of the plant expressing the polynucleotide and the desired nucleic acid is characterized by a difference in wood composition compared to a plant of the same species that does not contain the DNA construct.

In another embodiment, the phenotype of the plant expressing the polynucleotide and the desired nucleic acid is characterized by a difference in fiber yield compared to a plant of the same species that does not contain the DNA construct.

In another embodiment, the phenotype of the plant expressing the polynucleotide and the desired nucleic acid is characterized by a difference in plant cell division compared to a plant of the same species that does not contain the DNA construct.

In another embodiment, the phenotype of the plant expressing the polynucleotide and the desired nucleic acid is characterized by a difference in plant cell development compared to a plant of the same species that does not contain the DNA construct.

In another embodiment, the phenotype of the plant expressing the polynucleotide and the desired nucleic acid is characterized by a difference in any one of flower color, petal shape, petal size, aroma, leaf shape, leaf size, or plant height compared to a plant of the same species that does not contain the DNA construct.

In one embodiment, the desired nucleic acid is a gene.

In another aspect, the present invention provides a method for producing a transgenic plant, comprising (a) transforming a plant cell with a DNA construct that comprises (i) at least one polynucleotide that has the sequence of any one of SEQ ID NOs. 1-494, 496-820, 1641-1972, 3588-3592 and (ii) a promoter, wherein said polynucleotide and said promoter are operably linked; and (b) culturing said transformed plant cell under conditions that promote growth of a plant, wherein the polynucleotide encodes a polypeptide that is capable of at least one of binding to a part of the genome of the plant cell or regulating expression of a gene in the plant cell genome, wherein said plant is a transgenic plant that exhibits a phenotype that is different from a plant of the same species that does not contain said DNA construct.

In one embodiment, the phenotype of the plant expressing the polynucleotide and the desired nucleic acid is characterized by a difference in lignin quality compared to a plant of the same species that does not contain the DNA construct.

In another embodiment, the difference in lignin quality is characterized by change in the structure of the lignin molecule.

In another embodiment, the phenotype of the plant expressing the polynucleotide and the desired nucleic acid is characterized by a difference in wood composition compared to a plant of the same species that does not contain the DNA construct.

In another embodiment, the phenotype of the plant expressing the polynucleotide and the desired nucleic acid is characterized by a difference in fiber yield compared to a plant of the same species that does not contain the DNA construct.

In another embodiment, the phenotype of the plant expressing the polynucleotide and the desired nucleic acid is characterized by a difference in plant cell division compared to a plant of the same species that does not contain the DNA construct.

In another embodiment, the phenotype of the plant expressing the polynucleotide and the desired nucleic acid is characterized by a difference in plant cell development compared to a plant of the same species that does not contain the DNA construct.

In another embodiment, the phenotype of the plant expressing the polynucleotide and the desired nucleic acid is characterized by a difference in any one of flower color, petal shape, petal size, aroma, leaf shape, leaf size, or plant height compared to a plant of the same species that does not contain the DNA construct.

In another embodiment, the desired nucleic acid is a gene.

In one aspect, the invention provides a method for screening for a promoter that can be regulated by a plant transcription factor, comprising (a) expressing in a plant cell a DNA construct that comprises (i) at least one polynucleotide that has the sequence of any one of SEQ ID NOs. 1-494, 496-820, 1641-1972, 3588-3592 (ii) a constitutive promoter, (iii) a candidate promoter, and (iv) a reporter gene, wherein said polynucleotide encodes a plant transcription factor, wherein said candidate promoter and said reporter gene are operably linked, and wherein said polynucleotide is operably linked to and expressed by said constitutive promoter; (b) detecting the level of expression of said reporter gene; and (c) comparing the level of expression of said reporter gene with the level of expression of a second reporter gene from a plant cell that contains a DNA construct comprising said candidate promoter operably linked to said second reporter gene.

In another aspect, the invention provides a wood pulp obtained from a transgenic tree that expresses a transcription factor comprising the amino acid sequence of any one of SEQ ID NOs. 822-1640, 3593-3596.

In another aspect, the invention provides a transgenic plant that expresses a transcription factor comprising the amino acid sequence of any one of SEQ ID NOs. 822-1640, 3593-3596 and wherein the transcription factor confers a trait to the plant selected from the group consisting of increased drought tolerance, reduced or increased height, reduced or increased branching, enhanced cold and frost tolerance, improved vigor, enhanced color, enhanced health and nutritional characteristics, improved storage, enhanced yield, enhanced salt tolerance, enhanced heavy metal tolerance, increased disease tolerance, increased insect tolerance, increased water-stress tolerance, enhanced sweetness, improved taste, improved texture, decreased phosphate content, increased germination, increased micronutrient uptake, improved starch composition, improved flower longevity, and production of novel proteins or peptides.

In another aspect, the invention provides a transgenic plant expressing a transcription factor comprising the amino acid sequence of any one of SEQ ID NOs. 822-1640, 3593-3596, wherein said plant has a reduced or increased period of juvenality compared to a wild-type plant of the same species.

In another aspect, the invention provides a transgenic plant expressing a transcription factor comprising the amino acid sequence of any one of SEQ ID NOs. 822-1640, 3593-3596, wherein said plant has self-absicing branches.

In another aspect, the invention provides a transgenic plant expressing a transcription factor comprising the amino acid sequence of any one of SEQ ID NOs. 822-1640, 3593-3596, wherein said plant has accelerated or delayed reproductive development compared with a wild-type plant of the same species.

In another aspect, the invention provides an isolated nucleotide sequence having the nucleotide sequence of any of SEQ ID NO. 1-494, 496-820, 1641-1972, 3588-3592 and nucleotide sequences having 60% sequence identity with the nucleotide sequence of SEQ ID NO: 1-494, 496-820, 1641-1972, 3588-3592 and which bind DNA.

In another aspect, the invention provides an isolated nucleotide sequence having the nucleotide sequence of any of SEQ ID NO: 1-494, 496-820, 1641-1972, 3588-3592 and nucleotide sequences having 65% sequence identity with any of the nucleotide sequences of SEQ ID NO: 1-494, 496-820, 1641-1972, 3588-3592 and which are involved in transcription.

In another aspect, the invention provides an isolated nucleotide sequence having the nucleotide sequence of any of SEQ ID NO: 1-494, 496-820, 1641-1972, 3588-3592 and nucleotide sequences having 70% sequence identity with any of the nucleotide sequences of SEQ ID NO: 1-494, 496-820, 1641-1972, 3588-3592 and which regulate expression of a gene in a plant.

In another aspect, the invention provides an isolated nucleotide sequence having the nucleotide sequence of any of SEQ ID NO: 1-494, 496-820, 1641-1972, 3588-3592 and nucleotide sequences having 75% sequence identity with any of the nucleotide sequences of SEQ ID NO: 1-494, 496-820, 1641-1972, 3588-3592 and which encode a DNA-binding protein.

In another aspect, the invention provides an isolated nucleotide sequence having the nucleotide sequence of any of SEQ ID NO: 1-494, 496-820, 1641-1972, 3588-3592 and nucleotide sequences having 80% identity with any of SEQ ID NO: 1-494, 496-820, 1641-1972, 3588-3592 and which mediate transcription of a gene in a plant.

In another aspect, the invention provides an isolated nucleotide sequence having the nucleotide sequence of any of SEQ ID NO: 1-494, 496-820, 1641-1972, 3588-3592 and nucleotide sequences having 85% identity with any of SEQ ID NO: 1-494, 496-820, 1641-1972, 3588-3592 and which bind DNA.

In another aspect, the invention provides an isolated nucleotide sequence having the nucleotide sequence of any of SEQ ID NO: 1-494, 496-820, 1641-1972, 3588-3592 and nucleotide sequences having 90% identity with any of SEQ ID NO: 1-494, 496-820, 1641-1972, 3588-3592 and which regulate expression of a gene in a plant.

In another aspect, the invention provides an isolated nucleotide sequence having the nucleotide sequence of any of SEQ ID NO: 181-188 and nucleotide sequences having 79% identity with any of SEQ ID NO: 181-188 and which are involved in gene transcription.

In another aspect, the invention provides a method of correlating polynucleotide expression in two different samples, comprising:
  detecting a level of expression of one or more polynucleotides encoding a product encoded by a nucleic acid sequence selected from the group consisting of SEQ ID NOs: 1-494, 496-820, 1641-1972, 3588-3592 and conservative variants thereof in a first sample;
  detecting a level of expression of the one or more polynucleotides in a second sample;
  comparing the level of expression of the one or more polynucleotides in the first sample to the level of expression of the one or more polynucleotides in the second sample; and
  correlating a difference in expression level of the one or more polynucleotides between the first and second samples.

In one embodiment, the first sample and the second sample are each from a different type of plant tissue.

In another embodiment, the first sample and the second sample are from the same tissue, and wherein the first sample and the second sample are each harvested during a different season of the year.

In another embodiment, the first sample and the second sample are obtained from plants in different stages of development.

In another aspect, the invention provides a method of correlating the possession of a plant phenotype to the level of polynucletide expression in the plant of one or more polynucleotides comprising:
  detecting a level of expression of one or more polynucleotides encoding a product encoded by a nucleic acid sequence selected from the group consisting of SEQ ID NOs: 1-494, 496-820, 1641-1972, 3588-3592 and conservative variants thereof in a first plant possessing a phenotype;
  detecting a level of expression of the one or more polynucleotides in a second plant lacking the phenotype;
  comparing the level of expression of the one or more polynucleotides in the first plant to the level of expression of the one or more polynucleotides in the second plant; and
  correlating a difference in expression level of the one or more polynucleotides between the first and second plants to possession of the phenotype.

In one embodiment, the first and second samples are both obtained from a plant tissue selected from the group consisting of vascular tissue, apical meristem, vascular cambium, xylem, phloem, root, flower, cone, fruit, and seed.

In one embodiment, the plant tissue of the first sample and second sample are each obtained from a different type of tissue.

In another embodiment, the first and second samples are each obtained from a plant tissue in a different stage of development.

In another embodiment, both the first and second plants or plant cells are of a same species selected from *Eucalyptus* and *Pinus* species.

In yet another embodiment, the first and second plants or plant cells are of a species selected from *Eucalyptus grandis* or *Pinus radiata*.

In yet another embodiment, the step of detecting is effected using one or more polynucleotides capable of hybridizing to a nucleic acid sequence selected from the group consisting of SEQ ID NOs: 1-494, 496-820, 1641-1972, 3588-3592 under standard hybridization conditions.

In yet another embodiment, the step of detecting is effected using one or more polynucleotides capable of hybridizing to a polynucleotide expression product encoded by a nucleic acid sequence selected from the group consisting of SEQ ID NOs: 1-494, 496-820, 1641-1972, 3588-3592 under standard hybridization conditions.

In another embodiment, the detecting is effected by hybridization to a labeled nucleic acid.

In yet another embodiment, one or more polynucleotides are labeled with a detectable label.

In yet another embodiment, at least one of the one or more polynucleotides hybridizes to a 3' untranslated region of one of the one or more polynucleotides.

In another embodiment, one of the one or more polynucleotides hybridizes to the 3' untranslated region of one of the one or more polynucleotides.

In another embodiment, one or more polynucleotides comprises a nucleic acid sequence selected from the group consisting of SEQ ID NOs: 1-494, 496-820, 1641-1972, 3588-3592.

In another embodiment, one or more polynucleotides comprises a nucleic acid sequence selected from the group consisting of SEQ ID NOs: 2742-3587.

In another embodiment, one or more polynucleotides is selected from the group consisting of DNA and RNA.

In another embodiment, one or more polynucleotides is selected from the group consisting of DNA and RNA.

In another embodiment, prior to the detecting steps, the step of amplifying the one or more polynucleotides in the first and second plant or plant cells.

In another embodiment, further comprising, prior to the detecting steps, the step of labeling the one or more polynucleotides in the first and second plant or plant cells with a detectable label.

In another aspect, the invention provides a combination for detecting expression of one or more polynucleotides, comprising two or more oligonucleotides, wherein each oligonucleotide is capable of hybridizing to a nucleic acid sequence selected from the group consisting of SEQ ID NOs: 1-494, 496-820, 1641-1972, 3588-3592.

In another aspect, the invention provides a combination for detecting expression of one or more polynucleotides, comprising two or more oligonucleotides, wherein each oligonucleotide is capable of hybridizing to a polynucleotide expression product encoded by a nucleic acid sequence selected from the group consisting of SEQ ID NOs: 1-494, 496-820, 1641-1972, 3588-3592.

In another embodiment, the invention provides two or more oligonucleotides hybridizes to a different one of the nucleic acid sequences selected from the group consisting of SEQ ID NOs: 1-494, 496-820, 1641-1972, 3588-3592.

In another embodiment, two or more oligonucleotides hybridizes to a nucleotide sequence encoded by a different one of the nucleic acid sequences selected from the group consisting of SEQ ID NOs: 1-494, 496-820, 1641-1972, 3588-3592.

In another embodiment, at least one of the two or more oligonucleotides hybridizes to a 3' untranslated region of a nucleic acid sequence selected from the group consisting of SEQ ID NOs: 1-494, 496-820, 1641-1972, 3588-3592.

In another embodiment, at least one of the two or more oligonucleotides hybridizes to nucleic acid sequence that is complementary to a 3' untranslated region of a nucleic acid sequence selected from the group consisting of SEQ ID Nos: 1-494, 496-820, 1641-1972, 3588-3592.

In another embodiment, each of the two or more oligonucleotides are comprised of fewer than about 100 nucleotide bases.

In another embodiment, at least one of the two or more oligonucleotides comprises a nucleic acid sequence selected from the group consisting of SEQ ID NOs 1973-2304, 3593-3666.

In another embodiment, at least one of the two or more oligonucleotides comprises a nucleic acid sequence selected from the group consisting of SEQ ID NOs 1973-2304, 3593-3666.

In another embodiment, each of the two or more oligonucleotides hybridizes to a gene encoding a protein selected from the group consisting of AB13/VP1, Alfin-like, AP2-EREBP, ARF, ARID, AUX/IAA, bHLH, bZIP, C2C2 (Zn), C2C2 (Co-like), C2C2 (Dof), C2C2 (GATA), C2C2 (YABBY), C2H2 (Zn), C3H-type, CCAAT, CCAAT DR1, CCAAT HAP2, CCAAT HAP3, CCP (Zn), E2F/DP, EIL, GARP, GRAS, HMB-BOX, HOMEO BOX, HSF, Jumonji, LIM, MADS Box (SEQ ID NO: 3668), MYB, NAC, NIN-like, RAV-like, SBP, TCP, trihelix, TUBBY, and WRKY (SEQ ID NO: 3670).

In another embodiment, each of the two or more oligonucleotides hybridizes to a nucleic acid sequence encoded by a gene encoding a protein selected from the group consisting of AB13/VP1, Alfin-like, AP2-EREBP, ARF, ARID, AUX/IAA, bHLH, bZIP, C2C2 (Zn), C2C2 (Co-like), C2C2 (Dof), C2C2 (GATA), C2C2 (YABBY), C2H2 (Zn), C3H-type, CCAAT, CCAAT DR1, CCAAT HAP2, CCAAT HAP3, CCP (Zn), E2F/DP, EIL, GARP, GRAS, HMB-BOX, HOMEO BOX (SEQ ID NO: 3668), HSF, Jumonji, LIM, MADS Box, MYB, NAC, NIN-like, RAV-like, SBP, TCP, trihelix, TUBBY, and WRKY (SEQ ID NO: 3670).

In another embodiment, each of the two or more oligonucleotides hybridizes to a gene encoding a different one of the proteins.

In another embodiment, each of the two or more oligonucleotides hybridizes to a nucleic acid sequence encoded by a gene encoding a different one of the proteins.

In another embodiment, each of the two or more oligonucleotides hybridizes to a different gene.

In another embodiment, each of the two or more oligonucleotides hybridizes to a nucleic acid sequence encoded by a different gene.

In another embodiment, the combination comprises from about 2 to about 5000 of the two or more oligonucleotides.

In another embodiment, each of the two or more oligonucleotides is labeled with a detectable label.

In another embodiment, the invention provides a microarray comprising the combination of any one of claims 69-85 provided on a solid support, wherein each of said two or more oligonucleotides occupies a unique location on said solid support.

In another aspect, the invention proviA method for detecting one or more polynucleotides in a sample, comprising:
- contacting the sample with two or more oligonucleotides, wherein each oligonucleotide is capable of hybridizing to a gene comprising a nucleic acid sequence selected from the group consisting of SEQ ID NOs: 1-494, 496-820, 1641-1972, 3588-3592 under standard hybridization conditions; and
- detecting the one or more polynucleotides of interest which are hybridized to the one or more oligonucleotides.

In another aspect, the present invention provides a method for detecting one or more nucleic acid sequences encoded by one or more polynucleotides in a sample, comprising:
- contacting the sample with two or more oligonucleotides, wherein each oligonucleotide is capable of hybridizing to a nucleic acid sequence encoded by a gene comprising a nucleic acid sequence selected from the group consisting of SEQ ID NOs: 1-494, 496-820, 1641-1972, 3588-3592 under standard hybridization conditions; and
- detecting the one or more nucleic acid sequences which are hybridized to the one or more oligonucleotides.

In another embodiment, each of the two or more oligonucleotides hybridizes to a gene comprising a different one of the nucleic acid sequences selected from the group consisting of SEQ ID NOs: 1-494, 496-820, 1641-1972, 3588-3592.

In another embodiment, each of the two or more oligonucleotides hybridizes to a nucleic acid sequence encoded by a gene comprising a different one of the nucleic acid sequences selected from the group consisting of SEQ ID Nos 1-494, 496-820, 1641-1972, 3588-3592.

In another embodiment, at least one of the two or more oligonucleotides hybridizes to a 3' untranslated region of a gene comprising a nucleic acid sequence selected from the group consisting of SEQ ID NOs 1-494, 496-820, 1641-1972, 3588-3592.

In another embodiment, at least one of the two or more oligonucleotides hybridizes to a nucleic acid sequence that is complementary to a 3' untranslated region of a gene comprising a nucleic acid sequence selected from the group consisting of SEQ ID Nos 1-494, 496-820, 1641-1972, 3588-3592.

In another embodiment, each of the two or more oligonucleotides are comprised of fewer than about 100 nucleotide bases.

In another embodiment, at least one of the two or more oligonucleotides comprises a nucleic acid sequence selected from the group consisting of SEQ ID Nos 1973-2304, 3593-3666.

In another embodiment, at least one of the two or more oligonucleotides comprises a nucleic acid sequence selected from the group consisting of SEQ ID NOs 1973-2304, 3593-3666.

In another embodiment, each of the two or more oligonucleotides hybridizes to a gene encoding a protein selected from the group consisting of AB13/VP1, Alfin-like, AP2-EREBP, ARF, ARID, AUX/IAA, bHLH, bZIP, C2C2 (Zn), C2C2 (Co-like), C2C2 (Dof), C2C2 (GATA), C2C2 (YABBY), C2H2 (Zn), C3H-type, CCAAT, CCAAT DR1, CCAAT HAP2, CCAAT HAP3, CCP (Zn), E2F/DP, EIL, GARP, GRAS, HMB-BOX, HOMEO BOX, HSF, Jumonji, LIM, MADS Box (SEQ ID NO: 3668), MYB, NAC, NIN-like, RAV-like, SBP, TCP, trihelix, TUBBY, and WRKY (SEQ ID NO: 3670).

In another embodiment, each of the two or more oligonucleotides hybridizes to a nucleic acid sequence encoded by a gene encoding a protein selected from the group consisting of AB 13/VP1, Alfin-like, AP2-EREBP, ARF, ARID, AUX/IAA, bHLH, bZIP, C2C2 (Zn), C2C2 (Co-like), C2C2 (Dof), C2C2 (GATA), C2C2 (YABBY), C2H2 (Zn), C3H-type, CCAAT, CCAAT DR1, CCAAT HAP2, CCAAT HAP3, CCP (Zn), E2F/DP, EIL, GARP, GRAS, HMB-BOX, HOMEO BOX, HSF, Jumonji, LIM, MADS Box (SEQ ID NO: 3668), MYB, NAC, NIN-like, RAV-like, SBP, TCP, trihelix, TUBBY, and WRKY (SEQ ID NO: 3670).

In another embodiment, each of the two or more oligonucleotides hybridizes to a gene encoding a different one of the proteins.

In another embodiment, each of the two or more oligonucleotides hybridizes to a nucleic acid sequence encoded by a gene encoding a different one of the proteins.

In another embodiment, two or more oligonucleotides are provided on a solid support, wherein each of the two of more oligonucleotides occupy a unique location on the solid support.

In another embodiment, the solid support comprises from about 2 to about 5000 of the two or more oligonucleotides.

In another embodiment, further comprising, prior to the contacting step, the step of amplifying the one or more polynucleotides or nucleic acid sequences in the sample.

In another embodiment, further comprising, prior to the contacting step, the step of labeling the one or more polynucleotides or nucleic acid sequences in the sample with a detectable label.

In another embodiment, the invention provides a kit for detecting gene expression comprising the microarray with one or more buffers or reagents for a nucleotide hybridization reaction.

The above-mentioned and additional features of the present invention and the manner of obtaining them will become apparent, and the invention will be best understood by reference to the following more detailed description. All references disclosed herein are hereby incorporated by reference in their entirety as if each was incorporated individually.

BRIEF DESCRIPTION OF THE DRAWINGS

FIG. 1. Amino acid sequence of SEQ ID NO: 821. The conserved Transcriptional factor B3 domain identified using InterProScan is underlined.

FIG. 2. Amino acid sequence of SEQ ID NO: 822. The conserved Zn-finger-like, PHD finger domain identified using InterProScan is underlined.

FIG. 3. Amino acid sequence of SEQ ID NO: 823. The conserved Zn-finger-like, PHD finger domain identified using InterProScan is underlined.

FIG. 4. Amino acid sequence of SEQ ID NO: 3598. The conserved Zn-finger-like, PHD finger domain identified using InterProScan is underlined.

FIG. 5. Amino acid sequence of SEQ ID NO: 825. The conserved Zn-finger-like, PHD finger domain identified using InterProScan is underlined.

FIG. 6. Amino acid sequence of SEQ ID NO: 826. The conserved Zn-finger-like, PHD finger domain identified using InterProScan is underlined.

FIG. 7. Amino acid sequence of SEQ ID NO: 827. The conserved Zn-finger-like, PHD finger domain identified using InterProScan is underlined.

FIG. 8. Amino acid sequence of SEQ ID NO: 828. The conserved AP2 domain identified using InterProScan is underlined.

FIG. 9. Amino acid sequence of SEQ ID NO: 829. The conserved AP2 domain identified using InterProScan is underlined.

FIG. 10. Amino acid sequence of SEQ ID NO: 830. The conserved AP2 domain identified using InterProScan is underlined.

FIG. 11. Amino acid sequence of SEQ ID NO: 831. The conserved AP2 domain identified using InterProScan is underlined.

FIG. 12. Amino acid sequence of SEQ ID NO: 833. The conserved AP2 domain identified using InterProScan is underlined.

FIG. 13. Amino acid sequence of SEQ ID NO: 836. The conserved AP2 domain identified using InterProScan is underlined.

FIG. 14. Amino acid sequence of SEQ ID NO: 837. The conserved AP2 domain identified using InterProScan is underlined.

FIG. 15. Amino acid sequence of SEQ ID NO: 838. The conserved AP2 domain identified using InterProScan is underlined.

FIG. 16. Amino acid sequence of SEQ ID NO: 840. The conserved AP2 domain identified using InterProScan is underlined.

FIG. 17. Amino acid sequence of SEQ ID NO: 842. The conserved AP2 domain identified using InterProScan is underlined.

FIG. 18. Amino acid sequence of SEQ ID NO: 844. The conserved AP2 domain identified using InterProScan is underlined.

FIG. 19. Amino acid sequence of SEQ ID NO: 846. The conserved AP2 domain identified using InterProScan is underlined.

FIG. 20. Amino acid sequence of SEQ ID NO: 847. The conserved AP2 domain identified using InterProScan is underlined.

FIG. 21. Amino acid sequence of SEQ ID NO: 848. The conserved Transcriptional factor B3 domain identified using InterProScan is underlined.

FIG. 22. Amino acid sequence of SEQ ID NO: 849. The conserved AP2 domain identified using InterProScan is underlined.

FIG. 23. Amino acid sequence of SEQ ID NO: 850. The conserved AP2 domain identified using InterProScan is underlined.

FIG. 24. Amino acid sequence of SEQ ID NO: 851. The conserved AP2 domain identified using InterProScan is underlined.

FIG. 25. Amino acid sequence of SEQ ID NO: 852. The conserved AP2 domain identified using InterProScan is underlined.

FIG. 26. Amino acid sequence of SEQ ID NO: 853. The conserved AP2 domain identified using InterProScan is underlined.

FIG. 27. Amino acid sequence of SEQ ID NO: 854. The conserved AP2 domain identified using InterProScan is underlined.

FIG. 28. Amino acid sequence of SEQ ID NO: 855. The conserved AP2 domain identified using InterProScan is underlined.

FIG. 29. Amino acid sequence of SEQ ID NO: 856. The conserved AP2 domain identified using InterProScan is underlined.

FIG. 30. Amino acid sequence of SEQ ID NO: 857. The conserved AP2 domains identified using InterProScan are underlined.

FIG. 31. Amino acid sequence of SEQ ID NO: 868. The conserved ARID and HMG domains identified using InterProScan are underlined.

FIG. 32. Amino acid sequence of SEQ ID NO: 869. The conserved AUX_IAA domain identified using InterProScan is underlined.

FIG. 33. Amino acid sequence of SEQ ID NO: 870. The conserved AUX_IAA domain identified using InterProScan is underlined.

FIG. 34. Amino acid sequence of SEQ ID NO: 871. The conserved AUX_IAA domain identified using InterProScan is underlined.

FIG. 35. Amino acid sequence of SEQ ID NO: 872. The conserved AUX_IAA domain identified using InterProScan is underlined.

FIG. 36. Amino acid sequence of SEQ ID NO: 873. The conserved AUX_IAA domain identified using InterProScan is underlined.

FIG. 37. Amino acid sequence of SEQ ID NO: 874. The conserved AUX_IAA domain identified using InterProScan is underlined.

FIG. 38. Amino acid sequence of SEQ ID NO: 875. The conserved AUX_IAA domain identified using InterProScan is underlined.

FIG. 39. Amino acid sequence of SEQ ID NO: 876. The conserved AUX_IAA domain identified using InterProScan is underlined.

FIG. 40. Amino acid sequence of SEQ ID NO: 877. The conserved AUX_IAA domain identified using InterProScan is underlined.

FIG. 41. Amino acid sequence of SEQ ID NO: 878. The conserved AUX_IAA domain identified using InterProScan is underlined.

FIG. 42. Amino acid sequence of SEQ ID NO: 879 and 880. The conserved AUX_IAA domain identified using InterProScan is underlined.

FIG. 43. Amino acid sequence of SEQ ID NO: 881. The conserved Basic helix-loop-helix dimerization domain bHLH identified using InterProScan is underlined.

FIG. 44. Amino acid sequence of SEQ ID NO: 882. The conserved Basic helix-loop-helix dimerization domain bHLH identified using InterProScan is underlined.

FIG. 45. Amino acid sequence of SEQ ID NO: 883. The conserved Basic helix-loop-helix dimerization domain bHLH identified using InterProScan is underlined.

FIG. 46. Amino acid sequence of SEQ ID NO: 884. The conserved Basic helix-loop-helix dimerization domain bHLH identified using InterProScan is underlined.

FIG. 47. Amino acid sequence of SEQ ID NO: 3599. The conserved Basic helix-loop-helix dimerization domain bHLH identified using InterProScan is underlined.

FIG. 48. Amino acid sequence of SEQ ID NO: 886. The conserved Basic helix-loop-helix dimerization domain bHLH identified using InterProScan is underlined FIG. 49. Amino acid sequence of SEQ ID NO: 887. The conserved Basic helix-loop-helix dimerization domain bHLH identified using InterProScan is underlined.

FIG. 50. Amino acid sequence of SEQ ID NO: 888. The conserved Basic helix-loop-helix dimerization domain bHLH identified using InterProScan is underlined.

FIG. 51. Amino acid sequence of SEQ ID NO: 889. The conserved Basic helix-loop-helix dimerization domain bHLH identified using InterProScan is underlined.

FIG. 52. Amino acid sequence of SEQ ID NO: 890. The conserved Basic helix-loop-helix dimerization domain bHLH identified using InterProScan is underlined.

FIG. 53. Amino acid sequence of SEQ ID NO: 891. The conserved Basic helix-loop-helix dimerization domain bHLH identified using InterProScan is underlined.

FIG. 54. Amino acid sequence of SEQ ID NO: 892. The conserved Basic helix-loop-helix dimerization domain bHLH identified using InterProScan is underlined.

FIG. 55. Amino acid sequence of SEQ ID NO: 893. The conserved Basic helix-loop-helix dimerization domain bHLH identified using InterProScan is underlined.

FIG. 56. Amino acid sequence of SEQ ID NO: 894. The conserved Basic helix-loop-helix dimerization domain bHLH identified using InterProScan is underlined.

FIG. 57. Amino acid sequence of SEQ ID NO: 895. The conserved Basic helix-loop-helix dimerization domain bHLH identified using InterProScan is underlined.

FIG. 58. Amino acid sequence of SEQ ID NO: 897. The conserved Basic helix-loop-helix dimerization domain bHLH identified using InterProScan is underlined.

FIG. 59. Amino acid sequence of SEQ ID NO: 898. The conserved Basic helix-loop-helix dimerization domain bHLH identified using InterProScan is underlined.

FIG. 60. Amino acid sequence of SEQ ID NO: 899. The conserved Basic helix-loop-helix dimerization domain bHLH identified using InterProScan is underlined.

FIG. 61. Amino acid sequence of SEQ ID NO: 904. The conserved Basic helix-loop-helix dimerization domain bHLH identified using InterProScan is underlined.

FIG. 62. Amino acid sequence of SEQ ID NO: 905. The conserved bZIP domain identified using InterProScan is underlined.

FIG. 63. Amino acid sequence of SEQ ID NO: 906. The conserved Basic-leucine zipper (bZIP) domain identified using InterProScan is underlined.

FIG. 64. Amino acid sequence of SEQ ID NO: 907. The conserved Basic-leucine zipper (bZIP) domain identified using InterProScan is underlined.

FIG. 65. Amino acid sequence of SEQ ID NO: 908. The conserved bZIP domain identified using InterProScan is underlined.

FIG. 66. Amino acid sequence of SEQ ID NO: 909. The conserved Basic-leucine zipper (bZIP) transcription factor domain identified using InterProScan is underlined.

FIG. 67. Amino acid sequence of SEQ ID NO: 910. The conserved Basic-leucine zipper (bZIP) domain identified using InterProScan is underlined.

FIG. 68. Amino acid sequence of SEQ ID NO: 914. The conserved bZIP domain identified using InterProScan is underlined.

FIG. 69. Amino acid sequence of SEQ ID NO: 3600. The conserved Basic-leucine zipper (bZIP) transcription factor domain identified using InterProScan is underlined.

FIG. 70. Amino acid sequence of SEQ ID NO: 920. The conserved Basic-leucine zipper (bZIP) transcription factor domain identified using InterProScan is underlined.

FIG. 71. Amino acid sequence of SEQ ID NO: 925. The conserved Basic-leucine zipper (bZIP) transcription factor domain identified using InterProScan is underlined.

FIG. 72. Amino acid sequence of SEQ ID NO: 930. The conserved Zn-finger, Dof type domain identified using InterProScan is underlined.

FIG. 73. Amino acid sequence of SEQ ID NO: 932. The conserved Zn-finger, CONSTANS type domains identified using InterProScan are underlined.

FIG. 74. Amino acid sequence of SEQ ID NO: 933. The conserved Zn-finger, Dof type domain identified using InterProScan is underlined.

FIG. 75. Amino acid sequence of SEQ ID NO: 934. The conserved Zn-finger, Dof type domain identified using InterProScan is underlined.

FIG. 76. Amino acid sequence of SEQ ID NO: 935. The conserved Zn-finger, CONSTANS type domain identified using InterProScan is underlined.

FIG. 77. Amino acid sequence of SEQ ID NO: 937. The conserved Zn-finger, Dof type domain identified using InterProScan is underlined.

FIG. 78. Amino acid sequence of SEQ ID NO: 938. The conserved Zn-finger, Dof type domain identified using InterProScan is underlined.

FIG. 79. Amino acid sequence of SEQ ID NO: 939. The conserved Zn-finger, Dof type domain identified using InterProScan is underlined.

FIG. 80. Amino acid sequence of SEQ ID NO: 942. The conserved Zn-finger, Dof type domain identified using InterProScan is underlined.

FIG. 81. Amino acid sequence of SEQ ID NO: 943. The conserved Zn-finger, Dof type domain identified using InterProScan is underlined.

FIG. 82. Amino acid sequence of SEQ ID NO: 944. The conserved Zn-finger, CONSTANS type domain identified using InterProScan is underlined.

FIG. 83. Amino acid sequence of SEQ ID NO: 945. The conserved Zn-finger, B-box domains identified using InterProScan are underlined.

FIG. 84. Amino acid sequence of SEQ ID NO: 3601. The conserved Zn-finger, CONSTANS type domain identified using InterProScan is underlined.

FIG. 85. Amino acid sequence of SEQ ID NO: 947. The conserved Zn-finger, CONSTANS type domain identified using InterProScan is underlined.

FIG. 86. Amino acid sequence of SEQ ID NO: 948. The conserved Zn-finger, CONSTANS type domain identified using InterProScan is underlined.

FIG. 87. Amino acid sequence of SEQ ID NO: 949. The conserved Zn-finger, CONSTANS type domain identified using InterProScan is underlined.

FIG. 88. Amino acid sequence of SEQ ID NO: 951. The conserved Zn-finger, CONSTANS type domain identified using InterProScan is underlined.

FIG. 89. Amino acid sequence of SEQ ID NO: 952. The conserved Zn-finger, CONSTANS type domain identified using InterProScan is underlined.

FIG. 90. Amino acid sequence of SEQ ID NO: 953. The conserved Zn-finger, CONSTANS type domain identified using InterProScan is underlined.

FIG. 91. Amino acid sequence of SEQ ID NO: 954. The conserved Zn-finger, CONSTANS type and domain identified using InterProScan is underlined.

FIG. 92. Amino acid sequence of SEQ ID NO: 955. The conserved Zn-finger, Dof type domain identified using InterProScan is underlined.

FIG. 93. Amino acid sequence of SEQ ID NO: 956. The conserved Zn-finger, Dof type domain identified using InterProScan is underlined.

FIG. 94. Amino acid sequence of SEQ ID NO: 957. The conserved Zn-finger, Dof type domain identified using InterProScan is underlined.

FIG. 95. Amino acid sequence of SEQ ID NO: 959. The conserved Zn-finger, GATA type domain identified using InterProScan is underlined.

FIG. 96. Amino acid sequence of SEQ ID NO: 960. The conserved Zn-finger, GATA type domain identified using InterProScan is underlined.

FIG. 97. Amino acid sequence of SEQ ID NO: 961. The conserved Zn-finger, GATA type domain identified using InterProScan is underlined.

FIG. 98. Amino acid sequence of SEQ ID NO: 962. The conserved Zn-finger, GATA type domain identified using InterProScan is underlined.

FIG. 99. Amino acid sequence of SEQ ID NO: 963. The conserved Zn-finger, GATA type domain identified using InterProScan is underlined.

FIG. 100. Amino acid sequence of SEQ ID NO: 964. The conserved Zn-finger, GATA type domain identified using InterProScan is underlined.

FIG. 101. Amino acid sequence of SEQ ID NO: 973. The conserved Zn-finger, C2H2 type domains identified using InterProScan are underlined.

FIG. 102. Amino acid sequence of SEQ ID NO: 974. The conserved Zn-finger, C2H2 type domains identified using InterProScan are underlined.

FIG. 103. Amino acid sequence of SEQ ID NO: 3602. The conserved Zn-finger, C2H2 type domains identified using InterProScan are underlined.

FIG. 104. Amino acid sequence of SEQ ID NO: 976. The conserved Zn-finger, C2H2 type domain identified using InterProScan is underlined.

FIG. 105. Amino acid sequence of SEQ ID NO: 977. The conserved Zn-finger, C2H2 type domain identified using InterProScan is underlined.

FIG. 106. Amino acid sequence of SEQ ID NO: 978. The conserved Zn-finger, C2H2 type domain identified using InterProScan is underlined.

FIG. 107. Amino acid sequence of SEQ ID NO: 979. The conserved Zn-finger, C2H2 type domains identified using InterProScan are underlined.

FIG. 108. Amino acid sequence of SEQ ID NO: 980. The conserved Zn-finger, C2H2 type domain identified using InterProScan is underlined.

FIG. 109. Amino acid sequence of SEQ ID NO: 981. The conserved Zn-finger, C2H2 type domain identified using InterProScan is underlined.

FIG. 110. Amino acid sequence of SEQ ID NO: 982. The conserved Zn-finger, C2H2 type domains identified using InterProScan are underlined.

FIG. 111. Amino acid sequence of SEQ ID NO: 983. The conserved Zn-finger, C2H2 type domain identified using InterProScan is underlined.

FIG. 112. Amino acid sequence of SEQ ID NO: 984. The conserved Zn-finger, C2H2 type domain identified using InterProScan is underlined.

FIG. 113. Amino acid sequence of SEQ ID NO: 985. The conserved Zn-finger, C2H2 type domain identified using InterProScan is underlined.

FIG. 114. Amino acid sequence of SEQ ID NO: 986. The conserved Zn-finger, C2H2 type domain identified using InterProScan is underlined.

FIG. 115. Amino acid sequence of SEQ ID NO: 987. The conserved Zn-finger, C2H2 type domain identified using InterProScan is underlined.

FIG. 116. Amino acid sequence of SEQ ID NO: 988. The conserved Zn-finger, C2H2 type domain identified using InterProScan is underlined.

FIG. 117. Amino acid sequence of SEQ ID NO: 989. The conserved Zn-finger, C2H2 type domain identified using InterProScan is underlined.

FIG. 118. Amino acid sequence of SEQ ID NO: 990. The conserved Zn-finger, C-x8-C-x5-C-x3-H (SEQ ID NO: 3667) type domain identified using InterProScan is underlined.

FIG. 119. Amino acid sequence of SEQ ID NO: 991. The 3 conserved Zn-finger, C-x8-C-x5-C-x3-H (SEQ ID NO: 3667) type domains identified using InterProScan are underlined.

FIG. 120. Amino acid sequence of SEQ ID NO: 992. The conserved Zn-finger, C-x8-C-x5-C-x3-H (SEQ ID NO: 3667) type domain identified using InterProScan is underlined.

Figure 599:
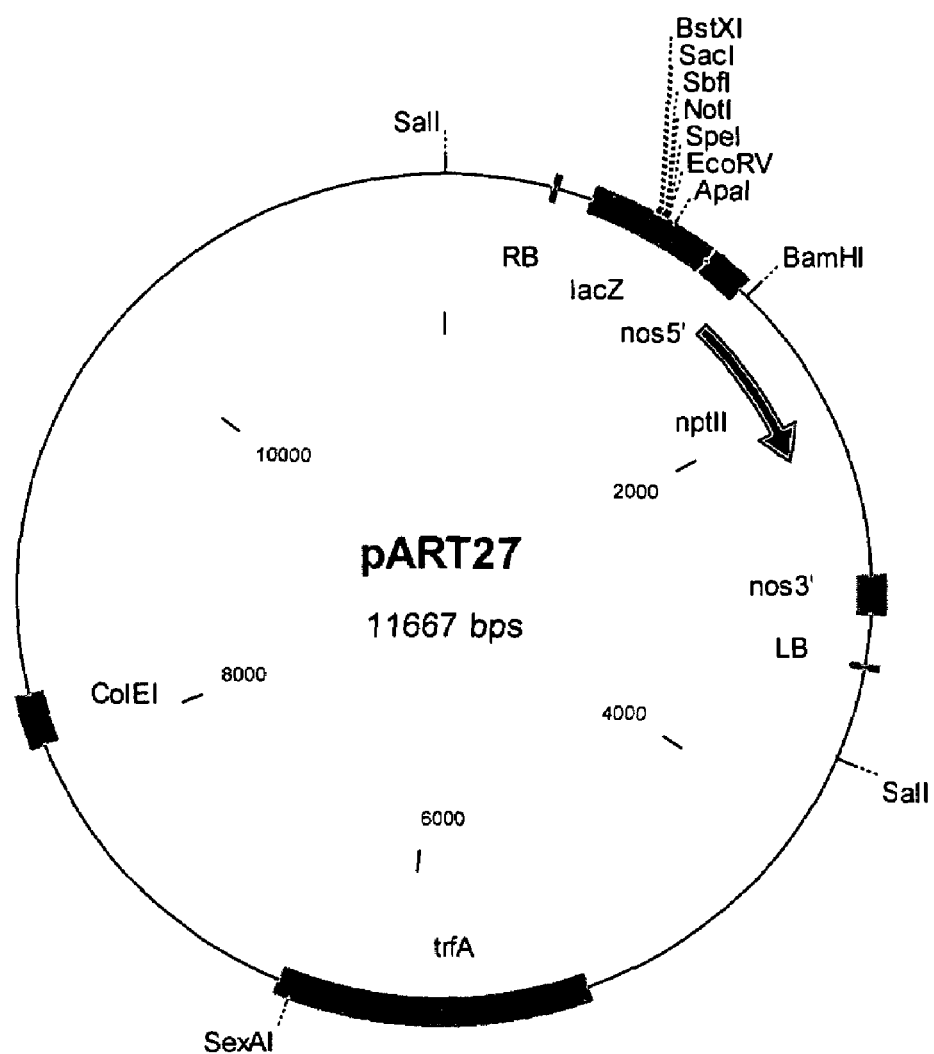

FIG. 121. Amino acid sequence of SEQ ID NO: 993. The conserved Zn-finger, C-x8-C-x5-C-x3-H (SEQ ID NO: 3667) type domain identified using InterProScan is underlined.

FIG. 122. Amino acid sequence of SEQ ID NO: 994. The conserved Zn-finger, C-x8-C-x5-C-x3-H (SEQ ID NO: 3667) type domain identified using InterProScan is underlined.

FIG. 123. Amino acid sequence of SEQ ID NO: 995. The 5 conserved Zn-finger, C-x8-C-x5-C-x3-H (SEQ ID NO: 3667) type domains identified using InterProScan are underlined.

FIG. 124. Amino acid sequence of SEQ ID NO: 996. The 6 conserved Zn-finger, C-x8-C-x5-C-x3-H (SEQ ID NO: 3667) type domains identified using InterProScan are underlined.

FIG. 125. Amino acid sequence of SEQ ID NO: 997. The conserved Zn-finger, C-x8-C-x5-C-x3-H (SEQ ID NO: 3667) type domain identified using InterProScan is underlined.

FIG. 126. Amino acid sequence of SEQ ID NO: 3603. The conserved Zn-finger, C-x8-C-x5-C-x3-H (SEQ ID NO: 3667) type domain identified using InterProScan is underlined.

FIG. 127. Amino acid sequence of SEQ ID NO: 999. The conserved Zn-finger, C-x8-C-x5-C-x3-H (SEQ ID NO: 3667) type domain identified using InterProScan is underlined.

FIG. 128. Amino acid sequence of SEQ ID NO: 1000. The conserved Zn-finger, C-x8-C-x5-C-x3-H (SEQ ID NO: 3667) type domain identified using InterProScan is underlined.

FIG. 129. Amino acid sequence of SEQ ID NO: 1001. The conserved Transcription factor CBF/NF-Y/archaeal histone domain identified using InterProScan is underlined.

FIG. 130. Amino acid sequence of SEQ ID NO: 1002. The conserved Transcription factor CBF/NF-Y/archaeal histone domain identified using InterProScan is underlined.

FIG. 131. Amino acid sequence of SEQ ID NO: 1003. The conserved CCAAT-binding transcription factor, subunit B domain identified using InterProScan is underlined.

FIG. 132. Amino acid sequence of SEQ ID NO: 1004. The conserved CCAAT-binding transcription factor, subunit B domain identified using InterProScan is underlined.

FIG. 133. Amino acid sequence of SEQ ID NO: 1005. The conserved Transcription factor CBF/NF-Y/archaeal histone domain identified using InterProScan is underlined.

FIG. 134. Amino acid sequence of SEQ ID NO: 1006. The conserved CCAAT-binding transcription factor, subunit B domain identified using InterProScan is underlined.

FIG. 135. Amino acid sequence of SEQ ID NO: 1007. The conserved CCAAT-binding transcription factor, subunit B domain identified using InterProScan is underlined.

FIG. 136. Amino acid sequence of SEQ ID NO: 1009. The conserved Tesmin/TSO1-like CXC domains identified using InterProScan are underlined.

FIG. 137. Amino acid sequence of SEQ ID NO: 1010. The conserved Tesmin/TSO1-like CXC domains identified using InterProScan are underlined.

FIG. 138. Amino acid sequence of SEQ ID NO: 1011. The conserved Transcription factor E2F/dimerisation partner (TDP) domain identified using InterProScan is underlined.

FIG. 139. Amino acid sequence of SEQ ID NO: 1016. The conserved Hpt domain identified using InterProScan is underlined.

FIG. 140. Amino acid sequence of SEQ ID NO: 1017. The conserved Hpt domain identified using InterProScan is underlined.

FIG. 141. Amino acid sequence of SEQ ID NO: 1018. The conserved Hpt domain identified using InterProScan is underlined.

FIG. 142. Amino acid sequence of SEQ ID NO: 1019. The conserved Response regulator receiver domain identified using InterProScan is underlined.

FIG. 143. Amino acid sequence of SEQ ID NO: 1020. The conserved Response regulator receiver domain identified using InterProScan is underlined.

FIG. 144. Amino acid sequence of SEQ ID NO: 1021. The conserved Response regulator receiver domain identified using InterProScan is underlined.

FIG. 145. Amino acid sequence of SEQ ID NO: 1022. The conserved Response regulator receiver domain identified using InterProScan is underlined.

FIG. 146. Amino acid sequence of SEQ ID NO: 1032. The conserved Response regulator receiver domain identified using InterProScan is underlined.

FIG. 147. Amino acid sequence of SEQ ID NO: 1033. The conserved Response regulator receiver domain identified using InterProScan is underlined.

FIG. 148. Amino acid sequence of SEQ ID NO: 1038. The conserved GRAS family transcription factor domain identified using InterProScan is underlined.

FIG. 149. Amino acid sequence of SEQ ID NO: 1039. The conserved GRAS family transcription factor domain identified using InterProScan is underlined.

FIG. 150. Amino acid sequence of SEQ ID NO: 1040. The conserved HMG1/2 (high mobility group) box domain identified using InterProScan is underlined.

FIG. 151. Amino acid sequence of SEQ ID NO: 1041. The conserved HMG1/2 (high mobility group) box domain identified using InterProScan is underlined.

FIG. 152. Amino acid sequence of SEQ ID NO: 1042. The conserved HMG1/2 (high mobility group) box domain identified using InterProScan is underlined.

FIG. 153. Amino acid sequence of SEQ ID NO: 1043. The conserved HMG1/2 (high mobility group) box domain identified using InterProScan is underlined.

FIG. 154. Amino acid sequence of SEQ ID NO: 1044. The conserved HMG1/2 (high mobility group) box domain identified using InterProScan is underlined.

FIG. 155. Amino acid sequence of SEQ ID NO: 1045. The conserved HMG1/2 (high mobility group) box domain identified using InterProScan is underlined.

FIG. 156. Amino acid sequence of SEQ ID NO: 1047. The conserved HMG-I and HMG-Y DNA-binding (A+T-hook) domains identified using InterProScan are underlined.

FIG. 157. Amino acid sequence of SEQ ID NO: 3604. The conserved Homeobox domain identified using InterProScan is underlined.

FIG. 158. Amino acid sequence of SEQ ID NO: 1054. The conserved Homeobox domain identified using InterProScan is underlined.

FIG. 159. Amino acid sequence of SEQ ID NO: 1056. The conserved Homeobox domain identified using InterProScan is underlined.

FIG. 160. Amino acid sequence of SEQ ID NO: 1057. The conserved Homeobox domain identified using InterProScan is underlined.

FIG. 161. Amino acid sequence of SEQ ID NO: 1058. The conserved Homeobox domain identified using InterProScan is underlined.

FIG. 162. Amino acid sequence of SEQ ID NO: 1059. The conserved Homeobox domain identified using InterProScan is underlined.

FIG. 163. Amino acid sequence of SEQ ID NO: 1060. The conserved Homeobox domain identified using InterProScan is underlined.

FIG. 164. Amino acid sequence of SEQ ID NO: 3605. The conserved Homeobox domain identified using InterProScan is underlined.

FIG. 165. Amino acid sequence of SEQ ID NO: 1068. The conserved Homeobox domain identified using InterProScan is underlined.

FIG. 166. Amino acid sequence of SEQ ID NO: 1069. The conserved Homeobox domain identified using InterProScan is underlined.

FIG. 167. Amino acid sequence of SEQ ID NO: 1070. The conserved Homeobox domain identified using InterProScan is underlined.

FIG. 168. Amino acid sequence of SEQ ID NO: 1073. The conserved Homeobox domain identified using InterProScan is underlined.

FIG. 169. Amino acid sequence of SEQ ID NO: 1077. The conserved Homeobox domain identified using InterProScan is underlined.

FIG. 170. Amino acid sequence of SEQ ID NO: 3606. The conserved Homeobox domain identified using InterProScan is underlined.

FIG. 171. Amino acid sequence of SEQ ID NO: 1081. The conserved Heat shock factor (HSF)-type DNA-binding domain identified using InterProScan is underlined.

FIG. 172. Amino acid sequence of SEQ ID NO: 1082. The conserved Heat shock factor (HSF)-type DNA-binding domain identified using InterProScan is underlined.

FIG. 173. Amino acid sequence of SEQ ID NO: 1086. The conserved Heat shock factor (HSF)-type DNA-binding domain identified using InterProScan is underlined.

FIG. 174. Amino acid sequence of SEQ ID NO: 1087. The conserved Heat shock factor (HSF)-type DNA-binding domain identified using InterProScan is underlined.

FIG. 175. Amino acid sequence of SEQ ID NO: 3607. The conserved Transcription factor jumonji, jmjC domain identified using InterProScan is underlined.

FIG. 176. Amino acid sequence of SEQ ID NO: 1089. The conserved Zn-binding protein, LIM domain identified using InterProScan is underlined.

FIG. 177. Amino acid sequence of SEQ ID NO: 1090. The conserved Zn-binding LIM domain identified using InterProScan is underlined.

FIG. 178. Amino acid sequence of SEQ ID NO: 1091. The conserved Zn-binding protein, LIM domains identified using InterProScan are underlined.

FIG. 179. Amino acid sequence of SEQ ID NO: 1092. The conserved Zn-binding protein, LIM domains identified using InterProScan are underlined.

FIG. 180. Amino acid sequence of SEQ ID NO: 3608. The conserved Zn-binding protein, LIM domains identified using InterProScan are underlined.

FIG. 181. Amino acid sequence of SEQ ID NO: 1094. The conserved Zn-binding LIM domains identified using InterProScan are underlined.

FIG. 182. Amino acid sequence of SEQ ID NO: 1095. The conserved Zn-binding protein, LIM domains identified using InterProScan are underlined.

FIG. 183. Amino acid sequence of SEQ ID NO: 1096. The conserved Transcrition factor, MADS-box (SEQ ID NO: 3668) domain and K-box domain identified using InterProScan are underlined.

FIG. 184. Amino acid sequence of SEQ ID NO: 1098. The conserved Transcription factor, MADS-box (SEQ ID NO: 3668) domain identified using InterProScan is underlined.

FIG. 185. Amino acid sequence of SEQ ID NO: 1099. The conserved Transcrition factor, MADS-box (SEQ ID NO: 3668) domain identified using InterProScan is underlined.

FIG. 186. Amino acid sequence of SEQ ID NO: 1100. The conserved Transcription factor, MADS-box (SEQ ID NO: 3668) domain identified using InterProScan is underlined, as supported by Table 1.

FIG. 187. Amino acid sequence of SEQ ID NO: 1101. The conserved Transcription factor, MADS-box (SEQ ID NO: 3668) domain and K-box domain identified using InterProScan are underlined FIG. 188. Amino acid sequence of SEQ ID NO: 1102. The conserved Transcription factor, MADS-box (SEQ ID NO: 3668) domain and K-box domain identified using InterProScan are underlined.

FIG. 189. Amino acid sequence of SEQ ID NO: 1103. The conserved Transcription factor, MADS-box (SEQ ID NO: 3668) domain identified using InterProScan is underlined.

FIG. 190. Amino acid sequence of SEQ ID NO: 1104. The conserved Transcription factor, MADS-box (SEQ ID NO: 3668) domain identified using InterProScan is underlined.

FIG. 191. Amino acid sequence of SEQ ID NO: 1105. The conserved Transcrition factor, MADS-box (SEQ ID NO: 3668) domain identified using InterProScan is underlined.

FIG. 192. Amino acid sequence of SEQ ID NO: 3609. The conserved Transcrition factor, MADS-box (SEQ ID NO: 3668) domain identified using InterProScan is underlined.

FIG. 193. Amino acid sequence of SEQ ID NO: 3610. The conserved MADS-box domain identified using InterProScan is underlined.

FIG. 194. Amino acid sequence of SEQ ID NO: 1108. The conserved MADS-box domain identified using InterProScan is underlined.

FIG. 195. Amino acid sequence of SEQ ID NO: 1109. The conserved Transcription factor, MADS-box (SEQ ID NO: 3668) domain identified using InterProScan is underlined.

FIG. 196. Amino acid sequence of SEQ ID NO: 1110. The conserved Transcription factor, MADS-box (SEQ ID NO: 3668) domain identified using InterProScan is underlined.

FIG. 197. Amino acid sequence of SEQ ID NO: 3611. The conserved Transcription factor, MADS-box (SEQ ID NO: 3668) domain identified using InterProScan is underlined.

FIG. 198. Amino acid sequence of SEQ ID NO: 1112. The conserved MADS-box (SEQ ID NO: 3668) domain identified using InterProScan is underlined.

FIG. 199. Amino acid sequence of SEQ ID NO: 3612. The conserved MADS-box (SEQ ID NO: 3668) domain identified using InterProScan is underlined.

FIG. 200. Amino acid sequence of SEQ ID NO: 1114. The conserved Transcription factor, MADS-box (SEQ ID NO: 3668) domain and K-box domain identified using InterProScan are underlined.

FIG. 201. Amino acid sequence of SEQ ID NO: 1115. The conserved MADS-box (SEQ ID NO: 3668) domain identified using InterProScan is underlined.

FIG. 202. Amino acid sequence of SEQ ID NO: 1116. The conserved MADS-box (SEQ ID NO: 3668) domain identified using InterProScan is underlined.

FIG. 203. Amino acid sequence of SEQ ID NO: 1117. The conserved MADS-box (SEQ ID NO: 3668) domain identified using InterProScan is underlined.

FIG. 204. Amino acid sequence of SEQ ID NO: 1118. The conserved Transcrition factor, MADS-box (SEQ ID NO: 3668) domain identified using InterProScan is underlined.

FIG. 205. Amino acid sequence of SEQ ID NO: 3613. The conserved Transcrition factor, MADS-box (SEQ ID NO: 3668) domain identified using InterProScan is underlined.

FIG. 206. Amino acid sequence of SEQ ID NO: 3614. The conserved Transcrition factor, MADS-box (SEQ ID NO: 3668) domain identified using InterProScan is underlined.

FIG. 207 Amino acid sequence of SEQ ID NO: 3615. The conserved Transcrition factor, MADS-box (SEQ ID NO: 3668) domain identified using InterProScan is underlined.

FIG. 208. Amino acid sequence of SEQ ID NO: 1126. The conserved Myb DNA-binding domain identified using InterProScan is underlined.

FIG. 209. Amino acid sequence of SEQ ID NO: 1127. The conserved Myb DNA-binding domain identified using InterProScan is underlined.

FIG. 210. Amino acid sequence of SEQ ID NO: 3616. The conserved Myb DNA-binding domain identified using InterProScan is underlined.

FIG. 211. Amino acid sequence of SEQ ID NO: 1129. The conserved Myb DNA-binding domain identified using InterProScan is underlined.

FIG. 212. Amino acid sequence of SEQ ID NO: 3617. The conserved Myb DNA-binding domain identified using InterProScan is underlined.

FIG. 213. Amino acid sequence of SEQ ID NO: 1131. The conserved Myb DNA-binding domain identified using InterProScan is underlined.

FIG. 214. Amino acid sequence of SEQ ID NO: 1132. The conserved Myb DNA-binding domains identified using InterProScan are underlined.

FIG. 215. Amino acid sequence of SEQ ID NO: 1133. The conserved Myb DNA-binding domain identified using InterProScan is underlined.

FIG. 216. Amino acid sequence of SEQ ID NO: 1134. The conserved Myb DNA-binding domains identified using InterProScan are underlined.

FIG. 217. Amino acid sequence of SEQ ID NO: 1136. The conserved Myb DNA-binding domain identified using InterProScan is underlined.

FIG. 218. Amino acid sequence of SEQ ID NO: 1137. The conserved Myb DNA-binding domains identified using InterProScan are underlined.

FIG. 219. Amino acid sequence of SEQ ID NO: 1138. The conserved Myb DNA-binding domain identified using InterProScan is underlined.

FIG. 220. Amino acid sequence of SEQ ID NO: 1140. The conserved Myb DNA-binding domain identified using InterProScan is underlined.

FIG. 221. Amino acid sequence of SEQ ID NO: 1142. The conserved Myb DNA-binding domains identified using InterProScan are underlined.

FIG. 222. Amino acid sequence of SEQ ID NO: 1144. The conserved Myb DNA-binding domain identified using InterProScan is underlined.

FIG. 223. Amino acid sequence of SEQ ID NO: 3618. The conserved Myb DNA-binding domains identified using InterProScan are underlined.

FIG. 224. Amino acid sequence of SEQ ID NO: 1146. The conserved Myb DNA-binding domains identified using InterProScan are underlined.

FIG. 225. Amino acid sequence of SEQ ID NO: 1148. The conserved Myb DNA-binding domains identified using InterProScan are underlined.

FIG. 226. Amino acid sequence of SEQ ID NO: 1150. The conserved Myb DNA-binding domain identified using InterProScan is underlined.

FIG. 227. Amino acid sequence of SEQ ID NO: 3619. The conserved Myb DNA-binding domain identified using InterProScan is underlined.

FIG. 228. Amino acid sequence of SEQ ID NO: 1154. The conserved Myb DNA-binding domain identified using InterProScan is underlined.

FIG. 229. Amino acid sequence of SEQ ID NO: 3620. The conserved Myb DNA-binding domain identified using InterProScan is underlined.

FIG. 230. Amino acid sequence of SEQ ID NO: 1156. The conserved Myb DNA-binding domain identified using InterProScan is underlined.

FIG. 231. Amino acid sequence of SEQ ID NO: 1158. The conserved Myb DNA-binding domain identified using InterProScan is underlined.

FIG. 232. Amino acid sequence of SEQ ID NO: 1159. The conserved Myb DNA-binding domain identified using InterProScan is underlined.

FIG. 233. Amino acid sequence of SEQ ID NO: 1160. The conserved Myb DNA-binding domain identified using InterProScan is underlined.

FIG. 234. Amino acid sequence of SEQ ID NO: 3621. The conserved Myb DNA-binding domain identified using InterProScan is underlined.

FIG. 235. Amino acid sequence of SEQ ID NO: 1162. The conserved Myb DNA-binding domain identified using InterProScan is underlined.

FIG. 236. Amino acid sequence of SEQ ID NO: 1163. The conserved Myb DNA-binding domain identified using InterProScan is underlined.

FIG. 237. Amino acid sequence of SEQ ID NO: 1164. The conserved Myb DNA-binding domain identified using InterProScan is underlined.

FIG. 238. Amino acid sequence of SEQ ID NO: 1165. The conserved Myb DNA-binding domains identified using InterProScan are underlined.

FIG. 239. Amino acid sequence of SEQ ID NO: 1167. The conserved Myb DNA-binding domain identified using InterProScan is underlined.

FIG. 240. Amino acid sequence of SEQ ID NO: 1168. The conserved Myb DNA-binding domain identified using InterProScan is underlined.

FIG. 241. Amino acid sequence of SEQ ID NO: 3622. The conserved Myb DNA-binding domain identified using InterProScan is underlined.

FIG. 242. Amino acid sequence of SEQ ID NO: 3623. The conserved Myb DNA-binding domains identified using InterProScan are underlined.

FIG. 243. Amino acid sequence of SEQ ID NO: 1174. The conserved Myb DNA-binding domain identified using InterProScan is underlined.

FIG. 244. Amino acid sequence of SEQ ID NO: 1175. The conserved Myb DNA-binding domain identified using InterProScan is underlined.

FIG. 245. Amino acid sequence of SEQ ID NO: 1176. The conserved Myb DNA-binding domain identified using InterProScan is underlined.

FIG. 246. Amino acid sequence of SEQ ID NO: 3624. The conserved Myb DNA-binding domain identified using InterProScan is underlined.

FIG. 247. Amino acid sequence of SEQ ID NO: 1178. The conserved Myb DNA-binding domain identified using InterProScan is underlined.

FIG. 248. Amino acid sequence of SEQ ID NO: 1180. The conserved Myb DNA-binding domain identified using InterProScan is underlined.

FIG. 249. Amino acid sequence of SEQ ID NO: 1181. The conserved Myb DNA-binding domain identified using InterProScan is underlined.

FIG. 250. Amino acid sequence of SEQ ID NO: 1182. The conserved Myb DNA-binding domain identified using InterProScan is underlined.

FIG. 251. Amino acid sequence of SEQ ID NO: 1183. The conserved Myb DNA-binding domain identified using InterProScan is underlined.

FIG. 252. Amino acid sequence of SEQ ID NO: 1184. The conserved Myb DNA-binding domain identified using InterProScan is underlined.

FIG. 253. Amino acid sequence of SEQ ID NO: 3625. The conserved Myb DNA-binding domain identified using InterProScan is underlined.

FIG. 254. Amino acid sequence of SEQ ID NO: 3626. The conserved Myb DNA-binding domain identified using InterProScan is underlined.

FIG. 255. Amino acid sequence of SEQ ID NO: 1189. The conserved Myb DNA-binding domain identified using InterProScan is underlined.

FIG. 256. Amino acid sequence of SEQ ID NO: 1190. The conserved Myb DNA-binding domain identified using InterProScan is underlined.

FIG. 257. Amino acid sequence of SEQ ID NO: 1192. The conserved No apical meristem (NAM) protein domain identified using InterProScan is underlined.

FIG. 258. Amino acid sequence of SEQ ID NO: 1193. The conserved No apical meristem (NAM) protein domain identified using InterProScan is underlined.

FIG. 259. Amino acid sequence of SEQ ID NO: 1194. The conserved No apical meristem (NAM) protein domain identified using InterProScan is underlined.

FIG. 260. Amino acid sequence of SEQ ID NO: 1195. The conserved No apical meristem (NAM) protein domain identified using InterProScan is underlined.

FIG. 261. Amino acid sequence of SEQ ID NO: 3627. The conserved No apical meristem (NAM) protein domain identified using InterProScan is underlined.

FIG. 262. Amino acid sequence of SEQ ID NO: 1197. The conserved No apical meristem (NAM) protein domain identified using InterProScan is underlined.

FIG. 263. Amino acid sequence of SEQ ID NO: 1198. The conserved No apical meristem (NAM) protein domain identified using InterProScan is underlined.

FIG. 264. Amino acid sequence of SEQ ID NO: 1199. The conserved No apical meristem (NAM) protein domain identified using InterProScan is underlined.

FIG. 265. Amino acid sequence of SEQ ID NO: 3628. The conserved No apical meristem (NAM) protein domain identified using InterProScan is underlined.

FIG. 266. Amino acid sequence of SEQ ID NO: 1201. The conserved No apical meristem (NAM) protein domain identified using InterProScan is underlined.

FIG. 267. Amino acid sequence of SEQ ID NO: 1203. The conserved No apical meristem (NAM) protein domain identified using InterProScan is underlined.

FIG. 268. Amino acid sequence of SEQ ID NO: 1204. The conserved No apical meristem (NAM) protein domain identified using InterProScan is underlined.

FIG. 269. Amino acid sequence of SEQ ID NO: 1205. The conserved No apical meristem (NAM) protein domain identified using InterProScan is underlined.

FIG. 270. Amino acid sequence of SEQ ID NO: 1206. The conserved No apical meristem (NAM) protein domain identified using InterProScan is underlined.

FIG. 271. Amino acid sequence of SEQ ID NO: 1209. The conserved No apical meristem (NAM) protein domain identified using InterProScan is underlined.

FIG. 272. Amino acid sequence of SEQ ID NO: 1210. The conserved No apical meristem (NAM) protein domain identified using InterProScan is underlined.

FIG. 273. Amino acid sequence of SEQ ID NO: 1211. The conserved No apical meristem (NAM) protein domain identified using InterProScan is underlined.

FIG. 274. Amino acid sequence of SEQ ID NO: 1213. The conserved No apical meristem (NAM) protein domain identified using InterProScan is underlined.

FIG. 275. Amino acid sequence of SEQ ID NO: 1214. The conserved No apical meristem (NAM) protein domain identified using InterProScan is underlined.

FIG. 276. Amino acid sequence of SEQ ID NO: 1215. The conserved No apical meristem (NAM) protein domain identified using InterProScan is underlined.

FIG. 277. Amino acid sequence of SEQ ID NO: 1217. The conserved No apical meristem (NAM) protein domain identified using InterProScan is underlined.

FIG. 278. Amino acid sequence of SEQ ID NO: 1219. The conserved No apical meristem (NAM) protein domain identified using InterProScan is underlined.

FIG. 279. Amino acid sequence of SEQ ID NO: 1220. The conserved No apical meristem (NAM) protein domain identified using InterProScan is underlined.

FIG. 280. Amino acid sequence of SEQ ID NO: 1221. The conserved No apical meristem (NAM) protein domain identified using InterProScan is underlined.

FIG. 281. Amino acid sequence of SEQ ID NO: 1222. The conserved No apical meristem (NAM) protein domain identified using InterProScan is underlined.

FIG. 282. Amino acid sequence of SEQ ID NO: 1224. The conserved No apical meristem (NAM) protein domain identified using InterProScan is underlined.

FIG. 283. Amino acid sequence of SEQ ID NO: 1226. The conserved No apical meristem (NAM) protein domain identified using InterProScan is underlined.

FIG. 284. Amino acid sequence of SEQ ID NO: 1227. The conserved No apical meristem (NAM) protein domain identified using InterProScan is underlined.

FIG. 285. Amino acid sequence of SEQ ID NO: 1228. The conserved No apical meristem (NAM) protein domain identified using InterProScan is underlined.

FIG. 286. Amino acid sequence of SEQ ID NO: 1229. The conserved No apical meristem (NAM) protein domain identified using InterProScan is underlined.

FIG. 287. Amino acid sequence of SEQ ID NO: 1230. The conserved Plant regulator RWP-RK domain (SEQ ID NO: 3669) identified using InterProScan is underlined.

FIG. 288. Amino acid sequence of SEQ ID NO: 1231. The conserved AP2 domain identified using InterProScan is underlined.

FIG. 289. Amino acid sequence of SEQ ID NO: 1232. The conserved SBP plant protein domain identified using InterProScan is underlined.

FIG. 290. Amino acid sequence of SEQ ID NO: 3629. The conserved SBP plant protein domain identified using InterProScan is underlined.

FIG. 291. Amino acid sequence of SEQ ID NO: 1234. The conserved SBP plant protein domain identified using InterProScan is underlined.

FIG. 292. Amino acid sequence of SEQ ID NO: 1235. The conserved SBP plant protein domain identified using InterProScan is underlined.

FIG. 293. Amino acid sequence of SEQ ID NO: 1236. The conserved TCP family transcription factor domain identified using InterProScan is underlined.

FIG. 294. Amino acid sequence of SEQ ID NO: 1243. The conserved Tubby domain identified using InterProScan is underlined.

FIG. 295. Amino acid sequence of SEQ ID NO: 1245. The conserved Tubby domain identified using InterProScan is underlined.

FIG. 296. Amino acid sequence of SEQ ID NO: 1246. The conserved Tubby domain identified using InterProScan is underlined.

FIG. 297. Amino acid sequence of SEQ ID NO: 1247. The conserved Tubby domain identified using InterProScan is underlined.

FIG. 298. Amino acid sequence of SEQ ID NO: 1248. The conserved DNA-binding WRKY domain (SEQ ID NO: 3670) identified using InterProScan is underlined.

FIG. 299. Amino acid sequence of SEQ ID NO: 1249. The conserved DNA-binding WRKY domain (SEQ ID NO: 3670) identified using InterProScan is underlined.

FIG. 300. Amino acid sequence of SEQ ID NO: 1250. The conserved DNA-binding WRKY domain (SEQ ID NO: 3670) identified using InterProScan is underlined.

FIG. 301. Amino acid sequence of SEQ ID NO: 1251. The conserved DNA-binding WRKY domain (SEQ ID NO: 3670) identified using InterProScan is underlined.

FIG. 302. Amino acid sequence of SEQ ID NO: 1252. The conserved DNA-binding WRKY domain (SEQ ID NO: 3670) identified using InterProScan is underlined.

FIG. 303. Amino acid sequence of SEQ ID NO: 1253. The conserved DNA-binding WRKY domain (SEQ ID NO: 3670) identified using InterProScan is underlined.

FIG. 304. Amino acid sequence of SEQ ID NO: 1254. The conserved DNA-binding WRKY domain (SEQ ID NO: 3670) identified using InterProScan is underlined.

FIG. 305. Amino acid sequence of SEQ ID NO: 1255. The conserved DNA-binding WRKY domain (SEQ ID NO: 3670) identified using InterProScan is underlined.

FIG. 306. Amino acid sequence of SEQ ID NO: 1256. The conserved DNA-binding WRKY domain (SEQ ID NO: 3670) identified using InterProScan is underlined.

FIG. 307. Amino acid sequence of SEQ ID NO: 1257. The conserved DNA-binding WRKY domain (SEQ ID NO: 3670) identified using InterProScan is underlined.

FIG. 308. Amino acid sequence of SEQ ID NO: 1258. The conserved DNA-binding WRKY domain (SEQ ID NO: 3670) identified using InterProScan is underlined.

FIG. 309. Amino acid sequence of SEQ ID NO: 1260. The conserved DNA-binding WRKY domain (SEQ ID NO: 3670) identified using InterProScan is underlined.

FIG. 310. Amino acid sequence of SEQ ID NO: 1261. The conserved DNA-binding WRKY domain (SEQ ID NO: 3670) identified using InterProScan is underlined.

FIG. 311. Amino acid sequence of SEQ ID NO: 1262. The conserved DNA-binding WRKY domain (SEQ ID NO: 3670) identified using InterProScan is underlined.

FIG. 312. Amino acid sequence of SEQ ID NO: 1263. The conserved DNA-binding WRKY domains (SEQ ID NO: 3670) identified using InterProScan are underlined.

FIG. 313. Amino acid sequence of SEQ ID NO: 1264. The conserved DNA-binding WRKY domains (SEQ ID NO: 3670) identified using InterProScan are underlined.

FIG. 314. Amino acid sequence of SEQ ID NO: 1265. The conserved DNA-binding WRKY domains (SEQ ID NO: 3670) identified using InterProScan are underlined.

FIG. 315. Amino acid sequence of SEQ ID NO: 1266. The conserved DNA-binding WRKY domains (SEQ ID NO: 3670) identified using InterProScan are underlined.

FIG. 316. Amino acid sequence of SEQ ID NO: 1267. The conserved DNA-binding WRKY domains (SEQ ID NO: 3670) identified using InterProScan are underlined.

FIG. 317. Amino acid sequence of SEQ ID NO: 1268. The conserved Zn-finger-like, PHD finger domain identified using InterProScan is underlined.

FIG. 318. Amino acid sequence of SEQ ID NO: 1269. The conserved Zn-finger-like, PHD finger domain identified using InterProScan is underlined.

FIG. 319. Amino acid sequence of SEQ ID NO: 1270. The conserved Zn-finger-like, PHD finger domain identified using InterProScan is underlined.

FIG. 320. Amino acid sequence of SEQ ID NO: 1271. The conserved Zn-finger-like, PHD finger domain identified using InterProScan is underlined.

FIG. 321. Amino acid sequence of SEQ ID NO: 1272. The conserved Zn-finger-like, PHD finger domain identified using InterProScan is underlined.

FIG. 322. Amino acid sequence of SEQ ID NO: 1273. The conserved Zn-finger-like, PHD finger domain identified using InterProScan is underlined.

FIG. 323. Amino acid sequence of SEQ ID NO: 1274. The conserved Zn-finger-like, PHD finger domain identified using InterProScan is underlined.

FIG. 324. Amino acid sequence of SEQ ID NO: 1275. The conserved Zn-finger-like, PHD finger domain identified using InterProScan is underlined.

FIG. 325. Amino acid sequence of SEQ ID NO: 1277. The conserved AP2 domain identified using InterProScan is underlined.

FIG. 326. Amino acid sequence of SEQ ID NO: 1278. The conserved AP2 domain identified using InterProScan is underlined.

FIG. 327. Amino acid sequence of SEQ ID NO: 1280. The conserved AP2 domain identified using InterProScan is underlined.

FIG. 328. Amino acid sequence of SEQ ID NO: 1282. The conserved AP2 domain identified using InterProScan is underlined.

FIG. 329. Amino acid sequence of SEQ ID NO: 1283. The conserved AP2 domain identified using InterProScan is underlined.

FIG. 330. Amino acid sequence of SEQ ID NO: 1285. The conserved AP2 domain identified using InterProScan is underlined.

FIG. 331. Amino acid sequence of SEQ ID NO: 1286. The conserved AP2 domain identified using InterProScan is underlined.

FIG. 332. Amino acid sequence of SEQ ID NO: 1287. The conserved AP2 domain identified using InterProScan is underlined.

FIG. 333. Amino acid sequence of SEQ ID NO: 1288. The conserved AP2 domain identified using InterProScan is underlined.

FIG. 334. Amino acid sequence of SEQ ID NO: 1289. The conserved AP2 domain identified using InterProScan is underlined.

FIG. 335. Amino acid sequence of SEQ ID NO: 1291. The conserved AP2 domain identified using InterProScan is underlined.

FIG. 336. Amino acid sequence of SEQ ID NO: 1292. The conserved AP2 domain identified using InterProScan is underlined.

FIG. 337. Amino acid sequence of SEQ ID NO: 1294. The conserved AP2 domain identified using InterProScan is underlined.

FIG. 338. Amino acid sequence of SEQ ID NO: 1296. The conserved AP2 domain identified using InterProScan is underlined.

FIG. 339. Amino acid sequence of SEQ ID NO: 1298. The conserved AP2 domain identified using InterProScan is underlined.

FIG. 340. Amino acid sequence of SEQ ID NO: 1299. The conserved AP2 domain identified using InterProScan is underlined.

FIG. 341. Amino acid sequence of SEQ ID NO: 1300. The conserved AP2 domain identified using InterProScan is underlined.

FIG. 342. Amino acid sequence of SEQ ID NO: 1301. The conserved AP2 domain identified using InterProScan is underlined.

FIG. 343. Amino acid sequence of SEQ ID NO: 1302. The conserved AP2 domain identified using InterProScan is underlined.

FIG. 344. Amino acid sequence of SEQ ID NO: 1303. The conserved AP2 domain identified using InterProScan is underlined.

FIG. 345. Amino acid sequence of SEQ ID NO: 1306. The conserved AP2 domain identified using InterProScan is underlined.

FIG. 346. Amino acid sequence of SEQ ID NO: 1309. The conserved AP2 domains identified using InterProScan are underlined.

FIG. 347. Amino acid sequence of SEQ ID NO: 1310. The conserved AP2 domain identified using InterProScan is underlined.

FIG. 348. Amino acid sequence of SEQ ID NO: 1312. The conserved AP2 domain identified using InterProScan is underlined.

FIG. 349. Amino acid sequence of SEQ ID NO: 1313. The conserved AP2-domain identified using InterProScan is underlined.

FIG. 350. Amino acid sequence of SEQ ID NO: 1315. The conserved AP2-domain identified using InterProScan is underlined.

FIG. 351. Amino acid sequence of SEQ ID NO: 1317. The conserved Transcriptional factor B3 domain identified using InterProScan is underlined.

FIG. 352. Amino acid sequence of SEQ ID NO: 1319. The conserved AUX/IAA domain identified using InterProScan is underlined.

FIG. 353. Amino acid sequence of SEQ ID NO: 1320. The conserved AUX/IAA domain identified using InterProScan is underlined.

FIG. 354. Amino acid sequence of SEQ ID NO: 1321. The conserved AUX/IAA domain identified using InterProScan is underlined.

FIG. 355. Amino acid sequence of SEQ ID NO: 1323. The conserved AUX/IAA domain identified using InterProScan is underlined.

FIG. 356. Amino acid sequence of SEQ ID NO: 3630. The conserved AUX/IAA domain identified using InterProScan is underlined.

FIG. 357. Amino acid sequence of SEQ ID NO: 1325. The conserved AUX/IAA protein domain identified using InterProScan is underlined.

FIG. 358. Amino acid sequence of SEQ ID NO: 1326. The conserved AUX/IAA domain identified using InterProScan is underlined.

FIG. 359. Amino acid sequence of SEQ ID NO: 1327. The conserved AUX/IAA domain identified using InterProScan is underlined.

FIG. 360. Amino acid sequence of SEQ ID NO: 1328. The conserved Basic helix-loop-helix dimerization domain bHLH identified using InterProScan is underlined.

FIG. 361. Amino acid sequence of SEQ ID NO: 1329. The conserved Basic helix-loop-helix dimerization domain bHLH identified using InterProScan is underlined.

FIG. 362. Amino acid sequence of SEQ ID NO: 1330. The conserved Basic helix-loop-helix dimerization domain bHLH identified using InterProScan is underlined.

FIG. 363. Amino acid sequence of SEQ ID NO: 1332. The conserved Basic helix-loop-helix dimerization domain bHLH identified using InterProScan is underlined.

FIG. 364. Amino acid sequence of SEQ ID NO: 1333. The conserved Basic helix-loop-helix dimerization domain bHLH identified using InterProScan is underlined.

FIG. 365. Amino acid sequence of SEQ ID NO: 1334. The conserved Basic helix-loop-helix dimerization domain bHLH identified using InterProScan is underlined.

FIG. 366. Amino acid sequence of SEQ ID NO: 1338. The conserved Basic helix-loop-helix dimerization domain bHLH identified using InterProScan is underlined.

FIG. 367. Amino acid sequence of SEQ ID NO: 1339. The conserved Basic helix-loop-helix dimerization domain bHLH identified using InterProScan is underlined.

FIG. 368. Amino acid sequence of SEQ ID NO: 1340. The conserved Basic helix-loop-helix dimerization domain bHLH identified using InterProScan is underlined.

FIG. 369. Amino acid sequence of SEQ ID NO: 1341. The conserved Basic helix-loop-helix dimerization domain bHLH identified using InterProScan is underlined.

FIG. 370. Amino acid sequence of SEQ ID NO: 1342. The conserved Basic helix-loop-helix dimerization domain bHLH identified using InterProScan is underlined.

FIG. 371. Amino acid sequence of SEQ ID NO: 1344. The conserved Basic-leucine zipper (bZIP) transcription factor domain identified using InterProScan is underlined.

FIG. 372. Amino acid sequence of SEQ ID NO: 1346. The conserved Basic-leucine zipper (bZIP) transcription factor domain identified using InterProScan is underlined.

FIG. 373. Amino acid sequence of SEQ ID NO: 1348. The conserved Basic-leucine zipper (bZIP) transcription factor domain identified using InterProScan is underlined.

FIG. 374. Amino acid sequence of SEQ ID NO: 1351. The conserved Basic-leucine zipper (bZIP) transcription factor domain identified using InterProScan is underlined.

FIG. 375. Amino acid sequence of SEQ ID NO: 1352. The conserved Basic-leucine zipper (bZIP) transcription factor domain identified using InterProScan is underlined.

FIG. 376. Amino acid sequence of SEQ ID NO: 3631. The conserved Basic-leucine zipper (bZIP) transcription factor domain identified using InterProScan is underlined.

FIG. 377. Amino acid sequence of SEQ ID NO: 1355. The conserved Basic-leucine zipper (bZIP) transcription factor domain identified using InterProScan is underlined.

FIG. 378. Amino acid sequence of SEQ ID NO: 1357. The conserved Zn-finger, CONSTANS type domain identified using InterProScan is underlined.

FIG. 379. Amino acid sequence of SEQ ID NO: 1358. The conserved Zn-finger, B-box domain identified using InterProScan is underlined.

FIG. 380. Amino acid sequence of SEQ ID NO: 1360. The conserved Zn-finger, CONSTANS type domain identified using InterProScan is underlined.

FIG. 381. Amino acid sequence of SEQ ID NO: 1361. The conserved Zn-finger, CONSTANS type domains identified using InterProScan are underlined.

FIG. 382. Amino acid sequence of SEQ ID NO: 1362. The conserved Zn-finger, CONSTANS type domains identified using InterProScan are underlined.

FIG. 383. Amino acid sequence of SEQ ID NO: 1364. The conserved Zn-finger, CONSTANS type domains identified using InterProScan are underlined.

FIG. 384. Amino acid sequence of SEQ ID NO: 1365. The conserved Zn-finger, CONSTANS type domain identified using InterProScan is underlined.

FIG. 385. Amino acid sequence of SEQ ID NO: 1366. The conserved Zn-finger, CONSTANS type domain identified using InterProScan is underlined.

FIG. 386. Amino acid sequence of SEQ ID NO: 1368. The conserved Zn-finger, Dof type domain identified using InterProScan is underlined.

FIG. 387. Amino acid sequence of SEQ ID NO: 1369. The conserved Zn-finger, Dof type domain identified using InterProScan is underlined.

FIG. 388. Amino acid sequence of SEQ ID NO: 1370. The conserved Zn-finger, Dof type domain identified using InterProScan is underlined.

FIG. 389. Amino acid sequence of SEQ ID NO: 1371. The conserved Zn-finger, Dof type domain identified using InterProScan is underlined.

FIG. 390. Amino acid sequence of SEQ ID NO: 1372. The conserved Zn-finger, Dof type domain identified using InterProScan is underlined.

FIG. 391. Amino acid sequence of SEQ ID NO: 1373. The conserved Zn-finger, Dof type domain identified using InterProScan is underlined.

FIG. 392. Amino acid sequence of SEQ ID NO: 1374. The conserved Zn-finger, GATA type domain identified using InterProScan is underlined.

FIG. 393. Amino acid sequence of SEQ ID NO: 1375. The conserved Zn-finger, GATA type domain identified using InterProScan is underlined.

FIG. 394. Amino acid sequence of SEQ ID NO: 1376. The conserved Zn-finger, GATA type domain identified using InterProScan is underlined.

FIG. 395. Amino acid sequence of SEQ ID NO: 1377. The conserved Zn-finger, GATA type domain identified using InterProScan is underlined.

FIG. 396. Amino acid sequence of SEQ ID NO: 1378. The conserved Zn-finger, GATA type domain identified using InterProScan is underlined.

FIG. 397. Amino acid sequence of SEQ ID NO: 1382. The conserved Zn-finger, C2H2 type domain identified using InterProScan is underlined.

FIG. 398. Amino acid sequence of SEQ ID NO: 1383. The conserved Zn-finger, C2H2 type domain identified using InterProScan is underlined.

FIG. 399. Amino acid sequence of SEQ ID NO: 1384. The conserved Zn-finger, C2H2 type domain identified using InterProScan is underlined.

FIG. 400. Amino acid sequence of SEQ ID NO: 1385. The conserved Zn-finger, C2H2 type domain identified using InterProScan is underlined.

FIG. 401. Amino acid sequence of SEQ ID NO: 1386. The conserved Zn-finger, C2H2 type domain identified using InterProScan is underlined.

FIG. 402. Amino acid sequence of SEQ ID NO: 1387. The conserved Zn-finger, C2H2 type domain identified using InterProScan is underlined.

FIG. 403. Amino acid sequence of SEQ ID NO: 1388. The conserved Zn-finger, C2H2 type domain identified using InterProScan is underlined.

FIG. 404. Amino acid sequence of SEQ ID NO: 1389. The conserved Zn-finger, C2H2 type domain identified using InterProScan is underlined.

FIG. 405. Amino acid sequence of SEQ ID NO: 1390. The conserved Zn-finger, C2H2 type domain identified using InterProScan is underlined.

FIG. 406. Amino acid sequence of SEQ ID NO: 1392. The conserved Zn-finger, C-x8-C-x5-C-x3-H (SEQ ID NO: 3667) type domain identified using InterProScan is underlined.

FIG. 407. Amino acid sequence of SEQ ID NO: 1393. The conserved Zn-finger, C-x8-C-x5-C-x3-H (SEQ ID NO: 3667) type domains identified using InterProScan are underlined.

FIG. 408. Amino acid sequence of SEQ ID NO: 1394. The conserved Zn-finger, C-x8-C-x5-C-x3-H (SEQ ID NO: 3667) type domains identified using InterProScan are underlined.

FIG. 409. Amino acid sequence of SEQ ID NO: 1395. The conserved Zn-finger, C-x8-C-x5-C-x3-H (SEQ ID NO: 3667) type domains identified using InterProScan are underlined.

FIG. 410. Amino acid sequence of SEQ ID NO: 1396. The conserved Zn-finger, C-x8-C-x5-C-x3-H (SEQ ID NO: 3667) type domains identified using InterProScan are underlined.

FIG. 411. Amino acid sequence of SEQ ID NO: 1397. The conserved Zn-finger, C-x8-C-x5-C-x3-H (SEQ ID NO: 3667) type domains identified using InterProScan are underlined.

FIG. 412. Amino acid sequence of SEQ ID NO: 1398. The conserved Zn-finger, C-x8-C-x5-C-x3-H (SEQ ID NO: 3667) type domains identified using InterProScan are underlined.

FIG. 413. Amino acid sequence of SEQ ID NO: 1399. The conserved Zn-finger, C-x8-C-x5-C-x3-H (SEQ ID NO: 3667) type domains identified using InterProScan are underlined.

FIG. 414. Amino acid sequence of SEQ ID NO: 1400. The conserved Zn-finger, C-x8-C-x5-C-x3-H (SEQ ID NO: 3667) type domains identified using InterProScan are underlined.

FIG. 415. Amino acid sequence of SEQ ID NO: 1401. The conserved Zn-finger, C-x8-C-x5-C-x3-H (SEQ ID NO: 3667) type domain identified using InterProScan is underlined.

FIG. 416. Amino acid sequence of SEQ ID NO: 1402. The conserved Zn-finger, C-x8-C-x5-C-x3-H (SEQ ID NO: 3667) type domain identified using InterProScan is underlined.

FIG. 417. Amino acid sequence of SEQ ID NO: 1403. The conserved Zn-finger, C-x8-C-x5-C-x3-H (SEQ ID NO: 3667) type domain identified using InterProScan is underlined.

FIG. 418. Amino acid sequence of SEQ ID NO: 1404. The conserved Zn-finger, C-x8-C-x5-C-x3-H (SEQ ID NO: 3667) type domains identified using InterProScan are underlined.

FIG. 419. Amino acid sequence of SEQ ID NO: 1405. The conserved Zn-finger, C-x8-C-x5-C-x3-H (SEQ ID NO: 3667) domain identified using InterProScan is underlined.

FIG. 420. Amino acid sequence of SEQ ID NO: 1406. The conserved Transcription factor CBF/NF-Y/archaeal histone domain identified using InterProScan is underlined.

FIG. 421. Amino acid sequence of SEQ ID NO: 1407. The conserved Transcription factor CBF/NF-Y/archaeal histone domain identified using InterProScan is underlined.

FIG. 422. Amino acid sequence of SEQ ID NO: 1408. The conserved Transcription factor CBF/NF-Y/archaeal histone domain identified using InterProScan is underlined.

FIG. 423. Amino acid sequence of SEQ ID NO: 1409. The conserved Transcription factor CBF/NF-Y/archaeal histone domain identified using InterProScan is underlined.

FIG. 424. Amino acid sequence of SEQ ID NO: 1410. The conserved Transcription factor CBF/NF-Y/archaeal histone domain identified using InterProScan is underlined.

FIG. 425. Amino acid sequence of SEQ ID NO: 1411. The conserved Transcription factor CBF/NF-Y/archaeal histone domain identified using InterProScan is underlined.

FIG. 426. Amino acid sequence of SEQ ID NO: 1413. The conserved Transcription factor CBF/NF-Y/archaeal histone domain identified using InterProScan is underlined.

FIG. 427. Amino acid sequence of SEQ ID NO: 1414. The conserved Transcription factor CBF/NF-Y/archaeal histone domain identified using InterProScan is underlined.

FIG. 428. Amino acid sequence of SEQ ID NO: 1415. The conserved Transcription factor CBF/NF-Y/archaeal histone domain identified using InterProScan is underlined.

FIG. 429. Amino acid sequence of SEQ ID NO: 1416. The conserved Transcription factor CBF/NF-Y/archaeal histone domain identified using InterProScan is underlined.

FIG. 430. Amino acid sequence of SEQ ID NO: 1417. The conserved Histone-like transcription factor CBF/NF-Y/archaeal histone, subunit A domain identified using InterProScan is underlined.

FIG. 431. Amino acid sequence of SEQ ID NO: 1418. The conserved Histone-fold/TFIID-TAF/NF-Y domain domain identified using InterProScan is underlined.

FIG. 432. Amino acid sequence of SEQ ID NO: 3632. The conserved Transcription factor CBF/NF-Y/archaeal histone domain identified using InterProScan is underlined.

FIG. 433. Amino acid sequence of SEQ ID NO: 1421. The conserved Tesmin/TSO1-like CXC domains identified using InterProScan are underlined.

FIG. 434. Amino acid sequence of SEQ ID NO: 1426. The conserved Hpt domain identified using InterProScan is underlined.

FIG. 435. Amino acid sequence of SEQ ID NO: 1427. The conserved Response regulator receiver domain identified using InterProScan is underlined.

FIG. 436. Amino acid sequence of SEQ ID NO: 1437. The conserved Response regulator receiver domain identified using InterProScan is underlined.

FIG. 437. Amino acid sequence of SEQ ID NO: 1438. The conserved GRAS family transcription factor domain identified using InterProScan is underlined.

FIG. 438. Amino acid sequence of SEQ ID NO: 1439. The conserved GRAS family transcription factor domain identified using InterProScan is underlined.

FIG. 439. Amino acid sequence of SEQ ID NO: 1440. The conserved HMG1/2 (high mobility group) box domain identified using InterProScan is underlined.

FIG. 440. Amino acid sequence of SEQ ID NO: 1441. The conserved HMG1/2 (high mobility group) box domain identified using InterProScan is underlined.

FIG. 441. Amino acid sequence of SEQ ID NO: 1442. The conserved HMG1/2 (high mobility group) box domain identified using InterProScan is underlined.

FIG. 442. Amino acid sequence of SEQ ID NO: 1443. The conserved HMG1/2 (high mobility group) box domain identified using InterProScan is underlined.

FIG. 443. Amino acid sequence of SEQ ID NO: 3633. The conserved HMG1/2 (high mobility group) box domain identified using InterProScan is underlined.

FIG. 444. Amino acid sequence of SEQ ID NO: 1445. The conserved ARID domain and HMG1/2 (high mobility group) box domain identified using InterProScan are underlined.

FIG. 445. Amino acid sequence of SEQ ID NO: 1446. The conserved HMG1/2 (high mobility group) box domain identified using InterProScan is underlined.

FIG. 446. Amino acid sequence of SEQ ID NO: 1448. The conserved Homeobox domain identified using InterProScan is underlined.

FIG. 447. Amino acid sequence of SEQ ID NO: 1454. The conserved Homeobox domain identified using InterProScan is underlined.

FIG. 448. Amino acid sequence of SEQ ID NO: 1455. The conserved Homeobox domain identified using InterProScan is underlined.

FIG. 449. Amino acid sequence of SEQ ID NO: 3634. The conserved Homeobox domain identified using InterProScan is underlined.

FIG. 450. Amino acid sequence of SEQ ID NO: 1457. The conserved Homeobox domain identified using InterProScan is underlined.

FIG. 451. Amino acid sequence of SEQ ID NO: 1458. The conserved Homeobox domain identified using InterProScan is underlined.

FIG. 452. Amino acid sequence of SEQ ID NO: 1459. The conserved Homeobox domain identified using InterProScan is underlined.

FIG. 453. Amino acid sequence of SEQ ID NO: 1460. The conserved Homeobox domain identified using InterProScan is underlined.

FIG. 454. Amino acid sequence of SEQ ID NO: 1461. The conserved Homeobox domain identified using InterProScan is underlined.

FIG. 455. Amino acid sequence of SEQ ID NO: 1462. The conserved Homeobox domain identified using InterProScan is underlined.

FIG. 456. Amino acid sequence of SEQ ID NO: 1463. The conserved Homeobox domain identified using InterProScan is underlined.

FIG. 457. Amino acid sequence of SEQ ID NO: 1464. The conserved Homeobox domain identified using InterProScan is underlined.

FIG. 458. Amino acid sequence of SEQ ID NO: 1465. The conserved Homeobox domain identified using InterProScan is underlined.

FIG. 459. Amino acid sequence of SEQ ID NO: 1466. The conserved Homeobox domain identified using InterProScan is underlined.

FIG. 460. Amino acid sequence of SEQ ID NO: 1467. The conserved Homeobox domain identified using InterProScan is underlined.

FIG. 461. Amino acid sequence of SEQ ID NO: 1468. The conserved Homeobox domain identified using InterProScan is underlined.

FIG. 462. Amino acid sequence of SEQ ID NO: 1469. The conserved Homeobox domain identified using InterProScan is underlined.

FIG. 463 Amino acid sequence of SEQ ID NO: 3635. The conserved Homeobox domain identified using InterProScan is underlined.

FIG. 464. Amino acid sequence of SEQ ID NO: 1471. The conserved Homeobox domain identified using InterProScan is underlined.

FIG. 465. Amino acid sequence of SEQ ID NO: 1472. The conserved Homeobox domain identified using InterProScan is underlined.

FIG. 466. Amino acid sequence of SEQ ID NO: 1473. The conserved Homeobox domain identified using InterProScan is underlined.

FIG. 467. Amino acid sequence of SEQ ID NO: 1474. The conserved Homeobox domain identified using InterProScan is underlined.

FIG. 468. Amino acid sequence of SEQ ID NO: 1475. The conserved Heat shock factor (HSF)-type DNA-binding domain identified using InterProScan is underlined.

FIG. 469. Amino acid sequence of SEQ ID NO: 1476. The conserved Heat shock factor (HSF)-type DNA-binding domain identified using InterProScan is underlined.

FIG. 470. Amino acid sequence of SEQ ID NO: 1477. The conserved Heat shock factor (HSF)-type DNA-binding domain identified using InterProScan is underlined.

FIG. 471. Amino acid sequence of SEQ ID NO: 1478. The conserved Heat shock factor (HSF)-type DNA-binding domain identified using InterProScan is underlined.

FIG. 472. Amino acid sequence of SEQ ID NO: 1479. The conserved Heat shock factor (HSF)-type DNA-binding domain identified using InterProScan is underlined.

FIG. 473. Amino acid sequence of SEQ ID NO: 1480. The conserved Heat shock factor (HSF)-type DNA-binding domain identified using InterProScan is underlined.

FIG. 474. Amino acid sequence of SEQ ID NO: 1483. The conserved Zn-binding protein LIM domains identified using InterProScan are underlined.

FIG. 475. Amino acid sequence of SEQ ID NO: 1484. The conserved Zn-binding protein LIM domains identified using InterProScan are underlined.

FIG. 476. Amino acid sequence of SEQ ID NO: 3636. The conserved Zn-binding protein LIM domains identified using InterProScan are underlined.

FIG. 477. Amino acid sequence of SEQ ID NO: 1486. The conserved Zn-binding protein LIM domains identified using InterProScan are underlined.

FIG. 478. Amino acid sequence of SEQ ID NO: 1487. The conserved Transcrition factor MADS-box (SEQ ID NO: 3668) domain identified using InterProScan is underlined.

FIG. 479. Amino acid sequence of SEQ ID NO: 1488. The conserved Transcrition factor MADS-box (SEQ ID NO: 3668) domain identified using InterProScan is underlined.

FIG. 480. Amino acid sequence of SEQ ID NO: 1489. The conserved Transcrition factor MADS-box (SEQ ID NO: 3668) domain identified using InterProScan is underlined.

FIG. 481. Amino acid sequence of SEQ ID NO: 1490. The conserved Transcrition factor MADS-box (SEQ ID NO: 3668) domain identified using InterProScan is underlined.

FIG. 482. Amino acid sequence of SEQ ID NO: 1491. The conserved Transcrition factor MADS-box (SEQ ID NO: 3668) domain identified using InterProScan is underlined.

FIG. 483. Amino acid sequence of SEQ ID NO: 1492. The conserved Transcrition factor MADS-box (SEQ ID NO: 3668) domain identified using InterProScan is underlined.

FIG. 484. Amino acid sequence of SEQ ID NO: 1493. The conserved Transcrition factor MADS-box (SEQ ID NO: 3668) domain identified using InterProScan is underlined.

FIG. 485. Amino acid sequence of SEQ ID NO: 1494. The conserved Transcrition factor MADS-box (SEQ ID NO: 3668) domain identified using InterProScan is underlined.

FIG. 486. Amino acid sequence of SEQ ID NO: 1495. The conserved MADS-box (SEQ ID NO: 3668) and K-box domains identified using InterProScan are underlined.

FIG. 487. Amino acid sequence of SEQ ID NO: 1496. The conserved Transcrition factor MADS-box (SEQ ID NO: 3668) domain identified using InterProScan is underlined.

FIG. 488. Amino acid sequence of SEQ ID NO: 1497. The conserved Transcrition factor MADS-box (SEQ ID NO: 3668) domain identified using InterProScan is underlined.

FIG. 489. Amino acid sequence of SEQ ID NO: 1498. The conserved MADS-box (SEQ ID NO: 3668) domain and K-box domain identified using InterProScan are underlined.

FIG. 490. Amino acid sequence of SEQ ID NO: 1499 The conserved Transcrition factor, MADS-box (SEQ ID NO: 3668) domain identified using InterProScan is underlined.

FIG. 491. Amino acid sequence of SEQ ID NO: 1500. The conserved MADS-box (SEQ ID NO: 3668) domain and K-box domain identified using InterProScan are underlined.

FIG. 492. Amino acid sequence of SEQ ID NO: 1501. The conserved MADS-box (SEQ ID NO: 3668) domain and K-box domain identified using InterProScan are underlined.

FIG. 493. Amino acid sequence of SEQ ID NO: 1502. The conserved MADS-box (SEQ ID NO: 3668) and K-box domains identified using InterProScan are underlined.

FIG. 494. Amino acid sequence of SEQ ID NO: 1503. The conserved Transcrition factor MADS-box (SEQ ID NO: 3668) domain identified using InterProScan is underlined.

FIG. 495. Amino acid sequence of SEQ ID NO: 1504. The conserved Transcrition factor MADS-box (SEQ ID NO: 3668) domain identified using InterProScan is underlined.

FIG. 496. Amino acid sequence of SEQ ID NO: 1506. The conserved Transcrition factor MADS-box (SEQ ID NO: 3668) domain identified using InterProScan is underlined.

FIG. 497. Amino acid sequence of SEQ ID NO: 1507. The conserved Transcrition factor MADS-box (SEQ ID NO: 3668) domain identified using InterProScan is underlined.

FIG. 498. Amino acid sequence of SEQ ID NO: 1508. The conserved MADS-box (SEQ ID NO: 3668) domain and K-box domain identified using InterProScan are underlined.

FIG. 499. Amino acid sequence of SEQ ID NO: 1509. The conserved MADS-box (SEQ ID NO: 3668) domain and K-box domain identified using InterProScan are underlined.

FIG. 500. Amino acid sequence of SEQ ID NO: 1510. The conserved Transcrition factor MADS-box (SEQ ID NO: 3668) domain identified using InterProScan is underlined.

FIG. 501. Amino acid sequence of SEQ ID NO: 1511. The conserved Transcrition factor MADS-box (SEQ ID NO: 3668) domain identified using InterProScan is underlined.

FIG. 502. Amino acid sequence of SEQ ID NO: 1512. The conserved MADS-box (SEQ ID NO: 3668) domain and K-box domain identified using InterProScan are underlined.

FIG. 503. Amino acid sequence of SEQ ID NO: 1513. The conserved Transcrition factor MADS-box (SEQ ID NO: 3668) domain identified using InterProScan is underlined.

FIG. 504. Amino acid sequence of SEQ ID NO: 1515. The conserved Transcrition factor MADS-box (SEQ ID NO: 3668) domain identified using InterProScan is underlined.

FIG. 505. Amino acid sequence of SEQ ID NO: 1516. The conserved Transcrition factor MADS-box (SEQ ID NO: 3668) domain identified using InterProScan is underlined.

FIG. 506. Amino acid sequence of SEQ ID NO: 1517. The conserved MADS-box (SEQ ID NO: 3668) domain identified using InterProScan is underlined.

FIG. 507. Amino acid sequence of SEQ ID NO: 1518. The conserved Myb DNA-binding domain identified using InterProScan is underlined.

FIG. 508. Amino acid sequence of SEQ ID NO: 3637. The conserved Myb DNA-binding domains identified using InterProScan are underlined.

FIG. 509. Amino acid sequence of SEQ ID NO: 1520. The conserved Myb DNA-binding domains identified using InterProScan are underlined.

FIG. 510 Amino acid sequence of SEQ ID NO: 3638. The conserved Myb DNA-binding domains identified using InterProScan are underlined.

FIG. 511. Amino acid sequence of SEQ ID NO: 1522. The conserved Myb DNA-binding domains identified using InterProScan are underlined.

FIG. 512. Amino acid sequence of SEQ ID NO: 3639. The conserved Myb DNA-binding domains identified using InterProScan are underlined.

FIG. 513. Amino acid sequence of SEQ ID NO: 1526. The conserved Myb DNA-binding domains identified using InterProScan are underlined.

FIG. 514. Amino acid sequence of SEQ ID NO: 3640. The conserved Myb DNA-binding domain identified using InterProScan is underlined.

FIG. 515. Amino acid sequence of SEQ ID NO: 3641. The conserved Myb DNA-binding domain identified using InterProScan is underlined.

FIG. 516. Amino acid sequence of SEQ ID NO: 3642. The conserved Myb DNA-binding domain identified using InterProScan is underlined.

FIG. 517. Amino acid sequence of SEQ ID NO: 1531. The conserved Myb DNA-binding domains identified using InterProScan are underlined.

FIG. 518. Amino acid sequence of SEQ ID NO: 1532. The conserved Myb DNA-binding domain identified using InterProScan is underlined.

FIG. 519. Amino acid sequence of SEQ ID NO: 1533. The conserved Myb DNA-binding domain identified using InterProScan is underlined.

FIG. 520. Amino acid sequence of SEQ ID NO: 1534. The conserved Myb DNA-binding domains identified using InterProScan are underlined.

FIG. 521. Amino acid sequence of SEQ ID NO: 1535. The conserved Myb DNA-binding domain identified using InterProScan is underlined.

FIG. 522. Amino acid sequence of SEQ ID NO: 1536. The conserved Myb DNA-binding domain identified using InterProScan is underlined.

FIG. 523. Amino acid sequence of SEQ ID NO: 1537. The conserved Myb DNA-binding domains identified using InterProScan are underlined.

FIG. 524. Amino acid sequence of SEQ ID NO: 1538. The conserved Myb DNA-binding domain identified using InterProScan is underlined.

FIG. 525. Amino acid sequence of SEQ ID NO: 1539. The conserved Myb DNA-binding domain identified using InterProScan is underlined.

FIG. 526. Amino acid sequence of SEQ ID NO: 1540. Amino acid sequence of SEQ ID NO: 768. The conserved Myb DNA-binding domains identified using InterProScan are underlined.

FIG. 527. Amino acid sequence of SEQ ID NO: 1541. The conserved Myb DNA-binding domain identified using InterProScan is underlined.

FIG. 528. Amino acid sequence of SEQ ID NO: 1542. The conserved Myb DNA-binding domains identified using InterProScan are underlined.

FIG. 529. Amino acid sequence of SEQ ID NO: 1543. The conserved Myb DNA-binding domain identified using InterProScan is underlined.

FIG. 530. Amino acid sequence of SEQ ID NO: 1544. The conserved Myb DNA-binding domain identified using InterProScan is underlined.

FIG. 531. Amino acid sequence of SEQ ID NO: 1545. The conserved Myb DNA-binding domain identified using InterProScan is underlined.

FIG. 532. Amino acid sequence of SEQ ID NO: 1546. The conserved Myb DNA-binding domain identified using InterProScan is underlined.

FIG. 533. Amino acid sequence of SEQ ID NO: 1547. The conserved Myb DNA-binding domain identified using InterProScan is underlined.

FIG. 534. Amino acid sequence of SEQ ID NO: 1548. The conserved Myb DNA-binding domain identified using InterProScan is underlined.

FIG. 535. Amino acid sequence of SEQ ID NO: 1550. The conserved Myb DNA-binding domain identified using InterProScan is underlined.

FIG. 536. Amino acid sequence of SEQ ID NO: 1551. The conserved Myb DNA-binding domain identified using InterProScan is underlined.

FIG. 537. Amino acid sequence of SEQ ID NO: 1552. The conserved Myb DNA-binding domain identified using InterProScan is underlined.

FIG. 538. Amino acid sequence of SEQ ID NO: 1553. The conserved Myb DNA-binding domain identified using InterProScan is underlined.

FIG. 539. Amino acid sequence of SEQ ID NO: 1554. The conserved Myb DNA-binding domain identified using InterProScan is underlined.

FIG. 540. Amino acid sequence of SEQ ID NO: 1555. The conserved Myb DNA-binding domain identified using InterProScan is underlined.

FIG. 541. Amino acid sequence of SEQ ID NO: 1556. The conserved Myb DNA-binding domain identified using InterProScan is underlined.

FIG. 542. Amino acid sequence of SEQ ID NO: 1557. The conserved Myb DNA-binding domain identified using InterProScan is underlined.

FIG. 543. Amino acid sequence of SEQ ID NO: 1558. The conserved Myb DNA-binding domain identified using InterProScan is underlined.

FIG. 544. Amino acid sequence of SEQ ID NO: 3643. The conserved Myb DNA-binding domain identified using InterProScan is underlined.

FIG. 545. Amino acid sequence of SEQ ID NO: 1560. The conserved Myb DNA-binding domain identified using InterProScan is underlined.

FIG. 546. Amino acid sequence of SEQ ID NO: 1561. The conserved Myb DNA-binding domains identified using InterProScan are underlined.

FIG. 547. Amino acid sequence of SEQ ID NO: 1562. The conserved Myb DNA-binding domain identified using InterProScan is underlined.

FIG. 548. Amino acid sequence of SEQ ID NO: 1564. The conserved Myb DNA-binding domain identified using InterProScan is underlined.

FIG. 549. Amino acid sequence of SEQ ID NO: 1565. The conserved Myb DNA-binding domain identified using InterProScan is underlined.

FIG. 550. Amino acid sequence of SEQ ID NO: 1569. The conserved Myb DNA-binding domain identified using InterProScan is underlined.

FIG. 551. Amino acid sequence of SEQ ID NO: 1570. The conserved Myb DNA-binding domain identified using InterProScan is underlined.

FIG. 552. Amino acid sequence of SEQ ID NO: 1571. The conserved Myb DNA-binding domain identified using InterProScan is underlined.

FIG. 553. Amino acid sequence of SEQ ID NO: 1572. The conserved No apical meristem (NAM) protein domain identified using InterProScan is underlined.

FIG. 554. Amino acid sequence of SEQ ID NO: 1573. The conserved No apical meristem (NAM) protein domain identified using InterProScan is underlined.

FIG. 555. Amino acid sequence of SEQ ID NO: 3644. The conserved No apical meristem (NAM) protein domain identified using InterProScan is underlined.

FIG. 556. Amino acid sequence of SEQ ID NO: 1576. The conserved No apical meristem (NAM) protein domain identified using InterProScan is underlined.

FIG. 557. Amino acid sequence of SEQ ID NO: 1578. The conserved No apical meristem (NAM) protein domain identified using InterProScan is underlined.

FIG. 558. Amino acid sequence of SEQ ID NO: 1579. The conserved No apical meristem (NAM) protein domain identified using InterProScan is underlined.

FIG. 559. Amino acid sequence of SEQ ID NO: 1580. The conserved No apical meristem (NAM) protein domain identified using InterProScan is underlined.

FIG. 560. Amino acid sequence of SEQ ID NO: 1581. The conserved No apical meristem (NAM) protein domain identified using InterProScan is underlined.

FIG. 561. Amino acid sequence of SEQ ID NO: 1582. The conserved No apical meristem (NAM) protein domain identified using InterProScan is underlined.

FIG. 562. Amino acid sequence of SEQ ID NO: 1584. The conserved No apical meristem (NAM) protein domain identified using InterProScan is underlined.

FIG. 563. Amino acid sequence of SEQ ID NO: 1585. The conserved No apical meristem (NAM) protein domain identified using InterProScan is underlined.

FIG. 564. Amino acid sequence of SEQ ID NO: 1586. The conserved No apical meristem (NAM) protein domain identified using InterProScan is underlined.

FIG. 565. Amino acid sequence of SEQ ID NO: 1587. The conserved No apical meristem (NAM) protein domain identified using InterProScan is underlined.

FIG. 566. Amino acid sequence of SEQ ID NO: 1588. The conserved No apical meristem (NAM) protein domain identified using InterProScan is underlined.

FIG. 567. Amino acid sequence of SEQ ID NO: 1589. The conserved No apical meristem (NAM) protein domain identified using InterProScan is underlined.

FIG. 568. Amino acid sequence of SEQ ID NO: 1590. The conserved No apical meristem (NAM) protein domain identified using InterProScan is underlined.

FIG. 569. Amino acid sequence of SEQ ID NO: 1591. The conserved No apical meristem (NAM) protein domain identified using InterProScan is underlined.

FIG. 570. Amino acid sequence of SEQ ID NO: 1592. The conserved No apical meristem (NAM) protein domain identified using InterProScan is underlined.

FIG. 571. Amino acid sequence of SEQ ID NO: 1593. The conserved No apical meristem (NAM) protein domain identified using InterProScan is underlined.

FIG. 572. Amino acid sequence of SEQ ID NO: 1594. The conserved No apical meristem (NAM) protein domain identified using InterProScan is underlined.

FIG. 573. Amino acid sequence of SEQ ID NO: 1595. The conserved No apical meristem (NAM) protein domain identified using InterProScan is underlined.

FIG. 574. Amino acid sequence of SEQ ID NO: 1596. The conserved Plant regulator RWP-RK domain identified using InterProScan is underlined.

FIG. 575. Amino acid sequence of SEQ ID NO: 3645. The conserved Chromo domain identified using InterProScan is underlined.

FIG. 576. Amino acid sequence of SEQ ID NO: 1598. The conserved AP2 and B3 domains identified using InterProScan are underlined.

FIG. 577. Amino acid sequence of SEQ ID NO: 1599. The conserved AP2 and B3 domains identified using InterProScan are underlined.

FIG. 578. Amino acid sequence of SEQ ID NO: 1603. The conserved SBP plant protein domain identified using InterProScan is underlined.

FIG. 579. Amino acid sequence of SEQ ID NO: 1605. The conserved SBP plant protein domain identified using InterProScan is underlined.

FIG. 580. Amino acid sequence of SEQ ID NO: 3646. The conserved SBP plant protein domain identified using InterProScan is underlined.

FIG. 581. Amino acid sequence of SEQ ID NO: 1607. The conserved TCP family transcription factor domain identified using InterProScan is underlined.

FIG. 582. Amino acid sequence of SEQ ID NO: 1608. The conserved TCP family transcription factor domain identified using InterProScan is underlined.

FIG. 583. Amino acid sequence of SEQ ID NO: 1609. The conserved TCP family transcription factor domain identified using InterProScan is underlined.

FIG. 584. Amino acid sequence of SEQ ID NO: 1610. The conserved TCP family transcription factor domain identified using InterProScan is underlined.

FIG. 585. Amino acid sequence of SEQ ID NO: 1626. The conserved Tubby domain identified using InterProScan is underlined.

FIG. 586. Amino acid sequence of SEQ ID NO: 1628. The conserved Tubby domain identified using InterProScan is underlined.

FIG. 587. Amino acid sequence of SEQ ID NO: 1629. The conserved Tubby domain identified using InterProScan is underlined.

FIG. 588. Amino acid sequence of SEQ ID NO: 1630. The conserved DNA-binding WRKY (SEQ ID NO: 3670) domain identified using InterProScan is underlined.

FIG. 589. Amino acid sequence of SEQ ID NO: 1631. The conserved DNA-binding WRKY (SEQ ID NO: 3670) domain identified using InterProScan is underlined.

FIG. 590. Amino acid sequence of SEQ ID NO: 1632. The conserved DNA-binding WRKY (SEQ ID NO: 3670) domain identified using InterProScan is underlined.

FIG. 591. Amino acid sequence of SEQ ID NO: 1633. The conserved DNA-binding WRKY (SEQ ID NO: 3670) domain identified using InterProScan is underlined.

FIG. 592. Amino acid sequence of SEQ ID NO: 1634. The conserved DNA-binding WRKY (SEQ ID NO: 3670) domain identified using InterProScan is underlined.

FIG. 593. Amino acid sequence of SEQ ID NO: 1635. The conserved DNA-binding WRKY (SEQ ID NO: 3670) domain identified using InterProScan is underlined.

FIG. 594. Amino acid sequence of SEQ ID NO: 3647. The conserved DNA-binding WRKY (SEQ ID NO: 3670) domain identified using InterProScan is underlined.

FIG. 595. Amino acid sequence of SEQ ID NO: 1637. The conserved DNA-binding WRKY (SEQ ID NO: 3670) domain identified using InterProScan is underlined.

FIG. 596. Amino acid sequence of SEQ ID NO: 1638. The conserved DNA-binding WRKY (SEQ ID NO: 3670) domain identified using InterProScan is underlined.

FIG. 597. Amino acid sequence of SEQ ID NO: 1639. The conserved DNA-binding WRKY (SEQ ID NO: 3670) domains identified using InterProScan are underlined.

FIG. 598. Amino acid sequence of SEQ ID NO: 1640. The conserved DNA-binding WRKY (SEQ ID NO: 3670) domains identified using InterProScan are underlined.

FIG. 599 provides a schematic representation of vector pART27.

FIG. 600: Amino Acid sequence of SEQ ID NO: 832. The conserved Pathogenesis-related transcriptional factor and ERF domain is underlined.

FIG. 601: Amino Acid sequence of SEQ ID NO: 859. The conserved AUX/IAA family domain is underlined, and the conserved transcriptional factor B3 family domain is in bold.

FIG. 602: Amino Acid sequence of SEQ ID NO: 860. The conserved transcriptional factor B3 domain is underlined.

FIG. 603: Amino Acid sequence of SEQ ID NO: 861. The conserved transcriptional factor B3 domain is underlined.

FIG. 604: Amino Acid sequence of SEQ ID NO: 3648. The conserved Zn-finger, CONSTANS type domains identified using InterProScan are underlined.

FIG. 605: Amino Acid sequence of SEQ ID NO: 863. The conserved transcriptional factor B3 family domain is underlined.

FIG. 606: Amino Acid sequence of SEQ ID NO: 864. The conserved transcriptional factor B3 family domain is underlined.

FIG. 607: Amino Acid sequence of SEQ ID NO: 865. The conserved transcriptional factor B3 domain is underlined.

FIG. 608: Amino Acid sequence of SEQ ID NO: 866. The conserved transcriptional factor B3 family domain is underlined.

FIG. 609: Amino Acid sequence of SEQ ID NO: 896. The basic helix-loop-helix (bHLH) dimerization family domain is underlined.

FIG. 610: Amino Acid sequence of SEQ ID NO: 900. The basic helix-loop-helix (bHLH) dimerization domain is underlined.

FIG. 611: Amino Acid sequence of SEQ ID NO: 901. The basic helix-loop-helix (bHLH) dimerization domain is underlined.

FIG. 612: Amino Acid sequence of SEQ ID NO: 902. The conserved basic helix-loop-helix dimerization domain is underlined.

FIG. 613: Amino Acid sequence of SEQ ID NO: 903. The basic helix-loop-helix (bHLH) dimerization domain is underlined. FIG. 607: Amino Acid sequence of 912. The conserved basic-leucine zipper (bZIP) transcription factor domain is underlined and the basic-leucine zipper (bZIP) transcription factor domain signature is in bold.

FIG. 614: Amino Acid sequence of SEQ ID NO: 912. The conserved basic-leucine zipper (bZIP) transcription factor domain is underlined and the basic-leucine zipper (bZIP) transcription factor domain signature is in bold.

FIG. 615: Amino Acid sequence of SEQ ID NO: 913. The conserved basic-leucine zipper (bZIP) transcription factor domain is underlined and the basic-leucine zipper (bZIP) transcription factor domain signature is in bold.

FIG. 616: Amino Acid sequence of SEQ ID NO: 915. The conserved basic-leucine zipper (bZIP) transcription factor domain is underlined.

FIG. 617: Amino Acid sequence of SEQ ID NO: 916. The conserved basic-leucine zipper (bZIP) transcription factor domain is underlined and the basic-leucine zipper (bZIP) transcription factor domain signature is in bold.

FIG. 618: Amino Acid sequence of SEQ ID NO: 918. The conserved basic-leucine zipper (bZIP) transcription factor domain is underlined and the basic-leucine zipper (bZIP) transcription factor domain signature is in bold.

FIG. 619: Amino Acid sequence of SEQ ID NO: 921. The conserved basic-leucine zipper (bZIP) transcription factor domain is underlined and the basic-leucine zipper (bZIP) transcription factor domain signature is in bold.

FIG. 620: Amino Acid sequence of SEQ ID NO: 922. The conserved basic-leucine zipper (bZIP) transcription factor domain is underlined.

FIG. 621: Amino Acid sequence of SEQ ID NO: 923. The conserved basic-leucine zipper (bZIP) transcription factor domain is underlined FIG. 622: Amino Acid sequence of SEQ ID NO: 924. The conserved basic-leucine zipper (bZIP) transcription factor domain is underlined and the basic-leucine zipper (bZIP) transcription factor domain signature is in bold.

FIG. 623: Amino Acid sequence of SEQ ID NO: 926. The conserved basic-leucine zipper (bZIP) transcription factor domain is underlined and the basic-leucine zipper (bZIP) transcription factor domain signature is in bold.

FIG. 624: Amino Acid sequence of SEQ ID NO: 927. The conserved basic-leucine zipper (bZIP) transcription factor domain is underlined and the basic-leucine zipper (bZIP) transcription factor domain signature is in bold.

FIG. 625: Amino Acid sequence of SEQ ID NO: 928. The conserved basic-leucine zipper (bZIP) transcription factor domain is underlined and the basic-leucine zipper (bZIP) transcription factor domain signature is in bold.

FIG. 626: Amino Acid sequence of SEQ ID NO: 929. The basic helix-loop-helix (bHLH) dimerization domain is underlined.

FIG. 627: Amino Acid sequence of SEQ ID NO: 940. The conserved DOF-type zinc finger domain is underlined.

FIG. 628: Amino Acid sequence of SEQ ID NO: 941. The conserved B-box zinc finger family domains are underlined.

FIG. 629: Amino Acid sequence of SEQ ID NO: 950. The conserved B-box zinc finger family domains are underlined.

FIG. 630: Amino Acid sequence of SEQ ID NO: 968. The conserved C2H2-type zinc finger is underlined.

FIG. 631: Amino Acid sequence of SEQ ID NO: 970. The conserved C2H2-type zinc finger domain is underlined.

FIG. 632: Amino Acid sequence of SEQ ID NO: 971. The conserved C2H2-type zinc finger domain signatures are in bold.

FIG. 633: Amino Acid sequence of SEQ ID NO: 972. The conserved C2H2-type zinc finger domain is underlined.

FIG. 634: Amino Acid sequence of SEQ ID NO: 1008. The conserved transcription factor CBF/NF-Y/archaeal histone family domain is underlined and the CBF-A/NF-YB subunit signature is in bold.

FIG. 635: Amino Acid sequence of SEQ ID NO: 1014. The conserved Ethylene insensitive 3 family domain is underlined.

FIG. 636: Amino Acid sequence of SEQ ID NO: 1023. The conserved SHAQKYF (SEQ ID NO: 3671) class Myb-like DNA-binding domain is underlined.

FIG. 637: Amino Acid sequence of SEQ ID NO: 1024. The conserved SHAQKYF (SEQ ID NO: 3671) class Myb-like DNA-binding domain is in bold.

FIG. 638: Amino Acid sequence of SEQ ID NO: 1031. The conserved SHAQKYF (SEQ ID NO: 3671) class Myb-like DNA-binding domain is underlined.

FIG. 639: Amino Acid sequence of SEQ ID NO: 1034. The conserved GRAS family domain is underlined.

FIG. 640: Amino Acid sequence of SEQ ID NO: 1035. The conserved GRAS family domain is underlined.

FIG. 641: Amino Acid sequence of SEQ ID NO: 1036. The conserved GRAS family domain is underlined.

FIG. 642: Amino Acid sequence of SEQ ID NO: 1046. The conserved HMG1/2 (high mobility group) box family domain is underlined FIG. 643: Amino Acid sequence of SEQ ID NO: 1048. The conserved HMG1/2 (high mobility group) box family domain is underlined, and the structure-specific recognition protein family domain is in bold.

FIG. 644: Amino Acid sequence of SEQ ID NO: 1050. The conserved homeobox domain is underlined with the homeobox domain signature in bold/underline. The lambda-like repressor helix-turn-helix motif is in italics.

FIG. 645: Amino Acid sequence of SEQ ID NO: 1051. The conserved homeobox domain is underlined.

FIG. 646: Amino Acid sequence of SEQ ID NO: 1052. The conserved homeobox domain is underlined with the homeobox domain signature in bold/underline. The homeobox-associated leucine zipper is in bold. The lambda-like repressor helix-turn-helix motif is in italics.

FIG. 647: Amino Acid sequence of SEQ ID NO: 1060. The conserved homeobox domain is underlined with the homeobox domain signature in bold/underline. The homeobox-associated leucine zipper is in bold.

FIG. 648: Amino Acid sequence of SEQ ID NO: 1062. The conserved homeobox domain is underlined, the ELK domain is in italics and the KNOX 1 and 2 domains are in bold.

FIG. 649: Amino Acid sequence of SEQ ID NO: 1063. The conserved homeobox domain is underlined with the homeobox domain signature in bold/underline. The homeobox-associated leucine zipper is in bold. The N-terminus of the HD-ZIP protein domain is in italics.

FIG. 650: Amino Acid sequence of SEQ ID NO: 1064. The conserved homeobox domain is underlined with the homeobox domain signature in bold/underline. The homeobox-associated leucine zipper is in bold. The lambda-like repressor helix-turn-helix motif is in italics.

FIG. 651: Amino Acid sequence of SEQ ID NO: 1066. The conserved homeobox domain is in bold with the homeobox domain signature in bold/underline. The homeobox-associated leucine zipper is underlined. The lambda FIG. 645: Amino Acid sequence of 1067. The ELK domain is underlined, the KNOX1 domain is in bold, and the KNOX2 domain is in bold/italics.

FIG. 652: Amino Acid sequence of SEQ ID NO: 1067. The ELK domain is underlined, the KNOX1 domain is in bold, and the KNOX2 domain is in bold/italics.

FIG. 653: Amino Acid sequence of SEQ ID NO: 1071. The conserved homeobox domain is underlined, the ELK domain is in italics and the KNOX 1 and 2 domains are in bold.

FIG. 654: Amino Acid sequence of SEQ ID NO: 1072. The conserved homeobox domain is underlined, the ELK domain is in italics and the KNOX 1 and 2 domains are in bold.

FIG. 655: Amino Acid sequence of SEQ ID NO: 1074. The conserved homeobox domain is underlined and the lipid-binding START family domain is in bold.

FIG. 656: Amino Acid sequence of SEQ ID NO: 1075. The conserved homeobox domain is underlined and the POX domain is in bold.

FIG. 657: Amino Acid sequence of SEQ ID NO: 1076. The conserved homeobox domain is underlined with the homeobox domain signature in bold. The lipid-binding START family domain is in bold/italics.

FIG. 658: Amino Acid sequence of SEQ ID NO: 1079. The conserved homeobox domain is underlined and the lipid-binding START family domain is in bold.

FIG. 659: Amino Acid sequence of SEQ ID NO: 1080. The conserved heat shock factor (HSF)-type DNA-binding domain is underlined and the HSF-type DNA-binding domain signature is in bold. The type I antifreeze protein domain is in bold/italics.

FIG. 660: Amino Acid sequence of SEQ ID NO: 1083. The conserved heat shock factor (HSF)-type DNA-binding domain is underlined and the HSF-type DNA-binding domain signature is in bold.

FIG. 661: Amino Acid sequence of SEQ ID NO: 1084. The conserved heat shock factor (HSF)-type DNA-binding family domain is underlined and the HSF-type DNA-binding domain signature is in bold.

FIG. 662: Amino Acid sequence of SEQ ID NO: 1085. The conserved heat shock factor (HSF)-type DNA-binding family domain is underlined.

FIG. 663: Amino Acid sequence of SEQ ID NO: 1097. The conserved MADS-box (SEQ ID NO: 3668) transcription factor family domain is underlined and the K-box transcription factor family domain is in bold.

FIG. 664: Amino Acid sequence of SEQ ID NO: 3649. The conserved Transcrition factor, MADS-box domain identified using InterProScan is underlined.

FIG. 665: Amino Acid sequence of SEQ ID NO: 1123. The conserved MADS box (SEQ ID NO: 3668) domain is underlined and MADS box domain signature is in bold. The conserved K box is in bold/italics.

FIG. 666: Amino Acid sequence of SEQ ID NO: 1125. The conserved MADS box (SEQ ID NO: 3668) family domain is underlined.

FIG. 667: Amino Acid sequence of SEQ ID NO: 1135. The conserved Myb DNA-binding domain is underlined and the Histone H1/H5 domain is in bold.

FIG. 668: Amino Acid sequence of SEQ ID NO: 1139. The conserved Myb DNA-binding domains are underlined.

FIG. 669: Amino Acid sequence of SEQ ID NO: 1141. The conserved Myb DNA-binding domains are underlined.

FIG. 670: Amino Acid sequence of SEQ ID NO: 1143. The conserved Myb DNA-binding domains are underlined and The Myb DNA-binding domain repeat signature 2 is in bold.

FIG. 671: Amino Acid sequence of SEQ ID NO: 1149. The conserved Myb DNA-binding domains are underlined.

FIG. 672: Amino Acid sequence of SEQ ID NO: 1152. The conserved Myb DNA-binding domains are underlined and the Myb DNA-binding domain repeat signature 2 is in bold.

FIG. 673: Amino Acid sequence of SEQ ID NO: 1157. The conserved Myb DNA-binding domains are underlined and two Myb DNA-binding domain repeat signatures 2 are in bold.

FIG. 674: Amino Acid sequence of SEQ ID NO: 1166. The conserved Myb DNA-binding domains are underlined.

FIG. 675: Amino Acid sequence of SEQ ID NO: 1169. The conserved Myb DNA-binding domain is underlined and the Histone H1/H5 domain is in bold.

FIG. 676: Amino Acid sequence of SEQ ID NO: 1170. The conserved Myb DNA-binding domains are underlined and the Myb DNA-binding domain repeat signature 2 is in bold.

FIG. 677: Amino Acid sequence of SEQ ID NO: 1173. The conserved Myb DNA-binding domains are underlined and the Myb DNA-binding domain repeat signature 2 is in bold.

FIG. 678: Amino Acid sequence of SEQ ID NO: 3650. The conserved No apical meristem (NAM) protein domain identified using InterProScan is underlined.

FIG. 679: Amino Acid sequence of SEQ ID NO: /1186. The conserved Myb DNA-binding domains are underlined and the Myb DNA-binding domain repeat signature 2 is in bold.

FIG. 680: Amino Acid sequence of SEQ ID NO: 1187. The conserved Myb DNA-binding domains are underlined and the Myb DNA-binding domain repeat signature 2 is in bold.

FIG. 681: Amino Acid sequence of SEQ ID NO: 1202. The conserved No apical meristem (NAM) domain is underlined.

FIG. 682: Amino Acid sequence of SEQ ID NO: 1207. The conserved No apical meristem (NAM) family domain is underlined.

FIG. 683: Amino Acid sequence of SEQ ID NO: 1208. The conserved No apical meristem (NAM) family domain is underlined.

FIG. 684: Amino Acid sequence of SEQ ID NO: 1212. The conserved No apical meristem (NAM) family domain is underlined.

FIG. 685: Amino Acid sequence of SEQ ID NO: 1214. The conserved No apical meristem (NAM) family domain is underlined.

FIG. 686: Amino Acid sequence of SEQ ID NO: 1216. The conserved No apical meristem (NAM) family domain is underlined.

FIG. 687: Amino Acid sequence of SEQ ID NO: 1225. The conserved No apical meristem (NAM) family domain is underlined.

FIG. 688: Amino Acid sequence of SEQ ID NO: 1237. The conserved TCP family transcription factor family domain is underlined.

FIG. 689: Amino Acid sequence of SEQ ID NO: 1238. The conserved TCP family transcription factor domain is underlined.

FIG. 690: Amino Acid sequence of SEQ ID NO: 1239. The conserved Myb DNA-binding domain is underlined.

FIG. 691: Amino Acid sequence of SEQ ID NO: 1243. The conserved Tubby domain is underlined.

FIG. 692: Amino Acid sequence of SEQ ID NO: 1244. The conserved cyclin-like F-box family domain is underlined and the tubby family domain is in bold.

FIG. 693: Amino Acid sequence of SEQ ID NO: 1245. The conserved Tubby domain is underlined and the Tub family signature 2 is in bold. The cyclin-like F-box domain is in italics.

FIG. 694: Amino Acid sequence of SEQ ID NO: 1250. The conserved DNA-binding WRKY (SEQ ID NO: 3670) domain is underlined.

FIG. 695: Amino Acid sequence of SEQ ID NO: 1253. The conserved WRKY (SEQ ID NO: 3670) family domain is underlined.

FIG. 696: Amino Acid sequence of SEQ ID NO: 1254. The conserved WRKY (SEQ ID NO: 3670) domain is underlined.

FIG. 697: Amino Acid sequence of SEQ ID NO: 1255. The conserved WRKY (SEQ ID NO: 3670) family domain is underlined.

FIG. 698: Amino Acid sequence of SEQ ID NO: 1259. The conserved WRKY (SEQ ID NO: 3670) domain is underlined.

FIG. 699: Amino Acid sequence of SEQ ID NO: 1263. The conserved DNA-binding WRKY (SEQ ID NO: 3670) domain is underlined.

FIG. 700: Amino Acid sequence of SEQ ID NO: 1264. The conserved WRKY (SEQ ID NO: 3670) domains are underlined.

FIG. 701: Amino Acid sequence of SEQ ID NO: 1265. The conserved WRKY (SEQ ID NO: 3670) domains are underlined.

FIG. 702: Amino Acid sequence of SEQ ID NO: 1266. The conserved WRKY (SEQ ID NO: 3670) domains are underlined.

FIG. 703: Amino Acid sequence of SEQ ID NO: 1267. The conserved WRKY (SEQ ID NO: 3670) domains are underlined.

FIG. 704: Amino Acid sequence of SEQ ID NO: 1973. The conserved PHD zinc finger-like domain is underlined.

FIG. 705: Amino Acid sequence of SEQ ID NO: 3651. The conserved PHD zinc finger-like domain is underlined.

FIG. 706: Amino Acid sequence of SEQ ID NO: 1975. The conserved Pathogenesis-related transcriptional factor and ERF domain is underlined.

FIG. 707: Amino Acid sequence of SEQ ID NO: 1976. The conserved Pathogenesis-related transcriptional factor and ERF domain is underlined.

FIG. 708: Amino Acid sequence of SEQ ID NO: 1977. The conserved Pathogenesis-related transcriptional factor and ERF domain is underlined.

FIG. 709: Amino Acid sequence of SEQ ID NO: 1978. The conserved Pathogenesis-related transcriptional factor and ERF domain is underlined.

FIG. 710: Amino Acid sequence of SEQ ID NO: 1979. The conserved Pathogenesis-related transcriptional factor and ERF domain is underlined.

FIG. 711: Amino Acid sequence of SEQ ID NO: 1980. The conserved Pathogenesis-related transcriptional factor and ERF family domain is underlined.

FIG. 712: Amino Acid sequence of SEQ ID NO: 1981. The conserved Pathogenesis-related transcriptional factor and ERF family domain is underlined.

FIG. 713: Amino Acid sequence of SEQ ID NO: 1982. The conserved Pathogenesis-related transcriptional factor and ERF domain is underlined.

FIG. 714: Amino Acid sequence of SEQ ID NO: 1983. The conserved Pathogenesis-related transcriptional factor and ERF family domain is underlined.

FIG. 715: Amino Acid sequence of SEQ ID NO: 1984. The conserved Pathogenesis-related transcriptional factor and ERF domains are underlined.

FIG. 716: Amino Acid sequence of SEQ ID NO: 1985. The conserved pathogenesis-related transcriptional factor and ERF family domain is underlined.

FIG. 717: Amino Acid sequence of SEQ ID NO: 1986. The conserved transcriptional factor B3 family domain is underlined.

FIG. 718: Amino Acid sequence of SEQ ID NO: 1987. The conserved transcriptional factor B3 family domain is underlined.

FIG. 719: Amino Acid sequence of SEQ ID NO: 1988. The conserved transcriptional factor B3 family domain is underlined.

FIG. 720: Amino Acid sequence of SEQ ID NO: 1989. The conserved AUX/IAA domain is underlined.

FIG. 721: Amino Acid sequence of SEQ ID NO: 1990. The conserved AUX/IAA domain is underlined.

FIG. 722: Amino Acid sequence of SEQ ID NO: 1991. The conserved AUX/IAA domain is underlined.

FIG. 723: Amino Acid sequence of SEQ ID NO: 1992. The conserved AUX/IAA family domain is underlined.

FIG. 724: Amino Acid sequence of SEQ ID NO: 1993. The conserved AUX/IAA family domain is underlined.

FIG. 725: Amino Acid sequence of SEQ ID NO: 1994. The conserved basic helix-loop-helix (bHLH) dimerization family domain is underlined.

FIG. 726: Amino Acid sequence of SEQ ID NO: 1995. The conserved basic helix-loop-helix (bHLH) dimerization family domain is underlined.

FIG. 727: Amino Acid sequence of SEQ ID NO: 1996. The basic helix-loop-helix (bHLH) dimerization domain is underlined.

FIG. 728: Amino Acid sequence of SEQ ID NO: 1997. The conserved basic helix-loop-helix (bHLH) dimerization domain is underlined.

FIG. 729: Amino Acid sequence of SEQ ID NO: 1998. The conserved basic helix-loop-helix (bHLH) dimerization family domain is underlined.

FIG. 730: Amino Acid sequence of SEQ ID NO: 1999. The basic helix-loop-helix (bHLH) dimerization domain is underlined.

FIG. 731: Amino Acid sequence of SEQ ID NO: 2000. The conserved basic helix-loop-helix dimerization domain is underlined.

FIG. 732: Amino Acid sequence of SEQ ID NO: 2001. The conserved basic helix-loop-helix (bHLH) dimerization family domain is underlined.

FIG. 733: Amino Acid sequence of SEQ ID NO: 2002. The basic helix-loop-helix (bHLH) dimerization domain is underlined.

FIG. 734: Amino Acid sequence of SEQ ID NO: 2003. The conserved basic helix-loop-helix (bHLH) dimerization family domain is underlined.

FIG. 735: Amino Acid sequence of SEQ ID NO: 2004. The conserved basic helix-loop-helix (bHLH) dimerization family domain is underlined.

FIG. 736: Amino Acid sequence of SEQ ID NO: 2005. The conserved basic helix-loop-helix (bHLH) dimerization family domain is underlined.

FIG. 737: Amino Acid sequence of SEQ ID NO: 2007. The conserved basic-leucine zipper (bZIP) transcription factor domain is underlined and the basic-leucine zipper (bZIP) transcription factor domain signature is in bold.

FIG. 738: Amino Acid sequence of SEQ ID NO: 2008. The conserved basic-leucine zipper (bZIP) transcription factor domain is underlined and the basic-leucine zipper (bZIP) transcription factor domain signature is in bold.

FIG. 739: Amino Acid sequence of SEQ ID NO: 2009. The conserved basic-leucine zipper (bZIP) transcription factor domain is underlined and the basic-leucine zipper (bZIP) transcription factor domain signature is in bold.

FIG. 740: Amino Acid sequence of SEQ ID NO: 2010. The conserved basic-leucine zipper (bZIP) transcription factor family domain is underlined and the basic-leucine zipper (bZIP) transcription factor domain signature is in bold.

FIG. 741: Amino Acid sequence of SEQ ID NO: 2012. The conserved basic-leucine zipper (bZIP) transcription factor family domain is underlined and the basic-leucine zipper (bZIP) transcription factor domain signature is in bold.

FIG. 742: Amino Acid sequence of SEQ ID NO: 2013. The conserved basic-leucine zipper (bZIP) transcription factor family domain is underlined and the basic-leucine zipper (bZIP) transcription factor domain signature is in bold.

FIG. 743: Amino Acid sequence of SEQ ID NO: 2014. The conserved B box zinc finger is underlined and the constans zinc finger domain is in bold.

FIG. 744: Amino Acid sequence of SEQ ID NO: 2015. The conserved DOF-type zinc finger is underlined.

FIG. 745: Amino Acid sequence of SEQ ID NO: 2016. The conserved DOF-type zinc finger domain is underlined.

FIG. 746: Amino Acid sequence of SEQ ID NO: 2018. The conserved DOF-type zinc finger domain is underlined.

FIG. 747: Amino Acid sequence of SEQ ID NO: 2019. The conserved B-box zinc finger family domains are underlined.

FIG. 748: Amino Acid sequence of SEQ ID NO: 2020. The conserved type 1 antifreeze protein domain is underlined.

FIG. 749: Amino Acid sequence of SEQ ID NO: 2021. The conserved C2H2-type zinc finger is underlined.

FIG. 750: Amino Acid sequence of SEQ ID NO: 2022. The conserved C2H2-type zinc finger family domain is underlined and the C2H2 type zinc finger domain signature is in bold.

FIG. 751: Amino Acid sequence of SEQ ID NO: 2024. The conserved C2H2-type zinc finger domain is underlined.

FIG. 752: Amino Acid sequence of SEQ ID NO: 2025. The conserved C2H2-type zinc finger family domain is underlined and the C2H2 type zinc finger domain signature is in bold.

FIG. 753: Amino Acid sequence of SEQ ID NO: 2026. The conserved C2H2-type zinc finger family domain is underlined.

FIG. 754: Amino Acid sequence of SEQ ID NO: 2027. The conserved zinc finger C2H2 type domain signature is underlined.

FIG. 755: Amino Acid sequence of SEQ ID NO: 2028. The conserved C2H2-type zinc finger family domain is underlined and the C2H2 type zinc finger domain signature is in bold.

FIG. 756: Amino Acid sequence of SEQ ID NO: 2029. The conserved C-x8-C-x5-C-x3-H (SEQ ID NO: 3667) type zinc finger family domains are underlined.

FIG. 757: Amino Acid sequence of SEQ ID NO: 2030. The conserved RNA-binding region RNP-1 (RNA recognition motif) family domains are underlined and the C-x8-C-x5-C-x3-H (SEQ ID NO: 3667) type zinc finger is in bold.

FIG. 758: Amino Acid sequence of SEQ ID NO: 2031. The conserved KH domain is in bold and the C-x8-C-x5-C-x3-H (SEQ ID NO: 3667) type Zn-finger domains are underlined.

FIG. 759: Amino Acid sequence of SEQ ID NO: 2032. The conserved G-protein beta WD-40 repeat domains are underlined and the Trp-Asp (WD) repeats signatures are in bold. The C-x8-C-x5-C-x3-H (SEQ ID NO: 3667) type zinc finger is in italics.

FIG. 760: Amino Acid sequence of SEQ ID NO: 2033. The conserved KH domain is in bold and the conserved Zn-finger, C-x8-C-x5-C-x3-H (SEQ ID NO: 3667) type domains are underlined.

FIG. 761: Amino Acid sequence of SEQ ID NO: 2034. The conserved C-x8-C-x5-C-x3-H (SEQ ID NO: 3667) type zinc finger is underlined, and the ankyrin family domain are in bold.

FIG. 762: Amino Acid sequence of SEQ ID NO: 2035. The conserved C-x8-C-x5-C-x3-H (SEQ ID NO: 3667) type zinc finger is underlined.

FIG. 763: Amino Acid sequence of SEQ ID NO: 2036. The conserved C-x8-C-x5-C-x3-H (SEQ ID NO: 3667) type zinc finger is underlined and the conserved Cys and His residues in bold, and the RNA-binding region RNP-1 (RNA recognition motif) is in bold italics.

FIG. 764: Amino Acid sequence of SEQ ID NO: 2037. The conserved CCAAT-binding transcription factor, subunit B, domain is underlined.

FIG. 765: Amino Acid sequence of SEQ ID NO: 2038. The conserved transcription factor CBF/NF-Y/archaeal histone domain is underlined.

FIG. 766: Amino Acid sequence of SEQ ID NO: 2039. The conserved transcription factor CBF/NF-Y/archaeal histone family domain is underlined and the CBF-A/NF-YB subunit signature is in bold.

FIG. 767: Amino Acid sequence of SEQ ID NO: 2040. The conserved CCAAT-binding transcription factor, subunit B, domain is underlined.

FIG. 768: Amino Acid sequence of SEQ ID NO: 2041. The conserved CCAAT-binding transcription factor, subunit B, domain is underlined.

FIG. 769: Amino Acid sequence of SEQ ID NO: 2042. The conserved transcription factor CBF/NF-Y/archaeal histone is underlined.

FIG. 770: Amino Acid sequence of SEQ ID NO: 2043. The conserved Myb DNA-binding domain is underlined and the response regulator receiver domain is in bold.

FIG. 771: Amino Acid sequence of SEQ ID NO: 2044. The conserved response regulator receiver domain is underlined.

FIG. 772: Amino Acid sequence of SEQ ID NO: 2045. The conserved response regulator receiver domain is underlined.

FIG. 773: Amino Acid sequence of SEQ ID NO: 2046. The conserved SHAQKYF class Myb-like DNA-binding domain is underlined.

FIG. 774: Amino Acid sequence of SEQ ID NO: 2047. The conserved Myb DNA-binding domain is underlined and the response regulator receiver domain is in bold.

FIG. 775: Amino Acid sequence of SEQ ID NO: 2049. The conserved SHAQKYF (SEQ ID NO: 3671) class Myb-like DNA-binding domain is underlined.

FIG. 776: Amino Acid sequence of SEQ ID NO: 2050. The response regulator receiver domain is underlined.

FIG. 777: Amino Acid sequence of SEQ ID NO: 2051. The conserved SHAQKYF (SEQ ID NO: 3671) class Myb-like DNA-binding domain is underlined.

FIG. 778: Amino Acid sequence of SEQ ID NO: 2052. The conserved response regulator receiver domain is underlined.

FIG. 779: Amino Acid sequence of SEQ ID NO: 2053. The conserved GRAS family domain is underlined.

FIG. 780: Amino Acid sequence of SEQ ID NO: 2054. The conserved GRAS family domain is underlined.

FIG. 781: Amino Acid sequence of SEQ ID NO: 2055. The conserved GRAS family domain is underlined.

FIG. 782: Amino Acid sequence of SEQ ID NO: 2056. The conserved GRAS family domain is underlined.

FIG. 783: Amino Acid sequence of SEQ ID NO: 2057. The conserved GRAS family domain is underlined.

FIG. 784: Amino Acid sequence of SEQ ID NO: 2058. The conserved GRAS family domain is underlined.

FIG. 785: Amino Acid sequence of SEQ ID NO: 2059. The conserved GRAS family domain is underlined.

FIG. 786: Amino Acid sequence of SEQ ID NO: 2060. The conserved GRAS family domain is underlined.

FIG. 787: Amino Acid sequence of SEQ ID NO: 2061. The conserved GRAS family domain is underlined.

FIG. 788: Amino Acid sequence of SEQ ID NO: 2062. The conserved GRAS family domain is underlined.

FIG. 789: Amino Acid sequence of SEQ ID NO: 2063. The conserved GRAS family domain is underlined.

FIG. 790: Amino Acid sequence of SEQ ID NO: 2064. The conserved GRAS family domain is underlined.

FIG. 791: Amino Acid sequence of SEQ ID NO: 2065. The conserved HMG1/2 (high mobility group) boxes are underlined.

FIG. 792: Amino Acid sequence of SEQ ID NO: 2066. The conserved HMG1/2 (high mobility group) box family domain is underlined.

FIG. 793: Amino Acid sequence of SEQ ID NO: 2067. The conserved homeobox domain is underlined and the lipid-binding START family domain is in bold.

FIG. 794: Amino Acid sequence of SEQ ID NO: 2068. The conserved homeobox family domain is underlined with the conserved homeobox domain signature in bold/underline, and the homeobox-associated leucine zipper (HALZ) is in bold.

FIG. 795: Amino Acid sequence of SEQ ID NO: 2069. The conserved homeobox domain is underlined, The ELK domain is in italics and the KNOX 1 and 2 domains are in bold.

FIG. 796: Amino Acid sequence of SEQ ID NO: 2070. The conserved homeobox domain is underlined with the homeobox domain signature in bold/underline. The homeobox-associated leucine zipper is in bold. The N-terminus of the HD-ZIP protein domain is in italics.

FIG. 797: Amino Acid sequence of SEQ ID NO: 2071. The conserved homeobox domain is underlined with the homeobox domain signature in bold. The lipid-binding START family domain is in bold/italics.

FIG. 798: Amino Acid sequence of SEQ ID NO: 2072. The conserved homeobox domain is underlined, the ELK domain is in italics and the KNOX 1 and 2 domains are in bold.

FIG. 799: Amino Acid sequence of SEQ ID NO: 2073. The conserved homeobox domain is underlined.

FIG. 800: Amino Acid sequence of SEQ ID NO: 2074. The conserved homeobox domain is underlined.

FIG. 801: Amino Acid sequence of SEQ ID NO: 2075. The conserved homeobox family domain is underlined and the PHD zinc finger-like domain is in bold.

FIG. 802: Amino Acid sequence of SEQ ID NO: 3652. The conserved homeobox domain is underlined with The conserved homeobox domain signature in bold/underline, and the homeobox-associated leucine zipper (HALZ) in bold.

FIG. 803: Amino Acid sequence of SEQ ID NO: 2077. The conserved homeobox domain is underlined.

FIG. 804: Amino Acid sequence of SEQ ID NO: 2078. The conserved homeobox domain is underlined with the conserved homeobox signature 1 boxed, and the conserved homeobox-associated leucine zipper (HALZ) double underlined with the leucine residues in bold.

FIG. 805: Amino Acid sequence of SEQ ID NO: 2079. The conserved heat shock factor (HSF)-type DNA-binding domain is underlined and the conserved heat shock factor (HSF)-type DNA-binding domain signature is boxed.

FIG. 806: Amino Acid sequence of SEQ ID NO: 2080. The conserved heat shock factor (HSF)-type DNA-binding domain is underlined.

FIG. 807: Amino Acid sequence of SEQ ID NO: 2081. The conserved heat shock factor (HSF)-type DNA-binding family domain is underlined.

FIG. 808: Amino Acid sequence of SEQ ID NO: 2082. The conserved heat shock factor (HSF)-type DNA-binding family domain is underlined and the HSF-type DNA-binding domain signature is in bold.

FIG. 809: Amino Acid sequence of SEQ ID NO: 2083. The conserved heat shock factor (HSF)-type DNA-binding family domain is underlined and the HSF-type DNA-binding domain signature is in bold.

FIG. 810: Amino Acid sequence of SEQ ID NO: 2084. The conserved jumonji C (jmjC) domain is underlined, the jumonji N (jmjN) domain is in bold and the C5HC2-type zinc finger is in bold/underline.

FIG. 811: Amino Acid sequence of SEQ ID NO: 2085. The conserved jumonji C (jmjC) domain is underlined.

FIG. 812: Amino Acid sequence of SEQ ID NO: 2087. The conserved jumonji C (jmjC) domain is underlined.

FIG. 813: Amino Acid sequence of SEQ ID NO: 2088. The conserved MADS-box (SEQ ID NO: 3668) transcription factor domain is underlined. The K-box transcription factor domain is in bold.

FIG. 814: Amino Acid sequence of SEQ ID NO: 3653. The conserved Transcrition factor, MADS-box (SEQ ID NO: 3668) domain identified using InterProScan is underlined.

FIG. 815: Amino Acid sequence of SEQ ID NO: 2090. The conserved MADS box (SEQ ID NO: 3668) domain is underlined and MADS box (SEQ ID NO: 3668) domain signature is in bold. The conserved K box is in bold/italics.

FIG. 816: Amino Acid sequence of SEQ ID NO: 2091. The conserved MADS box (SEQ ID NO: 3668) domain is underlined and MADS box (SEQ ID NO: 3668) domain signature is in bold. The conserved K box is in bold/italics.

FIG. 817: Amino Acid sequence of SEQ ID NO: 2092. The conserved Transcrition factor, MADS-box (SEQ ID NO: 3668) domain identified using InterProScan is underlined.

FIG. 818: Amino Acid sequence of SEQ ID NO: 2095. The conserved MADS box (SEQ ID NO: 3668) domain is underlined and the conserved K box in bold/italics.

FIG. 819: Amino Acid sequence of SEQ ID NO: 2098. The conserved MADS-box (SEQ ID NO: 3668) transcription factor domain is underlined. The K-box transcription factor domain is in bold.

FIG. 820: Amino Acid sequence of SEQ ID NO: 2099. The conserved MADS box (SEQ ID NO: 3668) domain is underlined and MADS box domain signature is in bold. The conserved K box is in bold/italics.

FIG. 821: Amino Acid sequence of SEQ ID NO: 3654. The conserved SHAQKYF (SEQ ID NO: 3671) class Myb-like DNA-binding domain is in bold.

FIG. 822: Amino Acid sequence of SEQ ID NO: 3655. The conserved SHAQKYF (SEQ ID NO: 3671) class Myb-like DNA-binding domain is underlined.

FIG. 823: Amino Acid sequence of SEQ ID NO: 2102. The conserved Myb DNA-binding domains are underlined.

FIG. 824: Amino Acid sequence of SEQ ID NO: 3656. The conserved Myb DNA-binding domains are underlined.

FIG. 825: Amino Acid sequence of SEQ ID NO: 2104. The conserved Myb DNA-binding domains are underlined.

FIG. 826: Amino Acid sequence of SEQ ID NO: 2105. The conserved Myb-like DNA-binding domains are underlined.

FIG. 827: Amino Acid sequence of SEQ ID NO: 2106. The conserved Myb DNA-binding domains are underlined.

FIG. 828: Amino Acid sequence of SEQ ID NO: 2107. The conserved SHAQKYF class Myb-like DNA-binding domain is in bold.

FIG. 829: Amino Acid sequence of SEQ ID NO: 2108. The conserved RNA-binding region RNP-1 (RNA recognition motif) family domains are underlined.

FIG. 830: Amino Acid sequence of SEQ ID NO: 3657. The conserved Myb DNA-binding domains are underlined.

FIG. 831: Amino Acid sequence of SEQ ID NO: 2110. The conserved Myb DNA-binding domain is underlined.

FIG. 832: Amino Acid sequence of SEQ ID NO: 2111. The conserved Myb DNA-binding domains are underlined and the Myb DNA-binding domain repeat signature 2 is in bold.

FIG. 833: Amino Acid sequence of SEQ ID NO: 2112. The conserved Myb DNA-binding domains are underlined.

FIG. 834: Amino Acid sequence of SEQ ID NO: 2113. The conserved SHAQKYF (SEQ ID NO: 3671) class Myb-like DNA-binding domain is underlined.

FIG. 835: Amino Acid sequence of SEQ ID NO: 2114. The conserved Myb DNA-binding domain is underlined.

FIG. 836: Amino Acid sequence of SEQ ID NO: 2115. The conserved Myb DNA-binding domains are underlined.

FIG. 837: Amino Acid sequence of SEQ ID NO: 2116. The conserved No apical meristem (NAM) domain is underlined.

FIG. 838: Amino Acid sequence of SEQ ID NO: 2117. The conserved No apical meristem (NAM) domain is underlined.

FIG. 839: Amino Acid sequence of SEQ ID NO: 2118. The conserved No apical meristem (NAM) domain is underlined.

FIG. 840: Amino Acid sequence of SEQ ID NO: 2119. The conserved No apical meristem (NAM) domain is underlined.

FIG. 841: Amino Acid sequence of SEQ ID NO: 2120. The conserved No apical meristem (NAM) domain is underlined.

FIG. 842: Amino Acid sequence of SEQ ID NO: 2121. The conserved No apical meristem (NAM) family domain is underlined.

FIG. 843: Amino Acid sequence of SEQ ID NO: 2122. The conserved No apical meristem (NAM) family domain is underlined.

FIG. 844: Amino Acid sequence of SEQ ID NO: 2123. The conserved No apical meristem (NAM) family domain is underlined.

FIG. 845: Amino Acid sequence of SEQ ID NO: 2124. The conserved No apical meristem (NAM) domain is underlined.

FIG. 846: Amino Acid sequence of SEQ ID NO: 2125. The conserved No apical meristem (NAM) domain is underlined.

FIG. 847: Amino Acid sequence of SEQ ID NO: 2126. The conserved No apical meristem (NAM) family domain is underlined.

FIG. 848: Amino Acid sequence of SEQ ID NO: 2127. The conserved No apical meristem (NAM) family domain is underlined.

FIG. 849: Amino Acid sequence of SEQ ID NO: 2128. The conserved No apical meristem (NAM) domain is underlined.

FIG. 850: Amino Acid sequence of SEQ ID NO: 2129. The conserved SBP plant protein domain is underlined.

FIG. 851: Amino Acid sequence of SEQ ID NO: 2130. The conserved SBP plant protein domain is underlined.

FIG. 852: Amino Acid sequence of SEQ ID NO: 2131. The conserved SBP plant protein family domain is underlined.

FIG. 853: Amino Acid sequence of SEQ ID NO: 2132. The conserved SBP plant protein domain is underlined.

FIG. 854: Amino Acid sequence of SEQ ID NO: 2134. The conserved Myb DNA-binding domains are underlined.

FIG. 855: Amino Acid sequence of SEQ ID NO: 2136. The conserved Tubby domain is underlined.

FIG. 856: Amino Acid sequence of SEQ ID NO: 2138. The conserved WRKY (SEQ ID NO: 3670) DNA binding domain is underlined.

FIG. 857: Amino Acid sequence of SEQ ID NO: 2139. The conserved DNA-binding WRKY (SEQ ID NO: 3670) domain is underlined.

FIG. 858: Amino Acid sequence of SEQ ID NO: 2140. The conserved DNA-binding WRKY (SEQ ID NO: 3670) domain is underlined.

FIG. 859: Amino Acid sequence of SEQ ID NO: 2141. The conserved WRKY (SEQ ID NO: 3670) family domain is underlined.

FIG. 860: Amino Acid sequence of SEQ ID NO: 1295. The conserved Pathogenesis-related transcriptional factor and ERF family domain is underlined.

FIG. 861: Amino Acid sequence of SEQ ID NO: 1314. The conserved Pathogenesis-related transcriptional factor and ERF family domain is underlined.

FIG. 862: Amino Acid sequence of SEQ ID NO: 1318. The conserved transcriptional factor B3 family domain is underlined and the AUX/IAA family domain is in bold.

FIG. 863: Amino Acid sequence of SEQ ID NO: 1322. The conserved AUX/IAA family domain is underlined.

FIG. 864: Amino Acid sequence of SEQ ID NO: 1347. The conserved basic-leucine zipper (bZIP) transcription factor domain is underlined and the basic-leucine zipper (bZIP) transcription factor domain signature is in bold.

FIG. 865: Amino Acid sequence of SEQ ID NO: 1350. The conserved basic-leucine zipper (bZIP) transcription factor domain is underlined and the basic-leucine zipper (bZIP) transcription factor domain signature is in bold.

FIG. 866: Amino Acid sequence of SEQ ID NO: 1356. The conserved B-box zinc finger family domains are underlined.

FIG. 867: Amino Acid sequence of SEQ ID NO: 1381. The conserved C2H2-type zinc finger family domains are underlined and the zinc finger C2H2 type domain signatures are in bold.

FIG. 868: Amino Acid sequence of SEQ ID NO: 1391. The conserved C-x8-C-x5-C-x3-H (SEQ ID NO: 3667) type zinc finger is underlined.

FIG. 869: Amino Acid sequence of SEQ ID NO: 1412. The conserved transcription factor CBF/NF-Y/archaeal histone family domain is underlined.

FIG. 870: Amino Acid sequence of SEQ ID NO: 1422. The conserved transcription factor CBF/NF-Y/archaeal histone family domain is underlined.

FIG. 871: Amino Acid sequence of SEQ ID NO: 1423. The conserved transcription factor E2F/dimerisation partner (TDP) family domain is underlined.

FIG. 872: Amino Acid sequence of SEQ ID NO: 1429. The conserved Myb DNA-binding domain is underlined.

FIG. 873: Amino Acid sequence of SEQ ID NO: 3658. The conserved Myb DNA-binding domain identified using Inter-ProScan is underlined.

FIG. 874: Amino Acid sequence of SEQ ID NO: 3659. The conserved Myb DNA-binding domain identified using Inter-ProScan is underlined.

FIG. 875: Amino Acid sequence of SEQ ID NO: 1432. The conserved Myb DNA-binding domain is underlined.

FIG. 876: Amino Acid sequence of SEQ ID NO: 1433. The conserved SHAQKYF (SEQ ID NO: 3671) class Myb-like DNA-binding domain is underlined.

FIG. 877: Amino Acid sequence of SEQ ID NO: 1434. The conserved SHAQKYF (SEQ ID NO: 3671) class Myb-like DNA-binding domain is underlined.

FIG. 878: Amino Acid sequence of SEQ ID NO: 1436. The conserved Myb DNA-binding domain is underlined.

FIG. 879: Amino Acid sequence of SEQ ID NO: 1447. The conserved HMG1/2 (high mobility group) box family domain is underlined, and the structure-specific recognition protein family domain is in bold.

FIG. 880: Amino Acid sequence of SEQ ID NO: 3660. The conserved Myb DNA-binding domain identified using Inter-ProScan is underlined.

FIG. 881: Amino Acid sequence of SEQ ID NO: 1452. The conserved ZF-HD class homeobox domain is underlined and the ZF-HD homeobox protein Cys/His-rich dimerization domain is in bold.

FIG. 882: Amino Acid sequence of SEQ ID NO: 3661. The conserved Myb DNA-binding domain identified using Inter-ProScan is underlined.

FIG. 883: Amino Acid sequence of SEQ ID NO: 1481. The conserved Floricaula/leafy protein family domain is underlined.

FIG. 884: Amino Acid sequence of SEQ ID NO: 1482. The conserved Floricaula/leafy protein family domain is underlined.

FIG. 885: Amino Acid sequence of SEQ ID NO: 1505. The conserved MADS box (SEQ ID NO: 3668) domain is underlined and MADS box domain signature is in bold. The conserved K box is in bold/italics.

FIG. 886: Amino Acid sequence of SEQ ID NO: 1514. The conserved MADS-box (SEQ ID NO: 3668) transcription factor family domain is underlined and the K-box transcription factor family domain is in bold.

FIG. 887: Amino Acid sequence of SEQ ID NO: 1523. The conserved Myb DNA-binding domains are underlined and the Myb DNA-binding domain repeat signature 2 is in bold.

FIG. 888: Amino Acid sequence of SEQ ID NO: 1525. The conserved MIP family domain is underlined and the MIP family signature is in bold. FIG. 884: Amino Acid sequence of 1549. The conserved Myb DNA-binding domains are underlined and the Myb DNA-binding domain repeat signature 2 is in bold.

FIG. 889: Amino Acid sequence of SEQ ID NO: 1549. The conserved Myb DNA-binding domains are underlined and the Myb DNA-binding domain repeat signature 2 is in bold.

FIG. 890: Amino Acid sequence of SEQ ID NO: 1563. The conserved Myb DNA-binding domains are underlined and the Myb DNA-binding domain repeat signature 2 is in bold.

FIG. 891: Amino Acid sequence of SEQ ID NO: 1566. The conserved Myb DNA-binding domains are underlined.

FIG. 892: Amino Acid sequence of SEQ ID NO: 1567. The conserved Myb DNA-binding domains are underlined and the Myb DNA-binding domain repeat signature 2 is in bold.

FIG. 893: Amino Acid sequence of SEQ ID NO: 1568. The conserved Myb DNA-binding domains are underlined and the Myb DNA-binding domain repeat signature 2 is in bold.

FIG. 894: Amino Acid sequence of SEQ ID NO: 1577. The conserved No apical meristem (NAM) family domain is underlined.

FIG. 895: Amino Acid sequence of SEQ ID NO: 1601. The conserved SBP plant protein family domain is underlined.

FIG. 896: Amino Acid sequence of SEQ ID NO: 1604. The conserved SBP plant protein family domain is underlined.

FIG. 897: Amino Acid sequence of SEQ ID NO: 3662. The conserved Homeobox domain identified using InterProScan is underlined.

FIG. 898: Amino Acid sequence of SEQ ID NO: 1613. No conserved domain identified.

FIG. 899: Amino Acid sequence of SEQ ID NO: 1625. The conserved Tubby family domain is underlined and the Tub family signature 2 is in bold.

FIG. 900: Amino Acid sequence of SEQ ID NO: 1627. The conserved Tubby family domain is underlined and the Tub family signature 2 is in bold. The cyclin-like F-box domain is in italics.

FIG. 901: Amino Acid sequence of SEQ ID NO: 2142. The conserved transcriptional factor B3 family domain is underlined.

FIG. 902: Amino Acid sequence of SEQ ID NO: 2143. The conserved Pathogenesis-related transcriptional factor and ERF family domain is underlined.

FIG. 903: Amino Acid sequence of SEQ ID NO: 2144. The conserved Pathogenesis-related transcriptional factor and ERF family domain is underlined.

FIG. 904: Amino Acid sequence of SEQ ID NO: 2145. The conserved Pathogenesis-related transcriptional factor and ERF family domain is underlined.

FIG. 905: Amino Acid sequence of SEQ ID NO: 2146. The conserved Pathogenesis-related transcriptional factor and ERF family domain is underlined.

FIG. 906: Amino Acid sequence of SEQ ID NO: 2147. The conserved Pathogenesis-related transcriptional factor and ERF domain is underlined.

FIG. 907: Amino Acid sequence of SEQ ID NO: 2148. The conserved Pathogenesis-related transcriptional factor and ERF family domain is underlined.

FIG. 908: Amino Acid sequence of SEQ ID NO: 2149. The conserved Pathogenesis-related transcriptional factor and ERF family domain is underlined.

FIG. 909: Amino Acid sequence of SEQ ID NO: 2150. The conserved Pathogenesis-related transcriptional factor and ERF domains are underlined.

FIG. 910: Amino Acid sequence of SEQ ID NO: 2151. The conserved Pathogenesis-related transcriptional factor and ERF family domain is underlined.

FIG. 911: Amino Acid sequence of SEQ ID NO: 2152. The conserved Pathogenesis-related transcriptional factor and ERF domain is underlined.

FIG. 912: Amino Acid sequence of SEQ ID NO: 2153. The conserved Pathogenesis-related transcriptional factor and ERF family domain is underlined.

FIG. 913: Amino Acid sequence of SEQ ID NO: 2154. The conserved Pathogenesis-related transcriptional factor and ERF family domain is underlined.

FIG. 914: Amino Acid sequence of SEQ ID NO: 2155. The conserved Pathogenesis-related transcriptional factor and ERF domain is underlined.

FIG. 915: Amino Acid sequence of SEQ ID NO: 2156. The conserved transcriptional factor B3 family domain is underlined.

FIG. 916: Amino Acid sequence of SEQ ID NO: 2157. The conserved transcriptional factor B3 family domain is underlined.

FIG. 917: Amino Acid sequence of SEQ ID NO: 2158. The conserved transcriptional factor B3 family domain is underlined.

FIG. 918: Amino Acid sequence of SEQ ID NO: 2159. The conserved transcriptional factor B3 family domain is underlined.

FIG. 919: Amino Acid sequence of SEQ ID NO: 2160. The conserved transcriptional factor B3 family domain is underlined.

FIG. 920: Amino Acid sequence of SEQ ID NO: 2161. The conserved transcriptional factor B3 family domain is underlined.

FIG. 921: Amino Acid sequence of SEQ ID NO: 2162. The conserved transcriptional factor B3 family domain is underlined.

FIG. 922: Amino Acid sequence of SEQ ID NO: 2163. The conserved transcriptional factor B3 family domain is underlined.

FIG. 923: Amino Acid sequence of SEQ ID NO: 2164. The conserved ARID (AT-rich interaction domain) protein domain is underlined.

FIG. 924: Amino Acid sequence of SEQ ID NO: 2165. The conserved HMG1/2 (high mobility group) box is underlined and the ARID (AT-rich interaction domain) protein domain is in bold.

FIG. 925: Amino Acid sequence of SEQ ID NO: 2166. The conserved HMG1/2 (high mobility group) box family domain is underlined and the ARID (AT-rich interaction domain) protein domain is in bold.

FIG. 926: Amino Acid sequence of SEQ ID NO: 2167. The conserved AUX/IAA family domain is underlined.

FIG. 927: Amino Acid sequence of SEQ ID NO: 2168. The conserved AUX/IAA family domain is underlined.

FIG. 928: Amino Acid sequence of SEQ ID NO: 2169. The basic helix-loop-helix (bHLH) dimerization domain is underlined.

FIG. 929: Amino Acid sequence of SEQ ID NO: 2170. The conserved basic helix-loop-helix (bHLH) dimerization family domain is underlined.

FIG. 930: Amino Acid sequence of SEQ ID NO: 2171. The conserved basic helix-loop-helix (bHLH) dimerization family domain is underlined.

FIG. 931: Amino Acid sequence of SEQ ID NO: 2173. The basic helix-loop-helix (bHLH) dimerization domain is underlined.

FIG. 932: Amino Acid sequence of SEQ ID NO: 2174. The conserved basic helix-loop-helix (bHLH) dimerization family domain is underlined.

FIG. 933: Amino Acid sequence of SEQ ID NO: 2175. The conserved basic helix-loop-helix (bHLH) dimerization family domain is underlined.

FIG. 934: Amino Acid sequence of SEQ ID NO: 2176. The conserved basic helix-loop-helix (bHLH) dimerization family domain is underlined.

FIG. 935: Amino Acid sequence of SEQ ID NO: 2178. The conserved basic helix-loop-helix (bHLH) dimerization family domain is underlined.

FIG. 936: Amino Acid sequence of SEQ ID NO: 2179. The conserved basic helix-loop-helix (bHLH) dimerization family domain is underlined.

FIG. 937: Amino Acid sequence of SEQ ID NO: 2180. The basic helix-loop-helix (bHLH) dimerization domain is underlined.

FIG. 938: Amino Acid sequence of SEQ ID NO: 2181. The basic helix-loop-helix (bHLH) dimerization domain is underlined.

FIG. 939: Amino Acid sequence of SEQ ID NO: 2182. The conserved basic helix-loop-helix (bHLH) dimerization family domain is underlined.

FIG. 940: Amino Acid sequence of SEQ ID NO: 2183. The conserved basic helix-loop-helix (bHLH) dimerization family domain is underlined.

FIG. 941: Amino Acid sequence of SEQ ID NO: 2184. The conserved basic helix-loop-helix (bHLH) dimerization family domain is underlined.

FIG. 942: Amino Acid sequence of SEQ ID NO: 2185. The conserved basic helix-loop-helix (bHLH) dimerization family domain is underlined.

FIG. 943: Amino Acid sequence of SEQ ID NO: 2186. The conserved basic-leucine zipper (bZIP) transcription factor domain is underlined and the basic-leucine zipper (bZIP) transcription factor domain signature is in bold.

FIG. 944: Amino Acid sequence of SEQ ID NO: 2187. The conserved basic-leucine zipper (bZIP) transcription factor domain is underlined and the basic-leucine zipper (bZIP) transcription factor domain signature is in bold.

FIG. 945: Amino Acid sequence of SEQ ID NO: 2188. The conserved basic-leucine zipper (bZIP) transcription factor family domain is underlined.

FIG. 946: Amino Acid sequence of SEQ ID NO: 2189. The conserved basic-leucine zipper (bZIP) transcription factor family domain is underlined.

FIG. 947: Amino Acid sequence of SEQ ID NO: 2190. The conserved basic-leucine zipper (bZIP) transcription factor domain is underlined and the basic-leucine zipper (bZIP) transcription factor domain signature is in bold.

FIG. 948: Amino Acid sequence of SEQ ID NO: 2191. The conserved basic-leucine zipper (bZIP) transcription factor domain is underlined and the basic-leucine zipper (bZIP) transcription factor domain signature is in bold.

FIG. 949: Amino Acid sequence of SEQ ID NO: 2193. The conserved B-box zinc finger family domains are underlined.

FIG. 950: Amino Acid sequence of SEQ ID NO: 2194. The conserved DOF-type zinc finger domain is underlined.

FIG. 951: Amino Acid sequence of SEQ ID NO: 2195. The conserved GATA-type zinc finger is underlined.

FIG. 952: Amino Acid sequence of SEQ ID NO: 2196. The conserved B-box zinc finger family domains are underlined.

FIG. 953: Amino Acid sequence of SEQ ID NO: 2197. The conserved DOF-type zinc finger domain is underlined.

FIG. 954: Amino Acid sequence of SEQ ID NO: 2198. The conserved B-box zinc finger family domain is underlined.

FIG. 955: Amino Acid sequence of SEQ ID NO: 2199. The conserved B-box zinc finger family domain is underlined.

FIG. 956: Amino Acid sequence of SEQ ID NO: 2201. The conserved zinc finger C2H2 type domain signature is underlined.

FIG. 957: Amino Acid sequence of SEQ ID NO: 2202. The conserved C2H2-type zinc finger family domain is underlined and the zinc finger C2H2 type domain signature is in bold.

FIG. 958: Amino Acid sequence of SEQ ID NO: 2203. The conserved C2H2-type zinc finger family domain is underlined and the zinc finger C2H2 type domain signature is in bold.

FIG. 959: Amino Acid sequence of SEQ ID NO: 2205. The conserved C2H2-type zinc finger family domain is underlined and the zinc finger C2H2 type domain signature is in bold.

FIG. 960: Amino Acid sequence of SEQ ID NO: 2206. The conserved C2H2-type zinc finger domains are underlined.

FIG. 961: Amino Acid sequence of SEQ ID NO: 2207. The conserved C2H2-type zinc finger family domains are underlined and the zinc finger C2H2 type domain signatures are in bold.

FIG. 962: Amino Acid sequence of SEQ ID NO: 2208. The conserved C2H2-type zinc finger domain is underlined and the zinc finger C2H2 type domain signature is in bold.

FIG. 963: Amino Acid sequence of SEQ ID NO: 2209. The conserved C2H2-type zinc finger domains are underlined.

FIG. 964: Amino Acid sequence of SEQ ID NO: 2210. The conserved C-x8-C-x5-C-x3-H (SEQ ID NO: 3667) type zinc finger is underlined.

FIG. 965: Amino Acid sequence of SEQ ID NO: 2212. The conserved RNA-binding region RNP-1 (RNA recognition motif) family domain is underlined and the C-x8-C-x5-C-x3-H (SEQ ID NO: 3667) type zinc finger is in bold.

FIG. 966: Amino Acid sequence of SEQ ID NO: 2213. The conserved C-x8-C-x5-C-x3-H (SEQ ID NO: 3667) type zinc finger is underlined and the ankyrin family domain is in bold.

FIG. 967: Amino Acid sequence of SEQ ID NO: 2214. The conserved C-x8-C-x5-C-x3-H (SEQ ID NO: 3667) type zinc finger is underlined.

FIG. 968: Amino Acid sequence of SEQ ID NO: 2215. The conserved C-x8-C-x5-C-x3-H (SEQ ID NO: 3667) type zinc finger family domains are underlined.

FIG. 969: Amino Acid sequence of SEQ ID NO: 2216. The conserved C-x8-C-x5-C-x3-H (SEQ ID NO: 3667) type zinc finger domains are underlined.

FIG. 970: Amino Acid sequence of SEQ ID NO: 2217. The conserved transcription factor CBF/NF-Y/archaeal histone family domain is underlined. and the CBF-A/NF-YB subunit signature is in bold.

FIG. 971: Amino Acid sequence of SEQ ID NO: 2218. The conserved CCAAT-binding transcription factor, subunit B, domain is underlined.

FIG. 972: Amino Acid sequence of SEQ ID NO: 2219. The conserved CCAAT-binding transcription factor, subunit B, domain is underlined.

FIG. 973: Amino Acid sequence of SEQ ID NO: 2220. The conserved CCAAT-binding transcription factor, subunit B, domain is underlined.

FIG. 974: Amino Acid sequence of SEQ ID NO: 2221. The conserved Tesmin/TSO1-like CXC domains are underlined.

FIG. 975: Amino Acid sequence of SEQ ID NO: 2222. The conserved transcription factor E2F/dimerisation partner (TDP) family domain is underlined.

FIG. 976: Amino Acid sequence of SEQ ID NO: 2223. The conserved transcription factor E2F/dimerisation partner (TDP) family domain is underlined.

FIG. 977: Amino Acid sequence of SEQ ID NO: 2224. The conserved Pathogenesis-related transcriptional factor and ERF family domain is underlined.

FIG. 978: Amino Acid sequence of SEQ ID NO: 2225. The conserved ethylene insensitive 3 family domain is underlined.

FIG. 979: Amino Acid sequence of SEQ ID NO: 2226. The conserved ethylene insensitive 3 family domain is underlined.

FIG. 980: Amino Acid sequence of SEQ ID NO: 2228. The conserved SHAQKYF (SEQ ID NO: 3671) class Myb-like DNA-binding domain is underlined.

FIG. 981: Amino Acid sequence of SEQ ID NO: 2229. The conserved Myb DNA-binding domain is underlined and the conserved response regulator receiver family domain is in bold.

FIG. 982: Amino Acid sequence of SEQ ID NO: 2230. The conserved response regulator receiver family domain is underlined.

FIG. 983: Amino Acid sequence of SEQ ID NO: 2231. The conserved SHAQKYF (SEQ ID NO: 3671) class Myb-like DNA-binding domain is underlined.

FIG. 984: Amino Acid sequence of SEQ ID NO: 2232. The conserved SHAQKYF (SEQ ID NO: 3671) class Myb-like DNA-binding domain is underlined.

FIG. 985: Amino Acid sequence of SEQ ID NO: 2233. The conserved SHAQKYF (SEQ ID NO: 3671) class Myb-like DNA-binding domain is underlined and the response regulator receiver domain is in bold.

FIG. 986: Amino Acid sequence of SEQ ID NO: 2234. The conserved GRAS family domain is underlined.

FIG. 987: Amino Acid sequence of SEQ ID NO: 2235. The conserved GRAS family domain is underlined.

FIG. 988: Amino Acid sequence of SEQ ID NO: 2236. The conserved GRAS family domain is underlined.

FIG. 989: Amino Acid sequence of SEQ ID NO: 2237. The conserved GRAS family domain is underlined.

FIG. 990: Amino Acid sequence of SEQ ID NO: 2238. The conserved GRAS family domain is underlined.

FIG. 991: Amino Acid sequence of SEQ ID NO: 2239. The conserved HMG1/2 (high mobility group) box family domains are underlined.

FIG. 992: Amino Acid sequence of SEQ ID NO: 2240. The conserved homeobox family domain is underlined with the conserved homeobox domain signature in bold/underline, and the homeobox-associated leucine zipper (HALZ) is in bold.

FIG. 993: Amino Acid sequence of SEQ ID NO: 2241. The conserved homeobox family domain is underlined.

FIG. 994: Amino Acid sequence of SEQ ID NO: 2242. The conserved POX family domain is underlined.

FIG. 995: Amino Acid sequence of SEQ ID NO: 2244. The conserved PHD finger zinc finger domain is underlined.

FIG. 996: Amino Acid sequence of SEQ ID NO: 2246. The conserved homeobox family domains are underlined and the PHD zinc finger-like domain is in bold.

FIG. 997: Amino Acid sequence of SEQ ID NO: 2247. The conserved homeobox domain is underlined and the homeobox domain signature is in bold. The conserved POX domain is in italics.

FIG. 998: Amino Acid sequence of SEQ ID NO: 2248. The conserved heat shock factor (HSF)-type DNA-binding family domain is underlined and the HSF-type DNA-binding domain signature is in bold.

FIG. 999: Amino Acid sequence of SEQ ID NO: 2249. The conserved heat shock factor (HSF)-type DNA-binding family domain is underlined.

FIG. 1000: Amino Acid sequence of SEQ ID NO: 2250. The conserved jumonji C (jmjC) family domain is underlined.

FIG. 1001: Amino Acid sequence of SEQ ID NO: 2252. The conserved LIM zinc-binding protein domains are underlined and the LIM domain signature is in bold.

FIG. 1002: Amino Acid sequence of SEQ ID NO: 2255. The conserved MADS box (SEQ ID NO: 3668) domain is underlined.

FIG. 1003: Amino Acid sequence of SEQ ID NO: 2256. The conserved MADS box (SEQ ID NO: 3668) domain is underlined and the conserved MADS box signature 1 is in bold.

FIG. 1004: Amino Acid sequence of SEQ ID NO: 2257. The conserved Myb DNA-binding domains are underlined and the Myb DNA-binding domain repeat signature 2 is in bold.

FIG. 1005: Amino Acid sequence of SEQ ID NO: 2258. The conserved Myb DNA-binding domains are underlined and the Myb DNA-binding domain repeat signature 2 is in bold.

FIG. 1006: Amino Acid sequence of SEQ ID NO: 2259. The conserved Myb DNA-binding domains are underlined and the Myb DNA-binding domain repeat signature 2 is in bold.

FIG. 1007: Amino Acid sequence of SEQ ID NO: 2260. The conserved Myb DNA-binding domains are underlined.

FIG. 1008: Amino Acid sequence of SEQ ID NO: 2261. The conserved Myb DNA-binding domains are underlined and the SHAQKYF (SEQ ID NO: 3671) class Myb-like DNA-binding domain is in bold.

FIG. 1009: Amino Acid sequence of SEQ ID NO: 2262. The conserved Myb DNA-binding domain is underlined.

FIG. 1010: Amino Acid sequence of SEQ ID NO: 2263. The conserved SHAQKYF (SEQ ID NO: 3671) class Myb-like DNA-binding domain is underlined.

FIG. 1011: Amino Acid sequence of SEQ ID NO: 2264. The conserved Myb DNA-binding domains are underlined.

FIG. 1012: Amino Acid sequence of SEQ ID NO: 3663. The conserved Myb DNA-binding domains are underlined and the Myb DNA-binding domain repeat signature 2 is in bold.

FIG. 1013: Amino Acid sequence of SEQ ID NO: 2266. The conserved Myb DNA-binding domains are underlined and the Myb DNA-binding domain repeat signature 2 is in bold.

FIG. 1014: Amino Acid sequence of SEQ ID NO: 2267. The conserved Myb DNA-binding domains are underlined and the Myb DNA-binding domain repeat signature 2 is in bold.

FIG. 1015: Amino Acid sequence of SEQ ID NO: 2268. The conserved SHAQKYF (SEQ ID NO: 3671) class Myb-like DNA-binding domain is underlined.

FIG. 1016: Amino Acid sequence of SEQ ID NO: 2269. The conserved Myb DNA-binding domains are underlined and the Myb DNA-binding domain repeat signature 2 is in bold.

FIG. 1017: Amino Acid sequence of SEQ ID NO: 2270. The conserved Myb DNA-binding domains are underlined and the Myb DNA-binding domain repeat signature 2 is in bold.

FIG. 1018: Amino Acid sequence of SEQ ID NO: 2271. The conserved Myb DNA-binding domain identified using InterProScan is underlined.

FIG. 1019: Amino Acid sequence of SEQ ID NO: 2272. The conserved Myb DNA-binding domains are underlined and the Myb DNA-binding domain repeat signature 2 is in bold.

FIG. 1020: Amino Acid sequence of SEQ ID NO: 2273. The conserved Myb DNA-binding domains are underlined and the Myb DNA-binding domain repeat signature 2 is in bold.

FIG. 1021: Amino Acid sequence of SEQ ID NO: 2274. The conserved No apical meristem (NAM) family domain is underlined.

FIG. 1022: Amino Acid sequence of SEQ ID NO: 2275. The conserved No apical meristem (NAM) family domain is underlined.

FIG. 1023: Amino Acid sequence of SEQ ID NO: 2276. The conserved No apical meristem (NAM) family domain is underlined.

FIG. 1024: Amino Acid sequence of SEQ ID NO: 2277. The conserved No apical meristem (NAM) family domain is underlined.

FIG. 1025: Amino Acid sequence of SEQ ID NO: 2278. The conserved No apical meristem (NAM) domain is underlined.

FIG. 1026: Amino Acid sequence of SEQ ID NO: 2279. The conserved No apical meristem (NAM) family domain is underlined.

FIG. 1027: Amino Acid sequence of SEQ ID NO: 3664. The conserved plant regulator RWP-RK domain (SEQ ID NO: 3669) is underlined and the octicosapeptide/Phox/Bem1p is in bold.

FIG. 1028: Amino Acid sequence of SEQ ID NO: 2281. The conserved sugar transporter family domain is underlined, the sugar transport proteins signatures 1 are in bold and the sugar transport proteins signature 2 is in bold/italics.

FIG. 1029: Amino Acid sequence of SEQ ID NO: 2282. The conserved Pathogenesis-related transcriptional factor and ERF family domain is underlined and the transcriptional factor B3 family domain is in bold.

FIG. 1030: Amino Acid sequence of SEQ ID NO: 3665. The conserved SBP plant protein family domain is underlined.

FIG. 1031: Amino Acid sequence of SEQ ID NO: 2284. The conserved SBP plant protein family domain is underlined.

FIG. 1032: Amino Acid sequence of SEQ ID NO: 3666. The conserved SBP plant protein family domain is underlined.

FIG. 1033: Amino Acid sequence of SEQ ID NO: 2286. The conserved TCP family transcription factor family domain is underlined.

FIG. 1034: Amino Acid sequence of SEQ ID NO: 2287. The conserved TCP family transcription factor family domain is underlined.

FIG. 1035: Amino Acid sequence of SEQ ID NO: 2288. The conserved Myb DNA-binding domain is underlined.

FIG. 1036: Amino Acid sequence of SEQ ID NO: 2289. No conserved domain identified.

FIG. 1037: Amino Acid sequence of SEQ ID NO: 2290. No conserved domain identified.

FIG. 1038: Amino Acid sequence of SEQ ID NO: 2291. No conserved domain identified.

FIG. 1039: Amino Acid sequence of SEQ ID NO: 2292. No conserved domain identified.

FIG. 1040: Amino Acid sequence of SEQ ID NO: 2293. No conserved domains identified.

FIG. 1041: Amino Acid sequence of SEQ ID NO: 2294. The conserved Myb DNA-binding domains are underlined FIG. 1042: Amino Acid sequence of SEQ ID NO: 2295. The conserved Myb DNA-binding domain is underlined.

FIG. 1043: Amino Acid sequence of SEQ ID NO: 2296. The conserved Tubby domain is underlined and the Tub family signature 2 is in bold. The cyclin-like F-box domain is in italics.

FIG. 1044: Amino Acid sequence of SEQ ID NO: 2297. The conserved Tubby domain is underlined and the Tub family signature 2 is in bold. The cyclin-like F-box domain is in italics.

FIG. 1045: Amino Acid sequence of SEQ ID NO: 2298. The conserved WRKY (SEQ ID NO: 3670) domains are underlined.

FIG. 1046: Amino Acid sequence of SEQ ID NO: 2299. The conserved WRKY family domain is underlined. FIG. 1042: Amino Acid sequence of 2300. The conserved WRKY (SEQ ID NO: 3670) family domain is underlined.

FIG. 1047: Amino Acid sequence of SEQ ID NO: 2300. The conserved WRKY (SEQ ID NO: 3670) family domain is underlined.

FIG. 1048: Amino Acid sequence of SEQ ID NO: 2301. The conserved WRKY (SEQ ID NO: 3670) domains are underlined FIG. 1049: Amino Acid sequence of SEQ ID NO: 2302. The conserved WRKY (SEQ ID NO: 3670) family domain is underlined.

FIG. 1050: Amino Acid sequence of SEQ ID NO: 2303. The conserved WRKY (SEQ ID NO: 3670) family domain is underlined.

FIG. 1051: Amino Acid sequence of SEQ ID NO: 2304, 3593-3666. The conserved WRKY (SEQ ID NO: 3670) domain is underlined.

FIG. 1052 provides a vector map for pWVR8.

FIG. 1053 presents data showing Mean Fluorescence Intensity of transfected *Z. elegans* protoplasts (Pine Ubiquitin promoter).

FIG. 1054 Graph showing a repression of COMT promoter by transcription factor pFOR369.

DETAILED DESCRIPTION OF THE INVENTION

The present invention provides isolated polynucleotides that encode plant transcription factors, together with isolated polypeptides encoded by such polynucleotides.

Transformation of a plant with a polynucleotide sequence encoding a protein involved in the regulation of gene expression can be employed to modify properties such as cellulose synthesis, lignin deposition, other aspects of wood development, flower development, root development, branching, seasonal responses such as light and cold controls on meristem identity, and disease resistance. To this end, the present invention provides a polynucleotide sequence encoding a polypeptide sequence having the function of a plant transcription factor. The present invention also provides a DNA construct having a promoter operably linked to a polynucleotide sequence, wherein said polynucleotide sequence encodes a plant transcription factor. Additionally, the invention provides methods for assaying the activity of an inventive transcription factor sequence, methods for using a transcription factor for modifying growth, wood development and/or fiber composition in a plant.

The present invention uses terms and phrases that are well known to those practicing the art. Unless defined otherwise, all technical and scientific terms used herein have the same meaning as commonly understood by one of ordinary skill in the art to which this invention belongs. Generally, the nomenclature used herein and the laboratory procedures in cell culture, molecular genetics, and nucleic acid chemistry and hybridization described herein are those well known and commonly employed in the art. Standard techniques are used for recombinant nucleic acid methods, polynucleotide synthesis, microbial culture, cell culture, tissue culture, transformation, transfection, transduction, analytical chemistry, organic synthetic chemistry, chemical syntheses, chemical analysis, and pharmaceutical formulation and delivery. Generally, enzymatic reactions and purification and/or isolation steps are performed according to the manufacturers' specifications. The techniques and procedures are generally performed according to conventional methodology (Sambrook & Russel, MOLECULAR CLONING: A LABORATORY MANUAL, 3$^{rd}$ ed., Cold Spring Harbor Laboratory Press, Cold Spring Harbor, N.Y., 2001).

A. Plant Transcription Factor Genes and Proteins

ABI3/VP1: The maize Vp1 gene and abi3 gene of *Arabidopsis* are believed to be orthologs based on similarities of the mutant phenotypes and amino acid sequence conservation. VP1 fully restores abscisic acid (ABA) sensitivity to abi3 mutants during seed germination and suppresses the early flowering phenotype of abi3. VP1 mediates a novel interaction between ABA and auxin signaling that results in developmental arrest and altered patterns of gene expression. (Suzuki M, et al., *Plant J.* 2001 28:4:409-18.) Auxin and abscisic acid are important in many plant developmental processes, including leaf and root development (Brady S M, Sarkar S F, Bonetta D and McCourt P, 2003, *Plant J.* 34(1):67-75).

AP2: The AP2 (APETALA2) and EREBPs (ethylene-responsive element binding proteins) are the prototypic members of a family of transcription factors unique to plants, whose distinguishing characteristic is that they contain the so-called AP2 DNA-binding domain. AP2/EREBP genes form a large multigene family, and they play a variety of roles throughout the plant life cycle. AP2/EREBP genes are key regulators of several developmental processes, including floral organ identity determination and leaf epidermal cell identity. In *Arabidopsis thaliana*, the homeotic gene APETALA2 (AP2) has been shown to control three salient processes during development: (1) the specification of flower organ identity throughout floral organogenesis (Jofuku et al., *Plant Cell* 6:1211-1225, 1994); (2) establishment of flower meristem identity (Irish and Sussex, *Plant Cell* 2:8:741-753, 1990); and (3) the temporal and spatial regulation of flower homeotic gene activity (Drews et al., *Cell* 65:6:991-1002, 1991). DNA sequence analysis suggests that AP2 encodes a theoretical polypeptide of 432 aa, with a distinct 68 aa repeated motif termed the AP2 domain. This domain has been shown to be essential for AP2 functions and contains within the 68 aa, an eighteen amino acid core region that is predicted to form an amphipathic α-helix (Jofuku et al., *Plant Cell* 6:1211-1225, 1994). Ap2-like domain-containing transcription factors have been also been identified in both *Arabidopsis thaliana* (Okamuro et al., *Proc. Natl. Acad. Sci. USA* 94:7076-7081, 1997) and in tobacco with the identification of the ethylene responsive element binding proteins (EREBPs) (Ohme-Takagi and Shinshi, *Plant Cell* 7:2:173-182, 1995). In *Arabidopsis*, these RAP2 (related to AP2) genes encode two distinct subfamilies of AP2 domain-containing proteins designated AP2-like and EREBP-like (Okamuro et al., *Proc. Natl. Acad. Sci. USA* 94:7076-7081, 1997). In vitro DNA binding has not been shown to date using the RAP2 proteins. Based upon the presence of two highly conserved motifs YRG and RAYD (SEQ ID NO: 3672) within the AP2 domain, it has been proposed that binding DNA binding occurs in a manner similar to that of AP2 proteins.

*Agrobacterium*: as is well known in the field, *Agrobacteria* that are used for transforming plant cells are disarmed and virulent derivatives of, usually, *Agrobacterium tumefaciens* or *Agrobacterium rhizogenes* that contain a vector. The vector typically contains a desired polynucleotide that is located between the borders of a T-DNA.

Alfin-like: Alfin1 is a transcription factor that functions in roots. Alfin1 overexpression also improves salt tolerance and root growth of the transgenic plants (Winicov I., 2000, *Planta.* 210(3):416-22).

Angiosperm: vascular plants having seeds enclosed in an ovary. Angiosperms are seed plants that produce flowers that bear fruits. Angiosperms are divided into dicotyledonous and monocotyledonous plants.

ARF: Auxin response factors ("ARFs") are a recently discovered family of transcription factors that bind with specificity to auxin response elements (AuxREs) in promoters of primary or early auxin-responsive genes. ARFs have an amino-terminal DNA-binding domain related to the carboxyl-terminal DNA-binding domain in the maize transactivator VIVIPAROUS1. Some ARFs contain transcriptional activation domains, while others contain repression domains. ARFs appear to play a pivotal role in auxin-regulated gene expression of primary response genes (Guilfoyle T J, Ulmasov T and Hagen G., 1998, *Cell Mol Life Sci.* 54(7):619-27). ARF genes in *Arabidopsis* have been shown to be important in controlling both axis formation in the embryo and auxin-dependent cell expansion (Hardtke C S, Ckurshumova W, Vidaurre D P, Singh S A, Stamatiou G, Tiwari S B, Hagen G, Guilfoyle T J and Berleth T., 2004, *Development.* 131(5): 1089-100). Auxin responses are important in meristem and wood development in plants (Uggla C, Magel E, Moritz T and Sundberg B, 2001, *Plant Physiol.* 125(4):2029-39).

ARID: Dead ringer (Dri) is a founding member of a recently defined ARID family of DNA binding proteins whose members share a conserved DNA binding domain termed the A/T-rich interaction domain. This family includes the B-cell-specific factor Bright and the *Drosophila* factor Eyelid (Osa). dri is developmentally regulated, and is expressed in a restricted set of cells including some neural cells and differentiating cells of the gut and salivary gland ducts. It is unlikely that Dri is a general transcription co-factor or chromatin modifier, as is Eyelid, since transcription of only a small number of the genes are disrupted in dri mutant embryos (Valentine, 1998 and Shandala, 1999).

The ARID domain can be found in many genomes of plants, and at least one ARID gene family can be clearly traced from plant to metazoans (Rbbp2 family) by the conservation of the order of multiple conserved domains.

Dri has been shown to be a sequence-specific DNA binding protein. The in vitro sequence specificity of Dri is strikingly similar to that of many homeodomain proteins. Dri preferentially binds the PuATTAA sequence. It is therefore likely that the phenotypes exhibited by dri mutant embryos result from disruption to the expression of regulatory genes. ARID proteins have been implicated in the control of cell growth, differentiation, and development (Wilsker D, Patsialou A, Dallas P B and Moran E., 2002, *Cell Growth Differ.* 13(3):95-106).

AUX/IAA: Indole-3-acetic acid (IAA or auxin) is indispensable for plant growth and development. The hormone rapidly and specifically activates within minutes transcription of a select set of early genes that are thought to mediate the various auxin effects, which include effects on meristem and wood development. The concept of early genes or primary response genes has successfully been used in several biological systems to access and explore upstream and downstream segments of signal transduction pathways. Molecular and genetic studies conducted by a number of groups indicate that Aux/IAA proteins play a central role in auxin responses (Tiwari S B, Hagen G and Guilfoyle T., 2003, *Plant Cell.* 15(2): 533-43, Moyle R, Schrader J, Stenberg A, Olsson O, Saxena S, Sandberg G and Bhalerao R P., 2002, *Plant J.* 31(6):675-85).

bZIP: The basic/leucine zipper (bZIP) is a conserved family of transcription factors defined by a basic/leucine zipper (bZIP) motif (Landschultz et al., *Science* 240:1759-1764

(1988); McKnight, *Sci. Am.* 264:54-64 (1991); Foster et al., *FASEB J.* 8:2:192-200 (1994)). Transcriptional regulation of gene expression is mediated by both the bZIPs and other families of transcription factors, through the concerted action of sequence-specific transcription factors that interact with regulatory elements residing in the promoter regions of the corresponding gene. The bZIP bipartite DNA binding structure consists of a region enriched in basic amino acids (basic region) adjacent to a leucine zipper that is characterized by several leucine residues regularly spaced at seven amino acid intervals (Vinson et al., *Science* 246:911-916, 1989). Whereas the basic region directly contacts the DNA, the leucine zipper mediates homodimerisation and heterodimerisation of protein monomers through a parallel interaction of the hydrophobic dimerization interfaces of two □-helices, resulting in a coiled-coil structure (O'Shea et al., *Science* 243:538-542 (1989); *Science* 254:539-544 (1991); Hu et al., *Science* 250:1400-1403 (1990); Rasmussen et al., *Proc. Natl. Acad. Sci. USA* 88:561-564 (1991)).

Dof proteins are a relatively new class of transcription factor and are thought to mediate the regulation of some patterns of plant gene expression in part by combinatorial interactions between bZIP proteins and other types of transcription factors binding to closely linked sites. Such an example of this combinatorial interaction has been observed between bZIP and Dof transcription factors (Singh, *Plant Physiol.* 118:1111-1120 (1998)). These Dof proteins possess a single zinc-finger DNA binding domain that is highly conserved in plants (Yanagisawa, *Trends Plant Sci.* 1:213 (1996)). Specific binding of the Dof protein to bZIP transcription factors has been demonstrated and it has been proposed that this specific interaction results in the stimulation of bZIP binding to DNA target sequences in plant promoters (Chen et al., *Plant J.* 10:955-966 (1996)). Examples of such Dof/bZIP interactions have been reported in the literature, including for example, the *Arabidopsis thaliana* glutathionine S-transferase-6 gene (GST6) promoter which has been shown to contain several Dof-binding sites closely linked to the ocs element, a recognized bZIP binding site (Singh, *Plant Physiol.* 118:1111-1120 (1998)).

The bZIP family of G-box binding factors from *Arabidopsis* (including GBF1, GBF2 and GBF3, for example) interact with the palindromic G-box motif (CCACGTGG). However, it has been demonstrated that the DNA binding specificity of such transcription factors, for example GBF1, may be influenced by the nature of the nucleotides flanking the ACGT core (Schindler et al., *EMBO J.* 11:1274-1289 (1992a). In vivo transient and transgenic plant expression studies have shown that these ACGT elements are necessary for maximal transcriptional activation and have been identified in a multitude of plant genes regulated by diverse environmental, physiological, and environmental cues. Classification of these transcription factors based upon their ability to bind to the ACGT core motif yielded a relatively diverse group of proteins, including, for example the CamV 35S promoter as-1-binding protein which exhibits DNA binding site requirements distinct from those proteins interacting with the G-box (Tabata et al., *EMBO J.* 10:1459-1467 (1991)). Thus, in addition to defining the individual classes of bZIP proteins on the basis of their DNA binding specificity, such proteins can also be classified according to their heterodimerisation characteristics (Cao et al., *Genes Dev.* 5:1538-1552, 1991; Schindler et al., *EMBO J.* 11:1261-1273 (1992b)).

Environmentally inducible promoters require the presence of two cis-acting elements, critical for promoter activity, one of which is the moderately conserved G-box (CCACGTGG) (deVetten et al., *Plant Cell* 4:10:1295-1307 (1992)). A mutation in one of the two elements abolishes or severely reduces the ability of the promoter to respond to environmental changes. The sequence of the second cis-acting element, positioned near the G-box, is not conserved among different environmentally-inducible promoters, but may be similar among promoters induced by the same signal. The spacing between the G-box and the second cis-acting element appears to be critical, suggesting a direct interaction between the respective binding factors (deVetten and Ferl, *Int. J. Biochem.* 26:9:1055-1068 (1994)); Ramachandran et al., *Curr. Opin. Genet. Dev.* 4:5:642-646, 1994)).

Basic helix-loop-helix zipper proteins represent an additional class of bZIP transcription factors described in the literature and includes, for example, the Myc proteins. These proteins contain two regions characteristic of transcription factors: an N-terminal transactivation domain consisting of several phosphorylation sites, and a C-terminal basic helix-loop-helix (bHLH) leucine zipper motif known to mediate dimerization and sequence specific DNA binding via three distinct domains: the leucine zipper, helix-loop-helix, and basic regions (Toledo-Ortiz G, Huq E and Quail P H., 2003, *Plant Cell.* 15(8):1749-70). It is predicted that this family of TFs has a range of different roles in plant cell and tissue development as well as plant metabolism, including specifying epidermal cell fate in roots (Bernhardt C, Lee M M, Gonzalez A, Zhang F, Lloyd A and Schiefelbein J., 2003, *Development.* 130(26):6431-9), fruit development (Liljegren S J, Roeder A H, Kempin S A, Gremski K, Ostergaard L, Guimil S, Reyes D K and Yanofsky M F, 2004, *Cell,* 116(6): 843-53), the formation of ER bodies (Matsushima R, Fukao Y, Nishimura M and Hara-Nishimura I., 2004, *Plant Cell*. May 21 [Epub ahead of print]) and be involved in anthocyanin biosynthasis (Ramsay N A, Walker A R, Mooney M and Gray J C, 2003, *Plant Mol. Biol.* 52(3):679-88).

CCAAT: The CCAAT-box element identified by Gelinas et al. (*Nature* 313[6000]:323-325, 1985) has been shown to occur between 80 bp and 300 bp from the transcription start site and may operate in either orientation, with possible cooperative interactions with multiple boxes (Tasanen et al., *J. Biol. Chem.* 267:16:11513-11519 (1992)); or other conserved motifs (Muro et al., *J. Biol. Chem.* 267:18:12767-12774 (1992)); Rieping and Schoffl, *Mol. Gen. Genet.* 231:2:226-232 (1992)). CCAAT-box related motifs have been identified in a number of promoters in a variety of organisms including yeast (Hahn et al., *Science* 240:4850:317-321 (1988)), rat (Maity et al., *Proc. Natl. Acad. Sci. USA* 87:14:5378-5382 (1990)); Vuorio et al., *J. Biol. Chem.* 265:36:22480-22486 (1990)); and plants (Rieping and Schoffl, *Mol. Gen. Genet.* 231:2:226-232 (1992)); Kehoe et al., *Plant Cell* 6:8:1123-1134 (1994)). In both yeast and vertebrates, a protein complex has been shown to bind to the CCAAT-motif. In yeast the complex consists of three proteins, known as HAP2, HAP3 and HAP5 (Pinkham and Guarente, *Mol. Cell. Biol.* 5:12: 3410-3416 (1985)).

In *Arabidopsis thaliana* there exists an analagous "DR1" transcription factor. The identification of a Dr1-like protein in *A. thaliana* strongly argues for the ubiquity of this protein among eukaryotic genera and for a conserved mechanism to regulate transcription initiation that involves Dr1. Kuromori & Yamamoto, Cloning of cDNAs from *Arabidopsis thaliana* that encode putative protein phosphatase 2C and a human Dr1-like protein by transformation of a fission yeast mutant, *Nucleic Acids Res.,* 22:24:5296-301 (1994)).

CAATT binding factors have been implicated with plant fertility in *Brasica napus* (Levesque-Lemay M, Albani D, Aldcorn D, Hammerlindl J, Keller W and Robert L S, 2003, *Plant Cell Rep.* 21(8):804-8. Epub 2003 Mar. 4), and embryogenesis (Lee H, Fischer R L, Goldberg R B and Harada J J. 2003, *Proc Natl Acad Sci USA*. 100(4):2152-6).

C2C2 Co-like: The vegetative and reproductive (flowering) phases of *Arabidopsis* development are clearly separated. The onset of flowering is promoted by long photoperiods, but the constans (co) mutant flowers later than wild type under these conditions (Putterill J, Robson F, Lee K, Simon R and Coupland G, 1995, *Cell*. 80(6):847-57; Valverde F, Mouradov A, Soppe W, Ravenscroft D, Samach A and Coupland G, 2004 *Science*. 303(5660): 1003-6). Some transgenic plants containing extra copies of CO flowered earlier than wild type, suggesting that CO activity limits flowering time. Double mutants were constructed containing co and mutations affecting gibberellic acid responses, meristem identity, or phytochrome function, and their phenotypes suggested a model for the role of CO in promoting flowering. CO interaction with phytohormone response and meristem identity means that CO-like genes may function to regulate genes in a variety of plant developmental processes.

Despite *Arabidopsis* promoting flowering in response to long days and rice promoting flowering in response to short days, the network controlling this response has been found to be highly conserved in these distantly related plants and controlled by Constans (Simpson G G. 2003, *Bioessays*. 25(9): 829-32).

C2C2 GATA: Many light-responsive promoters, common in plants, contain GATA motifs and a number of nuclear proteins have been defined that interact with these elements. Type-IV zinc-finger proteins have been extensively characterised in animals and fungi and are referred to as GATA factors by virtue of their affinity for promoter elements containing this sequence (Lowry J A and Atchley W R. 2000, *J Mol Evol*. 50(2):103-15).

Proteins containing a domain structure containing the C-X2-C-X20-C-X2-C motif (SEQ ID NO: 3673), a CCT domain, and an uncharacterized conserved domain were found exclusively in plants, indicating that they belong to a novel family of plant-specific GATA-type transcription factors. The overexpression of one such facor ZIM in *Arabidopsis* resulted in the elongation of hypocotyls and petiols (Shikata M, Matsuda Y, Ando K, Nishii A, Takemura M, Yokota A and Kohchi T., 2004, *J Exp Bot*. 55(397):631-9).

C2C2 YABBY: The expression of these genes is precisely correlated with abaxial cell fate in mutants in which abaxial cell fates are found ectopically, reduced or eliminated. Members of this gene family are responsible for the specification of abaxial cell fate in lateral organs of *Arabidopsis*, such as leaves and floral organs Siegfried K R, Eshed Y, Baum S F, Otsuga D, Drews G N and Bowman J L, 1999, *Development*. 126(18):4117-28). Yabby also plays a role in other plants, for example it regulates midrib formation by promoting cell proliferation in the central region of the rice leaf (Yamaguchi T, Nagasawa N, Kawasaki S, Matsuoka M, Nagato Y and Hirano H Y. 2004, *Plant Cell*. 16(2):500-9).

C2H2 (Zn): C2H2 zinc finger protein genes encode nucleic acid-binding proteins involved in the regulation of gene activity. AtZFP1 (*Arabidopsis thaliana* zinc finger protein 1) is one member of a small family of C2H2 zinc finger-encoding sequences previously characterized from *Arabidopsis*. The genomic sequence corresponding to the AtZFP1 cDNA has been determined. Molecular analysis demonstrates that AtZFP1 is a unique, intronless gene which encodes a 1100 nucleotides mRNA highly expressed in roots and stems (Chrispeels H E, Oettinger H, Janvier N and Tague B W. 2000, *Plant Mol Biol*. 42(2):279-90).

Plant C2H2 zinc finger transcription factors have been identified as playing important roles in floral organogenesis (Yun J Y, Weigel D and Lee I. 2002, *Plant Cell Physiol*. 43(1):52-7), flowering time (Kozaki A, Hake S and Colasanti J. 2004, *Nucleic Acids Res*. 32(5):1710-20), leaf initation, lateral shoot inititation, gametogenesis and seed development (Sagasser M, Lu G H, Hahlbrock K and Weisshaar B, 2002, *Genes Dev*. 16(1):138-49).

C3H-type (Zn): C3H type zinc finger proteins are known to be involved in the regulation of cell division in human tumors and may have similar functions in plants.

CPP(ZN): A novel type of DNA-binding protein (CPP1) has been identified interacting with the promoter of the soybean leghemoglobin gene Gmlbc3. The DNA-binding domain of CPP1 contains two similar Cys-rich domains with 9 and 10 Cys, respectively. The cpp1 gene is induced late in nodule development and the expression is confined to the distal part of the central infected tissue of the nodule. A constitutively expressed cpp1 gene reduces the expression of a Gmlbc3 promoter-gusA reporter construct in *Vicia hirsuta* roots. These data therefore suggest that CPP1 might be involved in the regulation of the leghemoglobin genes in the symbiotic root nodule (Cvitanich C, Pallisgaard N, Nielsen K A, Hansen A C, Larsen K, Pihakaski-Maunsbach K, Marcker K A and Jensen E O, 2000, *Proc Natl Acad Sci USA*. 97(14): 8163-8).

Desired Polynucleotide: a desired polynucleotide of the present invention is a genetic element, such as a promoter, enhancer, or terminator, or gene or polynucleotide that is to be transcribed and/or translated in a transformed cell that comprises the desired polynucleotide in its genome. If the desired polynucleotide comprises a sequence encoding a protein product, the coding region may be operably linked to regulatory elements, such as to a promoter and a terminator, that bring about expression of an associated messenger RNA transcript and/or a protein product encoded by the desired polynucleotide. Thus, a "desired polynucleotide" may comprise a gene that is operably linked in the 5'- to 3'-orientation, a promoter, a gene that encodes a protein, and a terminator. Alternatively, the desired polynucleotide may comprise a gene or fragment thereof, in a "sense" or "antisense" orientation, the transcription of which produces nucleic acids that may affect expression of an endogenous gene in the plant cell. A desired polynucleotide may also yield upon transcription a double-stranded RNA product upon that initiates RNA interference of a gene to which the desired polynucleotide is associated. A desired polynucleotide of the present invention may be positioned within a T-DNA, such that the left and right T-DNA border sequences flank or are on either side of the desired polynucleotide. The present invention envisions the stable integration of one or more desired polynucleotides into the genome of at least one plant cell. A desired polynucleotide may be mutated or a variant of its wild-type sequence. It is understood that all or part of the desired polynucleotide can be integrated into the genome of a plant. It also is understood that the term "desired polynucleotide" encompasses one or more of such polynucleotides. Thus, a T-DNA of the present invention may comprise one, two, three, four, five, six, seven, eight, nine, ten, or more desired polynucleotides.

Dicotyledonous plant (dicot): a flowering plant whose embryos have two seed halves or cotyledons, branching leaf veins, and flower parts in multiples of four or five. Examples of dicots include but are not limited to, *Eucalyptus, Populus, Liquidamber, Acacia*, teak, mahogany, cotton, tobacco, *Arabidopsis*, tomato, potato sugar beet, broccoli, cassaya, sweet potato, pepper, poinsettia, bean, alfalfa, soybean, carrot, strawberry, lettuce, oak, maple, walnut, rose, mint, squash, daisy, geranium, avocado, and cactus.

DRAP1: NC2 (Dr1-Drap1) is a bifunctional basal transcription factor that differentially regulates gene transcription through DPE or TATA box motifs. Purified recombinant dNC2 activates DPE-driven promoters and represses TATA-driven promoters. A mutant version of dNC2 can activate DPE promoters but is unable to repress TATA promoters. Thus, the activation and repression functions are distinct. Rice (Song W, Solimeo H, Rupert R A, Yadav N S and Zhu Q, 2002, *Plant Cell.* 14(1):181-95).

E2F/DP: E2F/DP complexes play a pivotal role in the regulation of the G1/S transition in animals. Recently, plant E2F and DP-related homologs have been cloned. Plant E2F homologs exhibit an overall domain organization similar to that of their animal counterparts, although phylogenetic analysis demonstrated that they form a separate subgroup. They are predominantly produced in actively dividing cells with highest transcript levels in early S phase cells (Mariconti L, Pellegrini B, Cantoni R, Stevens R, Bergounioux C, Cella R and Albani D, 2002, *J Biol. Chem.* 277(12):9911-9). In tobacco high expression of *Arabidopsis* E2F promotes endoreduplication by accelerating S phase entry in terminally differentiated cells with limited mitotic activity and enhanced E2F activity modulates cell cycle in a cell type-specific manner and affects plant morphology depending on a balance between activities for committing to S phase and M phase (Kosugi S and Ohashi Y. 2003, *Plant Physiol.* 132(4):2012-22). In known *Arabidopsis* promoters, E2F binding regions are found in the promoters of cell division related genes (Egelkrout E M, Mariconti L, Settlage S B, Cella R, Robertson D and Hanley-Bowdoin L. 2002, *Plant Cell.* 14(12): 3225-36; Stevens R, Mariconti L, Rossignol P, Perennes C, Cella R and Bergounioux C. 2002, *J Biol. Chem.* 277(36): 32978-84).

EIL: Overexpression of EIN3 or EIL1 in wild-type *Arabidopsis* plants resulted in a constitutive ethylene phenotype and increased ERF1 expression. These results indicate that EIN3 is a transcription factor that acts as a positive regulator of the ethylene signal-transduction pathway (Chao Q, Rothenberg M, Solano R, Roman G, Terzaghi W and Ecker J R, 1997, *Cell.* 89(7):1133-44). Ethylene is important in many plant processes, including maturation and wood formation.

Endogenous refers to a gene that is native to a plant genome.

Fiber composition: as used herein, fiber composition refers to trait that can be modified to change the structure, appearance, or use of fiber. While not limiting, traits that determine fiber composition include fiber length, coarseness, strength, color, cross-sectional, and fiber density. For example, it is known that fiber length imparts strength, whereas fiber coarseness determines texture and flexibility.

Foreign: "foreign," with respect to a nucleic acid, means that that nucleic acid is derived from non-plant organisms, or derived from a plant that is not the same species as the plant to be transformed or is not derived from a plant that is not interfertile with the plant to be transformed, does not belong to the species of the target plant. According to the present invention, foreign DNA or RNA represents nucleic acids that are naturally occurring in the genetic makeup of fungi, bacteria, viruses, mammals, fish or birds, but are not naturally occurring in the plant that is to be transformed. Thus, a foreign nucleic acid is one that encodes, for instance, a polypeptide that is not naturally produced by the transformed plant. A foreign nucleic acid does not have to encode a protein product.

GARP: GARP transcription factors are represented by the family of *Arabidopsis* Response Regulator (ARR) genes that mediate responses to cytokinin and ethylene. The ARR family can be divided into two groups, Type A and Type B, which differ in their sequence and domain structure. Type A genes are responsive to cytokinin, while Type B genes are induced by ethylene and osmotic stress. Both Type A and Type B family genes have a two-component signal transduction system. comprising a histidyl-aspartyl phosphorelay and a response regulator receiver. Stock et al., *Annu. Rev. Biochem.* 69:183-215 (2000).

Gene: A gene is a segment of a DNA molecule that contains all the information required for synthesis of a product, polypeptide chain or RNA molecule, that includes both coding and non-coding sequences.

Genetic element: a "genetic element" is any discreet nucleotide sequence such as, but not limited to, a promoter, gene, terminator, intron, enhancer, spacer, 5'-untranslated region, 3'-untranslated region, or recombinase recognition site.

Genetic modification: stable introduction of DNA into the genome of certain organisms by applying methods in molecular and cell biology.

Gymnosperm: as used herein, refers to a seed plant that bears seed without ovaries. Examples of gymnosperms include conifers, cycads, ginkgos, and ephedras.

GRAS: Sequence analysis of the products of the GRAS (GAI, RGA, SCR) gene family indicates that they share a variable amino-terminus and a highly conserved carboxyl-terminus that contains five recognizable motifs. The importance of the GRAS gene family in plant biology has been established by the functional analyses of SCR, GAI and RGA. These genes appear to have a function in patterning, particularly radial patterning, which is important in the development of stems, roots and floral organs (Pysh, et al., *Plant Journal* 18:111-119 (1999)). GRAS proteins exert important roles in very diverse processes such as signal transduction, meristem maintenance and development (Bolle C., 2004, *Planta.* 218(5):683-92).

Homeotic transcription factors: In animals, homeotic transcription factors have, in animals, been implicated in a number of developmental processes including, for example, the control of pattern formation in insects and vertebrate embryos and the specification of cell differentiation in many tissues (Ingham, *Nature* 335:25-34 (1988)); McGinnis and Krumlauf, *Cell* 68:283-302 (1992)). Homeodomain secondary structures are characterized by a distinctive helix-turn-helix motif initially identified in bacterial DNA binding domains. This helix-turn-helix sequence/structure motif spans approximately 20 amino acids and is characterized by two short helices separated by a sharp 90 degree bend or turn (Harrison and Aggarwal, *Ann. Rev. Biochem.* 59:933-969 (1990)). This helix has been shown to bind in the major groove of the DNA helix.

Plant homeobox genes have been identified in a number of plant species including *Arabidopsis thaliana*, maize, parsley and soybean. Expression pattern analysis of maize homeobox gene family members suggests that these transcription factors may be involved in defining specific regions in the vegetative apical meristem, potentially involved in the initiation of leaf structures (Jackson et al., *Development* 120:405-413 (1994). Such observations imply that the plant homeobox genes, as for the animal homeobox genes, may be involved in the determination of cell fate.

Homeodomain-zipper (HD-zip) represents an additional family of homeodomain proteins. These homeodomain-zipper proteins (HD-zip) possess both the characteristic homeodomain linked to an additional leucine zipper dimerization motif. This family includes, for example, Athb-1 and Athb-2 (Sessa et al., *EMBO J.* 12:3507-3517 (1993) and Athb-4 (Carabelli et al., *Plant J.* 4:469-479 (1993).

HSF: Heat shock factors (HSF) are the transcriptional activators of the heat shock response. The conversion of constitutively expressed HSF to a form that can bind DNA requires the trimerization of the protein, involving leucine zipper interactions as shown for yeast, *Drosophila*, chicken and human HSFs. Like other metazoan HSFs, the endogenous *Arabidopsis* HSF displays heat shock-inducible DNA-binding activity in gel retardation assays (Hubel A, Lee J H, Wu C and Schoffl F. 1995, *Mol Gen Genet.* 248(2):136-41). Overexpression of heat shock protein in plants results in plants exhibiting a thermotolerance (Sanmiya K, Suzuki K, Egawa Y and Shono M. 2004, *FEBS Lett.* 557(1-3):265-8; Sung D Y and Guy C L. 2003, *Plant Physiol.* 132(2):979-87).

Introduction: as used herein, refers to the insertion of a nucleic acid sequence into a cell, by methods including infection, transfection, transformation or transduction.

Jumonji: There is an absence of literature regarding jumonji transcriptional regulators in plants. In animals, however, there is a small amount of literature covering this family. Overexpression has been shown to decrease cell proliferation and suggests a role during regulation of cell proliferation signaling (Ohno T, Nakajima K, Kojima M, Toyoda M and Takeuchi T, 2004, *Biochem Biophys Res Commun.* 317(3):925-9; Kitajima K, Kojima M, Kondo S and Takeuchi T, 2001, *Exp Hematol.* 29(4):507-14). The jumonji protein contains an ARID domain and a jmjC domain. Frequently, jumonji proteins are associated with a small N-terminal jmjN domain and/or a C-terminal ZnC5HC2 domain and/or a PHD Zn finger (Toyoda M, Kojima M, Takeuchi T. 2000, *Biochem Biophys Res Commun.* 274(2):332-6).

Juvenility: describes a physiological difference between a young tree and a mature tree. In the present invention, juvenility refers to differences in microfibril angle, wood density, cellulose yield, regenerability, and reproductive ability between a young tree and a mature tree. For example, it has been shown that as a plant tissue matures, the tissue loses its ability to regenerate.

Lignin: as used herein, refers to a polymeric composition composed of phenylpropanoid units, including polymerized derivatives of monolignols coniferyl, coumaryl, and sinapyl alcohol. Lignin quality refers to the ability of a lignin composition to impart strength to cell wall matrices, assist in the transport of water, and/or impede degradation of cell wall polysaccharides. Lignin compositon or lignin structure may be changed by altering the relative amounts of each of monolignols or by altering the type of lignin. For example, guaiacyl lignins (derived from ferulic acid) are prominent in softwood species, whereas guaiacyl-syringyl lignins (derived from ferulic acid and sinapic acid) are characteristic of hardwood species. The degradation of lignin from softwoods, such as pine, requires substantially more alkali and longer incubations, compared with the removal of lignin from hardwoods. Additionally, lignin composition may be regulated by either up-regulation or down-regulation of enzymes involved lignin biosynthesis. For example, key lignin biosynthsesis enzymes include 4-coumaric acid: coenzyme A ligase (4CL), Cinnamyl Alcohol dehydrogenase (CAD), and Sinapyl Alcohol Dehydrogenase (SAD).

LIM: The LIM domain is a specialized double-zinc finger motif found in a variety of proteins, in association with domains of divergent functions, such as the homeodomain (see the sunflower pollen-specific SF3 transcription factor: Baltz et al., *Plant J.* 2:713-721 (1992) or forming proteins composed primarily of LIM domains: Dawid et al., *Trends Genet.* 144:156-162 (1998). LIM domains interact specifically with other LIM domains and with many different protein domains. LIM domains are thought to function as protein interaction modules, mediating specific contacts between members of functional complexes and modulating the activity of some of the constituent proteins. Nucleic acid binding by LIM domains, while suggested by structural considerations, remains an unproven possibility. However, it is possible that together with the homeodomain, the LIM domain could bind to the regulatory regions of developmentally controlled genes, as has been proposed for the paired box, a conserved sequence motif first identified in the paired (PRD) and gooseberry (GSB) homeodomain proteins from *Drosophila* (Triesman et al., *Genes Dev.* 5:594-604 (1991). The PRD box is also able to bind DNA in the absence of the homeodomain. LIM-domain proteins can be nuclear, cytoplasmic, or can shuttle between compartments. In the animal systems, several important LIM proteins have been shown to be associated with the cytoskeleton, having a role in adhesion-plaque and actin-microfilament organization. Among nuclear LIM proteins, the LIM homeodomain proteins form a major subfamily with important functions in cell lineage determination and pattern formation during animal development. In plants, a LIM protein has been demonstrated to control a number of genes in the lignin biosynthesis pathway, critically important for developing wood (Kawaoka A, Ebinuma H 2001 Transcriptional control of lignin biosynthesis by tobacco LIM protein. *Phytochemistry* 57:1149-1157, Kawaoka et al. *Plant J.* 22: 289-301 (2000).

MADS: MADS box (SEQ ID NO: 3668) transcription factors interact with a conserved region of DNA known as the MADS box. All MADS box (SEQ ID NO: 3668) transcription factors contain a conserved DNA-binding/dimerization region, known as the MADS domain (SEQ ID NO: 3668), which has been identified throughout the different kingdoms (Riechmann and Meyerowitz, *Biol. Chem.* 378:10:1079-1101 (1997). Many of the MADS box (SEQ ID NO: 3668) genes isolated from plants are expressed primarily in floral meristems or floral organs, and are believed to play a role in either specifying inflorescence and floral meristem identity or in determining floral organ identity. One class of regulatory genes responsible for floral meristem identity and the pattern of meristem development includes the genes APETALA1 (AP1), APETALA2 (AP2), CAULIFLOWER (CAL), LEAFY (LFY) and AGAMOUS (AG) from *Arabidopsis thaliana*. Both LFY and AP1 have been shown to encode putative transcription factors (Weigel et al., *Cell* 69:843-859 (1992), with AP1 and AG each encoding putative transcription factors of the MADS box domain family (Yanofsky et al., *Nature* 346:35-39 (1990). Mutations in the Lfy gene have been shown to result in a partial conversion of flowers into inflorescence shoots. MADS box (SEQ ID NO: 3668) genes are required for anther and pollen maturation (Schreiber D N, Bantin J and Dresselhaus T. 2004, *Plant Physiol.* 134(3):1069-79), the transition from vegetative to reproductive growth in plants (Murai K, Miyamae M, Kato H, Takumi S and Ogihara Y. 2003, *Plant Cell Physiol.* 44(12):1255-65) an flowering time (Trevaskis B, Bagnall D J, Ellis M H, Peacock W J and Dennis E S. 2003, *Proc Natl Acad Sci USA.* 100(22):13099-104).

Monocotyledonous plant (monocot): a flowering plant having embryos with one cotyledon or seed leaf, parallel leaf veins, and flower parts in multiples of three. Examples of monocots include, but are not limited to turfgrass, maize, rice, oat, wheat, barley, sorghum, orchid, iris, lily, onion, and palm. Examples of turfgrass include, but are not limited to *Agrostis* spp. (bentgrass species including colonial bentgrass and creeping bentgrasses), *Poa pratensis* (kentucky bluegrass), *Lolium* spp. (ryegrass species including annual ryegrass and perennial ryegrass), *Festuca arundinacea* (tall fescue) *Fes-* tuca rubra commutata (fine fescue), Cynodon dactylon (common bermudagrass varieties including Tifgreen, Tifway II, and Santa Ana, as well as hybrids thereof); Pennisetum clandestinum (kikuyugrass), Stenotaphrum secundatum (st. augustinegrass), Zoysia japonica (zoysiagrass), and Dichondra micrantha.

Myb: The Myb family of transcription factors is a group of functionally diverse transcriptional activators found in both plants and animals that is characterized by a conserved amino-terminal DNA-binding domain containing either two (in plant species) or three (in animal species) imperfect tandem repeats of approximately 50 amino acids (Rosinski and Atchley, J. Mol. Evol. 46:1:74-83 (1998) Stober-Grasser et al., Oncogene 7:3:589-596 (1992). Comparisons between the amino acid sequences of representative plant and mammalian MYB proteins indicate that there is a greater conservation between the same repeat from different proteins, than between the R2 and R3 repeats from the same protein (Martin and Paz-Ares, Trends Genet. 13:2:67-73 (1997). More than 100 MYB genes have been reported from Arabidopsis thaliana (Romero et al., Plant J. 14:3:273-284 (1998), Myb genes such at AtmybL2 have been isolated that include only one of the typical two or three tryptophan repeats found in other myb-like proteins (Kirik & Baumlein, Gene, 183(1-2): 109-13 (1996)). A myb-like gene has been previously isolated from Pinus taeda developing xylem, and when ectopically expressed in transgenic plants, the plants showed accelerated lignification (Patzlaff A, McInnis S, Courtenay A, Surman C, Newman L J, Smith C, Bevan M W, Mansfield S, Whetten R W, Sederoff R R, Campbell M M. 2003, Plant J. 36(6):743-54). A pine myb gene Pt MYB1 may regulate transcription from cis-acting AC elements in pine xylem (Patzlaff A, Newman L J, Dubos C, Whetten R W, Smith C, McInnis S, Bevan M W, Sederoff R R and Campbell M M. 2003, Plant Mol Biol. 53(4):597-608).

DNA-binding studies have demonstrated that there are differences, but also frequent overlaps, in binding specificity among plant MYB proteins, in line with the distinct but often related functions that are beginning to be recognized for these proteins. Studies involving the eight putative base-contacting residues in MYB DNA binding domains have revealed that at least six are fully conserved in all plant MYB proteins identified to date and the remaining two are conserved in at least 80% of these proteins (Martin and Paz-Ares, Trends Genet. 13:2:67-73 (1997). Mutational analysis involving residues that do not contact bases have indicated that the sequence-specific binding capacity of MYBs is affected and this may account for some of the differences in the DNA-binding specificity between plant MYB proteins (Solano et al., J. Biol. Chem. 272:5:2889-2895 (1997). This large-sized gene family may contribute to the regulatory flexibility underlying the developmental and metabolic plasticity displayed by plants.

NAC: NAC proteins are characterized by their conserved N-terminal NAC domains that can bind both DNA and other proteins. The NAC domain consists of a twisted beta-sheet surrounded by a few helical elements. NAC proteins are involved in developmental processes, including formation of the shoot apical meristem, floral organs and lateral shoots, as well as in plant hormonal control and defence (Ernst H A, Olsen A N, Larsen S AND Lo Leggio L. 2004, EMBO Rep. 5(3):297-303). Auxin plays a key role in lateral root formation, but the signaling pathway for this process is poorly understood. NAC1, a new member of the NAC family, is induced by auxin and mediates auxin signaling to promote lateral root development. NAC1 is a transcription activator consisting of an N-terminal conserved NAC-domain that binds to DNA and a C-terminal activation domain. This factor activates the expression of two downstream auxin-responsive genes, DBP and AIR3.

NIN-like: The NIN protein was discovered via a mutant phenotype conferring arrested nodule development. It was demonstrated that the NIN protein is required for the formation of infection threads and nodule primordia. NIN protein has sequence similarity to transcription factors, and a predicted DNA-binding/dimerization domain similar to other plant proteins involved in nitrogen related processes (Schauser L, Roussis A, Stiller J and Stougaard J. 1999, Nature. 1999 402(6758):191-5). The NIN-like family of transcription factors is characterized by the RWP-RK domain (SEQ ID NO: 3669) (Borisov A Y, Madsen L H, Tsyganov V E, Umehara Y, Voroshilova V A, Batagov A O, Sandal N, Mortensen A, Schauser L, Ellis N, Tikhonovich I A and Stougaard J. 2003, Plant Physiol. 131(3):1009-17). An N-terminal Octicosapeptide (OPR) is found in 11 out of 19 of the plant NIN-like proteins.

Operably linked: combining two or more molecules in such a fashion that in combination they function properly in a plant cell. For instance, a promoter is operably linked to a structural gene when the promoter controls transcription of the structural gene.

Phenotype: phenotype is a distinguishing feature or characteristic of a plant, which may be altered according to the present invention by integrating one or more "desired polynucleotides" and/or screenable/selectable markers into the genome of at least one plant cell of a transformed plant. The "desired polynucleotide(s)" and/or markers may confer a change in the phenotype of a tranformed plant, by modifying any one of a number of genetic, molecular, biochemical, physiological, morphological, or agronomic characteristics or properties of the transformed plant cell or plant as a whole. Thus, expression of one or more, stably integrated desired polynucleotide(s) in a plant genome, may yield a phenotype selected from the group consisting of, but not limited to, increased drought tolerance, enhanced cold and frost tolerance, improved vigor, enhanced color, enhanced health and nutritional characteristics, improved storage, enhanced yield, enhanced salt tolerance, enhanced heavy metal tolerance, increased disease tolerance, increased insect tolerance, increased water-stress tolerance, enhanced sweetness, improved vigor, improved taste, improved texture, decreased phosphate content, increased germination, increased micronutrient uptake, improved starch composition, and improved flower longevity.

Plant tissue: a "plant" is any of various photosynthetic, eukaryotic, multicellular organisms of the kingdom Plantae characteristically producing embryos, containing chloroplasts, and having cellulose cell walls. A part of a plant, i.e., a "plant tissue" may be treated according to the methods of the present invention to produce a transgenic plant. Many suitable plant tissues can be transformed according to the present invention and include, but are not limited to, somatic embryos, pollen, leaves, stems, calli, stolons, microtubers, and shoots. Thus, the present invention envisions the transformation of angiosperm and gymnosperm plants such as turfgrass, wheat, maize, rice, barley, oat, sugar beet, potato, tomato, tobacco, alfalfa, lettuce, carrot, strawberry, cassaya, sweet potato, geranium, soybean, oak, pine, fir, acacia, eucalyptus, walnut, and palm. According to the present invention "plant tissue" also encompasses plant cells. Plant cells include suspension cultures, callus, embryos, meristematic regions, callus tissue, leaves, roots, shoots, gametophytes, sporophytes, pollen, seeds and microspores. Plant tissues may be at various stages of maturity and may be grown in liquid or solid culture, or in soil or suitable media in pots, greenhouses or fields. A plant tissue also refers to any clone of such a plant, seed, progeny, propagule whether generated sexually or asexually, and descendents of any of these, such as cuttings or seed. Of particular interest are conifers such as pine, fir and spruce, monocots such as Kentucky bluegrass, creeping bentgrass, maize, and wheat, and dicots such as cotton, tomato, lettuce, *Arabidopsis*, tobacco, and geranium.

Plant transformation and cell culture: broadly refers to the process by which plant cells are genetically modified and transferred to an appropriate plant culture medium for maintenance, further growth, and/or further development. Such methods are well known to the skilled artisan.

POLYCOMB: Polycomb group (PcG) proteins play an important role in developmental and epigenetic regulation of gene expression in fruit fly (*Drosophila melanogaster*) and mammals. Recent evidence has shown that *Arabidopsis* homologs of PcG proteins are also important for the regulation of plant development. Recent studies in plants have shown that PcG proteins regulate diverse developmental processes and, as in animals, they affect both homeotic gene expression and cell proliferation (Reyes J C and Grossniklaus U. 2003, *Semin Cell Dev Biol.* 14(1):77-84). PcG proteins have also been shown to repress expression of introduced and endogenous genes in fruit fly. All examples of polycomb-based repression likely operate through formation of a repressive chromatin structure (Hsieh T F, Hakim O, Ohad N and Fischer R L. 2003, *Trends Plant Sci.* 8(9):439-45).

Progeny: a "progeny" of the present invention, such as the progeny of a transgenic plant, is one that is born of, begotten by, or derived from a plant or the transgenic plant. Thus, a "progeny" plant, i.e., an "F1" generation plant is an offspring or a descendant of the transgenic plant produced by the inventive methods. A progeny of a transgenic plant may contain in at least one, some, or all of its cell genomes, the desired polynucleotide that was integrated into a cell of the parent transgenic plant by the methods described herein. Thus, the desired polynucleotide is "transmitted" or "inherited" by the progeny plant. The desired polynucleotide that is so inherited in the progeny plant may reside within a T-DNA construct, which also is inherited by the progeny plant from its parent. The term "progeny" as used herein, also may be considered to be the offspring or descendants of a group of plants.

Promoter: promoter is intended to mean a nucleic acid, preferably DNA, that binds RNA polymerase and/or other transcription regulatory elements. As with any promoter, the promoters of the current invention will facilitate or control the transcription of DNA or RNA to generate an mRNA molecule from a nucleic acid molecule that is operably linked to the promoter. As stated earlier, the RNA generated may code for a protein or polypeptide or may code for an RNA interfering, or antisense molecule.

A plant promoter is a promoter capable of initiating transcription in plant cells whether or not its origin is a plant cell. Exemplary plant promoters include, but are not limited to, those that are obtained from plants, plant viruses, and bacteria such as *Agrobacterium* or *Rhizobium* which comprise genes expressed in plant cells. Examples of promoters under developmental control include promoters that preferentially initiate transcription in certain tissues, such as xylem, leaves, roots, or seeds. Such promoters are referred to as tissue-preferred promoters. Promoters which initiate transcription only in certain tissues are referred to as tissue-specific promoters. A cell type-specific promoter primarily drives expression in certain cell types in one or more organs, for example, vascular cells in roots or leaves. An inducible or repressible promoter is a promoter which is under environmental control.

Examples of environmental conditions that may effect transcription by inducible promoters include anaerobic conditions or the presence of light. Tissue specific, tissue preferred, cell type specific, and inducible promoters constitute the class of non-constitutive promoters. A constitutive promoter is a promoter which is active under most environmental conditions, and in most plant parts.

Polynucleotide is a nucleotide sequence, comprising a gene coding sequence, or a fragment thereof, (comprising at least 15 consecutive nucleotides, preferably at least 30 consecutive nucleotides, and more preferably at least 50 consecutive nucleotides), a promoter, an intron, an enhancer region, a polyadenylation site, a translation initiation site, 5' or 3' untranslated regions, a reporter gene, a selectable marker or the like. The polynucleotide may comprise single stranded or double stranded DNA or RNA. The polynucleotide may comprise modified bases or a modified backbone. The polynucleotide may be genomic, an RNA transcript (such as an mRNA) or a processed nucleotide sequence (such as a cDNA). The polynucleotide may comprise a sequence in either sense or antisense orientations.

An isolated polynucleotide is a polynucleotide sequence that is not in its native state, e.g., the polynucleotide is comprised of a nucleotide sequence not found in nature or the polynucleotide is separated from nucleotide sequences with which it typically is in proximity or is next to nucleotide sequences with which it typically is not in proximity.

RAV-like: RAV-like transcription factors are unique to higher plants. RAV stands for Related to ABI3/VP1 and have been placed in the AP2 EREBP transcription factor family because they contain the AP2 domain. However, they also contain a domain homologous to the B3 domain. The AP2 domain binds to 5'-CAACA-3' and the B3 domain binds to 5'-CACCTG-3'. This dual binding is autonomous and achieves high affinity and specificity of binding (Kagaya Y, Ohmiya K and Hattori T. 1999, *Nucleic Acids Res.* 27(2):470-8). Interestingly, some RAV-like proteins, such as those found in *Eucalyptus*, contain only the B3 domain.

Regenerability: as used herein, refers to the ability of a plant to redifferentiate from a de-differentiated tissue.

SBP: The *Arabidopsis thaliana* SPL gene family represents a group of structurally diverse genes encoding putative transcription factors found apparently only in plants. The distinguishing characteristic of the SPL gene family is the SBP-box encoding a conserved protein domain of 76 amino acids in length, the SBP-domain, which is responsible for the interaction with DNA. SBP genes appear to have a function in differentiation of plant organs, both in vegetative and floral organs (Unte U S, Sorensen A M, et al. 2003, *Plant Cell;* 15(4):1009-19; Cardon et al.; Gene 237:91-104 (1999); Moreno et al.; Genes Dev. 11:616-628 (1997); Cardon et al.; Plant J. 12:367-377 (1997)). SBP box genes have been isolated from trees and implicated in the regulation of flower development (Lannenpaa M, Janonen I, Holtta-Vuori M, Gardemeister M, Porali I and Sopanen T. 2004, *Physiol Plant.* 120(3):491-500).

Seed: a "seed" may be regarded as a ripened plant ovule containing an embryo, and a propagative part of a plant, as a tuber or spore. Seed may be incubated prior to *Agrobacterium*-mediated transformation, in the dark, for instance, to facilitate germination. Seed also may be sterilized prior to incubation, such as by brief treatment with bleach. The resultant seedling can then be exposed to a desired strain of *Agrobacterium*.

Selectable/screenable marker: a gene that, if expressed in plants or plant tissues, makes it possible to distinguish them from other plants or plant tissues that do not express that gene.

Screening procedures may require assays for expression of proteins encoded by the screenable marker gene. Examples of such markers include the beta glucuronidase (GUS) gene and the luciferase (LUX) gene. Examples of selectable markers include the neomycin phosphotransferase (NPTII) gene encoding kanamycin and geneticin resistance, the hygromycin phosphotransferase (HPT or APHIV) gene encoding resistance to hygromycin, acetolactate synthase (als) genes encoding resistance to sulfonylurea-type herbicides, genes (BAR and/or PAT) coding for resistance to herbicides which act to inhibit the action of glutamine synthase such as phosphinothricin (Liberty or Basta), or other similar genes known in the art.

Sequence identity: as used herein, "sequence identity" or "identity" in the context of two nucleic acid or polypeptide sequences includes reference to the residues in the two sequences which are the same when aligned for maximum correspondence over a specified region. When percentage of sequence identity is used in reference to proteins it is recognized that residue positions which are not identical often differ by conservative amino acid substitutions, where amino acid residues are substituted for other amino acid residues with similar chemical properties (e.g. charge or hydrophobicity) and therefore do not change the functional properties of the molecule. Where sequences differ in conservative substitutions, the percent sequence identity may be adjusted upwards to correct for the conservative nature of the substitution. Sequences which differ by such conservative substitutions are said to have "sequence similarity" or "similarity." Means for making this adjustment are well-known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Meyers and Miller, *Computer Applic. Biol. Sci.*, 4: 11-17 (1988) e.g., as implemented in the program PC/GENE (Intelligenetics, Mountain View, Calif., USA).

As used herein, percentage of sequence identity means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity.

"Sequence identity" has an art-recognized meaning and can be calculated using published techniques. See COMPUTATIONAL MOLECULAR BIOLOGY, Lesk, ed. (Oxford University Press, 1988), BIOCOMPUTING: INFORMATICS AND GENOME PROJECTS, Smith, ed. (Academic Press, 1993), COMPUTER ANALYSIS OF SEQUENCE DATA, PART I, Griffin & Griffin, eds., (Humana Press, 1994), SEQUENCE ANALYSIS IN MOLECULAR BIOLOGY, Von Heinje ed., Academic Press (1987), SEQUENCE ANALYSIS PRIMER, Gribskov & Devereux, eds. (Macmillan Stockton Press, 1991), and Carillo & Lipton, *SIAM J. Applied Math.* 48: 1073 (1988). Methods commonly employed to determine identity or similarity between two sequences include but are not limited to those disclosed in GUIDE TO HUGE COMPUTERS, Bishop, ed., (Academic Press, 1994) and Carillo & Lipton, supra. Methods to determine identity and similarity are codified in computer programs. Preferred computer program methods to determine identity and similarity between two sequences include but are not limited to the GCG program package (Devereux et al., *Nucleic Acids Research* 12: 387 (1984)), BLASTP, BLASTN, FASTA (Atschul et al., *J. Mol. Biol.* 215: 403 (1990)), and FASTDB (Brutlag et al., *Comp. App. Biosci.* 6: 237 (1990)).

TCP: The TCP family has been termed after its first characterised members (TB1, CYC and PCFs). They are expressed in rapidly growing floral primordia. This, together with the proposed involvement of cyc and tb1 in influencing meristem growth, suggests that many members of the TCP family may affect cell division (Cubas P, Lauter N, Doebley J and Coen E. 1999, *Plant J.* 18(2):215-22).

Transcription factor: Transcription factor refers to a polypeptide sequence that regulates the expression of a gene or genes by either directly binding to one or more nucleotide sequences associated with a gene coding sequence or indirectly affecting the activity of another polypeptide(s) that binds directly to one or more nucleotide sequences associated with a gene coding sequence. A transcription factor may activate (up-regulate) or repress (down-regulate) expression of a gene or genes. A transcription factor may contain a DNA binding domain, an activation domain, or a domain for protein-protein interactions. In the present invention, a transcription factor is capable of at least one of (1) binding to a nucleic acid sequence or (2) regulating expression of a gene in a plant. Additionally, the inventive polynucleotide sequences and the corresponding polypeptide sequences function as transcription factors in any plant species, including angiosperms and gymnosperms.

Transcription and translation terminators: The expression DNA constructs of the present invention typically have a transcriptional termination region at the opposite end from the transcription initiation regulatory region. The transcriptional termination region may be selected, for stability of the mRNA to enhance expression and/or for the addition of polyadenylation tails added to the gene transcription product. Translation of a nascent polypeptide undergoes termination when any of the three chain-termination codons enters the A site on the ribosome. Translation termination codons are UAA, UAG, and UGA.

Transfer DNA (T-DNA): an *Agrobacterium* T-DNA is a genetic element that is well-known as an element capable of integrating a nucleotide sequence contained within its borders into another genome. In this respect, a T-DNA is flanked, typically, by two "border" sequences. A desired polynucleotide of the present invention and a selectable marker may be positioned between the left border-like sequence and the right border-like sequence of a T-DNA. The desired polynucleotide and selectable marker contained within the T-DNA may be operably linked to a variety of different, plant-specific (i.e., native), or foreign nucleic acids, like promoter and terminator regulatory elements that facilitate its expression, i.e., transcription and/or translation of the DNA sequence encoded by the desired polynucleotide or selectable marker.

Transformation of plant cells: A process by which a nucleic acid is stably inserted into the genome of a plant cell. Transformation may occur under natural or artificial conditions using various methods well known in the art. Transformation may rely on any known method for the insertion of nucleic acid sequences into a prokaryotic or eukaryotic host cell, including *Agrobacterium*-mediated transformation protocols, viral infection, whiskers, electroporation, microinjection, polyethylene glycol-treatment, heat shock, lipofection and particle bombardment.

Transgenic plant: a transgenic plant of the present invention is one that comprises at least one cell genome in which an exogenous nucleic acid has been stably integrated. According to the present invention, a transgenic plant is a plant that comprises only one genetically modified cell and cell genome, or is a plant that comprises some genetically modified cells, or is a plant in which all of the cells are genetically modified. A transgenic plant of the present invention may be one that comprises expression of the desired polynucleotide, i.e., the exogenous nucleic acid, in only certain parts of the plant. Thus, a transgenic plant may contain only genetically modified cells in certain parts of its structure.

Trihelix: GT factors have either one or two trihelix DNA binding domains, distantly related to Myb DNA binding domains. Trihelix domains were discovered in proteins that bind to GT elements found in the promoters of many light responsive genes. To date, DNA-binding proteins characterized by the trihelix motif have been described only in plants, and may therefore be involved in plant-specific processes. Smalle et al.; *Proc. Natl. Acad. Sci. USA* 95, 3318-3322 (1998). Trihelix genes have been shown to be important for light regulated gene expression (Nagano Y, Inaba T, Furuhashi H and Sasaki Y. 2001, *J Biol Chem.* 276(25):22238-43; Wang R, Hong G and Han B, 2004, *Gene.* 324:105-15). Light responsiveness is important in many plant developmental processes.

TUB: TUB and TUBBY are transcription factors originally characterized in mouse, where they are important in nervous-system function and development (Carroll K, Gomez C and Shapiro L, 2004, *Nat Rev Mol Cell Biol.* 5(1):55-63). Though similar sequences have been found in plants their function is unknown. 11 Tubby-like sequences have been identified in *Arabidopsis* and one of this has been shown to possibly participate in the ABA signaling pathway (Lai C P, Lee C L, Chen P H, Wu S H, Yang C C and Shaw J F. 2004, *Plant Physiol.* 134(4):1586-97).

Variant: a "variant," as used herein, is understood to mean a nucleotide or amino acid sequence that deviates from the standard, or given, nucleotide or amino acid sequence of a particular gene or protein. The terms, "isoform," "isotype," and "analog" also refer to "variant" forms of a nucleotide or an amino acid sequence. An amino acid sequence that is altered by the addition, removal or substitution of one or more amino acids, or a change in nucleotide sequence, may be considered a "variant" sequence. The variant may have "conservative" changes, wherein a substituted amino acid has similar structural or chemical properties, e.g., replacement of leucine with isoleucine. A variant may have "nonconservative" changes, e.g., replacement of a glycine with a tryptophan. Analogous minor variations may also include amino acid deletions or insertions, or both. Guidance in determining which amino acid residues may be substituted, inserted, or deleted may be found using computer programs well known in the art such as Vector NTI Suite (InforMax, MD) software. "Variant" may also refer to a "shuffled gene" such as those described in Maxygen-assigned patents. For instance, a variant of the present invention may include variants of sequences and desired polynucleotides that are modified according to the methods and rationale disclosed in U.S. Pat. No. 6,132,970, which is incorporated herein by reference.

Wood composition, as used herein, refers to trait that can be modified to change the structure, appearance, or use of wood. While not limiting, traits that determine wood composition include cell wall thickness, cell length, cell density, microfibril angle, tensile strength, tear strength, wood color, and length and frequency of cell division.

Wood pulp refers to fiber generated from wood having varying degrees of purification. Wood pulp can be used for producing paper, paper board, and chemical products.

The invention provides methods of obtaining wood, wood pulp, paper, and oil from a plant transformed with a construct of the present invention. Methods for transforming and selecting a transgenic plant are are known in the art. For example, pine can be cultured and grown as described in U.S. Patent Application Publication No. 2002/0100083. *Eucalyptus* can be cultured and grown as in, for example, Rydelius, et al., Growing *Eucalyptus* for Pulp and Energy, presented at the Mechanization in Short Rotation, Intensive Culture Forestry Conference, Mobile, Ala., 1994. Wood, wood pulp, paper, and oil can be obtained from the plant by any means known in the art.

As noted above, the wood and wood pulp obtained in accordance with this invention may demonstrate improved characteristics including, but not limited to any one or more of lignin composition, lignin structure, wood composition, cellulose polymerization, fiber dimensions, ratio of fibers to other plant components, plant cell division, plant cell development, number of cells per unit area, cell size, cell shape, cell wall composition, rate of wood formation, aesthetic appearance of wood, formation of stem defects, rate of growth, rate of root formation ratio of root to branch vegetative development, leaf area index, and leaf shape include increased or decreased lignin content, increased accessibility of lignin to chemical treatments, improved reactivity of lignin, increased or decreased cellulose content increased dimensional stability, increased tensile strength, increased shear strength, increased compression strength, increased shock resistance, increased stiffness, increased or decreased hardness, decreased spirality, decreased shrinkage, and differences in weight, density, and specific gravity.

Phenotype can be assessed by any suitable means. The plants can be evaluated based on their general morphology. Transgenic plants can be observed with the naked eye, can be weighed and their height measured. The plant can be examined by isolating individual layers of plant tissue, namely phloem and cambium, which is further sectioned into meristematic cells, early expansion, late expansion, secondary wall formation, and late cell maturation. See, e.g., Hertzberg, supra. The plants also can be assessed using microscopic analysis or chemical analysis.

Microscopic analysis includes examining cell types, stage of development, and stain uptake by tissues and cells. Fiber morphology, such as fiber wall thickness and microfibril angle of wood pulp fibers can be observed using, for example, microscopic transmission ellipsometry. See Ye and Sundström, *Tappi J.,* 80:181 (1997). Wood strength, density, and grain slope in wet wood and standing trees can be determined by measuring the visible and near infrared spectral data in conjunction with multivariate analysis. See, U.S. Patent Application Publication Nos. 2002/0107644 and 2002/0113212. Lumen size can be measured using scanning electron microscopy. Lignin structure and chemical properties can be observed using nuclear magnetic resonance spectroscopy as described in Marita et al., *J. Chem. Soc., Perkin Trans. I* 2939 (2001).

The biochemical characteristic of lignin, cellulose, carbohydrates and other plant extracts can be evaluated by any standard analytical method known including spectrophotometry, fluorescence spectroscopy, HPLC, mass spectroscopy, and tissue staining methods.

WRKY (Zn): The WRKY (SEQ ID NO: 3670) proteins are a superfamily of transcription factors with up to 100 representatives in *Arabidopsis*. Family members appear to be involved in the regulation of various physiological programs that are unique to plants, including, GA signaling, pathogen defense, senescence and trichome development (Zhang Z L, Xie Z, Zou X, Casaretto J, Ho T H, Shen Q J. 2004, *Plant Physiol.* 134(4):1500-13; Kim C Y and Zhang S., 2004, *Plant J.* 38(1):142-51; Robatzek S and Somssich I E. 2002, *Genes Dev.* 16(9):1139-49; Johnson C S, Kolevski B and Smyth D R. 2002, *Plant Cell.* 14(6):1359-75). In spite of the strong conservation of their DNA-binding domain, the overall structures of WRKY (SEQ ID NO: 3670) proteins are highly divergent and can be categorized into distinct groups, which might reflect their different functions.

Zinc finger: Zinc finger domains of the type $Cys_2His_2$ appear to represent the most abundant DNA binding motif in eukaryotic transcription factors, with several thousand being identified to date (Berg and Shi, *Science* 271:5252:1081-1085 (1996). A structural role for zinc in transcription factors was initially proposed in 1983 for the transcription factor IIIA (TFIIIA) (Hanas et al., *J Biol. Chem.* 258[23]:14120-14125, 1983). The $Cys_2His_2$ Zinc finger domains are characterized by tandem arrays of sequences of C-x(2,4)-C-x(3)-[LIVM-FYWC]-x(8)-H-x(3,5)-H (SEQ ID NO: 3674) (where X represents a variable amino acid). Structurally, the zinc finger consists of two antiparallel α strands followed by an α-helix (Lee et al., *Science* 245:4918:635-637 (1989). This structural arrangement allows for the cysteine and histidine side chains to coordinate the zinc with the three other conserved residues forming the hydrophobic core adjacent to the metal coordination unit (Berg and Shi, *Science* 271:5252:1081-1085 (1996). Many proteins possessing a $Cys_2His_2$ domain have been shown to interact with DNA in a sequence-specific manner. Crystal structure analysis of the mouse transcription factor Zif268 bound to a specific DNA target indicates that the zinc fingers in the protein/DNA complex reside in the major groove of the double helix and interacts with the DNA bases through amino acid side chains referred to as the contact residues (Pavletich and Pabo, *Science* 252:5007:809-817 (1991). The orientations of the zinc finger domains with respect to the DNA are usually identical, with each domain contacting a contiguous 3-base pair subsite, the majority of which are directed to one strand. There are few interdomain interactions and the DNA recognition by each zinc finger appears to be largely independent of the other domains (Berg and Shi, *Science* 271:5252:1081-1085 (1996).

Plant C2H2 zinc finger transcription factors have been identified as playing important roles in floral organogenesis, leaf initation, lateral shoot inititation, lateral organ development, gametogenesis and seed development. In some cases the same gene can be involved in several different developmental processes, such as AtZFP1 (Chrispeels H E, Oettinger H, Janvier N and Tague B W. 2000, *Plant Mol Biol.* 42(2): 279-90; Dinneny J R, Yadegari R, Fischer R L, Yanofsky M F and Weigel D. 2004, *Development.* 131(5):1101-10; Weissig H, Narisawa S, Sikstrom C, Olsson P G, McCarrey J R, Tsonis P A, Del Rio-Tsonis K and Millan J L. 2003, *FEBS Lett.* 547(1-3):61-8; He Y, Gan S. 2004, *Plant Mol Biol.* 54(1):1-9).

It is understood that the present invention is not limited to the particular methodology, protocols, vectors, and reagents, etc., described herein, as these may vary. It is also to be understood that the terminology used herein is used for the purpose of describing particular embodiments only, and is not intended to limit the scope of the present invention. It must be noted that as used herein and in the appended claims, the singular forms "a," "an," and "the" include plural reference unless the context clearly dictates otherwise. Thus, for example, a reference to "a gene" is a reference to one or more genes and includes equivalents thereof known to those skilled in the art and so forth. Indeed, one skilled in the art can use the methods described herein to express any native gene (known presently or subsequently) in plant host systems.

Polynucleotide Sequences

The present invention relates to an isolated nucleic acid molecule comprising a polynucleotide having a sequence selected from the group consisting of any of the polynucleotide sequences of SEQ ID NO: 1-494, 496-820, 1641-1972, 3588-3592. The invention also provides functional fragments of the polynucleotide sequences of SEQ ID NO: 1-494, 496-820, 1641-1972, 3588-3592. The invention further provides complementary nucleic acids, or fragments thereof, to any of the polynucleotide sequences of SEQ ID NO: 1-494, 496-820, 1641-1972, 3588-3592, as well as a nucleic acid, comprising at least 15 contiguous bases, which hybridizes to any of the polynucleotide sequences of SEQ ID NO: 1-494, 496-820, 1641-1972, 3588-3592.

The present invention relates to an isolated nucleic acid molecule comprising a polynucleotide having a sequence identity to a sequence selected from the group consisting of any of the polynucleotide sequences set forth in of SEQ ID NO: 1-494, 496-820, 1641-1972, 3588-3592. The invention also provides functional fragments of the polynucleotide sequences set forth in of SEQ ID NO: 1-494, 496-820, 1641-1972, 3588-3592. The invention further provides complementary nucleic acids, or fragments thereof, to any of the polynucleotide sequences set forth in of SEQ ID NO: 1-494, 496-820, 1641-1972, 3588-3592, as well as a nucleic acid, comprising at least 15 contiguous bases, which hybridizes to any of the polynucleotide sequences recited in of SEQ ID NO: 1-494, 496-820, 1641-1972, 3588-3592.

The present invention also relates to an isolated polypeptide sequence comprising a polypeptide having a sequence selected from the group consisting of any of the polypeptide sequences of SEQ ID NO: 821-1640, 3593-3596. The invention also provides functional fragments of the polypeptide sequences of SEQ ID NO: 821-1640, 3593-3596.

By "isolated" nucleic acid molecule(s) is intended a nucleic acid molecule, DNA or RNA, which has been removed from its native environment. For example, recombinant DNA molecules contained in a DNA construct are considered isolated for the purposes of the present invention. Further examples of isolated DNA molecules include recombinant DNA molecules maintained in heterologous host cells or purified (partially or substantially) DNA molecules in solution. Isolated RNA molecules include in vitro RNA transcripts of the DNA molecules of the present invention. Isolated nucleic acid molecules, according to the present invention, further include such molecules produced synthetically.

Nucleic acid molecules of the present invention may be in the form of RNA, such as mRNA, or in the form of DNA, including, for instance, cDNA and genomic DNA obtained by cloning or produced synthetically. The DNA or RNA may be double-stranded or single-stranded. Single-stranded DNA may be the coding strand, also known as the sense strand, or it may be the non-coding strand, also referred to as the antisense strand.

Unless otherwise indicated, all nucleotide sequences determined by sequencing a DNA molecule herein were determined using an automated DNA sequencer (such as the Model 373 from Applied Biosystems, Inc.) and all amino acid sequences of polypeptides encoded by DNA molecules determined herein were predicted by translation of a DNA sequence determined as above. Therefore, as is known in the art for any DNA sequence determined by this automated approach, any nucleotide sequence determined herein may contain some errors. Nucleotide sequences determined by automation are typically at least about 95% identical, more typically at least about 96% to at least about 99.9% identical to the actual nucleotide sequence of the sequenced DNA molecule. The actual sequence can be more precisely determined by other approaches including manual DNA sequencing methods well known in the art. As is also known in the art, a single insertion or deletion in a determined nucleotide sequence compared to the actual sequence will cause a frame shift in translation of the nucleotide sequence such that the predicted amino acid sequence encoded by a determined nucleotide sequence may be completely different from the amino acid sequence actually encoded by the sequenced DNA molecule, beginning at the point of such an insertion or deletion.

Each "nucleotide sequence" set forth herein is presented as a sequence of deoxyribonucleotides (abbreviated A, G, C and T). However, by "nucleotide sequence" of a nucleic acid molecule or polynucleotide is intended, for a DNA molecule or polynucleotide, a sequence of deoxyribonucleotides, and for an RNA molecule or polynucleotide, the corresponding sequence of ribonucleotides (A, G, C and U) where each thymidine deoxynucleotide (T) in the specified deoxynucleotide sequence in is replaced by the ribonucleotide uridine (U).

The present invention is also directed to fragments of the isolated nucleic acid molecules described herein. By a fragment of an isolated DNA molecule having the polynucleotide sequences shown in of SEQ ID NO: 1-494, 496-820, 1641-1972, 3588-3592 is intended DNA fragments at least 15 nucleotides, and more preferably at least 20 nucleotides, still more preferably at least 30 nucleotides in length, which are useful as diagnostic probes and primers is discussed in more detail below. Of course larger nucleic acid fragments of up to the entire length of the nucleic acid molecules of the present invention are also useful diagnostically as probes, according to conventional hybridization techniques, or as primers for amplification of a target sequence by the polymerase chain reaction (PCR), as described, for instance, in Molecular Cloning, A Laboratory Manual, 3rd. edition, edited by Sambrook & Russel., (2001), Cold Spring Harbor Laboratory Press, the entire disclosure of which is hereby incorporated herein by reference. By a fragment at least 20 nucleotides in length, for example, is intended fragments which include 20 or more contiguous bases from the nucleotide sequence of the as shown in of SEQ ID NO: 1-494, 496-820, 1641-1972, 3588-3592. The nucleic acids containing the nucleotide sequences listed in of SEQ ID NO: 1-494, 496-820, 1641-1972, 3588-3592 can be generated using conventional methods of DNA synthesis which will be routine to the skilled artisan. For example, restriction endonuclease cleavage or shearing by sonication could easily be used to generate fragments of various sizes. Alternatively, the DNA fragments of the present invention could be generated synthetically according to known techniques.

In another aspect, the invention provides an isolated nucleic acid molecule comprising a polynucleotide which hybridizes under stringent hybridization conditions to a portion of the polynucleotide in a nucleic acid molecule of the invention described above. By a polynucleotide which hybridizes to a "portion" of a polynucleotide is intended a polynucleotide (either DNA or RNA) hybridizing to at least about 15 nucleotides, and more preferably at least about 20 nucleotides, and still more preferably at least about 30 nucleotides, and even more preferably more than 30 nucleotides of the reference polynucleotide. These fragments that hybridize to the reference fragments are useful as diagnostic probes and primers. A probe, as used herein is defined as at least about 100 contiguous bases of one of the nucleic acid sequences set forth in of SEQ ID NO: 1-494, 496-820, 1641-1972, 3588-3592. For the purpose of the invention, two sequences hybridize when they form a double-stranded complex in a hybridization solution of 6×SSC, 0.5% SDS, 5× Denhardt's solution and 100 µg of non-specific carrier DNA. See Ausubel et al., section 2.9, supplement 27 (1994). Sequences may hybridize at "moderate stringency," which is defined as a temperature of 60° C. in a hybridization solution of 6×SSC, 0.5% SDS, 5× Denhardt's solution and 100 µg of non-specific carrier DNA. For "high stringency" hybridization, the temperature is increased to 68° C. Following the moderate stringency hybridization reaction, the nucleotides are washed in a solution of 2×SSC plus 0.05% SDS for five times at room temperature, with subsequent washes with 0.1×SSC plus 0.1% SDS at 60° C. for 1 h. For high stringency, the wash temperature is increased to 68° C. For the purpose of the invention, hybridized nucleotides are those that are detected using 1 ng of a radiolabeled probe having a specific radioactivity of 10,000 cpm/ng, where the hybridized nucleotides are clearly visible following exposure to X-ray film at −70° C. for no more than 72 hours.

The present application is directed to such nucleic acid molecules which are at least 60%, 65%, 70%, 75%, 80%, 85%, 90%, 95%, 96%, 97%, 98%, 99% or 100% identical to a nucleic acid sequence described in of SEQ ID NO: 1-494, 496-820, 1641-1972, 3588-3592. Preferred, however, are nucleic acid molecules which are at least 95%, 96%, 97%, 98%, 99% or 100% identical to the nucleic acid sequence shown in of SEQ ID NO: 1-494, 496-820, 1641-1972, 3588-3592. Differences between two nucleic acid sequences may occur at the 5' or 3' terminal positions of the reference nucleotide sequence or anywhere between those terminal positions, interspersed either individually among nucleotides in the reference sequence or in one or more contiguous groups within the reference sequence.

As a practical matter, whether any particular nucleic acid molecule is at least 95%, 96%, 97%, 98% or 99% identical to a reference nucleotide sequence refers to a comparison made between two molecules using standard algorithms well known in the art and can be determined conventionally using publicly available computer programs such as the BLASTN algorithm. See Altschul et al., *Nucleic Acids Res.* 25:3389-3402 (1997).

Polynucleotides may be analyzed using the BLASTX algorithm, which compares the six-frame conceptual translation products of a nucleotide query sequence (both strands) against a protein sequence database. The similarity of polypeptide sequences may be examined using the BLASTP algorithm. The BLASTN, BLASTX and BLASTP programs are available from the National Center for Biotechnology Information (NCBI) National Library of Medicine, Building 38A, Room 8N805, Bethesda, Md. 20894, USA. The BLASTN algorithm Version 2.0.4 [Feb. 24, 1998] and Version 2.0.6 [Sep. 16, 1998], set to the default parameters described in the documentation and distributed with the algorithm, are preferred for use in the determination of polynucleotide variants according to the present invention. The BLASTP algorithm, is preferred for use in the determination of polypeptide variants according to the present invention. The computer algorithm FASTA is available from the University of Virginia by contacting David Hudson, Assistance Provost for Research, University of Virginia, PO Box 9025, Charlottesville, Va. Version 2.0u4 [February 1996], set to the default parameters described in the documentation and distributed with the algorithm, may be used in the determination of variants according to the present invention. The use of the FASTA algorithm is described in Pearson and Lipman, *Proc. Natl. Acad. Sci. USA* 85:2444-2448, 1988; and Pearson, *Methods in Enzymol.* 183:63-98, 1990.

The following running parameters are preferred for determination of alignments and similarities using BLASTN that contribute to the E values and percentage identity for polynucleotide sequences: Unix running command: blastall -p blastn -d embldb -e 10-G0-E0-r 1-v 30-b 30-i queryseq -o results; the parameters are: -p Program Name [String]; -d Database [String]; -e Expectation value (E) [Real]; -G Cost to open a gap (zero invokes default behavior) [Integer]; -E Cost to extend a gap (zero invokes default behavior) [Integer]; -r Reward for a nucleotide match (blastn only) [Integer]; -v Number of one-line descriptions (V) [Integer]; -b Number of alignments to show (B) [Integer]; -i Query File [File In]; and -o BLAST report Output File [File Out] Optional.

The following running parameters are preferred for determination of alignments and similarities using BLASTP that contribute to the E values and percentage identity of polypeptide sequences: blastall -p blastp -d swissprotdb -e 10-G 0-E 0-v 30-b 30-i queryseq -o results; wherein the parameters are: -p Program Name [String]; -d Database [String]; -e Expectation value (E) [Real]; -G Cost to open a gap (zero invokes default behavior) [Integer]; -E Cost to extend a gap (zero invokes default behavior) [Integer]; -v Number of one-line descriptions (v) [Integer]; -b Number of alignments to show (b) [Integer]; -I Query File [File In]; -o BLAST report Output File [File Out] Optional.

The "hits" to one or more database sequences by a queried sequence produced by BLASTN, FASTA, BLASTP or a similar algorithm, align and identify similar portions of sequences. The hits are arranged in order of the degree of similarity and the length of sequence overlap. Hits to a database sequence generally represent an overlap over only a fraction of the sequence length of the queried sequence.

The BLASTN, FASTA and BLASTP algorithms also produce "Expect" values for alignments. The Expect value (E) indicates the number of hits one can "expect" to see over a certain number of contiguous sequences by chance when searching a database of a certain size. The Expect value is used as a significance threshold for determining whether the hit to a database, such as the preferred EMBL database, indicates true similarity. For example, an E value of 0.1 assigned to a polynucleotide hit is interpreted as meaning that in a database of the size of the EMBL database, one might expect to see 0.1 matches over the aligned portion of the sequence with a similar score simply by chance. By this criterion, the aligned and matched portions of the polynucleotide sequences then have a probability of 90% of being the same. For sequences having an E value of 0.01 or less over aligned and matched portions, the probability of finding a match by chance in the EMBL database is 1% or less using the BLASTN or FASTA algorithm.

According to one embodiment, "variant" polynucleotides and polypeptides, with reference to each of the polynucleotides and polypeptides of the present invention, preferably comprise sequences having the same number or fewer nucleic or amino acids than each of the polynucleotides or polypeptides of the present invention and producing an E value of 0.01 or less when compared to the polynucleotide or polypeptide of the present invention. That is, a variant polynucleotide or polypeptide is any sequence that has at least a 99% probability of being the same as the polynucleotide or polypeptide of the present invention, measured as having an E value of 0.01 or less using the BLASTN, FASTA, or BLASTP algorithms set at parameters described above.

Alternatively, variant polynucleotides of the present invention hybridize to the polynucleotide sequences recited in of SEQ ID NO: 1-494, 496-820, 1641-1972, 3588-3592, or complements, reverse sequences, or reverse complements of those sequences, under stringent conditions.

The present invention also encompasses polynucleotides that differ from the disclosed sequences but that, as a consequence of the degeneracy of the genetic code, encode a polypeptide which is the same as that encoded by a polynucleotide of the present invention. Thus, polynucleotides comprising sequences that differ from the polynucleotide sequences recited in of SEQ ID NO: 1-494, 496-820, 1641-1972, 3588-3592; or complements, reverse sequences, or reverse complements thereof, as a result of conservative substitutions are contemplated by and encompassed within the present invention. Additionally, polynucleotides comprising sequences that differ from the polynucleotide sequences recited in of SEQ ID NO: 1-494, 496-820, 1641-1972, 3588-3592, or complements, reverse complements or reverse sequences thereof, as a result of deletions and/or insertions totaling less than 10% of the total sequence length are also contemplated by and encompassed within the present invention. Similarly, polypeptides comprising sequences that differ from the polypeptide sequences recited in of SEQ ID NO: 821-1640, 3593-3596, as a result of amino acid substitutions, insertions, and/or deletions totaling less than 10% of the total sequence length are contemplated by and encompassed within the present invention. In certain embodiments, variants of the inventive polypeptides possess biological activities that are the same or similar to those of the inventive polypeptides. Such variant polypeptides function as transcription factors and are thus capable of modifying gene expression in a plant. Similarly, variant polynucleotides may encode polypeptides that function as transcription factors.

In addition to having a specified percentage identity to an inventive polynucleotide or polypeptide sequence, variant polynucleotides and polypeptides preferably have additional structure and/or functional features in common with the inventive polynucleotide or polypeptide. Polypeptides having a specified degree of identity to a polypeptide of the present invention share a high degree of similarity in their primary structure and have substantially similar functional properties. In addition to sharing a high degree of similarity in their primary structure to polynucleotides of the present invention, polynucleotides having a specified degree of identity to, or capable of hybridizing to an inventive polynucleotide preferably have at least one of the following features: (i) they contain an open reading frame or partial open reading frame encoding a polypeptide having substantially the same functional properties as the polypeptide encoded by the inventive polynucleotide; or (ii) they have domains in common.

Promoters

The polynucleotides of the present invention can be used for specifically directing the expression of polypeptides or proteins in the tissues of plants. The nucleic acids of the present invention can also be used for specifically directing the expression of antisense RNA, or RNA involved in RNA interference (RNAi) such as small interfering RNA (siRNA), in the tissues of plants, which can be useful for inhibiting or completely blocking the expression of targeted genes. As used herein, vascular plant tissue refers to xylem, phloem or vascular cambium tissue. Preferably, the promoters of the invention are either "xylem-preferred," "cambium-preferred" or "phloem-preferred" and direct expression of an operably linked nucleic acid segment in the xylem, cambium or phloem, respectively. As used herein, "coding product" is intended to mean the ultimate product of the nucleic acid that is operably linked to the promoters. For example, a protein or polypeptide is a coding product, as well as antisense RNA or siRNA which is the ultimate product of the nucleic acid coding for the antisense RNA. The coding product may also be non-translated mRNA. The terms polypeptide and protein are used interchangeably herein. Xylem-preferred, for example, is intended to mean that the nucleic acid molecules of the current invention are more active in the xylem than in any other plant tissue. Most preferably, the nucleic acids of the current invention are promoters that are active specifically in the xylem, cambium or phloem, meaning that the promoters are only active in the xylem, cambium or phloem tissue of plants, respectively. In other words, a "xylem-specific" promoter, for example, drives the expression of a coding product such that detectable levels of the coding product are expressed only in xylem tissue of a plant. However, because of solute transport in plants, the coding product that is specifically expressed in the xylem, phloem or cambium may be found anywhere in the plant and thus its presence is not necessarily confined to xylem tissue. A vascular-preferred promoter, on the other hand can be preferentially active is any of the xylem, phloem or cambium tissues, or in at least two of the three tissue types. A vascular-specific promoter, is specifically active in any of the xylem, phloem or cambium, or in at least two of the three.

As used herein, promoter is intended to mean a nucleic acid, preferably DNA, that binds RNA polymerase and/or other transcription regulatory elements. As with any promoter, the promoters of the current invention will facilitate or control the transcription of DNA or RNA to generate an mRNA molecule from a nucleic acid molecule that is operably linked to the promoter. The RNA may code for a protein or polypeptide or may code for an RNA interfering, or antisense molecule. As used herein, "operably linked" is meant to refer to the chemical fusion, ligation, or synthesis of DNA such that a promoter-nucleic acid sequence combination is formed in a proper orientation for the nucleic acid sequence to be transcribed into an RNA segment. The promoters of the current invention may also contain some or all of the 5' untranslated region (5' UTR) of the resulting mRNA transcript. On the other hand, the promoters of the current invention do not necessarily need to possess any of the 5' UTR.

A promoter, as used herein, may also include regulatory elements. Conversely, a regulatory element may also be separate from a promoter. Regulatory elements confer a number of important characteristics upon a promoter region. Some elements bind transcription factors that enhance the rate of transcription of the operably linked nucleic acid. Other elements bind repressors that inhibit transcription activity. The effect of transcription factors on promoter activity may determine whether the promoter activity is high or low, i.e. whether the promoter is "strong" or "weak."

In a preferred embodiment the promoters described herein are selected from the group consisting of *Eucalyptus* CAD (Cinnamyl alcohol Dehydrogenase), *Eucalyptus* 4CL (4-coumaric acid: coenzyme A ligase), *Eucalyptus* SAD (Sinapyl Alcohol Dehydrogenase), *Eucalyptus* LIM, and Pine cellulose synthase.

In another embodiment, a constitutive promoter may be used for expressing the inventive polynucleotide sequences. Examples of constitutive plant promoters which may be useful for expressing the TF sequence include: the cauliflower mosaic virus (CaMV) 35S promoter, which confers constitutive, high-level expression in most plant tissues (Odel et al. *Nature* 313:810(1985)); the nopaline synthase promoter (An et al. *Plant Physiol.* 88:547 (1988)); and the octopine synthase promoter (Fromm et al., *Plant Cell* 1: 977 (1989)).

In another embodiment, a variety of inducible plant gene promoters can be used for expressing the inventive polynucleotide sequences. Inducible promoters regulate gene expression in response to environmental, hormonal, or chemical signals. Examples of hormone inducible promoters include auxin-inducible promoters (Baumann et al. *Plant Cell* 11:323-334(1999)), cytokinin-inducible promoter (Guevara-Garcia *Plant Mol. Biol.* 38:743-753(1998)), and gibberellin-responsive promoters (Shi et al. *Plant Mol. Biol.* 38:1053-1060(1998)). Additionally, promoters responsive to heat, light, wounding, pathogen resistance, and chemicals such as methyl jasmonate or salicylic acid, may be used for expressing the inventive polynucleotide sequences.

DNA Constructs

The present invention provides DNA constructs comprising the isolated nucleic acid molecules and polypeptide sequences of the present invention. In one embodiment, the DNA constructs of the present invention are Ti-plasmids derived from *A. tumefaciens*.

In developing the nucleic acid constructs of this invention, the various components of the construct or fragments thereof will normally be inserted into a convenient cloning vector, e.g., a plasmid that is capable of replication in a bacterial host, e.g., *E. coli*. Numerous vectors exist that have been described in the literature, many of which are commercially available. After each cloning, the cloning vector with the desired insert may be isolated and subjected to further manipulation, such as restriction digestion, insertion of new fragments or nucleotides, ligation, deletion, mutation, resection, etc. to tailor the components of the desired sequence. Once the construct has been completed, it may then be transferred to an appropriate vector for further manipulation in accordance with the manner of transformation of the host cell.

A recombinant DNA molecule of the invention typically includes a selectable marker so that transformed cells can be easily identified and selected from non-transformed cells. Examples of such markers include, but are not limited to, a neomycin phosphotransferase (nptII) gene (Potrykus et al., *Mol. Gen. Genet.* 199:183-188 (1985)), which confers kanamycin resistance. Cells expressing the nptII gene can be selected using an appropriate antibiotic such as kanamycin or G418. Other commonly used selectable markers include the bar gene, which confers bialaphos resistance; a mutant EPSP synthase gene (Hinchee et al., *Bio/Technology* 6:915-922 (1988)), which confers glyphosate resistance; and a mutant acetolactate synthase gene (ALS), which confers imidazolinone or sulphonylurea resistance (European Patent Application 154,204, 1985).

Additionally, vectors may include an origin of replication (replicons) for a particular host cell. Various prokaryotic replicons are known to those skilled in the art, and function to direct autonomous replication and maintenance of a recombinant molecule in a prokaryotic host cell.

In a preferred embodiment, the present invention utilizes the pWVR8 vector shown in FIG. 1.

In another embodiment, pART27 is suitable for use in the present invention. See Gleave, A. P. *Plant Mol. Biol,* 20:1203-1027 (1992).

The vectors will preferably contain selectable markers for selection in plant cells. Numerous selectable markers for use in selecting transfected plant cells including, but not limited to, kanamycin, glyphosate resistance genes, and tetracycline or ampicillin resistance for culturing in *E. coli, A. tumefaciens* and other bacteria.

For secretion of the translated protein into the lumen of the endoplasmic reticulum, the periplasmic space or into the extracellular environment, appropriate secretion signals may be incorporated into the expressed polypeptide. The signals may be endogenous to the polypeptide or they may be heterologous signals.

In one embodiment, a DNA construct of the current invention is designed in a manner such that a polynucleotide sequence described herein is operably linked to a tissue-specific promoter. Preferably, the polynucleotide encodes a polypeptide involved in cellulose or lignin biosynthesis in plants. Polynucleotides encoding many of the enzymes involved in lignin biosynthesis include, but are not limited to, cinnamyl alcohol dehydrogenase (CAD), cinnamate 4-hydroxylase (C4H), coumarate 3-hydroxylase (C3H), phenolase (PNL), O-methyl transferase (OMT), cinnamoyl-CoA reductase (CCR), phenylalanine ammonia-lyase (PAL), 4-coumarate: CoA ligase (4CL) and peroxidase (POX) from pine. U.S. Pat. No. 6,204,434. Other enzymes include coniferin β-glucosidase (CBG), and caffeic acid 3-O-methyltransferase (COMT). U.S. Pat. No. 5,451,514, WO 94/23044, and Dharmawardhana et al., *Plant Mol. Biol.* 40: 365-72 (1999).

In another embodiment, the coding sequence operably linked to the promoter may code for a gene product that inhibits the expression or activity of enzymes involved in lignin biosynthesis. For example, of particular interest for control of lignin biosynthesis is an antisense gene encoding a 4CL, CAD, Lim, TED2, or a COMT.

In a further embodiment, the DNA constructs of the current invention are designed such that the polynucleotide sequences of the current invention are operably linked to DNA or RNA that encodes antisense RNA or interfering RNA, which corresponds to genes that code for polypeptides of interest, resulting in a decreased expression of targeted gene products. Preferably the gene products targeted for suppression are enzymes involved in lignin biosynthesis. The use of RNAi inhibition of gene expression is described in U.S. Pat. No. 6,506,559, and the use of RNAi to inhibit gene expression in plants is specifically described in WO 99/61631, both of which are herein incorporated by reference.

The use of antisense technology to reduce or inhibit the expression of specific plant genes has been described, for example in European Patent Publication No. 271988. Reduction of gene expression led to a change in the phenotype of the plant, either at the level of gross visible phenotypic difference, for example a lack of lycopene synthesis in the fruit of tomato leading to the production of yellow rather than red fruit, or at a more subtle biochemical level, for example, a change in the amount of polygalacturonase and reduction in depolymerisation of pectins during tomato fruit ripening (Smith et. al., *Nature*, 334:724-726 (1988); Smith et. al., *Plant Mol. Biol.*, 14:369-379 (1990)). Thus, antisense RNA has been demonstrated to be useful in achieving reduction of gene expression in plants.

In one embodiment an inventive polynucleotide sequence is capable of being transcribed inside a plant to yield an antisense RNA transcript is introduced into the plant, e.g., into a plant cell. The inventive polynucleotide can be prepared, for example, by reversing the orientation of a gene sequence with respect to its promoter. Transcription of the exogenous DNA in the plant cell generates an intracellular RNA transcript that is "antisense" with respect to that gene.

The invention also provides host cells which comprise the DNA constructs of the current invention. As used herein, a host cell refers to the cell in which the coding product is ultimately expressed. Accordingly, a host cell can be an individual cell, a cell culture or cells as part of an organism. The host cell can also be a portion of an embryo, endosperm, sperm or egg cell, or a fertilized egg.

Accordingly, the present invention also provides plants or plant cells, comprising the DNA constructs of the current invention. Preferably the plants are angiosperms or gymnosperms. The expression construct of the present invention may be used to transform a variety of plants, both monocotyledonous (e.g. grasses, corn, grains, oat, wheat and barley), dicotyledonous (e.g., *Arabidopsis*, tobacco, legumes, alfalfa, oaks, eucalyptus, maple), and Gymnosperms (e.g., Scots pine; see Aronen, *Finnish Forest Res. Papers*, Vol. 595, 1996), white spruce (Ellis et al., *Biotechnology* 11:84-89, 1993), and larch (Huang et al., *In Vitro Cell* 27:201-207, 1991).

In a preferred embodiment, the inventive expression vectors are employed to transform woody plants, herein defined as a tree or shrub whose stem lives for a number of years and increases in diameter each year by the addition of woody tissue. Preferably the target plant is selected from the group consisting of eucalyptus and pine species, most preferably from the group consisting of *Eucalyptus grandis* and its hybrids, and *Pinus taeda*. Also preferred, the target plant is selected from the group consisting of *Pinus banksiana, Pinus brutia, Pinus caribaea, Pinus clausa, Pinus contorta, Pinus coulteri, Pinus echinata, Pinus eldarica, Pinus ellioti, Pinus jeffreyi, Pinus lambertiana, Pinus massoniana, Pinus monticola, Pinus nigra, Pinus palustrus, pinus pinaster, Pinus ponderosa, Pinus radiata, Pinus resinosa, Pinus rigida, Pinus serotina, Pinus strobus, Pinus sylvestris, Pinus taeda, Pinus virginiana, Abies amabilis, Abies balsamea, Abies concolor, Abies grandis, Abies lasiocarpa, Abies magnifica, Abies procera, Chamaecyparis lawsoniona, Chamaecyparis nootkatensis, Chamaecyparis thyoides, Juniperus virginiana, Larix decidua, Larix laricina, Larix leptolepis, Larix occidentalis, Larix siberica, Libocedrus decurrens, Picea abies, Picea engelmanni, Picea glauca, Picea mariana, Picea pungens, Picea rubens, Picea sitchensis, Pseudotsuga menziesii, Sequoia gigantea, Sequoia sempervirens, Taxodium distichum, Tsuga canadensis, Tsuga heterophylla, Tsuga mertensiana, Thuja occidentalis, Thuja plicata, Eucalyptus alba, Eucalyptus bancroftii, Eucalyptus botryoides, Eucalyptus bridgesiana, Eucalyptus calophylla, Eucalyptus camaldulensis, Eucalyptus citriodora, Eucalyptus cladocalyx, Eucalyptus coccifera, Eucalyptus curtisii, Eucalyptus dalrympleana, Eucalyptus deglupta, Eucalyptus delagatensis, Eucalyptus diversicolor, Eucalyptus dunnii, Eucalyptus ficifolia, Eucalyptus globulus, Eucalyptus gomphocephala, Eucalyptus gunnii, Eucalyptus henryi, Eucalyptus laevopinea, Eucalyptus macarthurii, Eucalyptus macrorhyncha, Eucalyptus maculata, Eucalyptus marginata, Eucalyptus megacarpa, Eucalyptus melliodora, Eucalyptus nicholii, Eucalyptus nitens, Eucalyptus nova-angelica, Eucalyptus obliqua, Eucalyptus occidentalis Eucalyptus obtusiflora, Eucalyptus oreades, Eucalyptus pauciflora, Eucalyptus polybractea, Eucalyptus regnans, Eucalyptus resinifera, Eucalyptus robusta, Eucalyptus rudis, Eucalyptus saligna, Eucalyptus sideroxylon, Eucalyptus stuartiana, Eucalyptus tereticornis, Eucalyptus torelliana, Eucalyptus urnigera, Eucalyptus urophylla, Eucalyptus viminalis, Eucalyptus viridis, Eucalyptus wandoo,* and *Eucalyptus youmanni.*

In particular, the transgenic plant may be of the species *Eucalyptus grandis* or its hybrids, *Pinus radiata, Pinus taeda* L (loblolly pine), *Populus nigra, Populus deltoides, Populus alba,* or *Populus* hybrids, *Acacia mangium,* or *Liquidamber styraciflua*. Beyond the ordinary meaning of plant, the term "plants" is also intended to mean the fruit, seeds, flower, strobilus etc. of the plant. The plant of the current invention may be a direct transfectant, meaning that the DNA construct was introduced directly into the plant, such as through *Agrobacterium,* or the plant may the progeny of a transfected plant. The second or subsequent generation plant may or may not be produced by sexual reproduction, i.e., fertilization. Furthermore, the plant can be a gametophyte (haploid stage) or a sporophyte (diploid stage).

In one embodiment, the present invention provides isolated polynucleotides encoding, or partially encoding, plant transcription factors that are involved in the regulation of gene expression. The polynucleotides of the present invention were isolated from *Eucalyptus grandis* and *Pinus radiata,* but may be isolated from any plant species or synthesized using conventional synthesis techniques.

In specific embodiments, isolated polynucleotides of the present invention comprise a sequence selected from the group consisting of sequences identified as SEQ ID NOS: 1-494, 496-820, 1641-1972, 3588-3592 complements of the sequences identified as SEQ ID NOS: 1-494, 496-820, 1641-1972, 3588-3592; reverse complements of the sequences identified as SEQ ID NOS: 1-494, 496-820, 1641-1972, 3588-3592, reverse sequences of the sequences identified as SEQ ID NOS: 1-494, 496-820, 1641-1972, 3588-3592; sequences comprising at least a specified number of contiguous residues (x-mers) of any of the above-mentioned polynucleotides; extended sequences corresponding to any of the above polynucleotides; antisense sequences corresponding to any of the above polynucleotides; and variants of any of the above polynucleotides, as that term is described in this specification.

In another aspect, the present invention provides isolated polypeptides encoded by the polynucleotides of SEQ ID NOS: 821-1640, 3593-3596.

*Eucalyptus grandis* and *Pinus radiata* cDNA expression libraries were prepared from mature shoot buds, early wood phloem, floral tissue, leaf tissue, feeder roots, structural roots, xylem or early wood xylem. cDNA sequence from positive clones containing inserts were obtained using methods known in the art. The determined cDNA sequences were compared with known sequences in the public databases (EMBL) using the computer algorithms FASTA and/or BLASTN. Multiple alignments of redundant sequences were used to build reliable consensus sequences. The determined cDNA sequences are provided in SEQ ID NOS: 1-494, 496-820, 1641-1972, 3588-3592. The predicted polypeptide sequences corresponding to the polynucleotide sequences of SEQ ID NOS: 1.820 are provided in SEQ ID NOS:821-1640, 3593-3596.

Based on similarity to known sequences from other plant species, the isolated polynucleotide sequences were identified as encoding transcription factors, as detailed in Tables 1 and 2. The polypeptide sequences were analyzed with publicly available annotation software. EMBL's publicly available "InterPro Scan" was used for identifying motifs and domains in the present polypeptide sequences. InterPro is a database of protein families, domains and functional sites in which identifiable features found in known proteins can be applied to unknown protein sequences. Mulder, N. J. et al. 2003, *Nucl Acid Res.* 31: 315-318.

As shown in Tables 1 and 2, the polynucleotides of the invention encode transcription factors. These transcription factors can up-regulate or down-regulate gene expression.

TABLE 1

Transcription Factors isolated from *E. grandis*

| Transcription Factor Family | Polynucleotide SEQ ID NO | Polypeptide SEQ ID NO |
|---|---|---|
| ABI3/VP1 | 1 | 821 |
| AP2-EREBP | 8-37, 1643-1653 | 828-838, 1975-1985 |
| ARF | 39-46, 1654-1656 | 860-861, 863-866, 1986-1988 |
| ARID | 48 | 868 |
| AUX/IAA | 49-60, 1657-1661 | 869-880, 1989-1993 |
| bHLH | 61-84, 1662-1673 | 881-884, 886-904, 929, 1994-2005 |
| bZIP | 85-109, 1674-1681 | 207-210, 212-213, 905-910, 912-916, 918, 920-928 |
| C2C2 (Co-like) | 112, 115, 121, 124-134, 1682-1687 | 932, 935, 941, 945, 947-950, 952-953, 2014, 2019 |
| C2C2 (Dof) | 110, 113-114, 116-123, 135-138, 1683-1684, 1686 | 930, 933-934, 937-940, 942-943, 955-957, 2015-2016, 2018 |
| C2C2 (GATA) | 139-144 | 959-964 |
| C2H2 (Zn) | 148-169, 1688-1696 | 968-989, 2020-2028 |
| C3H-type | 170-180, 1697-1703 | 990-1000, 2029-2035 |
| CCAAT DR1 | 185 | 1005 |
| CCAAT HAP2 | 183-184, 186-187, 1705, 1708, 1709 | 1003-1004, 1006-1007, 2037, 2040, 2041 |
| CCAAT HAP3 | 188, 1707 | 1008, 2039 |
| CCAAT HAP5 | 181-182, 1706 | 1001-1002, 2038 |
| CPP (Zn) | 189-190 | 1009-1010 |
| DRAP1 | 1710 | 2042 |
| E2F/DP | 191 | 1011 |
| EIL | 193-194 | 1013-1014 |
| GAI | 218 | 1038 |
| GARP | 195-213, 1711-1720 | 1016-1022, 1031-1033, 2044-2045, 2047, 2049-2052 |

TABLE 1-continued

Transcription Factors isolated from *E. grandis*

| Transcription Factor Family | Polynucleotide SEQ ID NO | Polypeptide SEQ ID NO |
|---|---|---|
| GRAS | 214-219, 1721-1732 | 1034-1036, 1038-1039, 2053-2064 |
| HMG-BOX | 220-229, 1733-1734 | 1040-1048, 2065-2066 |
| HOMEO BOX | 230-259, 1735-1746 | 1050-1052, 1054, 1056-1064, 1066-1079, 2067-2075, 2077-2078 |
| HSF | 260-267, 1747-1751 | 1080-1087, 2079-2083 |
| Jumonji | 268, 1752-1755 | 2084-2085, 2087 |
| LIM | 269-275 | 1089-1092, 1094-1095 |
| MADS Box (SEQ ID NO: 3668) | 276-305, 1756-1767 | 1096-1105, 1108-1123, 1125, 2088, 2090-2092, 2094-2095, 2098-2099 |
| MYB | 306-371, 701, 1768-1783 | 1126-1127, 1129, 1131-1144, 1146, 1148-1152, 1154, 1156-1160, 1162-1170, 1173-1176, 1178, 1180-1184, 1186-1187, 1189-1191, 1239, 2102, 2104-2108, 2110-2115, 2134, 3616-3626, 3650, 3656-3657 |
| NAC | 372-409, 1784-1796 | 1192-1195, 1197-1199, 1201-1217, 1219-1222, 1224-1229, 2116-2128, 3627-3628 |
| NIN-like | 410 | 1230 |
| RAV-like | 28, 411 | 848, 1231 |
| SBP | 52, 412-415, 1797-1800 | , 1232, 1234-1235, 2129-2132, 3593, 3629 |
| TCP | 416-418 | 1236-1238 |
| TUBBY | 421-427, 1804 | 1243-1247 |
| WRKY(SEQ ID NO: 3670) | 428-447, 1805-1809 | 1248-1267, 2137-2141 |

TABLE 2

Transcription Factors isolated from *P. radiata*

| Transcription Factor Family | Polynucleotide SEQ ID NO | Polypeptide SEQ ID NO |
|---|---|---|
| AB13/VP1 | 1810 | 2142 |
| Alfin-like | 448-455 | 1268-1275 |
| AP2-EREBP | 456-494, 1811-1823 | 1277-1278, 1280, 1282-1283, 1285-1292, 1294-1296, 1298-1303, 1306, 1309-1314, 2143-2155 |
| ARF | 496-498, 1824-1831 | 1317-1318, 2156-2163 |
| ARID | 625, 1832-1834 | 1445, 2164-2166 |
| AUX/IAA | 499-507, 600, 771, 1835-1836, 3590-3591 | 1319-1327, 1420a, 2167-2168, 3594, 3596 |
| bHLH | 508-522, 1837-1853 | 1328-1330, 1333-1334, 1338-1342, 2169-2171, 2173-2176, 2178-2185 |
| bZIP | 517, 523-535, 1854-1860 | 1344, 1346, 13481352, 1355, 2186-2191, 3631 |
| C2C2 (Co-like) | 536-547, 1861, 1864, 1866-1868 | 1356-1358, 1360-1362, 2193, 2196, 2198-2199 |
| C2C2 (Dof) | 548-553, 1862, 1865 | 1368-1373, 2194-2196, 2197 |
| C2C2 (GATA) | 554-558, 1863 | 1374-1378, 2195 |
| C2H2 (Zn) | 561-570, 1869-1877 | 1381-1390, 2201-2203, 2205-2209 |
| C3H-type | 571-585, 1878-1884 | 1391-1405, 2210, 2212-2216 |
| CCAAT DR1 | 586-587 | 1406-1407 |
| CCAAT | 586-592 | 1406-1412 |
| CCAAT HAP2 | 1886-1888 | 2218-2220 |
| CCAAT HAP3 | 688-590, 593-597 | 1408-1410, 1417 |
| CCAAT HAP5 | 592, 599-500 | 1412 |
| CPP (Zn) | 601, 1889 | 1421, 2221 |
| DRAP1 | 602 | 1422 |
| E2F/DP | 603, 1890-1892, 3592 | 1423, 2222-2224 |

TABLE 2-continued

Transcription Factors isolated from *P. radiata*

| Transcription Factor Family | Polynucleotide SEQ ID NO | Polypeptide SEQ ID NO |
|---|---|---|
| EIL | 1893-1894 | 2225-2226 |
| GARP | 604-617, 792, 1890, 1895-1901 | 1426-1429, 1432-1434, 1436-1437, 2228-2233, 3658-3659 |
| GRAS | 618-619, 1902-1906 | 1438-1439, 2234-2238 |
| HMG-BOX | 621-627, 1907 | 1441-1443, 1446, 2239, 3633 |
| HOMEO BOX | 628-654, 1908-1915 | 1448-1448, 1452, 1454-1455, 1457-1469, 1471-1474, 2240-2242, 2244, 2246-2247, 3635, 3644, 3660-3661 |
| HSF | 655-660, 1916-1917 | 1475-1480, 2248-2249 |
| Jumonji | 1918-1919 | 2250, 3607 |
| LFY | 661-662 | 1481, 1483-1484, 1486, 2252, 3636 |
| LIM | 666, 1920 | 1486, 2252 |
| MADS Box (SEQ ID NO: 3668) | 286, 299, 667-697, 1921-1924 | 1487-1517, 2255-2256, 3609, 3613 |
| MYB | 331, 698-751, 1925-1941 | 1151, 1518, 1520, 1522-1523, 1525-1526, 1529, 1532-1571, 2274-2279, 2288, 2294-2295, 3637-3643 |
| NAC | 752-775, 1942-1947 | 1572-1573, 1576-1582, 1584-1595, 2274-2279, 3644 |
| NIN-like | 776, 1948-1949 | 1596, 2281, 3664 |
| Polycomb-like | 777 | 3665 |
| RAV-like | 495, 778-779, 1950 | 1315, 1598-1599, 2282 |
| SBP | 780-786, 1951-1953 | 1601-1605, 2284, 3646, 3665-3666 |
| TCP | 787-790, 1954-1955 | 1607-1610, 2286-2287 |
| Trihelix | 793-804, 1956-1963 | 1613, 2289-2293 |
| TUBBY | 805-809, 1864-1965 | 1625-1629, 2296-2297 |
| WRKY(SEQ ID NO: 3670) | 810-820, 1966-1972, 3588-3592 | 1630-1640, 2298-2304, 3593-3666 |

Polypeptides encoded by the polynucleotides of the present invention may be expressed and used in various assays to determine their biological activity. Such polypeptides may be used to raise antibodies, to isolate corresponding interacting proteins or other compounds, and to quantitatively determine levels of interacting proteins or other compounds.

Plant Transformation and Regeneration

The present polynucleotides and polypeptides may be introduced into a host plant cell by standard procedures known in the art for introducing recombinant sequences into a target host cell. Such procedures include, but are not limited to, transfection, infection, transformation, natural uptake, electroporation, biolistics and *Agrobacterium*. Methods for introducing foreign genes into plants are known in the art and can be used to insert a construct of the invention into a plant host, including, biological and physical plant transformation protocols. See, for example, Miki et al., 1993, "Procedure for Introducing Foreign DNA Into Plants", In: Methods in Plant Molecular Biology and Biotechnology, Glick and Thompson, eds., CRC Press, Inc., Boca Raton, pages 67-88. The methods chosen vary with the host plant, and include chemical transfection methods such as calcium phosphate, microorganism-mediated gene transfer such as *Agrobacterium* (Horsch et al., Science 227:1229-31, 1985), electroporation, micro-injection, and biolistic bombardment.

Accordingly, the present invention also provides plants or plant cells, comprising the polynucleotides or polypeptides of the current invention. In one embodiment, the plants are angiosperms or gymnosperms. In another embodiment, the plants are selected from *Eucalyptus* and *Pinus* species. In particular, the transgenic plant may be of the species *Eucalyptus grandis* and hybrids, *Pinus radiata*, *Pinus taeda* L (loblolly pine), *Populus nigra*, *Populus deltoides*, or *Liquidamber styraciflua*. Beyond the ordinary meaning of plant, the term "plants" is also intended to mean the fruit, seeds, flower, strobilus etc. of the plant. The plant of the current invention may be a direct transfectant, meaning that the vector was introduced directly into the plant, such as through *Agrobacterium*, or the plant may be the progeny of a transfected plant. The progeny may also be obtained by asexual reproduction of a transfected plant. The second or subsequent generation plant may or may not be produced by sexual reproduction, i.e., fertilization. Furthermore, the plant can be a gametophyte (haploid stage) or a sporophyte (diploid stage).

Methods for transforming tree species are well known in the art. By no means limiting, explant refers to plant tissue that is a target for transformation and may include leaf, petiole, floral, and internodal tissues harvested from plants grown in vivo and/or in vitro. For example, a tree can be transformed as follows. For increased transformation efficiency, a tree explant can be harvested and cultured on a pre-culture medium before transformation. A pre-culture medium, as shown in Table 3, is a nutrient medium upon which plant explants are cultured before transformation with *Agrobacterium* and is needed for increasing transformation efficiency and plant regeneration. The pre-culture medium comprises an *Agrobacterium* inducer, such as acetosyringone. The pre-culture medium may optionally comprise plant growth regulators, including auxin and cytokinin. Alternatively, other pre-culture media and time periods of culture may be used.

TABLE 3

Plant Pre-Culture Medium

| Medium | Amount per Liter |
|---|---|
| WPM salts | 1 package (Sigma) |
| Ca(NO$_3$)$_2$•4H$_2$O | 3.7 g |
| MgSO$_4$•4H$_2$O | 0.37 g |
| Nicotinic Acid | 0.5 mg |
| Thiamine HCl | 0.5 mg |
| Pyridoxin HCl | 0.5 mg |
| D-Pantothenic Acid | 1.0 mg |
| Myo-inositol | 0.1 g |
| BA | 0.1-1 mg |
| Bacto-agar | 5-8 g |
| Acetosyringone | 5-200 mg |
| NAA | 0.2-3 mg |
| zeatin | 1-6 mg |

In the present invention, plant explants were pre-cultured for four days in the dark on the pre-culture medium displayed in Table 3. Woody Plant Medium (WPM) salts (Loyd and McCown, 1980) were used in the present pre-culture medium; however, other salt media, such as MS medium (Murashige and Skoog 1962) or Lepoivre medium, may be used. While the present pre-culture medium comprises acetosyringone, other *Agrobacterium* inducers may be used. Optionally, the instant pre-culture medium contained both auxin and cytokinin. Other pre-culture media and other culture time periods may be used.

Induced *Agrobacterium* culture was prepared by methods known in the art. The induced culture was dripped onto each explant by pipette. Sufficient *Agrobacterium* culture was dripped to ensure that all edges were covered with bacterial solution. Alternatively, the explants may be transformed by vacuum infiltration, floral dip, and other methods of *Agrobacterium*-mediated transformation. Following transformation, explants covered with *Agrobacterium* culture were placed in the dark for four days of co-cultivation. Alternatively, the explants may be co-cultivated with *Agrobacterium* under light conditions. Additionally, the explants may be co-cultivated with *Agrobacterium* under light or dark conditions for 2-10 days, preferably 4 days. Following co-cultivation, the explants were transferred to regeneration medium (Table 4) with 400 mg/l timentin. There is no need to wash explants. Explants were cultured on this medium for four days before transfer to a selection medium. In the present example, the selection medium is the regeneration medium supplemented with both timentin and an herbicide selection agent.

TABLE 4

Regeneration Medium

| Components for 1 Liter of Medium | Grams |
|---|---|
| KNO$_3$ | 1 |
| NH$_4$H$_2$PO$_4$ | 0.25 |
| MgSO$_4$•7H$_2$O | 0.25 |
| CaCl$_2$•2H$_2$O | 0.10 |
| FeSO$_4$•7H$_2$O | 0.0139 |
| Na$_2$EDTA•2H$_2$O | 0.01865 |
| MES (Duchefa m1501) | 600.0 |
| MS Micro (½ strength) | |
| MnSO$_4$•H$_2$O | 0.00845 |
| ZnSO$_4$•7H$_2$O | 0.0043 |

TABLE 4-continued

Regeneration Medium

| Components for 1 Liter of Medium | Grams |
|---|---|
| CuSO$_4$•5H$_2$O | 0.0000125 |
| CoCl$_2$•6H$_2$O | 0.0000125 |
| KI | 0.000415 |
| H$_3$BO$_3$ | 0.0031 |
| Na$_2$MoO$_4$•2H$_2$O | 0.000125 |
| Zeatin | |
| NAA (naphthalene acetic acid) | |
| Glucose/Sucrose | 20.0 |
| Myo-inositol | 0.100 |
| Nicotinic Acid | 0.010 |
| Thiamine | 0.010 |
| Ca Pantothenate | 0.001 |
| Pyridoxine | 0.001 |
| Biotin | 0.00001 |
| Ascorbic Acid | 0.050 |
| L-glutamine | 0.1 |
| Arginine | 0.0258 |
| Glycine | 0.00199 |
| Lysine | 0.0508 |
| Methionine | 0.0132 |
| Phenylalanine | 0.0257 |
| Serine | 0.00904 |
| Threonine | 0.00852 |
| Tryptophan | 0.0122 |
| Tyrosine | 0.0127 |
| Gelrite | 3.0 |

Shoot clumps that survive selection are maintained on regeneration medium containing herbicide and timentin, and they are transferred every 3 weeks until shoots proliferate and initially elongate. For transformation experiments with a reporter gene, such as GUS, leaf and stem tissues from the regenerated shoots are stained for GUS expression as soon as the shoots are developed. While any reporter gene may be used, such as GFP or luciferase, GUS expression was assayed in the present invention by methods known in the art.

GUS staining was performed to monitor the frequency of *Agrobacterium* infection and to ensure that the selected shoots are not escapes or chimeras. Leaf and stem tissues from the regenerated shoots were stained for GUS expression immediately upon shoot development. To determine GUS activity, the explants were incubated in a substrate comprising 100 mM phosphate buffer (pH 7.0), 0.05% dimethyl suphoxide, 0.05% Triton X-100, 10 mM EDTA, 0.5 mM potassium ferrocyanide, and 1.5 mg/ml 5-bromo-4-chloro-3-indolyl-β-D-glucuronide (X-gluc). The explants were subjected to 10 minutes of vacuum before an overnight incubation at 37° C. Following overnight incubation, GUS foci were counted.

Expression Profiling of Transcription Factor Polynucleotides

The present invention also provides methods and tools for performing expression profiling of transcription factor polynuecleotides. Expression profiling is useful in determining whether polynucleotides are transcribed or translated, comparing transcript levels for particular polynucleotide in different tissues, genotyping, estimating DNA copy number, determining identity of descent, measuring mRNA decay rates, identifying protein binding sites, determining subcellular localization of gene products, correlating polynucleotide expression to a phenotype or other phenomenon, and determining the effect on other polynucleotides of the manipulation of a particular gene. Expression profiling is particularly useful for identifying polynucleotide expression in complex, multigenic events. For this reason, expression profiling is useful in correlating polynuceotide expression to plant phenotype and formation of plant.

Only a small fraction of the genes of a plant's genome are expressed at a given time in a given tissue sample, and all of the expressed genes may not affect the plant phenotype. To identify polynucleotides capable of affecting a phenotype of interest, the present invention provides methods and tools for determining, for example, a polynucleotide expression profile at a given point in plant development and a gene expression profile a given tissue sample. The invention also provides methods and tools for identifying transcription factor polynucleotides whose expression can be manipulated to alter plant phenotype or to alter the biological activity of transcription factor transcription factor polynucleotides transcription and translation products. In support of these methods, the invention also provides methods and tools that distinguish expression of different polynucloetides of the same family.

As used herein, "polynucleotide expression," refers to the process of transcription of a DNA sequence into an RNA sequence, followed by translation of the RNA into a protein, which may or may not undergo post-translational processing. Thus, the relationship between phenotype and/or developmental stage and polynucleotide expression can be observed by detecting, quantitatively or qualitatively, changes in the level of an RNA or a protein. As used herein, the term "biological activity" includes, but is not limited to, the activity of a protein gene product, including enzyme activity.

The present invention provides oligonucleotides that are useful in these expression profiling methods. Each oligonucleotide is capable of hybridizing under a given set of conditions to a transcription factor polynucleotide or polynucleotide product. In one aspect of the invention, a plurality of oligonucleotides is provided, wherein each oligonucleotide hybridizes under a given set of conditions to a different cell cycle gene product. Examples of oligonucleotides of the present invention include SEQ ID NOs 2742-3587. Each of the oligos of SEQ ID Nos 2742-3587 hybridizes under standard conditions to a different gene product of one of SEQ ID NOs: 1-494, 496-820, and 1641-1972, 3588-3592. The oligonucleotides of the invention are useful in determining the expression of one or more cell cycle genes in any of the above-described methods.

1. Cell, Tissue, Nucleic Acid, and Protein Samples

Samples for use in methods of the present invention may be derived from plant tissue. Suitable plant tissues include, but are not limited to, somatic embryos, pollen, leaves, stems, calli, stolons, microtubers, shoots, xylem, male strolbili, pollen cones, vascular tissue, apical meristem, vascular cambium, xylem, root, flower, and seed.

According to the present invention "plant tissue" is used as described previously herein. Plant tissue can be obtained from any of the plants types or species described supra.

In accordance with one aspect of the invention, samples can be obtained from plant tissue at different developmental stages, from plant tissue at various times of the year (e.g. spring versus summer), from plant tissues subject to different environmental conditions (e.g. variations in light and temperature) and/or from different types of plant tissue and cells. In accordance with one embodiment, plant tissue is obtained during various stages of maturity and during different seasons of the year. For example, plant tissue can be collected from stem dividing cells, differentiating xylem, early developing wood cells, differentiated early wood cells, and differentiated late wood cells. As another example, polynucleotide expression in a sample obtained from a plant with developing wood can be compared to gene expression in a sample obtained from a plant which does not have developing wood.

Differentiating xylem includes samples obtained from compression wood, side-wood, and normal vertical xylem. Methods of obtaining samples for expression profiling from pine and eucalyptus are known. See, e.g., Allona et al., *Proc. Nat'l Acad. Sci.* 95:9693-8 (1998) and Whetton et al., *Plant Mol. Biol.* 47:275-91, and Kirst et al., INT'L UNION OF FORESTRY RESEARCH ORGANIZATIONS BIENNIAL CONFERENCE, S6.8 (June 2003, Umea, Sweden).

In one embodiment of the invention, polynucleotide expression in one type of tissue is compared to polynucleotide expression in a different type of tissue or to polynucleotide expression in the same type of tissue in a difference stage of development. Polynucleotide expression can also be compared in one type of tissue which is sampled at various times during the year (different seasons). For example, polynucleotide expression in juvenile secondary xylem can be compared to polynucleotide expression in mature secondary xylem. Similarly, polynucleotide expression in cambium can be compared to polynucleotide expression in xylem. Furthermore, gene expression in apical meristems can be compared to gene expression in cambium.

In another embodiment of the invention, a sample is obtained from a plant having a specific phenotype and polynucleotide expression in that sample is compared to a sample obtained from a plant of the same species that does not have that phenotype. For example, a sample can be obtained from a plant exhibiting a fast rate of growth and gene expression can be compared with that of a sample obtained from a plant exhibiting a normal or slow rate of growth. Differentially expressed polunucleotides identified from such a comparison can be correlated with growth rate and, therefore, useful for manipulating growth rate.

In a further embodiment, a sample is obtained from clonally propagated plants. In one embodiment the clonally propagated plants are of the species *Pinus* or *Eucalyptus*. Individual ramets from the same genotype can be sacrificed at different times of year. Thus, for any genotype there can be at least two genetically identical trees sacrificed, early in the season and late in the season. Each of these trees can be divided into juvenile (top) to mature (bottom) samples. Further, tissue samples can be divided into, for example, phloem to xylem, in at least 5 layers of peeling. Each of these samples can be evaluated for phenotype and polynucleotide expression.

Where cellular components may interfere with an analytical technique, such as a hybridization assay, enzyme assay, a ligand binding assay, or a biological activity assay, it may be desirable to isolate the polynucleotide expression products from such cellular components. Polynucleotide expression products, including nucleic acid and amino acid gene products, can be isolated from cell fragments or lysates by any method known in the art.

Nucleic acids used in accordance with the invention can be prepared by any available method or process, or by other processes as they become known in the art. Conventional techniques for isolating nucleic acids are detailed, for example, in Tijssen, LABORATORY TECHNIQUES IN BIOCHEMISTRY AND MOLECULAR BIOLOGY: HYBRIDIZATION WITH NUCLEIC ACID PROBES, chapter 3 (Elsevier Press, 1993), Berger and Kimmel, *Methods Enzymol.* 152:1 (1987), and GIBCO BRL & LIFE TECHNOLOGIES TRIZOL RNA ISOLATION PROTOCOL, Form No. 3786 (2000). Techniques for preparing nucleic acid samples, and sequencing polynucleotides from pine and eucalyptus are known. See, e.g., Allona et al., supra and Whetton et. al., supra, and U.S. Application No. 60/476,222.

A suitable nucleic acid sample can contain any type of nucleic acid derived from the transcript of a transcription factor gene or polypeptide, i.e., RNA or a subsequence thereof or a nucleic acid for which an mRNA transcribed from a transcription factor gene served as a template. Suitable nucleic acids include cDNA reverse-transcribed from a transcript, RNA transcribed from that cDNA, DNA amplified from the cDNA, and RNA transcribed from the amplified DNA. Detection of such products or derived products is indicative of the presence and/or abundance of the transcript in the sample. Thus, suitable samples include, but are not limited to, transcripts of a gene or a polynucleotide, cDNA reverse-transcribed from the transcript, cRNA transcribed from the cDNA, DNA amplified from the genes, and RNA transcribed from amplified DNA. As used herein, the category of "transcripts" includes but is not limited to pre-mRNA nascent transcripts, transcript processing intermediates, and mature mRNAs and degradation products thereof.

It is not necessary to monitor all types of transcripts to practice the invention. For example, the expression profiling methods of the invention can be conducted by detecting only one type of transcript, such as mature mRNA levels only.

In one aspect of the invention, a chromosomal DNA or cDNA library (comprising, for example, fluorescently labeled cDNA synthesized from total cell mRNA) is prepared for use in hybridization methods according to recognized methods in the art. See Sambrook et al., supra.

In another aspect of the invention, mRNA is amplified using, e.g., the MessageAmp kit (Ambion). In a further aspect, the mRNA is labeled with a detectable label. For example, mRNA can be labeled with a fluorescent chromophore, such as CyDye (Amersham Biosciences).

In some applications, it may be desirable to inhibit or destroy RNase that often is present in homogenates or lysates, before use in hybridization techniques. Methods of inhibiting or destroying nucleases are well known. In one embodiment of the invention, cells or tissues are homogenized in the presence of chaotropic agents to inhibit nuclease. In another embodiment, RNase is inhibited or destroyed by heat treatment, followed by proteinase treatment.

Protein samples can be obtained by any means known in the art. Protein samples useful in the methods of the invention include crude cell lysates and crude tissue homogenates. Alternatively, protein samples can be purified. Various methods of protein purification well known in the art can be found in Marshak et al., STRATEGIES FOR PROTEIN PURIFICATION AND CHARACTERIZATION: A LABORATORY COURSE MANUAL (Cold Spring Harbor Laboratory Press 1996).

2. Detecting Level of Polynucleotide Expression

For methods of the invention that comprise detecting a level of polynucleotide expression, any method for observing polynucleotide expression can be used, without limitation. Such methods include traditional nucleic acid hybridization techniques, polymerase chain reaction (PCR) based methods, and protein determination. The invention includes detection methods that use solid support-based assay formats as well as those that use solution-based assay formats.

Absolute measurements of the expression levels need not be made, although they can be made. The invention includes methods comprising comparisons of differences in expression levels between samples. Comparison of expression levels can be done visually or manually, or can be automated and done by a machine, using for example optical detection means. Subrahmanyam et al., Blood. 97: 2457 (2001); Prashar et al., Methods Enzymol. 303: 258 (1999). Hardware and software for analyzing differential expression of genes are available, and can be used in practicing the present invention. See, e.g., GenStat Software and GeneExpress® GX Explorer™ Training Manual, supra; Baxevanis & Francis-Ouellette, supra.

In accordance with one embodiment of the invention, nucleic acid hybridization techniques are used to observe polynucleotide expression. Exemplary hybridization techniques include Northern blotting, Southern blotting, solution hybridization, and S1 nuclease protection assays.

Nucleic acid hybridization typically involves contacting an oligonucleotide probe and a sample comprising nucleic acids under conditions where the probe can form stable hybrid duplexes with its complementary nucleic acid through complementary base pairing. For example, see PCT application WO 99/32660; Berger & Kimmel, Methods Enzymol. 152: 1 (1987). The nucleic acids that do not form hybrid duplexes are then washed away leaving the hybridized nucleic acids to be detected, typically through detection of an attached detectable label. The detectable label can be present on the probe, or on the nucleic acid sample. In one embodiment, the nucleic acids of the sample are detectably labeled polynucleotides representing the mRNA transcripts present in a plant tissue (e.g., a cDNA library). Detectable labels are commonly radioactive or fluorescent labels, but any label capable of detection can be used. Labels can be incorporated by several approached described, for instance, in WO 99/32660, supra. In one aspect RNA can be amplified using the MessageAmp kit (Ambion) with the addition of aminoallyl-UTP as well as free UTP. The aminoallyl groups incorporated into the amplified RNA can be reacted with a fluorescent chromophore, such as CyDye (Amersham Biosciences)

Duplexes of nucleic acids are destabilized by increasing the temperature or decreasing the salt concentration of the buffer containing the nucleic acids. Under low stringency conditions (e.g., low temperature and/or high salt) hybrid duplexes (e.g., DNA:DNA, RNA:RNA or RNA:DNA) will form even where the annealed sequences are not perfectly complementary. Thus, specificity of hybridization is reduced at lower stringency. Conversely, at higher stringency (e.g., higher temperature and/or lower salt and/or in the presence of destabilizing reagents) hybridization tolerates fewer mismatches.

Typically, stringent conditions for short probes (e.g., 10 to 50 nucleotide bases) will be those in which the salt concentration is at least about 0.01 to 1.0 M at pH 7.0 to 8.3 and the temperature is at least about 30° C. Stringent conditions can also be achieved with the addition of destabilizing agents such as formamide.

Under some circumstances, it can be desirable to perform hybridization at conditions of low stringency, e.g., 6×SSPE-T (0.9 M NaCl, 60 mM $NaH_2PO_4$, pH 7.6, 6 mM EDTA, 0.005% Triton) at 37° C., to ensure hybridization. Subsequent washes can then be performed at higher stringency (e.g., 1×SSPE-T at 37° C.) to eliminate mismatched hybrid duplexes. Successive washes can be performed at increasingly higher stringency (e.g., down to as low as 0.25×SSPE-T at 37° C. to 50° C.) until a desired level of hybridization specificity is obtained.

In general, standard conditions for hybridization is a compromise between stringency (hybridization specificity) and signal intensity. Thus, in one embodiment of the invention, the hybridized nucleic acids are washed at successively higher stringency conditions and read between each wash. Analysis of the data sets produced in this manner will reveal a wash stringency above which the hybridization pattern is not appreciably altered and which provides adequate signal for the particular oligonucleotide probes of interest. For example, the final wash may be selected as that of the highest stringency that produces consistent results and that provides a signal intensity greater than approximately 10% of the background intensity.

a. Oligonucleotide Probes

Oligonucleotide probes useful in nucleic acid hybridization techniques employed in the present invention are capable of binding to a nucleic acid of complementary sequence through one or more types of chemical bonds, usually through complementary base pairing via hydrogen bond formation. A probe can include natural bases (i.e., A, G, U, C or T) or modified bases (7-deazaguanosine, inosine, etc.). In addition, the nucleotide bases in the probes can be joined by a linkage other than a phosphodiester bond, so long as it does not interfere with hybridization. Thus, probes can be peptide nucleic acids in which the constituent bases are joined by peptide bonds rather than phosphodiester linkages.

Oligonucleotide probes can be prepared by any means known in the art. Probes useful in the present invention are capable of hybridizing to a nucleotide product of cell cycle genes, such as one of SEQ ID NOs: 1-235 and 698-717. Probes useful in the invention can be generated using the nucleotide sequences disclosed in SEQ ID NOs: 1-235 and 698-717. The invention includes oligonucleotide probes having at least a 2, 10, 15, 20, 30, 35, 40, 45, 50, 55, 60, 65, 70, 75, 80, 85, or 100 nucleotide fragment of a corresponding contiguous sequence of any one of SEQ ID NOs: 1-235 and 698-717. The invention includes oligonucleotides of less than 2, 1, 0.5, 0.1, or 0.05 kb in length. In one embodiment, the oligonucleotide is 60 nucleotides in length.

Oligonucleotide probes can be designed by any means known in the art. See, e.g., Li and Stormo, *Bioinformatics* 17: 1067-76 (2001). Oligonucleotide probe design can be effected using software. Exemplary software includes Array-Designer, GeneScan, and ProbeSelect. Probes complementary to a defined nucleic acid sequence can be synthesized chemically, generated from longer nucleotides using restriction enzymes, or can be obtained using techniques such as polymerase chain reaction (PCR). PCR methods are well known and are described, for example, in Innis et al. eds., PCR PROTOCOLS: A GUIDE TO METHODS AND APPLICATIONS, Academic Press Inc. San Diego, Calif. (1990). The probes can be labeled, for example, with a radioactive, biotinylated, or fluorescent tag. Optimally, the nucleic acids in the sample are labeled and the probes are not labeled. Oligonucleotide probes generated by the above methods can be used in solution or solid support-based methods.

The invention includes oligonucleotide probes that hybridize to a product of the coding region or a 3' untranslated region (3' UTR) of a transcription factor polynucleotide. In one embodiment, the oligonucleotide probe hybridizes to the 3'UTR of any one of SEQ ID Nos 1-494, 496-820, 1641-1972, 3588-3592. The 3' UTR is generally a unique region of the gene, even among members of the same family. Therefore, the probes capable of hybridizing to a product of the 3' UTR can be useful for differentiating the expression of individual genes within a family where the coding region of the genes likely are highly homologous. This allows for the design of oligonucleotide probes to be used as members of a plurality of oligonucleotides, each capable of uniquely binding to a single gene. In another embodiment, the oligonucleotide probe comprises any one of SEQ ID NOs: 2742-3587. In another embodiment, the oligonucleotide probe consists of any one of SEQ ID NOs: 2742-3587.

b. Oligonucleotide Array Methods

One embodiment of the invention employs two or more oligonucleotide probes in combination to detect a level of expression of one or more transcription factor polynucleotides, such as the genes of SEQ ID NOs: 1-494, 496-820, 1641-1972, 3588-3592. In one aspect of this embodiment, the level of expression of two or more different polynucleotide is detected. The two or more polynucleotide may be from the same or different transcription factor gene families discussed above. Each of the two or more oligonucleotides may hybridize to a different one of the polynucleotides.

One embodiment of the invention employs two or more oligonucleotide probes, each of which specifically hybridize to a polynucleotide derived from the transcript of a polynucleotide provided by SEQ ID NOs: 1-494, 496-820, 1641-1972, 3588-3592. Another embodiment employs two or more oligonucleotide probes, at least one of which comprises a nucleic acid sequence of SEQ ID NOs: 1973-2304, 3593-3666. Another embodiment employs two or more oligonucleotide probes, at least one of which consists of of SEQ ID Nos 1973-2304, 3593-3666.

The oligonucleotide probes may comprise from about 5 to about 60, or from about 5 to about 500, nucleotide bases, such as from about 60 to about 100 nucleotide bases, including from about 15 to about 60 nucleotide bases.

One embodiment of the invention uses solid support-based oligonucleotide hybridization methods to detect gene expression. Solid support-based methods suitable for practicing the present invention are widely known and are described, for example, in PCT application WO 95/11755; Huber et al., *Anal. Biochem.* 299: 24 (2001); Meiyanto et al., *Biotechniques.* 31: 406 (2001); Relogio et al., *Nucleic Acids Res.* 30:e51 (2002). Any solid surface to which oligonucleotides can be bound, covalently or non-covalently, can be used. Such solid supports include filters, polyvinyl chloride dishes, silicon or glass based chips, etc.

One embodiment uses oligonucleotide arrays, i.e. microarrays, which can be used to simultaneously observe the expression of a number of polynucleotides, genes or gene products. Oligonucleotide arrays comprise two or more oligonucleotide probes provided on a solid support, wherein each probe occupies a unique location on the support. The location of each probe may be predetermined, such that detection of a detectable signal at a given location is indicative of hybridization to an oligonucleotide probe of a known identity. Each predetermined location can contain more than one molecule of a probe, but each molecule within the predetermined location has an identical sequence. Such predetermined locations are termed features. There can be, for example, from 2, 10, 100, 1,000, 2,000 or 5,000 or more of such features on a single solid support. In one embodiment, each oligonucleotide is located at a unique position on an array at least 2, at least 3, at least 4, at least 5, at least 6, or at least 10 times.

Oligonucleotide probe arrays for detecting gene expression can be made and used according to conventional techniques described, for example, in Lockhart et al., *Nat'l Biotech.* 14: 1675 (1996), McGall et al., *Proc. Nat'l Acad. Sci. USA* 93: 13555 (1996), and Hughes et al., *Nature Biotechnol.* 19:342 (2001). A variety of oligonucleotide array designs is suitable for the practice of this invention.

In one embodiment the one or more oligonucleotides include a plurality of oligonucleotides that each hybridize to a different polynucleotide expressed in a particular tissue type. For example, the tissue can be developing wood.

In one embodiment, a nucleic acid sample obtained from a plant can be amplified and, optionally labeled with a detectable label. Any method of nucleic acid amplification and any detectable label suitable for such purpose can be used. For example, amplification reactions can be performed using, e.g. Ambion's MessageAmp, which creates "antisense" RNA or "aRNA" (complementary in nucleic acid sequence to the RNA extracted from the sample tissue). The RNA can optionally be labeled using CyDye fluorescent labels. During the amplification step, aaUTP is incorporated into the resulting aRNA. The CyDye fluorescent labels are coupled to the aaUTPs in a non-enzymatic reaction. Subsequent to the amplification and labeling steps, labeled amplified antisense RNAs are precipitated and washed with appropriate buffer, and then assayed for purity. For example, purity can be assay using a NanoDrop spectrophotometer. The nucleic acid sample is then contacted with an oligonucleotide array having, attached to a solid substrate (a "microarray slide"), oligonucleotide sample probes capable of hybridizing to nucleic acids of interest which may be present in the sample. The step of contacting is performed under conditions where hybridization can occur between the nucleic acids of interest and the oligonucleotide probes present on the array. The array is then washed to remove non-specifically bound nucleic acids and the signals from the labeled molecules that remain hybridized to oligonucleotide probes on the solid substrate are detected. The step of detection can be accomplished using any method appropriate to the type of label used. For example, the step of detecting can accomplished using a laser scanner and detector. For example, on can use and Axon scanner which optionally uses GenePix Pro software to analyze the position of the signal on the microarray slide.

Data from one or more microarray slides can analyzed by any appropriate method known in the art.

Oligonucleotide probes used in the methods of the present invention, including microarray techniques, can be generated using PCR. PCR primers used in generating the probes are chosen, for example, based on the sequences of SEQ ID NOs: 1-494, 496-820, 1641-1972, 3588-3592, to result in amplification of unique fragments of the transcription factor polynucleotides (i.e., fragments that hybridize to only one polynucleotide of any one of SEQ ID NOs: 1-494, 496-820, 1641-1972, 3588-3592 under standard hybridization conditions). Computer programs are useful in the design of primers with the required specificity and optimal hybridization properties. For example, Li and Stormo, supra at 1075, discuss a method of probe selection using ProbeSelect which selects an optimum oligonucleotide probe based on the entire gene sequence as well as other gene sequences to be probed at the same time.

In one embodiment, oligonucleotide control probes also are used. Exemplary control probes can fall into at least one of three categories referred to herein as (1) normalization controls, (2) expression level controls and (3) negative controls. In microarray methods, one or more of these control probes may be provided on the array with the inventive transcription factor-related oligonucleotides.

Normalization controls correct for dye biases, tissue biases, dust, slide irregularities, malformed slide spots, etc. Normalization controls are oligonucleotide or other nucleic acid probes that are complementary to labeled reference oligonucleotides or other nucleic acid sequences that are added to the nucleic acid sample to be screened. The signals obtained from the normalization controls, after hybridization, provide a control for variations in hybridization conditions, label intensity, reading efficiency and other factors that can cause the signal of a perfect hybridization to vary between arrays. In one embodiment, signals (e.g., fluorescence intensity or radioactivity) read from all other probes used in the method are divided by the signal from the control probes, thereby normalizing the measurements.

Virtually any probe can serve as a normalization control. Hybridization efficiency varies, however, with base composition and probe length. Preferred normalization probes are selected to reflect the average length of the other probes being used, but they also can be selected to cover a range of lengths. Further, the normalization control(s) can be selected to reflect the average base composition of the other probes being used. In one embodiment, only one or a few normalization probes are used, and they are selected such that they hybridize well (i.e., without forming secondary structures) and do not match any test probes. In one embodiment, the normalization controls are mammalian genes.

Expression level controls probes hybridize specifically with constitutively expressed genes present in the biological sample. Virtually any constitutively expressed gene provides a suitable target for expression level control probes. Typically, expression level control probes have sequences complementary to subsequences of constitutively expressed "housekeeping genes" including, but not limited to certain photosynthesis genes.

"Negative control" probes are not complementary to any of the test oligonucleotides (i.e., the inventive transcpriton factor-related oligonucleotides), normalization controls, or expression controls. In one embodiment, the negative control is a mammalian gene which is not complementary to any other sequence in the sample.

The terms "background" and "background signal intensity" refer to hybridization signals resulting from non-specific binding or other interactions between the labeled target nucleic acids (i.e., mRNA present in the biological sample) and components of the oligonucleotide array. Background signals also can be produced by intrinsic fluorescence of the array components themselves.

A single background signal can be calculated for the entire array, or a different background signal can be calculated for each target nucleic acid. In a one embodiment, background is calculated as the average hybridization signal intensity for the lowest 5 to 10 percent of the oligonucleotide probes being used, or, where a different background signal is calculated for each target gene, for the lowest 5 to 10 percent of the probes for each gene. Where the oligonucleotide probes corresponding to a particular cell cycle gene hybridize well and, hence, appear to bind specifically to a target sequence, they should not be used in a background signal calculation. Alternatively, background can be calculated as the average hybridization signal intensity produced by hybridization to probes that are not complementary to any sequence found in the sample (e.g., probes directed to nucleic acids of the opposite sense or to genes not found in the sample). In microarray methods, background can be calculated as the average signal intensity produced by regions of the array that lack any oligonucleotides probes at all.

c. PCR-Based Methods

In another embodiment, PCR-based methods are used to detect polynucleotide expression. These methods include reverse-transcriptase-mediated polymerase chain reaction (RT-PCR) including real-time and endpoint quantitative reverse-transcriptase-mediated polymerase chain reaction (Q-RTPCR). These methods are well known in the art. For example, methods of quantitative PCR can be carried out using kits and methods that are commercially available from, for example, Applied BioSystems and Stratagene®. See also Kochanowski, QUANTITATIVE PCR PROTOCOLS (Humana Press, 1999); Innis et al., supra.; Vandesompele et al., *Genome Biol.* 3: RESEARCH0034 (2002); Stein, *Cell Mol. Life Sci.* 59: 1235 (2002).

Polynucleotide expression can also be observed in solution using Q-RTPCR. Q-RTPCR relies on detection of a fluorescent signal produced proportionally during amplification of a PCR product. See Innis et al., supra. Like the traditional PCR method, this technique employs PCR oligonucleotide primers, typically 15-30 bases long, that hybridize to opposite strands and regions flanking the DNA region of interest. Additionally, a probe (e.g., TaqMan®, Applied Biosystems) is designed to hybridize to the target sequence between the forward and reverse primers traditionally used in the PCR technique. The probe is labeled at the 5' end with a reporter fluorophore, such as 6-carboxyfluorescein (6-FAM) and a quencher fluorophore like 6-carboxy-tetramethyl-rhodamine (TAMRA). As long as the probe is intact, fluorescent energy transfer occurs which results in the absorbance of the fluorescence emission of the reporter fluorophore by the quenching fluorophore. As Taq polymerase extends the primer, however, the intrinsic 5' to 3' nuclease activity of Taq degrades the probe, releasing the reporter fluorophore. The increase in the fluorescence signal detected during the amplification cycle is proportional to the amount of product generated in each cycle.

The forward and reverse amplification primers and internal hybridization probe is designed to hybridize specifically and uniquely with one nucleotide derived from the transcript of a target gene. In one embodiment, the selection criteria for primer and probe sequences incorporates constraints regarding nucleotide content and size to accommodate TaqMan® requirements.

SYBR Green® can be used as a probe-less Q-RTPCR alternative to the Taqman®-type assay, discussed above. ABI PRISM® 7900 SEQUENCE DETECTION SYSTEM USER GUIDE APPLIED BIOSYSTEMS, chap. 1-8, App. A-F. (2002).

A device measures changes in fluorescence emission intensity during PCR amplification. The measurement is done in "real time," that is, as the amplification product accumulates in the reaction. Other methods can be used to measure changes in fluorescence resulting from probe digestion. For example, fluorescence polarization can distinguish between large and small molecules based on molecular tumbling (see U.S. Pat. No. 5,593,867).

d. Protein Detection Methods

Proteins can be observed by any means known in the art, including immunological methods, enzyme assays and protein array/proteomics techniques.

Measurement of the translational state can be performed according to several protein methods. For example, whole genome monitoring of protein—the "proteome"—can be carried out by constructing a microarray in which binding sites comprise immobilized, preferably monoclonal, antibodies specific to a plurality of proteins having an amino acid sequence of any of SEQ ID Nos: 821-1640, 1973-2304, 3593-3666, or proteins encoded by the polynucleotides of SEQ ID NOs: 1-494, 496-820, 1641-1972, 3588-3592 or conservative variants thereof. See Wildt et al., *Nature Biotechnol.* 18: 989 (2000). Methods for making polyclonal and monoclonal antibodies are well known, as described, for instance, in Harlow & Lane, ANTIBODIES: A LABORATORY MANUAL (Cold Spring Harbor Laboratory Press, 1988).

Alternatively, proteins can be separated by two-dimensional gel electrophoresis systems. Two-dimensional gel electrophoresis is well-known in the art and typically involves isoelectric focusing along a first dimension followed by SDS-PAGE electrophoresis along a second dimension. See, e.g., Hames et al, GEL ELECTROPHORESIS OF PROTEINS: A PRACTICAL APPROACH (IRL Press, 1990). The resulting electropherograms can be analyzed by numerous techniques, including mass spectrometric techniques, western blotting and immunoblot analysis using polyclonal and monoclonal antibodies, and internal and N-terminal micro-sequencing.

3. Correlating Transcription Factor Polynucleotide Expression to Phenotype and Tissue Development As discussed above, the invention provides methods and tools to correlate transcription factor polynucleotide expression to plant phenotype. Transcription factor polynucleotide expression may be examined in a plant having a phenotype of interest and compared to a plant that does not have the phenotype or has a different phenotype. Such a phenotype includes, but is not limited to, increased drought tolerance, herbicide resistance, reduced or increased height, reduced or increased branching, enhanced cold and frost tolerance, improved vigor, enhanced color, enhanced health and nutritional characteristics, improved storage, enhanced yield, enhanced salt tolerance, enhanced resistance of the wood to decay, enhanced resistance to fungal diseases, altered attractiveness to insect pests, enhanced heavy metal tolerance, increased disease tolerance, increased insect tolerance, increased water-stress tolerance, enhanced sweetness, improved texture, decreased phosphate content, increased germination, increased micronutrient uptake, improved starch composition, improved flower longevity, production of novel resins, and production of novel proteins or peptides.

In another embodiment, the phenotype includes one or more of the following traits: propensity to form reaction wood, a reduced period of juvenility, an increased period of juvenility, self-abscising branches, accelerated reproductive development or delayed reproductive development.

In a further embodiment, the phenotype that is differs in the plants compares includes one or more of the following: lignin quality, lignin structure, wood composition, wood appearance, wood density, wood strength, wood stiffness, cellulose polymerization, fiber dimensions, lumen size, other plant components, plant cell division, plant cell development, number of cells per unit area, cell size, cell shape, cell wall composition, rate of wood formation, aesthetic appearance of wood, formation of stem defects, average microfibril angle, width of the S2 cell wall layer, rate of growth, rate of root formation ratio of root to branch vegetative development, leaf area index, and leaf shape.

Phenotype can be assessed by any suitable means as discussed above.

In a further embodiment, polynucleotide expression can be correlated to a given point in the cell cycle, a given point in plant development, and in a given tissue sample. Plant tissue can be examined at different stages of the cell cycle, from plant tissue at different developmental stages, from plant tissue at various times of the year (e.g. spring versus summer), from plant tissues subject to different environmental conditions (e.g. variations in light and temperature) and/or from different types of plant tissue and cells. In accordance with one embodiment, plant tissue is obtained during various stages of maturity and during different seasons of the year. For example, plant tissue can be collected from stem dividing cells, differentiating xylem, early developing wood cells, differentiated spring wood cells, differentiated summer wood cells.

It will be apparent to those skilled in the art that various modifications and variations can be made in the methods and compositions of the present invention without departing from the spirit or scope of the invention. Thus, it is intended that the present invention cover the modifications and variations of this invention provided they come within the scope of the appended claims and their equivalents.

The following examples are given to illustrate the present invention. It should be understood, however, that the invention is not to be limited to the specific conditions or details described in these examples. Throughout the specification, any and all references to a publicly available document, including a U.S. patent, are specifically incorporated by reference in their entirety.

EXAMPLE 1

Isolation and Characterization of cDNA Clones from Eucalyptus grandis

Eucalyptus grandis cDNA expression libraries were prepared from mature shoot buds, early wood phloem, floral tissue, leaf tissue (two independent libraries), feeder roots, structural roots, xylem or early wood xylem and were constructed and screened as follows.

Total RNA was extracted from the plant tissue using the protocol of Chang et al. (*Plant Molecular Biology Reporter* 11: 113-116 (1993). mRNA was isolated from the total RNA preparation using either a Poly(A) Quik mRNA Isolation Kit (Stratagene, La Jolla, Calif.) or Dynal Beads Oligo $(dT)_{25}$ (SEQ ID NO: 3675) (Dynal, Skogen, Norway). A cDNA expression library was constructed from the purified mRNA by reverse transcriptase synthesis followed by insertion of the resulting cDNA clones in Lambda ZAP using a ZAP Express cDNA Synthesis Kit (Stratagene), according to the manufacturer's protocol. The resulting cDNAs were packaged using a Gigapack II Packaging Extract (Stratagene) using an aliquot (1-5 αl) from the 5 µl ligation reaction dependent upon the library. Mass excision of the library was done using XL1-Blue MRF' cells and XLOLR cells (Stratagene) with ExAssist helper phage (Stratagene). The excised phagemids were diluted with NZY broth (Gibco BRL, Gaithersburg, Md.) and plated out onto LB-kanamycin agar plates containing X-gal and isopropylthio-beta-galactoside (IPTG).

Of the colonies plated and selected for DNA miniprep, 99% contained an insert suitable for sequencing. Positive colonies were cultured in NZY broth with kanamycin and cDNA was purified by means of alkaline lysis and polyethylene glycol (PEG) precipitation. Agarose gel at 1% was used to screen sequencing templates for chromosomal contamination. Dye primer sequences were prepared using a Turbo Catalyst 800 machine (Perkin Elmer/Applied Biosystems Division, Foster City, Calif.) according to the manufacturer's protocol.

DNA sequence for positive clones was obtained using a Perkin Elmer/Applied Biosystems Division Prism 377 sequencer. cDNA clones were sequenced first from the 5' end and, in some cases, also from the 3' end. For some clones, internal sequence was obtained using either Exonuclease III deletion analysis, yielding a library of differentially sized subclones in pBK-CMV, or by direct sequencing using gene-specific primers designed to identified regions of the gene of interest.

The determined cDNA sequences were compared with known sequences in the EMBL database using the computer algorithms FASTA and/or BLASTN. Multiple alignments of redundant sequences were used to build reliable consensus sequences. The determined cDNA sequences are provided in SEQ ID NOS: 1-494, 496-820, 1641-1972, 3588-3592. Based on similarity to known sequences from other plant species, the isolated polynucleotide sequences were identified as encoding transcription factors, as detailed in Tables 1 and 2. The predicted polypeptide sequences corresponding to the polynucleotide sequences of SEQ ID NOS: 1-820 are provided in SEQ ID NOS: 821-1640, 3593-3596.

EXAMPLE 2

Isolation and Characterization of cDNA Clones from *Pinus radiata*

*Pinus radiata* cDNA expression libraries (prepared from either shoot bud tissue, suspension cultured cells, early wood phloem (two independent libraries), fascicle meristem tissue, male strobilus, root (unknown lineage), feeder roots, structural roots, female strobilus, cone primordia, female receptive cones and xylem (two independent libraries) were constructed and screened as described above in Example 1.

DNA sequence for positive clones was obtained using forward and reverse primers on a Perkin Elmer/Applied Biosystems Division Prism 377 sequencer and the determined sequences were compared to known sequences in the database as described above.

Based on similarity to known sequences from other plant species, the isolated polynucleotide sequences were identified as encoding transcription factors as displayed above in Table 1. The predicted polypeptide sequences corresponding to the polynucleotide sequences of SEQ ID NOS: 1-494, 496-820, 1641-1972, 3588-3592 are provided in SEQ ID NOS: 821-1640, 3593-3596.

EXAMPLE 3

5' RACE Isolation

To identify additional sequence 5' or 3' of a partial cDNA sequence in a cDNA library, 5' and 3' rapid amplification of cDNA ends (RACE) was performed. using the SMART RACE cDNA amplification kit (Clontech Laboratories, Palo Alto, Calif.). Generally, the method entailed first isolating poly(A) mRNA, performing first and second strand cDNA synthesis to generate double stranded cDNA, blunting cDNA ends, and then ligating of the SMART RACE. Adaptor to the cDNA to form a library of adaptor-ligated ds cDNA. Gene-specific primers were designed to be used along with adaptor specific primers for both 5' and 3' RACE reactions. Using 5' and 3' RACE reactions, 5' and 3' $$ RACE fragments were obtained, sequenced, and cloned. The process may be repeated until 5' and 3' ends of the full-length gene were identified. A full-length cDNA may generated by PCR using primers specific to 5' and 3' ends of the gene by end-to-end PCR.

For example, to amplify the missing 5' region of a gene from first-strand cDNA, a primer was designed 5'→3' from the opposite strand of the template sequence, and from the region between ~100-200 bp of the template sequence. A successful amplification should give an overlap of ~100 bp of DNA sequence between the 5' end of the template and PCR product.

RNA was extracted from four pine tissues, namely seedling, xylem, phloem and structural root using the Concert Reagent Protocol (Invitrogen, Carlsbad, Calif.) and standard isolation and extraction procedures. The resulting RNA was then treated with DNase, using 10 U/ul DNase I (Roche Diagnostics, Basel, Switzerland). For 100 µg of RNA, 9 µl 10× DNase buffer (Invitrogen, Carlsbad, Calif.), 10 µl of Roche DNase I and 90 µl of Rnase-free water was used. The RNA was then incubated at room temperature for 15 minutes and 1/10 volume 25 mM EDTA is added. A RNeasy mini kit (Qiagen, Venlo, The Netherlands) was used for RNA clean up according to manufacturer's protocol.

To synthesize cDNA, the extracted RNA from xylem, phloem, seedling and root was used and the SMART RACE cDNA amplification kit (Clontech Laboratories Inc, Palo Alto, Calif.) was followed according to manufacturer's protocol. For the RACE PCR, the cDNA from the four tissue types was combined. The master mix for PCR was created by combining equal volumes of cDNA from xylem, phloem, root and seedling tissues. PCR reactions were performed in 96 well PCR plates, with 1 µl of primer from primer dilution plate (10 mM) to corresponding well positions. 49 µl of master mix is aliquoted into the PCR plate with primers. Thermal cycling commenced on a GeneAmp 9700 (Applied Biosystems, Foster City, Calif.) at the following parameters:

94° C. (5 sec),
72° C. (3 min), 5 cycles;
94° C. (5 sec),
70° C. (10 sec),
72° C. (3 min), 5 cycles;
94° C. (5 sec),
68° C. (10 sec),
72° C. (3 min), 25 cycles.

cDNA was separated on an agarose gel following standard procedures. Gel fragments were excised and eluted from the gel by using the Qiagen 96-well Gel Elution kit, following the manufacturer's instructions.

PCR products were ligated into pGEMTeasy (Promega, Madison, Wis.) in a 96 well plate overnight according to the following specifications: 60-80 ng of DNA, 5 µl 2× rapid ligation buffer, 0.5 µl pGEMT easy vector, 0.1 µl DNA ligase, filled to 10 µl with water, and incubated overnight.

Each clone was transformed into *E. coli* following standard procedures and DNA was extracted from 12 clones picked by following standard protocols. DNA extraction and the DNA quality was verified on an 1% agarose gel. The presence of the correct size insert in each of the clones was determined by restriction digests, using the restriction endonuclease EcoRI, and gel electrophoresis, following standard laboratory procedures.

EXAMPLE 4

Isolation of Vascular-Preferred or Vascular-Specific Promoters

*Pinus radiata* and *Eucalyptus grandis* cDNA libraries were constructed and screened as described above in Examples 1 and 2. Vascular-preferred or vascular-specific promoters were cloned using a "Genome Walker" kit (Clontech, Palo Alto, Calif.). This is a PCR-based method, which requires four PCR primers to be constructed, two of which must be gene-specific. The gene specific primers are designed generally within the 5' UTR of the gene. The fragment is amplified and then cloned into a T-tailed vector in front of a reporter gene. U.S. application Ser. No. 10/703,091 describes the identification and isolation of vascular-preferred promoters.

EXAMPLE 5

Methodology to Determine the Tissue Specificity of a Promoter

Following the identification and cloning of a promoter by the procedure outlined above, the promoter is operably linked with a reporter gene to determine those tissue types in which the promoter is active. To this end, a construct containing the promoter first is transformed into *Agrobacterium tumefaciens* by electroporation. Briefly, 40 µl of diluted AgL-1 competent cells are placed on ice and are contacted with about 10 ng of pART27 vector containing the promoter sequence. Electroporation is conducted at the following parameters:

Resistance=129 ohm
Charging voltage=1.44 kV
Field strength=14.4 kV/cm
Pulse duration=5.0 ms Following electroporation, 400 µl of YEP liquid media is added and the cells are allowed to recover for one hour at room temperature. Cells then are centrifuged at 6000 rpm for 3 min and are resuspended in ~50 µl YEP. Cell samples are spread over the surface of a YEP Kan50/Rif50 plate, sealed with parafilm, and incubated at 29° C. for 2 days for colony growth.

Wild type *Arabidopsis thaliana* cv. 'Columbia-0' plants are then transformed with *Agrobacterium* containing constructs of interest by floral dip infiltration. Briefly, *Agrobacterium* cultures are centrifuged at ~8600 rcf for 10 min at 20° C. and are resuspended to an optical density of ~0.7-0.8. Plants are dipped into an infiltration solution containing the *Agrobacterium* for 5 sec. Plants are drained of excess solution and placed under grow lights in ambient conditions. After 24 hrs, the plants are misted and maintained for seed production. $T_1$ seeds are surface sterilized in 5% commercial bleach solution and plated on MS media containing Kanamycin (50 mg/l) and Timentin (250 mg/l) to select for putative transformants.

Successfully transformed plants are then assayed for the expression of the operably linked reporter gene. Leaf, stem, root and floral regions are immersed in a staining solution (50 mM $NaPO_4$, pH 7.2, 0.5% Triton X-100, 1 mM X-Glucuronide, cycloheximide salt (Ducheffa). A vacuum is applied twice for 5 min to infiltrate the tissue with the staining solution. The tissue is then left shaking overnight at 37° C. for color development. Tissues are checked at three or four timepoints to check stain development, and if samples show early development, a piece of tissue is destained in 70% ethanol. This tissue is then examined for GUS expression using a light microscope and photographed.

EXAMPLE 6

Isolation and Culture of *Zinnia elegans* Mesophyll Cells in Tracheary Element (TE) Inducing (FKH) and Non-Inducing (FK) Medium Primary and secondary pair leaves from the *Zinnia* seedlings were harvested from 8 punnets. Leaves were sterilized in 500 ml of 0.175% sodium hypochlorite solution for 10 minutes. Leaves were then rinsed twice in 500 ml of sterile water. Using 20-30 leaves at a time, leaves were ground in mortar and pestle and 25-30 ml of FK medium. Cells were filtered through the 40 µm nylon mesh. A total of 90 ml of mesophyll cells were obtained in this fashion. Cells were pelleted by centrifuging at 200×g for 2 minutes at 20° C. The pellet was washed once more using equal volume of FK medium. Then the pellet was split in to two equal halves and one half was washed in 45 ml of FK medium and the other in 45 ml of FKH medium. The pellets were re-suspended in 60 ml of FK medium and 60 ml of FKH medium, respectively. They were cultured in the dark in two 6-well plates on the rotary shaker set at 120 rpm.

EXAMPLE 7

Isolation of *Zinnia elegans* Protoplasts from Leaves or Mesophyll Cells Cultured Overnight to Three Days in FK Medium and FKH Medium Sterile *Zinnia elegans* primary leaves (6-8 in number) were cut in slivers of 1 mm and placed in 15 ml of cell wall digesting enzyme mix (1% Cellulase Onozuka R-10 and 0.2% pectolyase Y23 in Protoplast isolation buffer). Mesophyll cells cultured in FK medium (40 ml) or FKH medium (40 ml) were pelleted by centrifuging at 200×g for 2 minutes at 20° C. Each pellet was re-suspended in 20 ml of sterile Protoplast isolation buffer containing 200 mg Cellulase Onozuka R-10 and 40 mg Pectolyase Y23. The protoplasts were isolated by incubating the cell suspensions in CellStar culture plates for 2-4 hours on a rotary shaker set at ~70 rpm at 23° C. Protoplasts were pelleted by centrifuging the contents of the plates at 200×g for 2 minutes. Each of the pellets was re-suspended in 20 ml of 24% sucrose solution.

EXAMPLE 8

Transfection of *Zinnia elegans* Protoplasts

*Zinnia protoplasts* in 24% sucrose solution were overlaid with 1 ml of W5 solution and centrifuged at 70×g for 10 minutes at 20° C. with brakes off. Floating protoplasts were harvested and resuspended in 10 ml of W5 solution. Protoplasts were pelleted by centrifuging at 70×g for 10 minutes at 20° C. Protoplasts were resuspended in MaMg medium (density=~5×10$^6$ protoplasts/ml) and aliquoted into individual 15 ml tubes (300 µl: 1.5×10$^6$ protoplasts). 5 µg DNA (of each construct) and 50 µg Salmon Testes DNA was added to the protoplast suspension, mixed and incubated for 5 minutes at 20° C. 300 µl 40% PEG solution was added to each aliquot of protoplasts, mixed and incubated for 20 minutes at 20° C. 5 ml of K3/0.4M sucrose was added to each aliquot of leaf-derived transfected protoplasts or transfected protoplasts from mesophyll cells cultured in FK medium and mixed. Similarly, 5 ml of K3/0.4M sucrose+0.1 ppm NAA+0.2 ppm BA was added to each aliquot of transfected protoplasts from mesophyll cells cultured in FKH medium and mixed. The transfected protoplast suspensions were incubated overnight at 23° C. in the dark.

EXAMPLE 9

Harvesting of Transfected *Zinnia elegans* Protoplasts and Reporter Gene Analysis Transfected *Zinnia protoplast* suspensions, prepared as described above, were individually harvested by adding 9.5 ml of W5 solution, mixing the contents of each tube and centrifuging at 70×g for 10 minutes at 20° C. The bulk of the supernatant was removed by decanting and the protoplasts volume was brought up to 900 µl. From this, 300 µL of protoplasts were aliquoted into 5 ml polystyrene round-bottom tubes, re-suspended in a volume of 500 µl W5 medium and set aside for analysis of fluorescent reporter gene expression and cell viability. The protoplasts and the remaining solution were transferred to individual microtubes and pelleted by centrifugation at 420×g for 2 minutes at 20° C. The protoplast pellet was assayed for GUS reporter gene expression as described by Jefferson, R. A., 1987, *Plant Mol. Biol. Rep.* 5, 387. GUS (MUG) assays were performed using a Wallac (Turku, Finland) Victor$^2$ 1420 Multilabel Counter. Umbelliferone was detected using a 355 nm excitation filter and a 460 nm emission filter for 1 second.

EXAMPLE 10

Cell Based Assay Screening of Transcription Factors

Cell-based assays are used for screening the function of promoters and transcription factors from the Pine and *Eucalyptus* databases. The assays are used to identify transcription factors that are active during tracheary differentiation and lignification by determining whether a promoter responds to trans-acting factors in plant cells that are either induced in tracheary element (TE) forming cells (endogenous factors) and/or introduced by transformation (transient assay after introduction of plasmid DNA into the cells). The assay comprises the isolation of *Zinnia elegans* mesophyll cells and their culture either in TE-inducing or maintenance medium. See Examples 6-9. Control promoterless constructs or constructs comprising promoters that are active during TE formation (linked to reporter genes) are introduced into the cells or protoplasts prepared from the cells. As described above in Example 8, the transfected protoplasts are harvested by centrifugation and assayed for viability and transgene expression. To correct for experimental variation that may arise from differences in transfection, the protoplasts are co-transfected with a transfection marker, which is also detected by flow cytometry. This system uses fluorescence analysis technologies to capture the data and informatics software to analyze the results. In this way the impact of an introduced gene or gene product can be monitored. Transcriptional repression or activation of a vascular-preferred Pine or *Eucalyptus* promoter can be attributed to the candidate transcription factor gene and may be used to support sequence data.

Four color flow cytometry can also be used in the TE assay. The pine ubiquitin promoter is consitutively expressed at a high level in plants, therefore pine ubquitin expressing DsRedExpress can be used as the co-transfection marker in the cell-based assay system. In *Zinnia* protoplasts, high level of expression of the pine ubiquitin promoter is also found. Pine ubiquitin::DsRedExpress can be used as a co-transfection marker for transfections that involve the two-color (green and red) TE assay.

To correlate a transcription factor with transcriptional regulation of a wood quality trait, a cell-based assay is performed in two steps. First, the transcription factor is tested for activity in combination with promoters individually fused to a fluorescent reporter gene. The promoters used include *Eucalyptus* COMT (306 bp), *Eucalyptus* Homeobox 8 (691 bp), Pine Ubiquitin (2 kb+Intron), *Eucalyptus* 4CL, *Eucalyptus* CAD, *Eucalyptus* The *Eucalyptus* COMT and Homeobox 8 promoters are vascular-specific, whereas the Pine Ubiquitin promoter (described in U.S. Pat. No. 6,380,459 B1) is a constitutive promoter. A transcription factor that generates a "hit" (e.g. upregulated transcription or downregulated transcription) against one of these two promoters will be screened further.

A transcription factor that either activates or represses transcription from one of the above-mentioned promoters will be used for screening vascular specific activity of other candidate vascular specific or vascular preferred promoters. Table 5 lists some candidate vascular-specific promoters that can be used with the inventive transcription factors. (those skilled in the art will recognize that any vascular-preferred promoters may be suitable for use in this assay).

TABLE 5

Vascular-Specific Promoters

| Promoter | Size (bp) | Function | Expression |
|---|---|---|---|
| Eucalyptus SAD Sinapyl Alcohol Dehydrogenase | 784 | Syringyl lignin production | Vascular-specific activity, expressed in leaf and stem veins |
| Eucalyptus 4CL 4-coumaric acid:coenzyme A ligase 4 | 1400 | Enzymatic role in phenylpropanoid metabolism | Expression correlates with lignification and formation of TE |
| Eucalyptus CAD Cinnamyl alcohol dehydrogenase | 894 | Key enzyme in lignin biosynthesis | Vascular specific promoter expression in stem, root and leaf tissue. |
| Eucalyptus TED2 Quinone oxidoreductase | 970 | Conversion of oxygen to hydroxyl groups | Vascular specific promoter |
| Eucalyptus Lim | 898 | Transcription Factor: Regulates transcription of lignin biosynthesis genes | Vascular specific promoter |
| Pine Cellulose synthase | 674 | Cellulose synthesis | Vascular specific promoter |

EXAMPLE 11

Transcriptional Repression of Pine Ubiquitin Promoter by an Ethylene Response Element/AP2 from *Pinus radiata*

The pFOR293 vector contains a gene encoding a protein similar to the Ethylene Response Element/AP2 class of proteins, SEQ ID NO: 474, which was isolated from a cDNA library made from developing *Pinus radiata* xylem fibers. As described in Example 10 above, transcription factor pFOR293 was assayed for the ability to either activate or repress transcription from the Pine Ubiquitin (2 kb+Intron) promoter.

Element/AP2 transcription factor in its multiple cloning site, while the vectors pFOR147 and pFOR263 contain a positive control transcription factor. The protoplasts were also transfected with a second plasmid containing the gene encoding green fluorescence protein (EGFP) driven by the *P. radiata* Ubiquitin promoter or deletion fragments of the promoter.

Control protoplasts were transfected with a plasmid vector, pART9, a modified version of pART7, containing the EGFP gene in its multiple cloning site but with the CaMV 35S promoter removed from the expression cartridge. Accordingly, pART9 is a promoterless construct which does not express any gene and is used as a control because of its similarity in length and composition to pFOR vectors.

Table 6 below shows the mean fluorescence intensity (MFI) of EGFP from *Zinnia elegans* protoplasts transfected with constructs harboring: (i) the Pine Ubiquitin promoter fused to EGFP (Clontech) and (ii) a selection of tree Transcription Factors. In this screen a positive control for transcriptional activation was used (pFOOR147) and a negative control construct was used (pART9 referred to as "No Transcription Factor").

TABLE 6

| Construct | Mean Fluorescence Intensity (MFI) |
|---|---|
| No Fluorescence Protein | 0 |
| No Transcription Factor (negative control) | 80 |
| PFOR147 (positive control) | 130 |
| PFOR 293 | 38 |

EXAMPLE 12

Transcriptional Repression of *Eucalyptus* COMT Promoter by an Ethylene Response Element/AP2 from *Pinus radiata*

Following the protocols described above, the *P. radiata* transcription factor pFOR293 was tested for its ability to activate the *E. grandis* COMT promoter, a vascular-preferred promoter. Table 7 shows the mean fluorescence intensity (MFI) of EGFP from *Zinnia elegans* protoplasts transfected Annotated Amino Acid Sequence for pFOR293 (SEQ ID NO: 3676)
MCAEVSQSAMAVHTMQMARMEMKREIGVCEQEASSAVKETHFRGVRKRPWGRFA
AEIRDPLKKTRVWLGTFDTAEEAARAYDNAARNLRGAKAKTNFGPSPLHDGKPLFN
NGFSAQKRDSLRRPGLCPKQEPGVPVLPSPDVQASTCVNIGNLSPNPAVEKQTVSNK
KPMVLFGTHLSVSPRNLLLQQQQKEEICRSQGRRQAPLWLDLNLPPVANDLELLI EAR motif Following the protocols described above, the *P. radiata* transcription factor construct pFOR293 was tested for its ability to activate the Pine Ubiquitin promoter. Specifically, *Z. elegans* protoplasts were co-transfected with two of three disparate constructs. Test protoplasts were transfected with the effector construct, pFOR293, a positive control, pFOR263 or pFOR147, or a negative control, pART9. Constructs of the pFOR series are based on the primary cloning vector pART7, which has an expression cartridge comprised of the CaMV 35S promoter, a multiple cloning site, and the transcriptional termination region of the octopine synthase gene (Gleave, *Plant Mol. Biol.* 20:1203-1207, (1992)). The vector pFOR293 contains the *P. radiata* Ethylene Response with constructs harbouring: (i) the *Eucalyptus* COMT promoter fused to EGFP (Clontech) and (ii) a selection of tree TFs.

TABLE 7

| Construct | Mean Fluorescence Intensity (MFI) |
|---|---|
| No Transcription Factor (negative control) | 20 |
| PFOR263 (positive control) | 45 |
| PFOR293 | 15 |

Due to the low level of COMT promoter activity, repression is more clearly visualised by determining the percentage cells express a co-transfection marker and a reporter gene. Table 8 below presents the results of Zinnia elegans protoplasts that were transfected with constructs harboring: (i) the COMT promoter fused to EGFP (Clontech) and (ii) a selection of tree TFs.

TABLE 8

| Construct | Percentage of cells expressing co-transfection marker and reporter gene |
|---|---|
| No Transcription Factor (negative control) | 10% |
| PFOR263 (positive control) | 70% |
| PFOR293 | 2% |

EXAMPLE 13

Transcriptional Repression of Eucalyptus Homeobox8 Promoter by an Ethylene Response Element/AP2 from Pinus radiata As described in the above examples, the P. radiata transcription factor pFOR293 was assayed for its ability to activate the E. grandis Homeobox8 promoter. Table 9 below shows the mean fluorescence intensity (MFI) of EGFP from Zinnia elegans protoplasts transfected with constructs harbouring: (i) the Eucalyptus Homeobox 8 promoter fused to EGFP (Clontech) and (ii) a selection of tree TFs. In this screen a positive control for transcriptional activation was used (pFOR263) and a negative control construct was used ("No Transcription Factor").

TABLE 9

| Construct | Mean Fluorescence Intensity (MFI) |
|---|---|
| No Transcription Factor (negative control) | 18 |
| PFOR263 (positive control) | 32 |
| PFOR293 | 16 |

Due to the low level of Homeobox 8 promoter activity, repression is more clearly visualised by determining the percentage cells expressing a co-transfection marker and a reporter gene. Table 10 below shows Zinnia elegans protoplasts transfected with constructs harbouring: (i) the Eucalyptus Homeobox 8 promoter fused to EGFP (Clontech) and (ii) a selection of tree TFs.

TABLE 10

| Construct | Percentage of cells expressing co-transfection marker and reporter gene |
|---|---|
| No Transcription Factor (negative control) | 15% |
| PFOR263 (positive control) | 45% |
| PFOR293 | 5% |

EXAMPLE 14

Transcriptional Activators and Repressors Isolated from E. grandis and P. radiata As described in Examples 1 and 2, transcription factors are isolated and identified from E. grandis and P. radiata cDNA libraries. Following isolation, a transcription factor is cloned in a DNA construct having a promoter operably linked to a reporter gene, wherein the transcription factor regulates the activity of the promoter-reporter gene fusion. While any promoter can be used, this example uses vascular-preferred promoters. Based on the expression level of a reporter gene, a transcription factor can be identified as a transcriptional activator or repressor, relative to a wild-type construct that does not contain a transcription factor sequence. A transcriptional activator causes an increase in reporter gene expression, relative to a wild-type construct. A transcriptional repressor causes a decrease in reporter gene expression, relative to a wild-type construct. Tables 11-12 displays transcription factors having transcriptional activity with a specific promoter. Transcriptional activity is quantified as a value between one and five, wherein a value of five represents an upward maximum of transcriptional activity. Repression is quantified as a value between negative one and negative five, wherein a value of negative five represents an upward maximum of transcriptional activity.

TABLE 11

| | | E. grandis Transcriptional Activity | | | | | | |
|---|---|---|---|---|---|---|---|---|
| SEQ ID NO: | ConsID Eucalyptus spp | Eg COMT 306 bp | Eg HB8 | Pine Ubq | Eg 4cl (EHUB001320) | Eg CAD 894 bp (EGXC017379) | Eg SAD (EGBA013771) | Eg CesA (EGXA017831) | Pr PAL476 bp (PRWN013157) |
| 1649 | _022379 | 2 | 3 | 2 | | | | | |
| 424 | _009742 | 0 | 1 | 0 | | | | | |
| 205 | _007283 | 0 | −1 | 2 | | | | | |
| 208 | _028451 | 2 | 0 | 3 | | | | | |
| 227 | _004569 | 0 | −2 | −2 | | | | | |
| 169 | _040897 | 0 | 3 | 1 | | | | | |
| 157 | _031783 | 0 | 0 | 2 | | | | | |
| 135 | _031737 | −2 | 2 | −2 | | | | | |
| 65 | _002338 | 0 | 2 | 0 | | | | | |
| 417 | _006935 | 3 | 2 | | | | | | |
| 413 | _008476 | 0 | 0 | 0 | 0 | | 2 | 0 | 0 |
| 186 | _006133 | 0 | 0 | 2 | | | | | |
| 57 | _002551 | 0 | 0 | 1 | | | | | |
| 192 | _001801 | 0 | 0 | 0 | 0 | | 0 | 0 | −1 |
| 1721 | _001101 | 0 | 0 | 0 | | | | | |
| 11 | _021440 | 3 | 3 | 0 | | | | | |
| 420 | _007850 | −1 | 0 | 0 | | | | | |
| 25 | _002012 | 2 | 1 | 0 | | | | | |
| 418 | _001499 | 3 | 2 | 0 | | | | | |

TABLE 11-continued

| | | | | E. grandis Transcriptional Activity | | | | |
|---|---|---|---|---|---|---|---|---|
| SEQ ID NO: | ConsID Eucalyptus spp | Eg COMT 306 bp | Eg HB8 | Pine Ubq | Eg 4cl (EHUB001320) | Eg CAD 894 bp (EGXC017379) | Eg SAD (EGBA013771) | Eg CesA (EGXA017831) | Pr PAL476 bp (PRWN013157) |
| 1724 | _016292 | 0 | 2 | -2 | | | | | |
| 10 | _010329 | -1 | -1 | -1 | | | | | |
| 101 | _012574 | 0 | -2 | 2 | | | | | |
| 110 | _023116 | 2 | 1 | 2 | | | | | |
| 114 | _011635 | -1 | 0 | -1 | | | | | |
| 117 | _020932 | -1 | 0 | -1 | | | | | |
| 118 | _008505 | -1 | 0 | -1 | | | | | |
| 119 | _012929 | -1 | 0 | -1 | | | | | |
| 12 | _006609 | 2 | 2 | 2 | | | | | |
| 129 | _016288 | 1 | 1 | 0 | | | | | |
| 13 | _009633 | 2 | 2 | | | | | | |
| 130 | _022186 | 0 | 0 | -1 | | | | | |
| 135 | _031737 | -2 | 2 | -2 | | | | | |
| 137 | _016475 | -1 | 0 | | | | | | |
| 141 | _016383 | -2 | -2 | 0 | | | | | |
| 157 | _031783 | 0 | 0 | 2 | | | | | |
| 16 | _004527 | -1 | -1 | 0 | | | | | |
| 160 | _017799 | 0 | 0 | 3 | | | | | |
| 168 | _004276 | 0 | 1 | 2 | | | | | |
| 169 | _040897 | 0 | 3 | 1 | | | | | |
| 170 | _009792 | 1 | 0 | 0 | | | | | |
| 176 | _009160 | 0 | 0 | 0 | 0 | | 0 | 0 | -2 |
| 18 | _017429 | 2 | 3 | 3 | | | | | |
| 181 | _010921 | 0 | 1 | | | | | | |
| 205 | _007283 | 0 | -1 | 2 | | | | | |
| 207 | _006977 | 0 | -1 | 0 | | | | | |
| 208 | _028451 | 2 | 0 | 3 | | | | | |
| 209 | _012713 | 0 | 0 | 2 | | | | | |
| 21 | _003981 | 2 | 2 | | | | | | |
| 218 | _004908 | 1 | 0 | 0 | | | | | |
| 227 | _004569 | 0 | -2 | -2 | | | | | |
| 23 | _004354 | 1 | 0 | 0 | | | | | |
| 238 | _012985 | -2 | -1 | 0 | | | | | |
| 239 | _003554 | 0 | 0 | 3 | | | | | |
| 240 | _001379 | -1 | -1 | -1 | | | | | |
| 246 | _003387 | -1 | -1 | | | | | | |
| 249 | _008290 | -1 | -1 | -1 | | | | | |
| 255 | _007716 | 1 | 0 | 1 | | | | | |
| 29 | _017530 | 2 | 1 | 0 | | | | | |
| 310 | _013445 | 5 | 3 | 0 | | | | | |
| 325 | _017240 | 3 | 1 | 3 | | | | | |
| 327 | _028821 | 1 | 0 | 0 | | | | | |
| 329 | _020719 | -1 | 0 | | | | | | |
| 330 | _012391 | 0 | -1 | 0 | | | | | |
| 332 | _023163 | 4 | 0 | 0 | | | | | |
| 336 | _016428 | 0 | 0 | 2 | | | | | |
| 339 | _022894 | 0 | 0 | 2 | | | | | |
| 341 | _014013 | 4 | 2 | | | | | | |
| 344 | _034148 | 2 | 0 | | | | | | |
| 345 | _044052 | 0 | 1 | | | | | | |
| 347 | _022443 | 3 | 0 | -1 | | | | | |
| 35 | _009704 | 3 | 0 | 0 | | | | | |
| 358 | _012687 | 5 | 0 | 0 | | | | | |
| 36 | _000995 | 2 | 1 | 0 | | | | | |
| 368 | _012460 | 5 | 0 | 0 | | | | | |
| 397 | _012557 | 0 | 1 | 0 | | | | | |
| 401 | _028287 | -1 | 0 | -1 | | | | | |
| 404 | _032958 | 0 | 0 | -2 | | | | | |
| 406 | _016343 | 0 | 0 | -1 | | | | | |
| 407 | _023082 | -1 | 0 | -1 | | | | | |
| 424 | _009742 | 0 | 1 | 0 | | | | | |
| 438 | _000846 | 1 | | 0 | | | | | |
| 444 | _005217 | 0 | 1 | 0 | | | | | |
| 63 | _002337 | -1 | 0 | 0 | | | | | |
| 65 | _002338 | 0 | 2 | 0 | | | | | |
| 72 | _017014 | 3 | 2 | 0 | | | | | |
| 74 | _011943 | 2 | 1 | 0 | | | | | |
| 84 | _016552 | 1 | 0 | 0 | | | | | |
| 89 | _039711 | 0 | -1 | 2 | | | | | |
| 94 | _028626 | 1 | 0 | 0 | | | | | |
| 95 | _016958 | 0 | -1 | 1 | | | | | |

TABLE 12

| | | | | | | Eg CAD | | | Pr |
|---|---|---|---|---|---|---|---|---|---|
| | | Eg | | | | 894 bp | Eg SAD | Eg CesA | PAL476 bp |
| SEQ | | COMT | Eg | Pine | Eg 4cl | (EGXC | (EGBA | (EGXA | (PRWN |
| ID NO | Target | ConsID P. radiata | 306 bp | HB8 | Ubq | (EHUB001320) | 017379) | 013771) | 017831) | 013157) |
| 1868 | C2C2 CO-like | _027486 | 0 | 2 | 0 | | | | | |
| 325 | MYB | _005942 | 0 | 0 | 0 | | | | | |
| 325 | MYB | _005942 | 0 | | | | | | | |
| 561 | C2H2(Zn) | _010991 | 0 | 0 | | 0 | | 1 | 0 | |
| 766 | NAC | _010260 | 0 | 2 | | | | | | |
| 779 | RAV-like | _012365 | 0 | 0 | 1 | | | | | |
| 583 | C3H-type(Zn) | _023685 | −1 | 0 | 0 | | | | | |
| 556 | C2C2 GATA | _012556 | −1 | 0 | 0 | | | | | |
| 1954 | TCP | _010213 | 3 | 0 | 0 | | | | | |
| 657 | HSF | _012590 | 0 | 0 | 0 | 0 | 0 | 4 | 0 | 0 |
| 555 | C2C2 GATA | _005377 | 0 | 3 | 0 | | | | | |
| 802 | Trihelix | _023713 | 1 | 1 | 0 | | | | | |
| 1887 | CCAAT HAP2 | _016282 | 0 | 0 | 1 | | | | | |
| | SBP | _023335 | 2 | 0 | 0 | | | | | |
| | TFIID | _001017 | 2 | 0 | 0 | | | | | |
| 1873 | C2H2(Zn) | _018501 | 0 | 1 | 1 | | | | | |
| 1862 | C2C2 DOF | _006699 | 0 | 4 | −2 | | | | | |
| 784 | SBP | _013360 | 0 | 0 | 2 | | | | | |
| 458 | AP2/EREBP | _027777 | 4 | 2 | 3 | | | | | |
| 464 | AP2/EREBP | _001118 | 2 | 0 | 0 | | | | | |
| 465 | AP2/EREBP | _026952 | 2 | 0 | 0 | | | | | |
| 468 | AP2/EREBP | _010821 | 2 | 0 | 0 | | | | | |
| 469 | AP2/EREBP | _003747 | 1 | 0 | 0 | | | | | |
| 472 | AP2/EREBP | _004713 | 2 | 3 | 1 | | | | | |
| 474 | AP2/EREBP | _010888 | −1 | 0 | −1 | | | | | |
| 478 | AP2/EREBP | _011974 | 4 | 2 | 1 | | | | | |
| 485 | AP2/EREBP | _013025 | 2 | 0 | 0 | | | | | |
| 486 | AP2/EREBP | _018610 | 1 | 0 | 0 | | | | | |
| 498 | ARF | _001178 | 1 | 1 | 1 | | | | | |
| 515 | bHLH | _017391 | 0 | 0 | 0 | 1 | | 1 | 0 | 0 |
| 520 | bHLH | _003715 | 0 | 0 | 2 | | | | | |
| 524 | bZIP | _009274 | 0 | 0 | 5 | | | | | |
| 525 | bZIP | _028043 | 0 | 0 | 2 | | | | | |
| 530 | bZIP | _008316 | 0 | 0 | 1 | | | | | |
| 535 | bZIP | _010149 | 0 | 0 | 3 | | | | | |
| 548 | C2C2 DOF | _008939 | 0 | 0 | −1 | | | | | |
| 549 | C2C2 DOF | _009559 | −1 | 1 | | | | | | |
| 550 | C2C2 DOF | _011015 | −1 | 0 | 0 | | | | | |
| 551 | C2C2 DOF | _004761 | 0 | −1 | −1 | | | | | |
| 552 | C2C2 DOF | _010914 | 2 | 0 | 0 | | | | | |
| 553 | C2C2 DOF | _008932 | 0 | 0 | 2 | | | | | |
| 554 | C2C2 GATA | _003121 | 0 | 3 | 0 | | | | | |
| 557 | C2C2 GATA | _004862 | 1 | 4 | | | | | | |
| 557 | C2C2 GATA | _004862 | 1 | 4 | | | | | | |
| 563 | C2H2(Zn) | _003979 | 1 | 1 | 2 | | | | | |
| 584 | C3H-type(Zn) | _007401 | 0 | 0 | 0 | 0 | | 1 | 0 | 0 |
| 592 | CCAAT HAP5 | _001969 | 0 | 2 | 0 | | | | | |
| 615 | GARP | _011491 | 1 | 0 | 0 | | | | | |
| 618 | GRAS | _001161 | 0 | 0 | −1 | | | | | |
| 621 | HMG-box | _011491 | −1 | 0 | 0 | | | | | |
| 639 | HOMEObox | _009019 | 0 | 0 | 2 | | | | | |
| 645 | HOMEObox | _008529 | 0 | 0 | 2 | | | | | |
| 647 | HOMEObox | _005880 | 0 | 0 | 2 | | | | | |
| 655 | HSF | _013748 | 1 | 0 | 0 | | | | | |
| 660 | HSF | _001836 | 0 | 0 | 2 | | | | | |
| 661 | LFY | _014648 | 0 | 0 | 3 | | | | | |
| 662 | LFY | _021924 | 1 | 0 | 0 | | | | | |
| 680 | MADS box (SEQ ID NO: 3668) | _010394 | 0 | 1 | 0 | | | | | |
| 699 | MYB | _014663 | 1 | 1 | | | | | | |
| 701 | MYB | _005942 | | | | | | | | |
| 707 | MYB | _005036 | 2 | 0 | 0 | | | | | |

TABLE 12-continued

P. radiata Transcriptional Activity

| SEQ ID NO | Target | ConsID P. radiata | Eg COMT 306 bp | Eg HB8 | Pine Ubq | Eg 4cl (EHUB001320) | Eg CAD 894 bp (EGXC017379) | Eg SAD (EGBA013771) | Eg CesA (EGXA017831) | Pr PAL476 bp (PRWN013157) |
|---|---|---|---|---|---|---|---|---|---|---|
| 708 | MYB | _015746 | 1 | 0 | 0 | | | | | |
| 713 | MYB | _087430 | 1 | 0 | 0 | | | | | |
| 714 | MYB | _002140 | 5 | 0 | 3 | | | | | |
| 715 | MYB | _102213 | 1 | 0 | 0 | | | | | |
| 739 | MYB | _005041 | 2 | 0 | 2 | | | | | |
| 749 | MYB | _001512 | 2 | 0 | 0 | | | | | |
| 750 | MYB | _018720 | 3 | 0 | 0 | | | | | |
| 757 | NAC | _008171 | 0 | −1 | 0 | | | | | |
| 776 | NIN-like | _024619 | 0 | 0 | 0 | | | | | |
| 781 | SBP | _001584 | 3 | 2 | 4 | | | | | |
| 789 | TCP | _002869 | 4 | 3 | 0 | | | | | |
| 793 | Trihelix | _005391 | 0 | 0 | −1 | | | | | |
| 795 | Trihelix | _027495 | 0 | 1 | 0 | | | | | |
| 797 | Trihelix | _013316 | 3 | 0 | 0 | | | | | |
| 798 | Trihelix | _017176 | 0 | 1 | 0 | | | | | |
| 810 | WRKY (Zn) (SEQ ID NO: 3670) | _000383 | 0 | 1 | 0 | | | | | |
| 811 | WRKY (Zn) (SEQ ID NO: 3670) | _025684 | 0 | 1 | | | | | | |

EXAMPLE 15

The pFOR113 vector contains a gene, SEQ ID NO: 137, that encodes a protein similar to the DOF class of zinc finger proteins and that was isolated from a cDNA library made from *Eucalyptus grandis* xylem fibres.

As described in Example 11 above, transcription factor construct pFOR113 was assayed for the ability to either activate or repress transcription from the Pine Ubiquitin (2 kb+Intron) promoter.

As shown in FIG. 2, the mean fluorescence intensity (MFI) of EGFP from *Zinnia elegans* protoplasts transfected with constructs harbouring: (i) the Pine Ubiquitin promoter fused to EGFP (Clontech) and (ii) a selection of tree TFs.

It should be noted that the effects of pFOR113 were more subtle than that observed for pFOR293, so the following experiment was next performed. As described in Example 12 above, the gene contained in pFOR113, also contained in the multiple cloning site of pFOR369, was tested with the promoter construct of *E. grandis* COMT. As shown in FIG. 3, protoplasts from *Zinnia elegans* transfected with constructs harbouring: (i) the COMT promoter fused to EGFP (Clontech) and (ii) a selection of tree TFs. were assayed for mean fluorescence intensity (MFI) of EGFP

EXAMPLE 16

Method for Increasing Lignin Composition in a Plant

The inventive polynucleotide sequences can be used to regulate gene expression in any plant, including both angiosperms and gymnosperms. The overexpression of a key gene in the lignin biosynthesis pathway may be desirable under circumstances where increased mechanical strength of wood or resistance to pathogens and pests is desired. For example, the construct pFOR 434 comprises the *E. grandis* Homeobox 8 promoter, which is strongly activated by a MYB transcription factor (SEQ ID NO: 315). Accordingly, the Homeobox 8 promoter can be operably linked to a gene in the lignin biosynthesis pathway. In the presence of the MYB transcription factor, expression of the resulting gene product derived from Homeobox 8 promoter-lignin biosynthesis gene construct should be higher than the expression product of the same construct in the absence of the MYB transcription factor.

For example, ferulate-5-hydroxylase (F5H) is a key enzyme in the biosynthesis of syringyl lignin monomers. Franke et al., *Plant J* 22:3:223-224(2000). A DNA vector can be constructed having a MYB transcription factor sequence (SEQ ID NO X) that binds to the Homeobox 8 promoter operably linked to a sense nucleotide sequence encoding 5FH. As described in Example 4, any plant can be transformed with this DNA construct.

5FH activity can be assayed in a transformed plant according to Franke et al., and references cited therein. Lignin content and composition may be assayed by the methods of Baucher et al., *Plant Physiol.* 112: 1479-90 (1996).

EXAMPLE 17

Method for Decreasing Lignin Content in a Plant

Under some circumstances, it may be desirable to reduce expression of a lignin biosynthesis gene in a plant. For example, cinnamyl alcohol dehydrogenase (CAD) catalyzes the last step of lignin monomer synthesis and has provided a target for successful antisense-mediated down-regulation of lignin in transgenic plants using other promoters. See Yahiaoui et al., *Phytochemistry* 49: 295-306 (1998) and references cited therein. Expression of an RNAi molecule corresponding to a portion of CAD results in a decrease in enzyme activity and a corresponding increase in the proportion of cinnamyl aldehydes in the lignin of a transgenic plant.

By use of the inventive polynucleotides of the present invention, a DNA vector can be constructed having a transcription factor sequence that binds to a vascular-specific promoter operably linked to a gene encoding an RNA interference (RNAi) molecule corresponding to a portion of the coding region of CAD. For example, a DNA vector may have a WRKY (SEQ ID NO: 3670) transcription factor (SEQ ID NO: 446) that binds to an *E. grandis* COMT promoter operably linked to a nucleotide sequence encoding a CAD RNAi molecule. Any plant may be transformed with the DNA vector, as described in Example 4. Transgenic plants may be assayed for CAD activity using the method of Wyrambik et al., *Eur. J. Biochem.* 59:9-15 (1975) as adapted by Baucher et al., *Plant Physiol.* 112:1479-90 (1996). Lignin content and composition can be measured as set forth by Baucher (1996).

*Arabidopsis* plants are sampled for lignin analysis at approximately 6 weeks of age. Freeze dried bolts are ground in a in a ring mill. Ground samples are dried for a minimum of 1 day at 55° C. and stored at this temperature until use. Cell wall material is isolated from the samples in a series of stages by suspending the ground material in a solvent or solution, extracting with an ultrasonic cleaner, centrifuging and then decanting the supernatant. The following sequence of extractions are used: aqueous detergent, NaCl at two concentrations, aqueous ethanol; $CHCl_3$:MeOH; and acetone. To remove the starch, the extracted cell wall materials are washed, heated in tris-acetate buffer to gelatinize the starch, and then treated with α-amylase. Following enzyme treatment the suspension is centrifuged and the resulting precipitate is washed with ethanol and acetone, allowed to stand overnight, and then dried at 55° C. The isolated cell material is used for small scale lignin determinations carried out using the procedure described in Fukushima, R. S. and Hatfield, R. D. (2001) *J. Ag. Food Chem.* 49(7):3133-9.

EXAMPLE 18

Use of an HMG-Box Transcription Factor to Modify Root Growth

Plant growth and the growth of particular organs such as the roots can be regulated using an inventive polynucleotide sequence. In this example, *Arabidopsis* was transformed with a construct comprising a gene encoding an HMG-box transcription factor, SEQ ID NO: 229, driven by the cauliflower mosaic virus promoter. This DNA construct was inserted into a strain of *Agrobacterium tumefaciens* capable of transforming *Arabidopsis thaliana*, and transformation was carried out using the floral dip method as described above. Seeds were collected and germinated under aseptic conditions in gelled nutrient media. The morphology of the seedlings was compared with that of wild type seedlings and seedlings that had arisen from transformation with pART9. Compared to these control seedlings, an unusual growth phenotype was noticed in 16 out of 20 seedlings arising from the transformtion with the construct comprising SEQ ID NO: 229. In particular, 15 of the 20 seedlings examined showed more branching of the primary root, and 5 of the 20 seedlings examined showed unusually vigorous growth, which may be associated with greater root surface area and nutrient absorption. Such a phenotype is potentially valuable in transgenic plants, including forest tree species and plants grown in low-nutrient or arid conditions.

EXAMPLE 19

Use of a SBP Transcription Factor to Activate Gene Expression in Plants

Based on the data from the above examples, plant gene expression can be regulated using an inventive polynucleotide sequence, e.g. aDNA construct having one of the inventive polynucleotide sequences in a sense or antisense orientation. For example, *Arabidopsis* can be transformed with a gene encoding a SBP transcription factor. As shown in Table 12, a SBP transcription factor can be used to activate gene expression.

DNA constructs comprising a nucleic acid sequence encoding a SBP transcription factor including the coding region of the SBP transcription factor of SEQ ID NO: 781 (inserted into the multiple cloning site of pART7 to create pFOR462) are inserted into a strain of *Agrobacterium tumefaciens* capable of transforming a plant. Additionally, the pFOR462 construct comprises the Euc COMT promoter operably linked to a desired gene. A desired gene includes any gene involved in wood development. Genes involved in wood development include genes that generate denser cells and/or longer cells, control microfibril angle, and extend cell division. Plants may be transformed as described above in Example 5.

EXAMPLE 20

Use of C2C2 GATA Transcription Factor to Repress Gene Expression in Plants

As shown in the above examples, plant gene expression can be regulated using an inventive polynucleotide sequence. Vectors can be constructed with one of the inventive polynucleotide sequences in a sense or antisense orientation. For example, *Arabidopsis* can be transformed with a gene encoding a C2C2 GATA transcription factor. As shown in Example 14, the construct comprising a transcription factor can be used to repress gene expression.

DNA constructs comprising a nucleic acid sequence encoding a transcription factor including the coding region of the transcription factor of SEQ ID NO: 142 are inserted into a strain of *Agrobacterium tumefaciens* capable of transforming a plant. Additionally, the construct comprises the Euc COMT promoter operably linked to a desired gene. A desired gene includes any gene involved in wood development. Genes involved in wood development include genes that generate denser cells and/or longer cells, control microfibril angle.

EXAMPLE 21

*Eucalyptus* in Silico Data

In silico gene expression can be used to determine the membership of the consensi EST libraries. For each library, a consensus is determined from the number of ESTs in any tissue class divided by the total number of ESTs in a class multiplied by 1000. These values provide a normalized value that is not biased by the extent of sequencing from a library. Several libraries were sampled for a consensus value, including reproductive, bud reproductive, bud vegetative, fruit, leaf, phloem, cambium, xylem, root, stem, sap vegetative, whole plant libraries.

As shown below, a number of the inventive transcription factor sequences exhibit vascular-preferred expression (more than 50% of the hits by these sequences if the databases were searched at random would be in libraries made from developing vascular tissue) and thus are likely to be involved in wood-related developmental processes. Many of the remaining transcription factors exhibit vegetative-preferred expression, suggesting expression in leaf developmental processes and photosynthesis-related processes, or root-preferred expression, suggesting expression in root developmental processes and water and nutrient uptake. The data is shown in the Table 13.

EXAMPLE 22

Phenotypic Expression of *E. grandis* Transcription Factors

As described in Example 1, transcription factors were isolated from *E. grandis* cDNA libraries. Following isolation and identification, a polynucleotide sequence encoding a transcription factor can be cloned in a DNA construct and transformed into a recipient host cell. Any plant, including angiosperms and gymnosperms, may be transformed with one of the inventive polynucleotides. As outlined in Example 5, wild-type *Arabidopsis thaliana* cv. 'Columbia-0' plants are transformed with *Agrobacterium* containing a DNA construct having a promoter operably linked to a polynucleotide sequence encoding a transcription factor. Shown below in Table 14, expression of a transcription factor in a host plant cell can modify a plant phenotype.

TABLE 14

Expression of *E. grandis* Transcription Factors in *Arabidopsis*

| SEQ ID NO | Transcription Factor Family | Number of Plants Transformed | Transformation Efficiency(%) | Phenotypic Expression |
|---|---|---|---|---|
| 7 | Alfin-like | 20 | 0.30 | 15 seedlings survived; 4 with short roots |
| 79 | bHLH | 19 | 0.10 | 19 seedlings survived; 6 with chlorophyllic primary roots |
| 95 | bZIP | 20 | 0.41 | 20 seedlings survived; No visible abnormalities |
| 97 | bZIP | 20 | 2.20 | 20 seedlings survived; 6 with a branched primary root |
| 102 | bZIP | 20 | 0.20 | 20 seedlings survived; 1 with short roots, 1 with cotyledon having anthocyanin |
| 103 | bZIP | 20 | 0.27 | 20 seedlings survived; 5 with increased root hairs; 2 with reduced root branching |
| 126 | C2C2 CO-like | 19 | 0.25 | 19 seedlings survived; No visible abnormalities |
| 127 | C2C2 CO-like | 20 | 0.10 | 18 seedlings survived; 3 with large cotyledons |
| 129 | C2C2 CO-like | 20 | 0.50 | 20 seedlings survived; 3 with premature bolting |
| 178 | C3H-Type Zn Finger | 20 | 0.46 | 20 seedlings survived; 4 with small cotyledons |
| 246 | HOMEO box | 9 | 0.01 | 9 seedlings survived; all 9 have small roots and cotyledons |
| 300 | MADS Box (SEQ ID NO: 3668) | 20 | 0.18 | 20 seedlings survived; 7 with smaller, paler cotyledons |
| 319 | MYB | 20 | 1.5 | 20 seedlings survived; No visible abnormalities |

EXAMPLE 23

Phenotypic Expression of *P. radiata* Transcription Factors

As described in Example 1, transcription factors were isolated from *P. radiata* cDNA libraries. Following isolation and identification, a polynucleotide sequence encoding a transcription factor can be cloned in a DNA construct and transformed into a recipient host cell. Any plant, including angiosperms and gymnosperms, may be transformed with one of the inventive polynucleotides. As outlined in Example 5, wild-type *Arabidopsis thaliana* cv. 'Columbia-0' plants are transformed with *Agrobacterium* containing a DNA construct having a promoter operably linked to a polynucleotide sequence encoding a transcription factor. Shown below in Table 15, expression of a transcription factor in a host plant cell can modify a plant phenotype.

TABLE 15

Expression of *P. radiatas* Transcription Factors in *Arabidopsis*

| SEQ ID NO | Construct | TF Family | Number of Plants Transformed | Transformation Efficiency |
|---|---|---|---|---|
| 1710 | pFOR116 | CBF/NF-Y archeal Histone | 15 | 0.2 |
| 539 | pFOR122 | CONSTANS-like Zn Finger | 20 | 0.5 |
| 538 | pFOR126 | CONSTANS-like Zn Finger | 20 | 0.7 |
| 474 | pFOR294 | Ethylene-Response Element Binding Protein | 20 | 0.2 |
| 620 | pFOR244 | HMG2 | 20 | 0.5 |
| 622 | pFOR258 | HMG1 | 13 | 0.1 |
| 675 | pFOR146 | MADS-Box | 20 | 1.6 |
| 708 | pFOR234 | MYB | 20 | 0.9 |
| 728 | pFOR208 | MYB | 20 | 0.26 |
| 453 | pFOR124 | Zinc Finger | 20 | 0.26 |
| 1892 | pFOR226 | Pathogenesis-Related and ERF | 20 | 0.77 |

EXAMPLE 24

Curation of an EST Sequence

During the production of cDNA libraries, the original transcripts or their DNA counterparts may have features that prevent them from coding for functional proteins. There may be insertions, deletions, base substitutions, or unspliced or improperly spliced introns. If such features exist, it is often possible to identify them so that they can be changed. The consensus sequence pinusRadiata_001720, equivalent to EST number 011005PRAA002374HT, will be used as an example, although similar curation can be performed on any other sequences that have homology to sequences in the public databases.

After determination of the DNA sequence, BLAST analysis showed that it was related to the *Arabidopsis* gene SHORT VEGETATIVE PHASE or SVP (gene At2g22540 on the publicly available *Arabidopsis* genome sequence). However, instead of coding for an approximately 240 amino acid polypeptide, pinusRadiata_001720 was predicted to code for a product of only 157 amino acid residues. This suggested an error in the DNA sequence. To identify where the genuine coding region might be, the DNA sequence from position 600 to the end of the EST was translated in each of the three reading frames and the predicted sequences were aligned with the SVP amino acid sequence. It was found that the DNA segment from position 924 to 1170 coded for a sequence with similarity to the carboxyl terminus of SVP. Therefore, it appears that an unspliced intron is present in the EST.

Unspliced introns are a relatively minor issue with regard to use of a cloned sequence for overexpression of the gene of interest. The RNA resulting from transcription of the cDNA can be expected to undergo normal processing to remove the intron. Antisense and RNAi constructs are also expected to function to suppress the gene of interest. On other occasions, it may be desirable to identify the precise limits of the intron so that it can be removed. When the sequence in question has a published sequence that is highly similar, it may be possible to find the intron by aligning the two sequences and identifying the locations where the sequence identity falls off, aided by the knowledge that introns start with the sequence GT and end with the sequence AG.

For pinusRadiata_001720, there is plausible similarity to SVP up to position 552, where there is a possible EXON|intron junction CAAAA|gtggg (SEQ ID NO: 3677). A second candidate junction is at position 582, where the sequence is TACCA|gtacc (SEQ ID NO: 3678). In both these cases, the putative intron junction falls between the second and third nucleotides of a codon. The likely site of the 3'-end of the intron is position 925, where the predicted intron|EXON junction is acaag|TGGAA (SEQ ID NO: 3679) and again falls between the second and third bases of a codon. When there is some doubt about the site of the intron because highly similar sequences are not available, as is the case for pinusRadiata_001720, the intron location can be verified experimentally. For example, DNA oligomers can be synthesized flanking the region where the suspected intron is located. For pinusRadiata_001720, a sense primer could be synthesized based on sequence in the region from position 400 to 500 and an antisense primer could be synthesized based on sequence in the region from position 1000 to 1100. RNA from radiata pine is isolated and used as a template to make cDNA using reverse transcriptase. The selected primers are then used in a PCR reaction to amplify the correctly spliced DNA segment (predicted size of approximately 350 bp smaller than the corresponding segment of the original consensus) from the population of cDNAs. The amplified segment is then subjected to sequence analysis and compared to the pinusRadiata_001720 sequence to identify the differences.

The same procedure can be used when an alternate splicing event (partial intron remaining, or partial loss of an exon) is suspected. When an EST has a small change, such as insertion or deletion of a small number of bases, computer analysis of the EST sequence can still indicate its location when a translation product of the wrong size is predicted or if there is an obvious frameshift. Verification of the true sequence is done by synthesis of primers, production of new cDNA, and PCR amplification as described above.

EXAMPLE 25

Example 25 illustrates how transcription factor polynucleotides important for wood development in *P. radiata* can be determined and how oligonucleotides which uniquely bind to those genes can be designed and synthesized for use on a microarray.

Open pollinated trees of approximately 16 years of age are selected from plantation-grown sites, in the United States for loblolly pine, and in New Zealand for radiata pine. Trees are felled during the spring and summer seasons to compare the expression of genes associated with these different developmental stages of wood formation. Trees are felled individually and trunk sections are removed from the bottom area approximately one to two meters from the base and within one to two meters below the live crown. The section removed from the basal end of the trunk contains mature wood. The section removed from below the live crown contains juvenile wood. Samples collected during the spring season are termed earlywood or springwood, while samples collected during the summer season are considered latewood or summerwood (Larson et al., *Gen. Tech. Rep.* FPL-GTR-129. Madison, Wis.: U.S. Department of Agriculture, Forest Service, Forest Products Laboratory. 42p.).

Tissues are isolated from the trunk sections such that phloem, cambium, developing xylem, and maturing xylem are removed. These tissues are collected only from the current year's growth ring. Upon tissue removal in each case, the material is immediately plunged into liquid nitrogen to preserve the nucleic acids and other components. The bark is peeled from the section and phloem tissue removed from the inner face of the bark by scraping with a razor blade. Cambium tissue is isolated from the outer face of the peeled section by gentle scraping of the surface. Developing xylem and lignifying xylem are isolated by sequentially performing more vigorous scraping of the remaining tissue. Tissues are transferred from liquid nitrogen into containers for long term storage at −70° C. until RNA extraction and subsequent analysis is performed.

cDNA clones containing sequences that hybridize to the genes showing wood-preferred expression are selected from cDNA libraries using techniques well known in the art of molecular biology. Using the sequence information, oligonucleotides are designed such that each oligonucleotide is specific for only one cDNA sequence in the library. The oligonucleotide sequences are provided in TABLE 19. 60-mer oligonucleotide probes are designed using the method of Li and Stormo, supra or using software such as ArrayDesigner, GeneScan, and ProbeSelect.

Oligonucleotides are then synthesized in situ described in Hughes et al., *Nature Biotechnol.* 19:324 (2002) or as described in Kane et al., *Nucleic Acids Res.* 28:4552 (2000). The oligonucleotides can also be synthesized by Sigma-Aldrich (Saint Louis, Mo., USA). Oligonucleotides are volume normalized to a final concentration of 100 μM redissolved in 100 μl DNAse/RNAse free water. All oligonucleotides are desalted and cartridge purified by HPLC in accordance with the quality control specifications of the vendor.

Synthesized 60-mer oligonucleotides are spotted in duplicate onto Corning UltraGAPS gamma-amino propyl silane aminosilane-coated glass microscope slides (Corning, N.Y.) using Amersham's Lucidea Array spotter (Amersham Biosciences, NY, USA). The position of each oligonucleotide on the slide is known.

All pre- and post-arraying steps are performed according to specifications described in the US Provisional Patent Application for "Methods and Kits for Labeling and Hybridizing cDNA for Microarray Analysis" (60/390,142, filed Jun. 20, 2002).

EXAMPLE 26

Example 26 illustrates how cell cycle genes important for wood development in *E. grandis* can be determined and how oligonucleotides which uniquely bind to those genes can be designed and synthesized for use on a microarray.

*Eucalyptus* trees of the species *Eucalyptus grandis* are grown under natural light conditions. Tissue samples are prepared as described in, e.g., Sterky et al., *Proc. Nat'l Acad. Sci.* 95:13330 (1998). Specifically, tissue samples are collected from woody trees having a height of 5 meters. Tissue samples of the woody trees are prepared by taking tangential sections through the cambial region of the stem. The stems are sectioned horizontally into sections ranging from juvenile (top) to mature (bottom). The stem sections separated by stage of development are further separated into 5 layers by peeling into sections of phloem, differentiating phloem, cambium, differentiating xylem, developing xylem, and mature xylem. Tissue samples, including leaves, buds, shoots, and roots are also prepared from seedlings of the species *P. radiata*.

RNA is isolated and ESTs generated as described in Sterky et al., supra. The nucleic acid sequences of ESTs derived from samples containing developing wood are compared with nucleic acid sequences of genes known to be involved in the plant cell cycle. ESTs from samples that do not contain developing wood are also compared with sequences of genes known to be involved in the plant cell cycle. An in silico hybridization analysis is performed as described in, for example, Audic and Clayerie, *Genome Res.* 7:986 (1997). Sequences from among the known cell cycle genes that show hybridization in silico to ESTs made from samples containing developing wood, but do not hybridize to ESTs from samples not containing developing wood are selected for further examination.

cDNA clones containing sequences that hybridize to the genes showing wood-preferred expression are selected from cDNA libraries using techniques well known in the art of molecular biology. Using the sequence information, oligonucleotides are designed such that each oligonucleotide is specific for only one cDNA sequence in the library. The oligonucleotide sequences are provided in TABLE 20. 60-mer oligonucleotide probes are designed using the method of Li and Stormo, supra or using software such as ArrayDesigner, GeneScan, and ProbeSelect.

The oligonucleotides are then synthesized in situ described in Hughes et al., *Nature Biotechnol.* 19:324 (2002) or as described in Kane et al., *Nucleic Acids Res.* 28:4552 (2000) and affixed to an activated glass slide (Sigma-Genosus, The Woodlands, Tex.) using a 5' amino linker. The position of each oligonucleotide on the slide is known.

EXAMPLE 27

Example 27 illustrates how to detect expression of *Pinus* transcription factor genes which are important in wood formation using an oligonucleotide microarray prepared as in Example 28. This is an example of a balanced incomplete block designed experiment carried out using aRNA samples prepared from mature-phase phloem (P), cambium (C), expanding xylem found in a layer below the cambium (X1) and differentiating, lignifying xylem cells found deeper in the same growth ring (X2). In this example, cell cycle gene expression is compared among the four samples, namely P, C, X1, and X2.

RNA is isolated according to the protocol of Chang et al., *Plant Molec. Biol. Rep.* 11:113 (1993). DNA is removed using DNase I (Invitrogen, Carlsbad, Calif.) according to the manufacturer's recommendations. The integrity of the RNA samples is determined using the Agilent 2100 Bioanalyzer (Agilent Technologies, USA).

10 μg of total RNA from each tissue is reverse transcribed into cDNA. All laboratory steps associated with cDNA synthesis and labelling were performed according to specifications described in the US patent application for "Methods and Kits for Labeling and Hybridizing cDNA for Microarray Analysis" (supra).

In the case of *P. radiata* phloem tissue, it can be difficult to extract sufficient amounts of total RNA for normal labelling procedures. Total RNA is extracted and treated as previously described and 100 ng of total RNA is amplified using the Ovation™ Nanosample RNA Amplification system from NuGEN™ (CA, USA). Similar amplification kits such as those manufactured by Ambion may alternatively be used. The amplified RNA is reverse transcribed into cDNA and labelled as described above.

Hybridization and stringency washes are performed using the protocol as described in the US patent application for "Methods and Kits for Labeling and Hybridizing cDNA for Microarray Analysis" (supra) at 42° C. The arrays (slides) are scanned using a ScanArray 4000 Microarray Analysis System (GSI Lumonics, Ottawa, ON, Canada). Raw, non-normalized intensity values are generated using QUANTAR-RAY software (GSI Lumonics, Ottawa, ON, Canada).

A fully balanced, incomplete block experimental design (Kerr, M. K. and Churchill, G. A. 2001, Statistical design and the analysis of gene expression microarray data. Gen. Res. 123:123-128) is used in order to design an array experiment that would allow maximum statistical inferences from analyzed data.

Gene expression data is analyzed using the SAS® Microarray Solution software package (The SAS Institute, Cary, N.C., USA). Resulting data was then visualized using JMP® (The SAS Institute, Cary, N.C., USA).

Analysis done for this experiment is an ANOVA approach with mixed model specification. (Wolfinger et al. *J. Comp. Biol.* 8:625 (2001). Assessing gene significance from cDNA microarray expression data via mixed models. Two steps of linear mixed models are applied. The first one, normalization model, is applied for global normalization at slide-level. The second one, gene model, is applied for doing rigorous statistical inference on each gene. Both models are stated in Models (1) and (2).

$$\log_2(Y_{ijkls}) = \theta_{ij} + D_k + S_l + DS_{kl} + \omega_{ijkls} \quad (1)$$

$$R_{ijkls}{}^{(g)} = \mu_{ij}{}^{(g)} + D_k{}^{(g)} + S_l{}^{(g)} + DS_{kl}{}^{(g)} + SS_{ls}{}^{(g)} + \epsilon_{ijkls}{}^{(g)} \quad (2)$$

$Y_{ijkls}$ represents the intensity of the $s^{th}$ spot in the $l^{th}$ slide with the $k^{th}$ dye applying the $j^{th}$ treatment for the $i^{th}$ cell line.

$\theta_{ij}$, $D_k$, $S_l$, and $DS_{kl}$ represent the mean effect of the $j^{th}$ treatment in the $i^{th}$ cell line, the $k^{th}$ dye effect, the $l^{th}$ slide random effect, and the random interaction effect of the $k^{th}$ dye in the $l^{th}$ slide. $\omega_{ijkls}$ is the stochastic error term. $R_{ijkls}^{(g)}$ represents the residual of the $g^{th}$ gene from model (1). $\mu_{ij}^{(g)}$, $D_k^{(g)}$, $S_l^{(g)}$ and $DSS_{kl}^{(g)}$ represent the similar roles as $\theta_{ij}$, $D_k$, $S_l$, and $DS_{kl}$ except they are specific for the $g^{th}$ gene. $SS_{ls}^{(g)}$ represent the spot by slide random effect for the $g^{th}$ gene. $\epsilon_{ijkls}^{(g)}$ represent the stochastic error term. All random terms are assumed to be normal distributed and mutually independent within each model.

According to the analysis described above, certain cDNAs, some of which were shown in Table 16 below, are found to be differentially expressed.

TABLE 16

| EQ ID | Annotation | hloem v Camb&Xyl | hloem v Xylem | amb v Xylem |
|---|---|---|---|---|
| 14 | MYB transcription factor | 1.39 | 1.45 | .16 |
| 50 | MYB transcription factor | 1.29 | 1.39 | .3 |
| 53 | HOMEOBOX TRANSCRIPTION FACTOR | 1.16 | 1.01 | 0.46 |
| 83 | PUTATIVE MADS BOX (SEQ ID NO: 3668) TRANSCRIPTION FACTOR PRMADS9 | 1.05 | 1.05 | 0.02 |
| 54 | HOMEOBOX PROTEIN HD-ZIP (HD-ZIP TRANSCRIPTION FACTOR) | 1.02 | 0.85 | 0.53 |
| 22 | HMG-Box transcription factor | .38 | .73 | 1.06 |

The involvement of these specific genes in wood development is inferred through the association of the up-regulation or down-regulation of genes to the particular stages of wood development. Both the spatial continuum of wood development across a section (phloem, cambium, developing xylem, maturing xylem) at a particular season and tree trunk position and the relationships of season and tree trunk position are considered when making associations of gene expression to the relevance in wood development.

EXAMPLE 28

Example 28 demonstrates how one can correlate transcription factor gene expression with agronomically important wood phenotypes such as density, stiffness, strength, distance between branches, and spiral grain.

Mature clonally propagated pine trees are selected from among the progeny of known parent trees for superior growth characteristics and resistance to important fungal diseases. The bark is removed from a tangential section and the trees are examined for average wood density in the fifth annual ring at breast height, stiffness and strength of the wood, and spiral grain. The trees are also characterized by their height, mean distance between major branches, crown size, and forking.

To obtain seedling families that are segregating for major genes that affect density, stiffness, strength, distance between branches, spiral grain and other characteristics that may be linked to any of the genes affecting these characteristics, trees lacking common parents are chosen for specific crosses on the criterion that they exhibit the widest variation from each other with respect to the density, stiffness, strength, distance between branches, and spiral grain criteria. Thus, pollen from a plus tree exhibiting high density, low mean distance between major branches, and high spiral grain is used to pollinate cones from the unrelated plus tree among the selections exhibiting the lowest density, highest mean distance between major branches, and lowest spiral grain. It is useful to note that "plus trees" are crossed such that pollen from a plus tree exhibiting high density are used to pollinate developing cones from another plus tree exhibiting high density, for example, and pollen from a tree exhibiting low mean distance between major branches would be used to pollinate developing cones from another plus tree exhibiting low mean distance between major branches.

Seeds are collected from these controlled pollinations and grown such that the parental identity is maintained for each seed and used for vegetative propagation such that each genotype is represented by multiple ramets. Vegetative propagation is accomplished using micropropagation, hedging, or fascicle cuttings. Some ramets of each genotype are stored while vegetative propagules of each genotype are grown to sufficient size for establishment of a field planting. The genotypes are arrayed in a replicated design and grown under field conditions where the daily temperature and rainfall are measured and recorded.

The trees are measured at various ages to determine the expression and segregation of density, stiffness, strength, distance between branches, spiral grain, and any other observable characteristics that may be linked to any of the genes affecting these characteristics. Samples are harvested for characterization of cellulose content, lignin content, cellulose microfibril angle, density, strength, stiffness, tracheid morphology, ring width, and the like. Samples are also examined for gene expression as described in Example 4. Ramets of each genotype are compared to ramets of the same genotype at different ages to establish age:age correlations for these characteristics.

EXAMPLE 29

Example 29 demonstrates how the stage of plant development and responses to environmental conditions such as light and season can be correlated to transcription factor gene expression using microarrays prepared as in Example 25. In particular, the changes in gene expression associated with wood density are examined.

Trees of three different clonally propagated *Eucalyptus grandis* hybrid genotypes are grown on a site with a weather station that measures daily temperatures and rainfall. During the spring and subsequent summer, genetically identical ramets of the three different genotypes are first photographed with north-south orientation marks, using photography at sufficient resolution to show bark characteristics of juvenile and mature portions of the plant, and then felled as in Example 35. The age of the trees is determined by planting records and confirmed by a count of the annual rings. In each of these trees, mature wood is defined as the outermost rings of the tree below breast height, and juvenile wood as the innermost rings of the tree above breast height. Each tree is accordingly sectored as follows:

NM—NORTHSIDE MATURE
SM—SOUTHSIDE MATURE
NT—NORTHSIDE TRANSITION
ST—SOUTHSIDE TRANSITION
NJ—NORTHSIDE JUVENILE
SJ—SOUTHSIDE JUVENILE

Tissue is harvested from the plant trunk as well as from juvenile and mature form leaves. Samples are prepared simultaneously for phenotype analysis, including plant morphology and biochemical characteristics, and gene expression analysis. The height and diameter of the tree at the point from which each sector was taken is recorded, and a soil sample from the base of the tree is taken for chemical assay. Samples prepared for gene expression analysis are weighed and placed into liquid nitrogen for subsequent preparation of RNA samples for use in the microarray experiment. The tissues are denoted as follows:

P—phloem
C—cambium
X1—expanding xylem
X2—differentiating and lignifying xylem

Thin slices in tangential and radial sections from each of the sectors of the trunk are fixed as described in Ruzin, Plant Microtechnique and Microscopy, Oxford University Press, Inc., New York, N.Y. (1999) for anatomical examination and confirmation of wood developmental stage. Microfibril angle is examined at the different developmental stages of the wood, for example juvenile, transition and mature phases of *Eucalyptus grandis* wood. Other characteristics examined are the ratio of fibers to vessel elements and ray tissue in each sector. Additionally, the samples are examined for characteristics that change between juvenile and mature wood and between spring wood and summer wood, such as fiber morphology, lumen size, and width of the S2 (thickest) cell wall layer. Samples are further examined for measurements of density in the fifth ring and determination of modulus of elasticity using techniques well known to those skilled in the art of wood assays. See, e.g., Wang, et al., Non-destructive Evaluations of Trees, Experimental Techniques, pp. 28-30 (2000).

For biochemical analysis, 50 grams from each of the harvest samples are freeze-dried and analyzed, using biochemical assays well known to those skilled in the art of plant biochemistry for quantities of simple sugars, amino acids, lipids, other extractives, lignin, and cellulose. See, e.g., Pettersen & Schwandt, J. Wood Chem. & Technol. 11:495 (1991).

In the present example, the phenotypes chosen for comparison are high density wood, average density wood, and low density wood. Nucleic acid samples are prepared as described in Example 3, from trees harvested in the spring and summer. Gene expression profiling by hybridization and data analysis is performed as described in Examples 3 and 4.

Using similar techniques and clonally propagated individuals one can examine cell cycle gene expression as it is related to other complex wood characteristics such as strength, stiffness and spirality.

EXAMPLE 30

Example 30 demonstrates the ability of the oligonucleotide probes of the invention to distinguish between highly homologous members of a family of transcription factor genes. Hybridization to a particular oligonucleotide on the array identifies a unique HMG-box gene that is expressed more strongly in a genotype having a higher density wood than in observed in other genotypes examined. The HMG-box gene is also expressed more strongly in mature wood than in juvenile wood and more strongly in summer wood than in spring wood. This gene is not found to be expressed at high levels either in leaves or buds.

The gene expression pattern is confirmed by RT-PCR. This gene, the putative "density-related" gene, is used for in situ hybridization of fixed radial sections. The density-related HMG-box gene hybridizes most strongly to the vascular cambium in regions of the stem where the xylem is comprised primarily of fibers with few vessel elements and few xylem ray cells.

These results suggest that the HMG-box gene product functions in radial cell division, which occurs in the cambium and results in diameter growth, rather than in axial cell division such as may be important in the apex or leaves. Such a gene would be difficult to identify by cDNA microarrays or other traditional hybridization means because the highly conserved regions present in the gene would result in confusing it with genes encoding enzymes having similar catalytic functions, but acting in axial or radial divisions. Furthermore, from the sequence similarity-based annotation suggesting a function of this gene product in cell division and the observation of this microarray hybridization pattern, confirmed by RT-PCR and in silico hybridization, this gene product functions specifically in developing secondary xylem to guide the cell division patterns of fibers, such that higher expression of this gene results in greater fiber production relative to vessel element or ray production. The fiber content is correlated with a principal components analysis (PCA) variable that accounts for at least 10% of the variation in basic density.

EXAMPLE 31

Example 31 describes microarrays for identifying gene expression differences that contribute to the phenotypic characteristics that are important in commercial wood, namely wood appearance, stiffness, strength, density, fiber dimensions, coarseness, cellulose and lignin content, extractives content and the like.

As in Examples 25-26, woody trees of genera that produce commercially important wood products, in this case *Pinus* and *Eucalyptus*, are felled from various sites and at various times of year for the collection and isolation of RNA from developing xylem, cambium, phloem, leaves, buds, roots, and other tissues. RNA is also isolated from seedlings of the same genera.

All contigs are compared to both the ESTs made from RNA isolated from samples containing developing wood and the sequences of the ESTs made from RNA of various tissues that do not contain developing wood. Contigs containing primarily ESTs that show more hybridization in silico to ESTs made from RNA isolated from samples containing developing wood than to ESTs made from RNA isolated from samples not containing developing wood are determined to correspond to possible novel genes particularly expressed in developing wood. These contigs are then used for BLAST searches against public domain sequences. Those contigs that hybridize with high stringency to no known genes or genes annotated as having only a "hypothetical protein" are selected for the next step. These contigs are considered putative novel genes showing wood-preferred expression.

The longest cDNA clones containing sequences hybridizing to the putative novel genes showing wood-preferred expression are selected from cDNA libraries using techniques well known to those skilled in the art of molecular biology. The cDNAs are sequenced and full-length gene-coding sequences together with untranslated flanking sequences are obtained where possible. Stretches of 45-80 nucleotides (or oligonucleotides) are selected from each of the sequences of putative novel genes showing wood-preferred expression such that each oligonucleotide probe hybridizes at high stringency to only one sequence represented in the ESTs made from RNA isolated from trees or seedlings of the same genus.

Oligomers are then chemically synthesized and placed onto a microarray slide as described in Example 34. Each oligomer corresponds to a particular sequence of a putative novel gene showing wood-preferred expression and to no other gene whose sequence is represented among the ESTs made from RNA isolated from trees or seedlings of the same genus.

Sample preparation and hybridization are carried out as in Example 35. The technique used in this example is more effective than use of a microarray using cDNA probes because the presence of a signal represents significant evidence of the expression of a particular gene, rather than of any of a number of genes that may contain similarities to the cDNA due to conserved functional domains or common evolutionary history. Thus, it is possible to differentiate homologous genes, such as those in the same family, but which may have different functions in phenotype determination.

Thus hybridization data, gained using the method of Example 30, enable the user to identify which of the putative novel genes actually has a pattern of coordinate expression with known genes, a pattern of expression consistent with a particular developmental role, and/or a pattern of expression that suggests that the gene has a promoter that drives expression in a valuable way.

The hybridization data thus using this method can be used, for example, to identify a putative novel gene that shows an expression pattern particular to the tracheids with the lowest cellulose microfibril angle in developing spring wood (early wood).

EXAMPLE 32

Example 32 is directed to generation of a transgenic high throughput cottonwood plant (*Populus deltoides*). Transgenic *Populus* plants are transformed with the following plasmids: 35S(I)GUS; pFOR090; pFOR126; pFOR188; pFOR200; pFOR238, and pFOR292. Control plants were not transformed. Plants are transformed using Agobacterium as described in Horsch et al., Science 227:1229-31 (1985). Seedlings are grown until of suitable size to transfer into soil. Height and diameters are measured on all plants and from these data, a mean seedling volume index is calculated. This volume index is usually more closely correlated with seedling biomass than height or volume measures alone.

Plants containing the pFor238 plasmid shows reduced early growth of the transformed cottonwood (Table 1). In 5 of the 6 lines growth is severely reduced compared to the Gus controls or the non-transformed controls. In the remaining line, growth is no better than the controls. The mean growth rates of all lines in the pFOR090, pFOR188, pFOR126, and pFOR292 are similar to the controls. However, some individual lines exhibit increased growth rates as compared to the controls. See Table 17.

TABLE 17

| Plasmid | Promoter | Gene | Number of lines Represented | Height (cm) | Root Collar Diameter (mm) | Seedling Volume Index (cm²) |
|---|---|---|---|---|---|---|
| 35S(I)GUS | 35S | GUS(int) | 2 | 12.2 | 2.30 | 0.29 |
| 269 | 35S | Muscle LIM protein | 26 | 14.3 | 2.23 | 0.32 |
| 538 | 35S | Putative zinc finger protein | 21 | 12.6 | 2.10 | 0.28 |
| 270 | 35S | Muscle LIM protein | 19 | 12.4 | 1.95 | 0.27 |
| 469 | 35S | Pine AP2-line transcription factor | 1 | 12.4 | 2.44 | 0.31 |
| 277 | 35S | MADS Box (SEQ ID NO: 3668) protein | 6 | 9.3 | 1.64 | 0.16 |
| 127 | 35S | Putative zinc finger protein | 3 | 14.6 | 2.23 | 0.33 |
| Non-transfomed | | | 1 | 13.1 | 2.11 | 0.28 |

For SEQ ID NO: 269, 5 of the 26 lines exhibit early volume production of at least 40% greater than the GUS controls. For SEQ ID NO: 270, 1 line of the 19 lines exhibit volume growth rates of at least 40% greater than the GUS controls. For SEQ ID NO: 538, 3 out of 21 lines exhibit growth rates of at least 40% great than the controls. For SEQ ID NO: 127, 1 of 3 lines exhibit growth rates greater than the control. In total, 10 of the lines exhibit growth at least 40% greater than the GUS controls.

These preliminary results also suggest that the different lines are affecting total plant production in different ways. Some lines show a disproportionate increases in height growth. Other lines demonstrate volume growth increases over the controls due primarily to increases in stem diameter growth. In still other lines, stem volume increases are due to increases in both height and diameter growth. The magnitude of the growth increases are from these early measurements is encouraging. For example, line 1942 of SEQ ID NO: 188 has a seedling volume 76% greater than the GUS controls. Measurement of height and diameter of treess grown in fields is determined. These measurements are used for developing age-age correlations for growth in these studies. The results identify optimal early selection strategies for greenhouse production.

Mean height, diameter, and seedling volume index for all lines for each plasmid is shown in Table 18.

Lengthy table referenced here
US07507875-20090324-T00001
Please refer to the end of the specification for access instructions.

Lengthy table referenced here
US07507875-20090324-T00002
Please refer to the end of the specification for access instructions.

Lengthy table referenced here
US07507875-20090324-T00003
Please refer to the end of the specification for access instructions.

Lengthy table referenced here
US07507875-20090324-T00004
Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US07507875B2). An electronic copy of the table will also be available from the USPTO upon request and payment of the fee set forth in 37 CFR 1.19(b)(3).

SEQUENCE LISTING (3679 sequences)

SEQ ID NO: 1 - DNA, 3305 bp, Eucalyptus sp.
cctgcaccgccctccctcgccgccgccgccgctgccgccggcgattcaatccctcccctcgcctcgcctgctccggctccctccggtcccggcccccgctcccttcggtgatcgcggggaagcctactgatcagctcagtgaagctcgcgcacgccgccggctgaccggccgagccgaaagcgacgcgcgacctccccgccggccaccgatagctccgcgggttcgccgttcggcgagctggctcccggctttgttcgcgggagtcattcgagcagcggaccgaagccggttctcgccgtctcttctttcgccgtctcgcttcgcccgctgcgggccggtcgcggcgttttgacccgttgaccgggctcgagcttcgggaggaggtcgtttggggctttggtcgggattggattctaccggaaatttgcgcgccgttgggggttttttgatgtcggaggatggggtcgtcgcagaagtgcatgaatgtgctgtgcgaggagaaggggtcgaccgagtggaagagaggttggcccctccgatctggtcaactcgccaccctctgcgataagtgcgggtctgcatttgaacaggccacgttttgcgaagttttccactcgaaggactctggatggagggagtgcgcttcctgtggcaagcgcctgcattgcggatgcattgcttcgaggatgctgctggagctgctcgattgtggcgggatcaactgcgcgacctgtgcgaaaagttcaggacttctgcctatcgcaagtgatgagaggcctagtgagtttggcatgattaatgttcgtactggtgaactgcaatctagtaccacagacaaccatttcgatagcgacgaggttgataaactgaagcttattcgattgagaagcagtacagatgattctggcctggggcagtcgcttctgactcagtacaatgacacaaacagatcacatgaaccaacgaacagggaaggagttatcaatacgccttctgcattagaaatgggtggctcatgttatctgctatcaagtaaagcatccaatggagcaactcatgcttcccaaccagacattttaaaagcaaatatagcagcaaaagagtttgatgatccccatgcgcggacagacctcagcatgaccattggcgtccctttaggaaaatcatatccatctttaagggaccacagtacaactccatcactatcaccgcaaggaccaaaatctcgccatgttttgcataagccacctaagccggcctttgcaagtggatttgagtcaaatgccagtgttgtttcacaaatacgagttgcaaggccgcctgctgaaggtcgtgggagaaatcaattgcttcctcgttattggcctcggattactgaccaggagttacaacaaatatctggagattcaaattccacaattgtgccactgtttgaaaaggttctgagtgctagtgatgcgggtcgaattggccgtttagtattgccaaaagcttgtgctgaagcttattttccacccatttctcaaccagagggccttcctctgcggattcaagatgtaaagggaaaggagtgggtgtttcagttcagattttggcccaataataacagcagaatgtacgtgttggagggtgtaactccttgcatacaatctatgcagttacaagctggagacactgtaacttttagccgcatggaccctgaagcgaaacttataatgggtttccggaaagcatcaacctctatgatgcaggacagccaactagctgctgtttctaacggtaaccattcaagtgaagctttgatttctggtggttttgaaaatgtacctatgataagtgggtattcgagtctccttcattcatttaaaggaagcacagatccccaactaaatgcactatccaagcactggagttcagctagtggtgatataagttggcaaggcactgagaaacatggactccctagggatgccttcttgcttcccggaatgtcggccccagagaggaaaagagcacgcaacattgggtccaaaagtaaaaggctgttgattgacagtcaagatgctcttgagctgaaaatgacatgggaagaactccaggatttgcttcggccaccgagtgttaacccaagcattgttacagttgaagaccatgagtttgaagagtatgatgaacctccggtttttggaaaaagcagtatttttatacttcgctccactgggggacaagagcaatgggttcaatgtgatagctgtggtaaatggagaaggttaccagtagatgttcttcttcctcctaggtggacctgtgcagaaaatgcctgggaccaaagcaggcgtttatgttctgcaccagatggattgaccccgagagatctggaaaatcttctgagactgactaaggaattcaagaaaagaaaactagcaacaaccgtcaggccggccctggagcacgagtcatctggtctggatgccttggccaatgccgcaattgttggagatgatggtgacccaggtacaacatcagttgcagcgactacaaagcacccaaggcaccgtcctggttgctcttgcatcgtttgtatccagccccctagtgggaagggcaagcacaagccgacgtgcaactgcaatgtgtgcatgaccgttaagcgccgcttcaaaaccctaatgatgcgcaagaagaagcgccaatcagagcgtgaagcagagattgcccagagaaaacaactctggggctctaaggatgagattgaagttgatagtacctctgctcatcgatcttcacatcacaatccttcagaaaatgaatccaggattggaaatgagttggagtcccagagccaaacaaccaactcggccaacacatttgctgaaacaggcaaaggacagataaacttgaattgccaacttgatctgaattgccaaccagaccgtaacgaagatcttaaattggggtcgagtcaaacaagtatgatgaatcttctccgggtggctagccagccgttggagacgtatttgaagcagaatggtcttgcgagtttggtatccgagcagcaagcaagtccagcaggtcacgtgcaactccaaggtgctaccacagacaatgagggacaaccttcggaggatcactgcgctgattcagagattcaagagatggctctggaaaaggatgatacggacgaaaaagactccactccagatcagggcgaaggcgacccttagggaagtcccccggatctcctctttagcttttctttttcccttgtctgtgaatgttccttagatcacacgcttctagcaaa

SEQ ID NO: 2 - DNA, 1221 bp, Eucalyptus sp.
gtctctttctgcctctcgatactcttctgtagctccccacatccaagatcgcagtgcttcgataaacgcacgcgaccgcagggcctgaagagagagatctgccttcgtctctctgactccggcgggcatctgcaggaaaaaggagcgatcttttccatggtatgatggcttcttcgatctcttcatcgagtccccgcactgtagaagagatcttcaaggactacaacgctcggcgcaccgccctcgtccgcgctctcacttacgatgtggatgaattctactcgctctgcgatccagaaaaggagaatttgtgtctgtatggtcatgcaaccgaaacatgggaggtggctctgcccgccgaggaagtacctccagagcttcctgaaccagccttgggcattaactttgctagagatggaatgaaacgcaaggactggctgtctttggtggctgtgcacagtgactgttggttgctttctgtggccttctactttggtgctcgacttaaccgcaatgaaaggaagcgtttatttagcctgataaatgatctgccaaccctttttgaagttgtgacggagagaaagcctataaaagacaagcctaacatggacagtgggagcaagtcgaaaaacagcactaagagatccattgatggaccaactagaagcaccccgaagccatatgaagaaaactatggcgaagaggaagatgaacatagtgaaacactctgtggaagctgcggcggtaactacagtgccgatgagttttggatctgctgtgacatctgcgaaaggtggttccatgggaaatgcgtgaagataacaccggccaaggccgagaacatcaagcagtacaaatgtccttcttgtagctcaaaaaggagcaggcagtagtagctccggaggctaatagcatgtggaggggtttgcttgcaagcatgacaactttggcggtttaactacagcatctcatggtaattaatatcatccaaaagcatcaaatctgaagttagtcctctaattaatactacaattctttttgcttttctgctaagttatgtttgaagttttagccgtagaaaagtcagtactttgtccttggacaagatttcggctgctttctgcacaaatcagtctctctatggatgtttgtactgtaagaaatgttttaccctaatagtagtttacaatatatgagctgattgttcagttaaaaaaaaaa

SEQ ID NO: 3 - DNA, 1200 bp, Eucalyptus sp.
ggtttcgattagcgtcaccattagccaaaagagcaaaaaaaaaaaaaaaaaaaaaaaaaagaagaagaagaagaagaagaagaagaagaagaagaaaaagacactcaattaattctgacagagaacgaaccctagacagccaaaaagggaagaagagaaaagaagggaacagaagggaagcgggatggatgaattcgctcaggaatagcaattagcaagcagcagcagcagatcgacggacggagcgagggagcgagacgaaggaaggaaggaggagggaagtgggggattgaatcatcggcgtatatggagggaataccgcacccattcccaaggacggtggaggaggtcttcagcgatttcaagggccgacgcgccggcctcatcaaggctctcaccgctgacgtcgagaagttctaccagcagtgcgaccccgagaaggagaacctctgcctgtatggatttccaaacgagacctgggaagttaatttaccggtggaggaggtcccccccgagctcccggagcctgctttaggaatcaatttcgcaagggatggaatgcaagagaaggactggttgtccttggtcgccgtccacagcgattcctggttacttgccgttgctttctatttcggtgcacggttcggtttcggtaaaaacgaaagaaagaggcttttccaaatgataaatgatctcccaactatttttgaagttgtgacgggaaatgttaagcaagcaaaggaacaatctgctaatcaaaacagcaaaagcaaatctagtacaaagatgtctgatccacaatccaagggagtgaagatgtctccaccacccaaacgagaagaggaaagtggggaagaagaagaagatgatgagcagggtgccacctgtggagcatgtggggatagctatgcaaatgatgaattctggatttgctgtgatatctgcgagagatggttccatggaaaatgtgtaaaaattactccagcaaaggcggagcatataaagcaatacaaatgccccagttgcagtaccaagaaggctagagtctgaaccatgttcagaaattggacatagatcaatcaagaaggctagacaagattgagaaatttctctttgcagtttaatatggacactgtagttgggaactggcattgcaacagtgggacttaagctacactcttcttctgtccaaaaaaaaaa

SEQ ID NO: 4 - DNA, 1347 bp, Eucalyptus sp.
gcccttcccttccctcctcttcaaaacgcacatttccccaatccctctctctctctgtgaaattcctccgttccgcccgtcgccgccgccgccgccgctgccgagaaatgccgatcctccgcccgctccgccgccgccgcgccgcccgtccccgctcctcgacgcgcgaattcgggctttgagattccgaatctaccccccgctcgccgtcgccgcggcggccttctccgagagagaaaagctcgccccctgttcgcgcttcttcgaggagagagagagagagagagagcgagagagagaggttgttgcgcgggcggacggagttggagagagatggatgggggagggcagtacaaccctcggactgtggaggaggtgtttagggatttcaagggccgtcgcgctggaatgatcaaggctctgaccactgatgttgaggaattctatcagcagtgcgatcctgagaaggagaatctgtgcctgtatggattccctaatgaaaaatgggaagttaatttgcctgctgaagaagtgccaccagagctacctgagcctgcacttggcattaactttgctagggatggaatgcaagaaaaggactggttatccctggttgctgtacacagtgatgcatggttactttctgtggccttttattttggtgctagatttggttttaacaaggctgacaggaagaacctgttcgccatgattaatgatctcccaacaatatttgaagtcgtaactggaactgtcaagaaacagacaaaggagaagatatcggtttcgaatcacagtagcagcaaatccaagtctggctcaaaagtgcgaggatcagattcaggcaaattcacaaggactatccaagcaaaggatgaagatgacgtggtggacggagaagatgaagaagagcacggggatactttgtgtggggcctgtggggagaactatgcttcagacgagttctggatctgttgtgacatgtgcgagaagtggttccatgggaaatgcgtgaaaattactcccgccagggctgagcacatcaagcagtacaagtgtccctcctgcagcaataagagagtgcgtacttgatatagctggtgccgtgcccataagctctctccccctcgtagtttcgttaggttggtatatgctaattgctgtcaggtcgtcaagttttcacatcgtaccaaacatttggtgttgggaaccttgtcatcgtggttcacatttgtaggtatcaggatttaagcatttacctaattctagattaggagttatttgtactttcagttcgaaaacagtttgtccttacattgcgtaacatgctctctctcaaaaaaaaaa

SEQ ID NO: 5 - DNA, 1162 bp, Eucalyptus sp.
gctctctctaggaattccctctcctccgtgctcaattcccgaccccccaccgcctcccctcctccgccgttcctccgaattcaggggtccttgagctccacgcttcgtcgtcgttgtgccatcatggacggaggcgcgcagtacaatcctcgcaccgtcgaggaggttttcagggatttcaagggccggagggccggcatgattaaggccctcaccaccgaagtcgaggagttttaccagcagtgcgatcccgaaaaggagaacctttgcctttatggatttccaagtgagcagtgggaagtcaacttacctgcggaagaggttccaccggagcttccagaacctgccctcggcattaattttgctagagatgggatgcaagagaaggactggttgtctttggtcgcggttcacagtgatgcatggctactttctgtcgcattttattttggtgcaagatttggatttgataaagctgacaggaaacgccttttcaatatgattaatgatcttcccacaatatttgaggttgtgacaggcacggctaagaagcaagtcaaggaaaagtcatcaattacaaataacagcagcagcaaatctaaatcgaatcccaagaaagtatcagaatctcagacaaagtatacaaaggcagtgcaaccgaaggaagaggaggaggaaggcttggaggaggaagatgaggaggagcacggggagactctttgtggggcgtgtggagagaattatgcctcggatgagttctggatttgctgcgatatctgtgagaagtggttccatgggaagtgtgtcaaaatcactcctgcaagggctgagcacatcaagcagtacaaatgcccatcttgcagcaacaagagatcccggccttgatagttgcttgggaggtagctgttcaaatggttccttttccttgactgctaattgtgtagttggtcactcttattagtttggtgttccttggttagagaaagttgtgtaggttgcagatcagttgttcattaactaaagattcatatttttatggttgagttaaggcggaattcagactttcctgttaaggacacctttttttttttttttaaatgtcagttgtaattttaatttacggaagatgtaatgtctcctcgttccagcttcaaaaaaaaaa

SEQ ID NO: 6 - DNA, 1155 bp, Eucalyptus sp.
gagaatagagagagagagagagagagagagcgagagagaggttcgacgatggagggagcgcagtacaatccgcgcactgtggaggaagtcttcaaggacttcaagggccgccgcgccgccttgatcaaggccctcaccaccgatgtcgaagaattttatcagcaatgtgatccaggaaaagagaacctttgcttgtatggctttccaagtgaacaatgggaagtgaatttacctgctgaagaagtgcccccagagctcccagagccggtcctaggtataaactttgcaagagatggcatgcaagaaaaggactggatttctttagtggctgtccacagtgattcctggctgattgcagttgccttctattttggtgctagatttggatttgataaggctgataggaagcggctctccaatatgatacatgaccttccaacaatctttgaagtggtgactggtactgcaaagaaagaaagggcaaggtcgtcgggagccaatcacagcggtagcaaatccaagtctgcttacaaagggcgagcatctgactctcggggaaagtacacaagagaactaccggagaaggaagaagaggaggagctggatgaggaagatgaggaggagaatggggagaccctttgcggagcatgtggggagaacagtgctgcggatgatttctggatctgctgcgacctgtgcctgaggtggttccatggctcgtgtgtgaagataactccagctagggccgagcatattaaacaatacaaatgcccatcctgcaataacaagagagctcggactggaaattagtccactgcccaggcgatgcagcgcacttcccttgctctgcaatctcgcctgccctgctgctggattctcgtctgtcttttactagcaccacattgaacctttattaggatatttaaattagacgttgggagctatttttatttaattcacatgtgacattttcatttggactttcggttatacagatgtagatgctgtcaggcaagatgcttcacgacgtttgcgctccttttcccatttgcttgctggtagttcatggcttaagccgatgtcgggatcgtccgtcaatttatttccatttagtttttccttacaataaacagccatttgtcctgaaaaaaaaaa

SEQ ID NO: 7 - DNA, 1426 bp, Eucalyptus sp.
gggagcgcctccccctctccctccttatacgacgtctgcgttcgcctccaggcaagtccgcagcgagtccgtgagcgttagggtctcggcaggtactatatccatcgggtctgggaactaccaacaaacattcgtagaccctgaaaatatacacgaaatcccatcgaagctctccgacccggtttgataatccagaaggccctgtccggtccggttttcacccatccatccttctcttcgatgtttaaattcggcttgatttagttcaagtcaagtttaatttcgtcaaactctcggcagcaacagaagagtctatggaaggcggttcagggccatacaatccgcgcacggtggaagaagtctttaaagacttcaagagccgcagaaatggattgataaaagccctcacaacagacgtggaggagttttatcagcaatgcgaccctgacaaggagaacttgtgcctttatggattcccaaatgaatcatgggaagttaatctccctgcggaggaggttccaccagagcttcctgagcctgcattgggaatcaattttgcaagggatgggatgcaagaaaaggattggttatctttggttgctgttcacagtgatgcatggctactttcagttgccttttattttggtgcacgatttggttttgataaaaatgacaggaggcgtcttttccacatgattaatgaccttccaacaatatttgagagtgttactgggattgggaaaaggccaacaaaagaaaaaccggctgttaccaacaacagtagtagtaaaaacaagcaaagtggaaagatgagagcatctgagcctccgatgaaaatgtcaaagacaccaccacctagggatgaagatgactcattggatgaagaggacgaagatgagcatggagaaacgttgtgtggagcttgtggagataactatgcctctgatgagttctggatctgttgtgatatgtgtgagagatggtttcatggtaaatgtgtgaagattactccagctagggctgaacatatcaagcagtacaaatgcccttcatgcaccaataaaaggccccggacctgaaaatgcacaaataatattttgaacaatggacatcctccgatggttttcaagcatggaggctgcagtccccaagtatttgtgtgcattttagcagcttaaaggatacacatgactttcctcaggctaatgctggtgaaacatatgaggagctgtagacagttttcatttttatattgttttaggtttttgtttacaattttaatgtaatactctttagtttctatcgtcctgtgtcgtactgttaattacatgcaaaaattgtgtaatatttctttgggctgatgttatgactgtaagatagctgttttaattaatattcaaacaaggtttccggttcaaaaaaaaaa

SEQ ID NO: 8 - DNA, 733 bp, Eucalyptus sp.
gaccaatcttcactccccctatcccctctctctctctctcaagaactaggagcttgctatggaaagcgaacgctacgatgagacgacagagaagcagcgaatcaggagaaggccgcaccagaagccgtacaggggtatccggatgaggaagtggggtaagtgggtggctgagatcagggagcccaacaagcgctcccgtatctggctcggctcctacgccaccgccgtggctgccgcccgcgcctacgacaccgctgtgttctacctccgtggcccctctgcccgcctcaacttccccgacctcatcttgcacgagggccaggactcgctgggtgaggtctcagccgcctccatccgcaggcgtgcagctgaggtcggggcccaggtcgatgctgtccaggcggcggcgccggccgagtcgaggccatgccgcaccccggacttgaacgagtacccacaactggaggacttgggggagattgatcacgagtctgtgttttgaattagtttctttatgggaaaagccgggttcaggaagaaatactggttgccccagatcaaagaggcattcatctaggccagggctgaagagataggagcaaatgaagaacagtgatctctttgctggtgcagaccagcgccacgtccgtctccagttttgattaagaaaagaaactgtagagcctctagttcttcgagcgtggatggaatttctatttgttaattgcaattt

SEQ ID NO: 9 - DNA, 859 bp, Eucalyptus sp.
gtcgactccccctatcccctctctctctccctctcaagaatcaagagattactatggaaagcgaacgctacgatgagacgacagaggggcagcgaatcaagagaaggccgcaccagcagcagcagcagcagcagcagcggcggcagaagccttacaggggtatccggatgaggaagtggggcaagtgggtggccgagatcagggagcccaacaagcgctcccgcatctggctcggctcctatgccacccccgtggccgccgcccgcgcctacgacaccgccgtcttctacctccgcggcccctccgcccgcctcaacttccccgacctcatctggcgcgagggcgaggactcgctgggcgaggtctcggccaactccatccgcaggcgcgccgctgaggtcggcgcccaggtcgatgctgtccaggcggcggcggccaagtcgaggccatgctgtgcccctgacttgaacgagtacccgaaactggaggactcggaggagtttcatcgcgaatctgtgttttgaaatactttcttcatgggaaaagacgggttctggaagaaaaactgactgcctcagatcaaagaggcattaacttaggccagggctcgggagattgaaggaccaaaagaagaacagtgatctctttgcgcgtgcagaccagcgtaacgtccgtctccagttctgattaagaaaatagattttagagcctctagttcttcgagttcgggaggaaatttcttgtacaatattcctagatcatagagattaagctcttctctttggttctcagatgggatatctccgtctcaccgatgctgggagctttaccataaacagtgacaatatagacagataca

SEQ ID NO: 10 - DNA, 1184 bp, Eucalyptus sp.
gcccaacaagagaccctagatgcaaaccctggaattctcttcccctacctccatcatcgtcgtcatcatcacaccccagtagccaccataattgaggaagtaagcaccaaccctcttcttcttcttcttcatcatagatttgtcggtgaatttggatttctccgctctctctttctctcttcttcctcttccgtggaattcaacgatggagttcgcaaaaggtgacgcctttcctctcccttctcttccctgaaaccttttttgcccagattagatgaaccctcaatcggcccaagaccctttctgattcgaactccgtcacttcctctggaggatagagagaaagatttgttgtgcctcccctttttttcttggtgggtttagatgatggtggaggaggaagcggtttcgggggtcgccggccaagagagcccggcggcggcgaagaagagggggttgaacggcagggagaggccgtacaaggggataagaatgaggaaatggggcaagtgggtggccgagattcgggagcccaacaagaggtcgaggatttggctggggtcttactcgacgccggtcgcggcggcgagggcctacgacacggcggtgttctacctccgcggaccctcggctcggctcaacttcccggagttcctgggggcggcggcggcggagggcggcggcggcggcggcagctgcggcgacatgacggccgctttcataaggaagaaggcgaccgaggtcggcgcgagcgtggacgcggcgctcaacagcggcggccacggatcggtgctcaagaacggcgggtcgggtttaggtcacgagtacaagggctgtggtgggttcttgcagagggtggtggatttgaacaaggtgccggagcccgaggactcggatggtgaattcgagaaagcttagggggggaaattgggaaaaaaagaagaagaagaaaaaggtggtcctgatttctccctgtttctctctttccctctggcggtgtttgaaggagggtggtggtcttggtggtggtggtggtggtggctgaagatatgatgaggcctaagtggggttagtcttttactgtctctttttgtttagtttttgatttgttccttttttttcactctttcccctttcgaatttttggatttggatcaagaaattttgatgctgtaaaaaaaaaa

SEQ ID NO: 11 - DNA, 1108 bp, Eucalyptus sp.
caaaccccaccctgataagttcccagcaacatagagacactcacagaaacactcgcaaaaaacctctttgctgtcttccatggttccgccattcccgactgcagaactgcctctcaacgagaatgattcgcaagacatggtcatctaccatgtcttgaacgaggccatgtcccagaacaactcctccctcccgcatccgaaccaatctgggtccccgtcgagcggcggttccctcgagccgtccaggggcatcacgaagaagcactacagaggagtccggcggcgcccgtgggggaagttcgcggctgagattcgcgactcgttacgccacggggcccgagtttggctcgggacattcgagacagccgaggaggcggcgctggcttacgaccgggcggcgttccggatgcgcggcgccaaggccctgctcaatttcccgccggaagtggtggccgcgtcgatgccgatggagaggtatgatccaagccggagccagagccccgggtcggccaattcggacacgagaggccagacgcatcggtcggattctgaggttggcatcgccggaggagcatcccgggatgtggccactgaacacctcgagaaggtgttggatgtgttctgaggttgagcgtctccggtcactcacgactcttgcgggtagcctgggccatgtactaggggtcaaaaaagttctattttcttgccaattcggattactttttggtgtcacataagtttttcatcatggttttttgctcgtcttgagtttcaatgtggtccattgtgtgatccattctgtctaaatgatgagcaaatccgggcatctctctccagatgatgatatctttattggtcccttttacaacaacaatcagaaggactatattgaacaactttgcagaatgcacaaagtgctacaataaggtatagacatcgcgaagacaatgcattttgtccttgctagagtttttggttttgctgattcataggttgtctcttaggttatcgtacttcggctatattgtataagcaatgcgaaaaagttcaggcgtaagcttctgattgggctatatatacgctctgcaatttttgagtaaaaaaaaaa

SEQ ID NO: 12 - DNA, 1007 bp, Eucalyptus sp.
gcacttcttgcgcagacaattgcagactctctctctctctcattcaggcgcctgtcttctcaagcattttgtcaaagaaactcctttgttttttctctctttctctctcgaccatggcccgaccgcagcagcgatatcgcggcgtgcgccagaggcattggggctcctgggtctctgaaattcgccacccgttattgaaaacaagaatttggctagggacgtttgaaacggccgaggatgcggctcgagcctatgacgaggcggcaaggctaatgtgcgggccgagggctcggaccaacttcccttacaacccaaacatgtctcagtcttcttcgtcgaagctcctctcggcgacattgacagcaaagctccacaggtgctacatggcctcgttgcagatgaccaagtctgcattgcaagtgcaagagccacagaagccacccagttctcattttgtcaacgccaatggtatctttgagaggaacaacgatatgggtcatcaaaagatgcaatttcaattgcaagaatcagagagttgggtgatcaagaaagagaaagtcgaggaggccgagacccaacagttcaagcctctcgaagacgatcacatacagcaaatgattgaggagcttctcgactacggctccctcgaatttagctctagcatcgcctcctaggagtctgaagatttagcagcaagaaaagattctgaagctagcctcgaattttatccgcatttcacctactaatgcctctctctcgtcccactaatttaaccccatttcccctgaattcactggggctgcttcgcgtaatttttagatttttccttccaattcctagaactcattccctagagatggcacatttgatgatgctacgtgtacagtgctgtactatgccgctatttacgatgcctagtacttacgttaagctttagtttgtattcacattgtaattttctctgttttgagaagcaatgcaagacttcctctgtttcaaaaaaaaaa

SEQ ID NO: 13 - DNA, 2601 bp, Eucalyptus sp.
gctcaagcaacggcaatagctcatttttcattcagacacatcacaaacaccttcaaacgtttccttctctctactgcacatcgctgatgactcgaactcagcagcgatatcgaggtgtccggcaacgccactggggctcttgggtctccgaaatccgccaccctttacttaagactaggatatggttaggcacattcgaaacggcagaggacgcagccagggcatacgacgaggctgctaggctgatgtgtgggccgaaagcacgcaccaactttccctacaatccgaatgagcctcagacgtcctcgtcgaagcttctctcggcaactttagccgccaaattacacaaatgtcacttggcatctctgcaggtggccaagaaaagcgcgaaaaaagagatcgatgactcacatcccgggcatttcaggcgggaaggagatcgaaccagcagccaaagaaatggagatcaaagagcgggtgggtggtcggaggaaaaaccaaccgttgtccagtggcatgagatgaactgggatagtgatgaaggccacggagacaacagtgttcagcaatttaggccacttgaggatgaccatatagagcagatgattgaggaattactcgattatgggtcaattgagctctgctctgcaattcaaacatagcttctaacctgctagctcttttctttctataggtagtttctctccctttcctgaagagatcgtaggattcaatcctaggtcattggtatgaaatgccaaagactctgcccatcagaagcaagcaagaaggaagggatgaggagaagtggaaaaatccttgttatatgaagtacctctcatgaagctgatccacggatcccaaagcacaaaagaagtgtgaaaactctcttgtcctacctcctttgcatggagacatggtcccgcaacctctatcttttctattctttccgtggttaaagtgacgatgatcctaatcgggagcaacgctaaatatactagagcttaactgcgaactgctcgcaaaatgacatgaaaataccggtggaattgaaaagcgggtgaggctacaaggagggtaaaaccatacggttaattggcacgttcataatttagaaggttggtttgatttatctaattggacacccaacaacagagagatttagagggcccgtgtcatgcaattgcgaacggttcttgaccctaccacgcaaaacacaagctccaatccagggaaataggaatacccaaatgaaagaggacaaataaaaagggttcatgcgcaatgttgctgcagaaagagtgtcttttccatggggccattcagcagagagtgttgtcccattcggtctgaaccctccattttcgctctgagttcacaaacaaactcgccaacatcctcttccagtgtgaacaaagatcgcccttttttgttggtgcaactggcagtggtagaaccatgtctacatctagacgtacattctcattgttttctcacttgctttcacaagctgacaagggactttgttatcatctccagaaacaacacttttgaccaatgcactcactccccccgatcaccctacacgagaactacggagtcctcgctcattcctctagtgcagtatcaccacagtgaacatgctcagcaagatattatagtttataatccttgtcatcatgaagcatgattgtcgagtaagcaaaggattgtcccttggagcttgcttaaagaatggtaaacctttggtgtgcttaggttattcagcaacatggcgcccaagttttcttttgcaagatctagcatctcccaacaccatggtcccacaaatcaatgtctcaggctgctttggcaggcagaaatcaataattaaatgtcgatttgctcagatcaacaagatttgagcatgcaaatggatgcagatcctattgctgaaaaactgaaaaggcgattcacccgctcccattggttgaaactgaggttctaaaaactaaatcccatcactctggatatgtagaaatcagagatttatgatcatcctgaaagagtaggatgacaatgaaatgaaatctttttttatgcttttagaaaaagaagttgcaaaatttttaactttttcttttttgatgagaaatttcatactttctcacccatgatgttattgttttcttaatgactgaagaatcttcttcctatcatctcttggtatttcttagtaattttatttccattagacattatatatgacattacatataaattgtctctggcctcactgcaatggacccttccttttctttgttttgcctatcaaagataattttccctttccctcccagggtaatttaattgacactcactcaattttttccacaaagagaaaaaaattttaagttcatgggaaagagattcttaattacggaatgcagaaactgtgcagctttcagcagcttaaccttttttccccttattgtggtatgaaacttggttctgtgctggttgttttttttcttcctttgggtaaaagctgcttgagctgatttactaattgtataatcattgagacgatggtggaatctaaatcctgttgtaaaaaaaaaa

SEQ ID NO: 14 - skipped

SEQ ID NO: 15 - DNA, 925 bp, Eucalyptus sp.
ccaacatcgttctcgagaacccagctccatcccagttcgacccatctgagaacaagtcaacccagatcgtcaaaatcgaatcttgactcgagggagaagcggagaatgacgaagcgcagcgcagccaaggccgcggcggtgcacgagggcgagggagcgaggagcgagctgaagttcagaggggtgcggaagaggaagtggggcaggtgggtctccgagatccgcctgcccaacagccgggagaggatctggctcggctcctacgacacccccgagaaggcggcccgcgccttcgacgccgccgccttctgcctcggccgccccgccgcgaagctcaacttccccggcagccccccggagatctccggcgcggcgtccctctcccccgatgagatccagtcggccgcggcgagctacgccaacttcggggccgtggccgtgccggcccgggccgagctgccccgaccaggatcgccggccccgtcgccttcgctgtcggcctcggaggcgagcagcgtgctgacgaccgagagcgacctgaccctggacctatcgttcctggattttctggatgattcgggcccggtttccggcgagccccatatcgggaagttcccgggcgtggaggaggctcccgacgttttctaccacatgcagttcccgagcgtggagagcgcggggctgaatctcgatactctattggcttcagacagcttcccgtggcgtatctgaagtggactgaaggaagaagcctggccgatcatttctctcttttttttttctttttttttctataattcttttgatggactagattttgtggggtcgtcatccacttcaggataatacagatgacaagaactgactttttatggtgtaaaaagacgtagcttttttgttggttcggttcaaaaaaaaaaaaaaa

SEQ ID NO: 16 - DNA, 1013 bp, Eucalyptus sp.
gcccgttctccacaacaagcgactctctctctttctctctctcctccaactaaaatcccaagcctcccaagtctctccgaccatggctccccgggagaggcccaacgccgtcaccgtcgccgtcagccccaggccccagggcggcgccaaggagatccgcttccgcggcgtcaggaagcggccgtggggccgctacgccgccgagatccgcgacccaggcaagaagacccgcgtctggctcggcaccttcgacaccgccgaggaggccgcccgcgcctacgacacggcggcgcgtgagttccgcggcgccaaggccaagaccaacttccccaccgccgacgagctcgtcgtcgccgtcgccgccgccgcccgcagccccagccagagcagcaccgtcgacaacgcctcccctccgccgcccccggcgccgccggcgctggacctcagcctcggcggcttccccttcgccgccgcgtacgccgccccggccgcgtgcttccccgtcatcccggtggcgcgcccggtgttcttcttcgacgtcttcgcccgtggcgggcaggtcggggacagcttccccagggattgtaaaccactccgccccgcggtgagcgagtttttcccgacggtcgggagcggtggggtgaagagcgagtccgattcgtcgtccgtcgtggactccgacgtgacccctcgcagcagatcgttcctcgatctcgacctcaaccagcctccgccggccgaggcggcttgagattttcttttttttttcctcccggagggaccgtcttgatcggcggcggatttgcgaatttttcggtggcgattcctgttttctgtggttcgaagtcgaagacggaaagcggatcttccatgtagagagagaaaatagcctgacaattaattttcggttcggcggttgacggtgacgccaaaattagctgatgacgacaacgatgacttggatatgtatataagtgattaaatataactccagttttttagcaaaaaaaaaa

SEQ ID NO: 17 - DNA, 899 bp, Eucalyptus sp.
tcacttcctcctgaagcatcggtgcaagagaaggccaaagaagaagaggaagaagaacaagacgaagagccgtgcagtttctcgtcatcctggtccgagaccgacttctcgaccatggtcactactctcactcaagtcatggacaccaccgccaccaacaccacaaatcttcccagctcagcttattcatcagttgaatccaccaccacaactctcgtctttgactcgcctcaaccatctcaaaatcaggagaatagcaggatgacgagaagacactatagaggagtgaggcaaaggccgtggggcaaatgggccgccgagatacgagacccgatcaaagcagctcgggtgtggcttggcacgttcgacacggctgaagcagcggccctcgcctacgacaacgctgccctcagattcaaaggcaccaaggccaagctcaatttccccgaacgagttcaaggcaacactagtacgagcatccctaggaacgtgtaccctcctcgcaatctatcgtcattgtccggacaaagcatcaacgccatgccgtttaatccatcagtgacaacgacggcatcgtctcatgaagcatacccgcacttgattcagtacgcgcagcttctctcaagtagtgatgcggagttccccatcattacttcgaccttgttgggtcaagagcactttggttccccatcttcgatgtcgtcgcctcgacaagacgaggtggcgagatcatctagttatgattttcaggatgctgaggaatacaagcctggtgaccgaagcaagtgaagaggaaagtgcttttgtgtgtgtctttggaacattctctttggaaatattttggtctggttaatattggaatgacgcacagatccaagcgtgttgtgttaggcttgatt

SEQ ID NO: 18 - DNA, 977 bp, Eucalyptus sp.
gctctctccctccctctctctcccctctctctctctctctctctctcaaaagccaaaataatggagccactcatcaacaccaaatgcattgaagctcaaaccagcacttcctactcctcaaatagtccctcaggatcaagctcttcctgctcaaagaaagctggagcagcagggagtggttctagcgactccagtaagcagaaggagagctcggacggcccgaattaccgcggggtgcggcggcgccaatggggccggtgggtgtccgagatccgggagccgaggaagaagtcgaggatctggctggggacgttccagacggcggagatggcggcgcgggcccacgacgtggccgcgctcacgatcaagggccggtctgcccacctcaacttccccgagctggccgagctgctcccccggcccgcgagcaagtcggccaaggacatccaggcggcggcggccctggccgccgcgatcagcttcccggggggcgacggagccgccgcaggggaggccgggccgagccggcctcactccccgaacgccacggcggagtccttcgacacccaggagtcggcgagttcgccgctggataacgaggacgacacgttcatcgacctgccggatctcctggtgggcttcggcaacaggatggaggagctctgcatgtcgttcgcatggcaagacgaagatggcacgagattcagccacggggatgacccttttctctggaattagccgtcattattaccacctcaattccctgccaaaatagaaaatgaatgactgtgtacatcccagtttcggttgaactgagtgatgatgatggtgataacagagccagccgttttcctgtcatttttgtggtttgtcacataaaggtggttcatttttggatctttcttgttctctctctctttttttttttaggcatgagagtcttatataagttcttcattccttgtataaaaaaaaaa

SEQ ID NO: 19 - DNA, 1145 bp, Eucalyptus sp.
gctgcttctggtgccgtccacttccttcttcccacctccatcttcatctctccctccctctctctctctgaatctaccgaacccttctcgccgaaggaggagagagagagagagagagagagagacgggaagaccatcgctttcggccatcgcgtgcacgagcagtcatgaggagaggcagatgcgccgccgcggccgcgaagagggaggcggccgagatagcgccgccgccggtgccccatgcggctgcggcggcggcggcggaacccagatacaggggcgtccggcggaagtcgctgggccgatacacggccgagatcagagaccccgggacgaagaagctcgtgcggctcggcactttcggctcgccggaggaagcggcgcgtgctttcgacgcgaaggccgtggcgttccgcggggtcaaggccaggaccaacttccccgtcgccccgtcgagtttccctccggccgcttctcgcgatctgcgagctccgttgattgaatccagaaagttcggtcggagaggcgctcgagatcttcgcggcgaccaccacgacgtcagcccgcagagaccgacctcgagcagcttaagcagcaccgtggtgtcgtccagtggtcctcgaccgtcgccgccgccggagacggcgaagcggcggactaggactccgccgccgccaccgccgccgccggaggattgtcggagcggctgcggttcctcatccacggtgattgatgacgagggcgaggatttcgcgtcttcgtcgagaagagaacccttgccgttcgatctcaacctcctccctccgccggagatcgacgatttccagttcacatccctgcgcctctagggaggatgaagacgaaccgacccgtgtgatttctcgcgctattttcttcttcttcctcgtctttattactaagttaaatcaattagcctcttctatcacgaccttttattgtctcgggtgatcattgtcgccacgacatgtagcgcagtggcgatatgccgtgtcatcaatctgaagtctgatgtgaggataaatggggttctttaggtacctcgaccccaggctccctgaaagtgtgtttgtacatttaccagatgcagtaaccactaaagaagtggatttgttccaaaaaaaaaa

SEQ ID NO: 20 - DNA, 1001 bp, Eucalyptus sp.
acaaacaaacaaacaagacggaacgagatgaagacggttcagtcgaagaagttcaggggcgtcagacagcgtcactggggctcttgggtttccgaaattcgccatcctctgttgaagagaagggtgtggctgggcacgttcgagacggctgaggaggcggcacgagcctacgaccaggccgccatcttgatgagtggccgcaatgcaaagaccaacttcccgacatctcaaaccacgaacggcgaccccgccgctgccaattccttgtcttcctcgaagcacttgtcggagatcctccacgcgaagctcaagaaatgcagcaagacgccgtcgccatccctcacctgcctaaggctcgacactgagaactcccacatcggagtctggcagaagggcgccggccagcgctcagactccaactgggtcatgaccgtacagctcggcaacaaaaataccgattccattggagagtctggagaccatcttcctcttcctcatcctccttccacttcttcttcttcttgttgctcatcttcttcatcggtgccgtcaccattgttgccgccgcagccaccgccttcagagctgatggcgaggggcaccatggaagaagaagagaggattgccttgcaaatgattgaagagctcctgaacaggaattccgctacccctacttttgaaaacccggaggaggaggatagtttttttctctagtcctttaaaaatggtaaatctaatgtgttcttatgatattgtgtataaagtattgcgagaagtcgttatacttttgaaaatgacaattgtgatgtatcggtgaagatagtgctcgagataaataatgtttacagggaccgaacatgggggtagaggaacaaatttaagggagtgcggggatgtattactaaatatgtaaaattgtgggtccaaaatgtgtggcttgtatgcagggaagaaaaagattggatggttaacacttgacagcatttctcataaaaaaaaaa

SEQ ID NO: 21 - skipped

SEQ ID NO: 22 - DNA, 1008 bp, Eucalyptus sp.
ggagcttccgcaacgaggcgataccatctccggcccgcgtcttgctcttccctctccaatcccatccatccctccatccatccatccatccgcccgaaccctccctttctctctccatctctctcgcgcagcatgattccgagccgagccgccgcggcgcccgacgacgtcccggaagtcgccggatcggcaccgaaggggcacgtacaacagcagcagcagccgcagcaacaggtcggcgccggcgagcccaagtacaggggcgtgcggaggcggcggtggggcaagtacaccgccgagatcagcgaccccgtcaagaaggcacgcgtctggctcggcaccttcgcctccgccgaggaggccgcccgcgcctacgacctcgccgccgtccggttccgcggctccaaggccaagaccaacttccccgcctccctctacgaccgcgacgacgcccaggcccaggccccggcccggatccgccgccacgccgcggcgcgggaggacccccagcaaggccggcgggcgttcccgcagcggccgacctgcagcagcctgagcagcaccgtggagtcgttcagcgggcctcggcccccgccgtccgccgccgccgcggcgccgcagcagcagccggagaagaggtaccggaggtcgccgccggtggagccggaggactgccagagcgactgcgattcgtcgtcgtccgtggtggacgattgcggagggggcgtcgaggaggggtcctcgtcgacgtcgtggttcaggaggaggggtcctttgcctttcgatctgaatctgccgccgtcgtcgggcggggtcgaccttgacggcgaagatctgcggttgtgcctgtgagtggttgggcggcccgtaaagagatattaaaagccatgtcttgaattattttttattttttttcctctctcccgatattctgcttgtattctcattgcggaaatggaatgaaaaagatgagatgaaagaagaaaaagtctttaactaaaaaaaaaa

SEQ ID NO: 23 - skipped

SEQ ID NO: 24 - DNA, 1035 bp, Eucalyptus sp.
cccttctctctctgcccttctctctctagaatttatggcgatgaaggagaaggcgggttcgggcggcggcgccaggctggcggtgagggaggcgcactaccggggggtgaggaagaggccgtgggggcggtacgcggcggagatcagggacccgaagaagaagagccgggtgtggctcggcaccttcgacaccgccgaggaggccgcccgcgcctacgactccgccgcccgcgacttccgcggctccaaggccaagaccaacttccccctcccctcggagcgccccgtcctcctcctcgccggagccgccggaggagcagcaggagccgccggcggcagcggcggcggcggcaagggctgcaacagccgcagccccagccagagcagcacggtcgagtcctccggccacgacccggcggcggcggcggctgcggcgccgatggtggacttctccgcgcagctggatctcaacctcgcctaccaccacggcggcgcgggcgcgggcgcgggagcgggcggcgctgtcgggttccggttcccgcaccaggtcgcggcggccgggccgtacgggcccttctacatggaggcgatggcggcgcgggcgggggcgatgaacaaccagctctaccagcggatcatcttcgaccggcgcgcggcggacggatcccggagcgactccgactcgtgctccgtcgtcgtggacgcgagcgaccgcggccagaagcccgccgccagggtgctggatctcgacctcaacgagccgccgccgccggagtccgcctgatgacgatgatgatgatgatgggcggcgggggcggcgggtcctcgagggatagaatctaggcctcgatcgtttcgctttttgtcgattttaattttagaagaaattagacaagaaggcaaaaaaccaaaaaatatagagagaaggaaattaggcgaaagattagatcggaaaaaaggttcgattgatctgttgtttggtgtcgttgatctcggatcgatcttgatgtgaatagaggaagatcatatcaacat

SEQ ID NO: 25 - DNA, 1549 bp, Eucalyptus sp.
ttttcatgctgctacgccccgtcctttggcctgcatccatggccaatcagccacccggtgagccccaaccaaatccgccaccgccaccgccaccagccccagcgatccaaatccctgaccaaccaccgcataattcgccttcttcttcttcttcttcttcttcttcattggccaccaccggtgatcggggcggttcctcgcctagaccgatgctttctccgagcgggtcgtcgccgctggctcaatccacagggaggcacccgctttaccgtggagtccggtcccgcagcgggaagtgggtctccgagatccgcgagccccgcaagaccacccgcatttggcttgggacatacccgaatcccgagatggccgccgccgcctttgacgtggccgcgctggctctgaaaggctccgacgccgccctgaacttcccccatgatgttcccaattacccagttccaaattccgtgtcggcagccgacatacgctcggcagcagctagtgcggcagcatccaggggggcgagaacggaagctgaggggaaggaggatccagtgggtcggcccgagagtgccagtgagattagccaagagccgggtcaagagtttatggatgaagacgagctcttgaacatgccgaaactgctggacgacatggcggaaggaatgctggtgagcccaccgaggactcagatggcctcagagaacgactcgccggaggactcagatggtggagagagcctgtggagttatccctaattttagaaggtgagatgatcagggcttatcaattacagtagtcctcattgtagacatatacgaatacgatatccattgtatatgatcaggatttcgtcatgatggttgatcgcatcccagtgattttattagtacgtggagtgtaggtctgagtcttttttggccccgtactaatgtagcttccggccgggtgtgagagtctctggtgaaggttttgcccgcagcttttatgtctggggttgtttccgattggcacttagctgtatatggctatgtatacacactgcctctttgtatcatagattggttgaacgaaagatctccagagcaatttatggcgcagcataccgagtcgattgcaatcgcatgtgtattcaaagaagaagaagcgagcgatgtgttccttctgtcatagaaaacgaacattttactccagaaggcaattttatgagcgtttatatggatctgcaacagaatgaagatgctcaggatgagatgaaagtgtttacgagcccgggatacagtatcccgggcgccatagacggcccctcctggctcttggtgcttgcgaagtggcttcctcgcctcattcaatagtgtcctgatgttctgcatgtgcaggggttttatgacagtgatccaatgtcccctcgggtgggcccctgcatttcaaaattacaccgacaattcaggccttaaattgaaggaaaatggaaaatgtatctaagcgtgatttgaaagatgagaccggaagagatacacgtacgttaagttgaatgctaaaaaaaaaa

SEQ ID NO: 26 - DNA, 1266 bp, Eucalyptus sp.
gtcctcctctccttctctcgctctctcgcggtcgctctatctccctctctccttctaccttaattatatccatatgtcggaccctagttctcctaaggatgaggcccatgtggtccaatcatcagcggagctagaccctccaccgccgcagccgcttccgtcgccatcaccgccgccgcctcctcctcttgcactgcacgcgctagaccaaaccctgcattcctttcctgcttacgcgggcgatgctccgtcccctaagggcaaatccccctcccccaggcatctgcagaggtcgtccccgaggagcaacccctccggctcggcctcctctggcgggaagcacccgttctaccgtggcatccggagccggagcggcaagtgggtgtcggagatccgggagccacgcaagacgacccgcgtgtggctgggcacctaccccaccccggagatggccgctgccgcctacgacgtggctgccctggccctcaaaggcggggacgcggtcctcaacttcccgcacttggtgaagtcgtacccggtccccgcatccaccgcgcccaccgacgtgcgaagggcagcagctgccgccgctgcctcgaggaaggcggaaacgagcggcggcaccgatgatacagcattgttaggtcaggaaggcgatgagggcaagactaggaaagatcatcgtcctgatttaagctcaaaaccaccggaagccgaattcatcgacgaagaggcactgttcgatatgccaaacttgttggtggacatggcggagggaatgatggtgtcgccgccgagaataagctcgcccccctcggacgactcgcctgacaactccgacatggaaagcttgtggagctacccttaaaattgtttccccagttgcgtgtttcaaaaacttcctcaaccaaattaaacatctccaacgacacgaaaaatttcacagatgattaagagggcttgtgagtgtgtgtgtgtgtgtgtgtgtgtgtgtgtgtgtgtgtgtgtgtgtggactaaaacgacagtgatcaatattcaatactagatagccaggacatgattgttcctggaaactacattgagcaaaagaggtggggaagaaaaaggagaaaaattacagggcatgggagaaattgtcgcagtgcagtgataaattttgatggtagcagctgaaggaggaagctttcaaaggaaagttaaagagctagggtttgggtttggcgttttatgaacattttcttttgcggtaaaaaaaaaaaaaaaa

SEQ ID NO: 27 - DNA, 945 bp, Eucalyptus sp.
aagaagagcagaattcaccagagcagacaagctagagatagagagagagagagcaagagagagagagatgcgcaggctgaggctcccagaatcagccgggcagccgccgtctccgccgccgcgccgcctcacccacgagcaagagctctccatcatggtcgccgccctcaagaacgtcgtctccggctccaccccctccgacccggtcccttacctccctcccacctccgcctccgccaccaccgccggcgataactactactggggcagcgacttcgtggccctctccgacctcgagacgtgccaggtgtgcaggatcagcggctgcctcggttgcaacttcttcacccccgtcgccgaccaagcagatgacaggaatagcagcggcaactccaccaagaagaggcagtcgtcctcgtcgcgtgtggcgggtaagaagaagtaccggggcgtaaggcagcggccatgggggaagtgggcggcggagatccgggacccgaggcgggccgtccgggtctggctcgggacgttcaacacggcggacgaggccgcgcgggcctacgacaaggcggccaccgagttccgcggggcgcgcgcgaagctcaacttcccgcacgaggaccactcgctcttgctgccgcctccgccgcccccgcccccggcgccgcttcctcagagacaagacccgatggcttcgagctcggataataacagttcggcgatgcggtcgaactcggaggagaacaaggggaagggaaaggtggagacggaagcagacgacttctggaacacgttcaataacgacgagatggagaggcagtggacgatgtggatggacatgggaggcgattcgtcggactcgaacgggccggcggtgcgctcatttgattcatgaattcgccgtattgtataatcagttcacatcattcaacgtcaaaaaaaaaa

SEQ ID NO: 28 - DNA, 1498 bp, Eucalyptus sp.
tccttccttctccttctccttctccttcgtctccttcagacatgtcgctcaaccaccccctctctacttcagacggcacccccaacactctctggtggaccactcaccccaccatgttccgccagcacaacctcctcctcaatttcaaccccaccgacgacgacccgcaagacgagggctcgcccccgccgccctacgtcctccgaggggcgccgccaccggcggagccgtcgcctgcagagaaagagcccatgttcgagaagccgctgacgccgagcgacgtggggaagctgaacaggctggtgataccgaagcagcacgcggagaagcacttcccgctggtgggcgaggcgacccagcagctgagcttcgaggacgagtccgggaagtggtggaggttccgctactcctactggagcagcagccagagctacgtcctcaccaagggctggagccgcttcgtcaaggacaagcgcctcgacgccggggacgtggtcctcttccaccgcgaccgcgccgacgccgaacggctcttcatcggttggaggcggcgaggggagtcgtcgcctggcgcctctgcagtggcggcggagacacgtgtcggtggcggtggcggggggttctatgccgggcgtccttatcctgggcacaatgatgggccgtcgcaacctggttcctatactcatggtcaagcggggggcgcgcccgccgctgggaacaacccgaggagggtgaggctattcggcgtgaacttggagtgccagcttgacggcgacgaggagtctgagctaccgggctcgagccacagtccgaccggccatggcctctcctctaattcatcaaactataccccctcacatggtcttcactttatctgaggaagatcgtgtcaaccacatgagaaatcgccgaggataagatctgtggacgtgacttctttcttctctctctctctttttttttttttttcatttttaaattggctacggagccccaacttgggagtgttcattggaaatgttcaagatttgacaagaaagggtcaaagaaacaacaacaaaaaaaaggggagaaaatcccagatttttaggcaatcctgaagttcacagcaaaggaaatcaaattgatcaaggaagaaagactgtagatgggaacatgaagagaaagaaggtgggtaaaggaccccccaagggaagaaaaagaaagagaaaagcaagagatctcttcatcaatgtcaaatggttgaaatcagggatccatatgctgctccagaagctatatatatccataatttcttttttatttcttttttatccatgtaatgaaatgttgaaatgggattgttcgggtaactagcgaaacaccaaaaagaaagaagggaaagaaaaagggaagggacggtgctggtgggtggagttgaatagatcattgatgatgatggcaggtctctctcttctgtacatacatcttttgaaagatatttagttcaaaaaaaaaa

SEQ ID NO: 29 - DNA, 1191 bp, Eucalyptus sp.
gtgcaaacttacaacgccctctctctctctctctctctctctctctctctctctctttctctttctcaagatattaagtgagttggcctaagatattgacgtacccaagattggattttttagcatttctagcatcgagaaatcctgggttagaaagatgtatgcacagagtttccaggagtccgacctggcgcttcttgaatccatcagcaggcacttgttgctcgacgactcggagagccggctcctctcgagttgtccgaacggagctcagtcgtggaccgcgggcctcggcggtgacccgtgcccgtatgtggccgagaactactggggagggctccctctcagggaagacgacccggacgacgtggtcctttacaggctcctgaacgagcctgcctccttcggctgggccccgccgggctcgcaggaggcccgcctgcccggcttcgcggctcaggtttccgtgaagccagagccagagtccttcccgacttggtcgccggagtgcgtcgcgactcggccgccgcctgtggcggtcccggcgacggggaggcactacagaggagtgaggcggcggccgtgggggaagttcgcggcggagatccgcgacccggcgaagaacggggcccgggtgtggctcgggacttacgagaccgcggaggatgcggcgctggcctacgaccgagctgcctacagaatgcgcggctcgcgggccttgctcaatttcccgctccggatcaattcgggcgagcccgagccggtcagggtgacggtgaagagatcgtcgccaaaacggccatcgccggagtcgtcggcttcgtcatcgtcatcgctggacaacgacgctgggaagaggaggaagaaggcggcgggcccgtcggtggctcccgcggcggcacgcgtggccacgccagagaatgagacgaagggattccaagttggacgacaagtgggaacgtccacaaatggcgaacagctgttggttagcctatgatttacatctcctttccctgtaacgcaacgtgggtcaggacagagagggaacctttgtgaaaattcttttgttttttttctttttgtttcttttcgggttgtgttttttttttgctgtggatgttttgagacaatgggaagcgaaataagacacaagcaaagacggaaaggggctttttcctgggaaaaaaaaaa

SEQ ID NO: 30 - DNA, 1087 bp, Eucalyptus sp.
ctctcgctctgcaatttcacaacgagtccgtcagtagtaggacctcattcacagctccagaaacccgaaaagatgagccaatccaccatgttggtagcggaagagaccatattttctccgccccctttgtataaccagcgaaaccatccccacgacggcgcctctgggctcaacccgttcctcacccaggagcactggggcgacctccctctccagctcaacgactccgatgacatgctcatctacaactccctccacgacgccctccactccggctggtcccctttcgactccgtcatcaccgccgtccaccccgagccccagccccaccccctcctccccgccgcttccgtccccacctccttcgcctccgacgacgccctgtcgctccacaacgctttcgcctcttacaactaccccatcgaggtcgccggcggcgtggtcaactcggaacggcgcgagagcgactttgccagagattacggtttccaccggagctcgttttgcaagggacgccacttcaggggagtgaggcagaggccgtgggggaagtacgccgccgagatacgcgacccggctaagaacggcgcccgagtctggctcggcacctacgagacggctgaggaagctgctctcgcttacgaccgagccgcttaccggatgcggggcgccaaggccttgctcaacttccctcaccggatcggctccggcgagcccgcgccggtcagagtcaccgcgaagcgcaaggattccgaggctaaaggcgccgtcgctggctcagccaagaagccgaaaggaacgccgacagcgccggcggccgaggccgatggaggagccggtttgaggagggagggggagcgattggatgcattccaacaagggctgttgcgactgagcgaggagctactggttagttaggttcgttgaaaaaacatggtcagcgaccaagaagatggaaggtgcaaaagcatcgacggtctgttttgtaatgctaactaccaatcgcaacgcagtgtgttttgggaatgaatactagaactgaggacgagtctgtcggtcgtcgatgaacattaaaaaaaaaaaaaaa

SEQ ID NO: 31 - DNA, 1244 bp, Eucalyptus sp.
gtagactctccatcttcccacgatttgaacactctctcctgcttgactaatctccaaaggcggattgatggcctcgacacagcagcagagctccaccctggaactcatcaggcaacacctcctgatcgacttctcctccgtggacaccttcctcaccagcctcgacgcttgcacttccaaggtggcgccggtccccgccgccgccgccgcctcctccccctcctccggttccaactcaccccagacctctttcagcttccaacccaatcctgcccctctaccccccaagccccccaagccgtcctcgtccaccctcagctcccgccgcccggccatccaagtcgcggtccccgcggcgacgagcttcctggcggcgccggctgtcccccgggccgagccgtcgggctccgctggcggcgacgacgacaagcactaccggggcgtgcgccggcggccgtgggggaagttcgcggcggagatacgcgacccgacgcgcaaggggacgcgcgtgtggctggggacgttcgacacggcggtggaggccgcgaaggcctacgaccgcgccgcgtttaggctccgcgggagcaaggccatcctgaacttcccgctcgaggcgggacgcgacgagccgacgtcgacggaaccgtcgctggccccggcggacgcttctcgcaagagagcaagagaggaagccgccgcggagagcgccgagtccgagatgagtgccggcggctgttataaagtggtgaagaaggagcagcatgcggacgtggcgagcggcagggatacatgtccgctgacgccgtcgagctggagggggttctgggacattggggaagggaacaaggagagtatattcagcgtcccgccgctgtcgccgctatctccacatccatgcttcggctattctcagctcatggtcatatgaggaaaggccatagatcacatcatcgatttcaagaaatgaactatgactttgctcaatcgggggactgctgttgacccaaaacccagaacacaaaaacggaagagaggggaaagtatctacgatcatttgagttaagtcttaattccttcgaagatgagggaagatgattaaaccaaagaagaagaaagtagtttgagtgtgagtttgagtttgagttcttagattagtgtatatacgagtgaggttgcgggagaatgtggtgtgggtgtatttgccatggaaggctaatgaatttgttcattcgttcaaaaaaaaa

SEQ ID NO: 32 - DNA, 1405 bp, Eucalyptus sp.
tccaccctcactcgcgaagtcaaaatcttctagtgtagccatattcttgatgaacattcacacgcaactaccgtcggacgtgcgggtgccgacgccggcgcagtcgtcttcgccgtccccgtcgcagtcgtcgcagtcggagtcctccgcgagccacgccgcgtgctccgacgaggagccggccgtggcgctggcttccagccggcccaagaggccggctgggcggaaggtcttcaaggagacgaggcacccggtgtaccgtggggtgcggcggcggaacaggggcaagtgggtgtgcgagctccgggagcccaacaagaagacccgggtatggctcgggacgtacccgaccgcggagatggcggcgcgcgcccacgacgtggccgcgctggccctgcgcgggaggcacggcgtgtgcctcaacttcgccgactccgcctggcggctgcccgtgccggcgtcccgcgaggcggccgagataaggaggaccgccatggcggcagctgaggcgttccgccctgcagaggccgaggaggcggtctcttcgtgtggcgaagccagcggagggagcgtctgccccggccaagtggcgagtgtgcatattgtacatgataaaaaggtaaagcaagagagagagagtgattgcatggagattgaagagtcgacatcgttcgacatgaaggcttggctcgagcgtcctcttctatctccgacgccacatgatgccagcgttcgtttaaagcaagagagagcgagtggttgcgtgaagattgaagagatgacatcgttggacatgaaggcgtggctcgagtgtcctcttctatctccgacgccacatgatgccggcgttcctttaagctgtgacttcgatgcagatggcgatgatccagatgtttcactctggagctattccttgtgacgacgacgacaacgacgacgatacaaattatgcagcttttctttctttctacattcttttatcttctcctcttggtagggctttccatcttacttcgattttattcctttcccccccccccccctattatcagctcgttatagtgtctctgggtcctgtcgaataggcagagttctgtgtcaatatgtttgtcgcgtgtataactgttgtcattactgaccggacagacagcatgggtgataattgtagaaagagtcgaaattgttgtggcagaatctttcaaagattctttgctttctgaagtaaatctttgaaagattctgcctatacatgcgtttgggaattgtcaccagtttcgagtgccaatgcaagcaagagagttgactaaggagtaaagtaggtttgtccctatgcctcatattttttaaatcgtaaatgatgggttgaattttcataaaaaaaaaaaaaaaaaaaaaaaaaaaaaaa

SEQ ID NO: 33 - DNA, 1319 bp, Eucalyptus sp.
cttaaaccctcccgtcaaaaccctctctctacatcgccatcttcttcttcttcctctccttccatttctcccctttccctaaaccacaagcaaacattctccgaacacctctgttctgccttcgtctgtatttgcagctttgcattctcccgcgaaagttgaggctccgacaatgtgtggcggcgctatcatcgctgaattcatcccccggaaccgacgccgcgtcacctcctccgacctctggcccgactccctgttcctcaagccctcgaacggcctcgacgacccgctccccccgaaacaacacccctgcctcgcctcaggtggcgcgcaggaagagaaggccccgaagaagccgcggaagaacctgtaccgtgggatccggcagcgcccgtggggcaagtgggcggcggagatccgcgacccgaggaagggcgtccgggtctggctcgggacgttcaacaccgccgaggaggccgcgcgggcttacgaccgggaggcccgtaagatccgcggcaagaaggccaaggtgaatttccccaacgaggacgacgccttctccaccatcccgcgggctcaccagacccagcaccaccacccccaggtccccgactaccctcctctgtatcaacccaactggaacaacaacggggcacccgccaaaactctggacttggccttcgcttacgacctgaaccagacagggcatttccccgcgaacggctacgctccgatccacgccgagcccgtggccatgtccagcgaagagatatccgggtcgggctcggaggacacgcacgcctcgtcgacggccgcgctgctgggcgccaactacggcgccgccgaagcgaaggtgaaggcggagggggaggtggggaagaagaaagaggaggacgaggagagcgaggtgcagaagctgtcggaggagctcctggcgttcgagaactacatgaagttctaccagattccctacctggacggccagtccgccgccgcgccgccgaatcccgctcaggatagcgtcgtgggcgagctctgggccttcgacgacgacaacgacaacgcctccggcgtaaccgccgtggctccggccgctctctgatcgcgtcgtttttgggggcgcctcttagaatttttattcctattttgcccttttattttcgcatttcctttatttatattttagaacctgtgtcgatcgggtaggggggggatttgatggtcgtggttgctgatcggaactcctttttctttttgtgaacaaagtacaacctcttaccttgtaataaaattgtgattactctcgttcaaaaaaaaaa

SEQ ID NO: 34 - DNA, 1778 bp, Eucalyptus sp.
gctctgggtcgtgtctgtttcctcttcttctccttcttcgcaatcgtcgtcttcttctcgggcatctgtttctcgctctggtgggttgggtgctccccgcttcatgcttttgcgctgcttctggccggcttcgaatctgggttcctcgtctgcttcgatgcgtttgaggccaagaaggacttgttctggcgtcgagtgctttgggggttttcacataaagcgattttccaatctcttcttgttcttgagagggggtttcacttgatatagctccggtctcgcaccgattttgctcctttttgacctctttgagttctttaatttttttatatctatttgcgttgaggtaaaatttcgagggcgtcgttgagggggggtttttggtgagggttttgcggtcacagaaatgccagaacctgtgattcagcctctagaccacaacaatctgctcaagaaaccgaggaagatgacgaggatcactgtagactcgagaagggtgaggaagattcgaattttctgtcgagatcctgaagcgaccgacgattcctcgagcgaagacgaatcggaccaccaccggaaaggcgatgccaagcttttcgtccgagagatcaatctccccctcgtctcaacccaccgcgccagtgaccttccaagcgagagctcttgccaagacagcaacaacggcttcaaaagcctcgaaaagaagaggaaggcctcgccgaaaggcgcagcgggcacgaagaggagggcatgtaattcgccgtacaagggcgtccggcagaggaagtggggtaagtgggctgccgagattcgagacccccggcgaaaggggtctcggatttggctggggacgttcgacaccccgcaggaagctgcgaaggcgtacgagaacaagaggcttgaattcgaggctgctaaggcggaagaggcgtccttctcgcactcgctcaacaggccatccacatctgaagacacggagagcgtcctgtcgcacacttctccggcttcggtcctcgatctagatactaccgcgtctaactcgactaaagaagccactgctgatgccaatgaggagaacatggagagaccctgcctagaactcattgaggaggagccacttatttcgctggatgatgtggctatccaggatttttaccccggggaggatattgattcgctgttcaaggacgacttcgggggtttcgtggatgatgatatctggggctttggtgatatacccttatgcggattcgacaagaacaagctgatcgagctcccagattacgatttcgagctcgaggacgacgagtttggccattggattgatgagccaccaccccttaatatcgcatgcccataagttttgcagctataggtacattagtagtagtatcgatgatgaagcatattatctatatatttagcgagtacactcttgagaactaactggtaatcgagttcttgagactggttttgtcattgtgttcaattaattcgtttgtaactagagagattcgtgtgtgagtagggattgagtgagctggggaagaaatcccttttgggttttcttgtgctatttgagccgtccataaaggggttttttcattttcctcccctgagagagtgttcttgcaatgtcctgagatctgagaaggagaaaaagactcaatctcccactcacacatgtcctgcgttgctctctgtatttattgtctgatcatatggtaattcgagatggaaaaacttttgtttggctgctgatcagtctaaaaaaaaaa

SEQ ID NO: 35 - DNA, 1404 bp, Eucalyptus sp.
gaagatcggatctttcctgctttggcgacgccggaaacccgaattcagtgcccaaacagtagtcgaccgaccgaccgaccgaccgaccgggaagttccgatcatggccgtggagatgtttcaagagccggagtcggcgttcctcgactccgtccggcggtacctgctgtcggaggactccgagtgccggttcttcgagccgccgccgccgccgacccggaacttctgcggcgccggagccccggtgatctgcgggagctccagcttcagcagcctgtacccgtgcctgaccgagaactggggcgagttgccgctcaaagaagatgacccggaagacatggtcctctacggcgtcctccgcgacgccctcacggtcggttgggcgccgttccagccgagcgggccacccggtcccggattcggggcgagccaggtggttaagcgggagctggattccttgccggcgccggcttcttcgccggaatccgccgccgcagccgcagccgcagccgcagccgctgtccctcagacggagaaggcggcccaggcggtcccggcgaaggggaagcattacagaggagtgaggcagcggccgtgggggaagttcgcggcggagattcgcgacccggctaaaaacggggctcgggtttggctcgggacctacgagaccgcggaggacgccgcgctggcttacgaccgggccgcttaccggatgcggggctcgcgggcgttgctcaatttccctctccgggtcaattcgggcgagcccgacccggttagagtgacgtcgaagcggtcatccccggaaccatcatcagcatcgccctcctcctcctcctcctcctcattgtcatcggagagcgagacctcaaagaggaggaagaaggcggccgtgccggcgggtcgggcagcggcggctcaattcgggtcggagcgagtggggaatgctgacgccgtcaacggatctttgcaagttggacagcaagtgggaatgtggacaagtgggcagcagctgatggtcagtggatgtcgacagacagtgaaatgtgaaaccacttgttgagggagcaggacaattttgataaagagccccgtggacgattcgcctgaggaatataaattctttggaattttgttgggagtggaagtgggagaagaaaattttcgaccaaaaagaaaaattggggaagaaattattctaaatatatgtataaagtgaatgaaaggggagattttttatttctttttttattcctttcccttgaatctgtgaatacagattttgttaatgcattattgagaagttttgtggaagccacacagtagatgcttgaagtgtggaatctttcctttttcacgttaccaattcagatctagtagctataagaaagaagtaaaaaaaaaa

SEQ ID NO: 36 - DNA, 1844 bp, Eucalyptus sp.
ggaggtctgagagatcagcagaagtaaaaaaaaaaaacatagcagaaaaagagcgctcgcgtttgcttcttcttcaacgctccttcccccctctgtaattccccgcttctccgagtccctttctgttaatcatctgtctttctaaacgaagttggcgatttcttttctttctctaaggtttggcctcaggatttttcagaagcacaaacttaggagagaaaaaaaaagtgggtaattttttttgacgaaagccaggtgttttcagaatcgagatccaggagtcctgtttttttttctccatcttctcgttgttgggtttttgtttttgtttttgttttctttctcgattagaatcggccaagagggcgatttttggtccctcccaggttgaatctctaggtgttttcttggaagtgacggaggttggttatttgttaacctcttgaaccctttggaaatagttcttttggttcttgtttatttttttgctacttcttgtaaagcttgcagatttcctggtgttattatggcaactaccatggagttctacagcagtagatcggctctcccatcgtaccgaatttccaacggtggtgacgagctcatggaagctctgtgcccgttcatcggcggctacggcgcttccacatctaccccttctctttcctccccctcctcttcttcgtcttctctcttctctttcgagcccgtgtcgttctcggatggctgctcgacaagccccgaccctctgggcttcgagctacccggtccgatcgggctcaaccacctcaccccatctcagatcaaccagatccaagcccagatccagttccaaagcacgaacttgccctcctaccatggccacggctaccacccgagcatgcttctgggaccgaagcccgtgtccatgaagatttccgggtcggcgggcaaaccggcgacgaagctgtaccggggtgtgaggcagaggcattggggcaagtgggtcgccgagatccggctgcccaagaacaggacccgcctctggctcggcaccttcgacacggctgaggaagccgccctcgcctacgaccgggccgcctacaagctgaggggcgatttcgcccggctcaacttcccccacctcaaacactgcgccgcgtccgacgtcggcgacggcagagtctcgccgttgcactcgtcggtcgatgcgaagctggaggctatctgccagactatcgccgagaagaaggctgacggtgccaagaagcccccagcctcaggccgatcccgagccgcagccgcagccgcagccgcagccgcagcagcagccgcggcagcagctgcagccgcgcgggaggtttcttctccggaagaggcctcggaggtgacggaggtgacggaggtgaagggatccgaaccggagagcgaagggtcggcggaatcgtcgccgctttcggatctgacgttcgacgacttcgcggaggccacgtgggagtgcgtttcgttgccggaggcgtcgaccttgatgaagtatccatcggagatcgactgggacgcgatctgatgtcaaaaaaatcgtttatttttcttttcctgtttccattcgtgtagtcaaattgttagctcgtgtcttttttagagcaaaaagttcaggaaggcgggagcggtcgctgcgattgagtttttgtgggttgcagtggactgctccttgttcttttaggggttttccatttcattgtgattagctgtagctagctagcagggctgtaaaactaaaaagtctgcctcgtccagttgaaactttttatctgctgggctatggatgttcctatgtaattcgttcgtcttatgtaaaaaaaaaa

SEQ ID NO: 37 - DNA, 1543 bp, Eucalyptus sp.
gtaatcgttcataactctttcttatcagccctttttccattggacgactctcgctctctctctctctctctctctcattgaagcccttcttcttcttcttcttcttcttcttcttcttcttgtgatcgctatatatattagtccagaccaagtttcctttccgttcggaagctttgatggcgaaaacctcactgccccggcagggccaggaagaagcttcggaccccaagaaggacggcggcggggccaagagcgcggccgccaaggcgaaggccaagcgcacccgcaagagcgtcccccgggacgcgccgcagcagcgtagctccatctaccgcggcgtcaccaggcatcggtggacgggtcgatacgaagctcatctgtgggacaagcactgctggaacgagtcgcagaacaagaaaggaaggccagtgtatctaggggcatatgacgatgaagaagccgcagcacatgcgtatgacctggctgcattgaagtactggggaccagaaaccgtcctcaattttacgttgtcggcatacgaagaagagctgaaggaaatggaaggccaatcgaaggaagaatacattggatccttgagaagaaagagcagcgggttttcccgtggagtctcgaagtacagaggagtcgcaaggcaccatcacaatggcagatgggaggctcgaattgggagagtgtttggcaacaagtatctgtatcttgggacttatgctactcaagaagaagcggccgaggcatacgacatggcggccattgagtaccgggggctcaacgccgtcaccaactttgacctcagccgttacatcaagtggccccagccgggcgccccggacagctccgccgctgaacttagcaactcccaacagagccccactgcgggcggtggcggtgcagccgcggctgtggcagaagtgccggcagcccacgacccgcaggggggcggctctgcctcctcggcgctgagcctcctgctgcagtcgtccaagttcaaggagatgctcgagcggacgagctcggccgaggaccaaggagccgggtcgaccacgtcctcggagtccgaggcgccccgccggagcttccccgacgacatacagacctactttgactgccacgatgtgagcggcgggctcgacgacgatggcatcttcggggatctgaactcgttcggttccccgattttccactgcgagctcgatctatctagctaaggccgagcagtcgttaaaagaagatcgattagggttcaagagaaactttcggcaacgtcattccaagaaacgatgaaagctcagcctcgcaagcatgcacgcgagcgtggccatatgtgaatatggagaggtgaggatagcgacgggaaggcgggaaggaagatgacgacgagaatcgatcagagtaaagagacaatcgagattcttttttctttaaattattaccgtctctgcttaatttttttctttaaattacatgtaaatgatggggatattctttcgctgaggatttattttacgttttcataaaaaaaaaa

SEQ ID NO: 38 - skipped

SEQ ID NO: 39 - DNA, 2818 bp, Eucalyptus sp.
ggcttctttcctctccccagattttcctcgagggcgcgtgctccctgcgtttttcctctgtggattctagagagagagtgagagagagagagggaggggggtgtttgtttcttgggctgccggtggctctggagaagctggtggcggcggcggtggtgggtgacggacggacggagacggcgacggcggcggcggcggcggtttaacgttgggtctcctctttttttttcttggttattttccccttcgagcgaatcgcggcgggcggttgttagctgcggcgggctttgttcatcgccggctttatcgtgcgtgtggcgagagagaaagagggagatctccgagccgtgcttgatactccggcgatcccgctagctccgtcgaattccgcgctcacatggctaatcgaggtggtggagaagacgatctgtacacggagctatggaaggcgtgcgcgggcccgctcgttgacgtcccccgagctggggagcgagtcttctacttcccccaagggcacatggaacagctggaggcgtccacgaatcaggagctgaacgagaggatcccgctgttcaatcttcccccgaagatactttgtcgcgtcatgtacattcagctgctggcggagcaagaaacggatgaagtttatgcccagattactctacttccagaggcccctcaatccgagcctatgagtcctgacccttaccttcctgagcctccgaggccgcgagttcactccttttgcaaggttttgacggcctccgatacgagcacgcacggtggattttctgttctcaggaaacatgcgactgagtgtcttccgcctttggatatgaaccagtcaacaccgactcaagagttggctgcaagggatctccatggttatgagtggaaatttaagcatattttcagaggtcaaccacgtaggcatttgctgacaactggatggagtacatttgtcacttccaagagattggttgctggtgattcctttgtgttcttgagaggggagagtggagaacttcgtgttggtgtcagacgcatggcacgtcaacagagcaccatgcctgcatcggtgatatcgagtcagagtatgcacttaggagtgcttgcaactgcctctcatgctgttcagactcaaaccctgtttgtagtctattataagcccaggacaagtcagttcatcataagcttgaacaagtatctagaagctgttaacaataagttctctgttggcatgagattcaagatgaggtttgagggagaggattctcctgagagaaggttttctggtactatagtaggagtcgaagacatttcctctcagtggactgattccaagtggcgatcattgaaggttcaatgggatgaacatgcttctgttccaaggccagatagagtttcaccatgggagattgaatcctctgtaccatctatacctccgagcatgacagagtcagcagtggcgaagaaaaggcctcgaccacctgctgagctccctgctcttgatactgctggtgcaactctccatgatgttggacttatgcagtcctgtgattctacgcaaccaactgttttcattgaaggaaaaagaagcgataatcatggtatttggcatcataagcaaacaagtgtgaacactggcagcaactctatctcgtggcctcagactgagggggacaggcagttttctcccagtgtctgtggctggccacttctttccagttcaactatgcactcaccaaagccgagaaatgaacctaaggtcgagctggctgagaagcccgagagacctactagttgccgattgtttggcattgacttgataaatcattcttcaaactctcagcaagtggacaggctgactgttcagccacttgatggatctgctggcattaacgaaacacacactccaggcaacgctccagcagcagattcacagcagaagtctgttgttttaaagacctcgaaagagataattccaaagcagtctgtggtttcaccaaaagagattagaagcaaacaaagttgttctaccactgcaaggagtcgcattaaggttcaaatgcaaggagtagctgtgggtcgcgctgttgacttgaccatgtttgaagagtatgatcagctcattgatgagctcgaggagatgtttgagattaaaggagagctcaggcctcggaataagtgggaaatcgtcttcaccgatgatgaaggggacatgatgcttgtgggagatgatccctggccggaattctgcaacatggccagaagaatcttcatatggtcaagtcaggacgtgaagaagatgagccccggaagcaggctccccgtgttctcggtagaagaagaagggagcttagcttaaccaccggagtctcgccgcctgtgtatcttttcctctatttcccccttgcaattcttgtatgcagcttgttgtctgtaatctccttgtgcctaaggggccttctttttttccttcattttcttcttattctatttttttgttttgttttttcggggtggggttgaaatttgcatagcttggggaattgggggacttggcgttatttgcgaaagctaacttctataataggacccactatcaatcaacacttaggaacttgggaggatggggttttatatgcgttaggtttttaggaccaagaatctgtgtatatctttggagtttcttcttgggtgggatgtaagtggggaggtctttttgttttatgtagatatgtttaattgggaagtggaatccatggtagtcatcagcaaatggaagatggcaaagcttttccccccaaaaaaaaaa

SEQ ID NO: 40 - DNA, 2505 bp, Eucalyptus sp.
gctctctttctctctcctcctcctcctcctcctcctcctcgctttttcttgaaacaatcgataatccttccttccatctttcctcctcctcccccccttgaaatcccgaatccaccaccacaaccccccaccgccaccttctcgttgggtaatctctcttttgcttctggagagggaagtgaagtgatcttggatcagctgactttggagaatgatcctaaagctggtatttctacattgagatcatctttaagagcgctgtggttctctgatggcatctcatccatcaaatcattcgtgtgggcgccctcatcaaggtgcgtttgctgatgctttatacaaagagctgtggcatgcctgtgctgggcctcttgtcacccttcctcgagagggagagcgtgtctattattttccacaaggtcacatggagcagcttgaagcatcaacaaacagagggttggaacagcaaatgccttctttcgatctgccctctaaaattctttgcagggtagtcaatattcagctccgggccgaacctgaaacagatgaagtttattcacagataactttgctacctgaacctgaacaaaaggaagtcacgagcccagatcctcccctcccagagcctccaaggtgcaaggtgcattccttttgcaagacacttaccgcttctgacacaagtactcatgggggattttctgtccttcggaggcatgctgaggagtgtctgccacttctagatatgacccagcagcctccttggcaggaattggttgcaactgatctacatggcaatgaatggcatttccgacatatttttcgagggcaacctagacgccacctactcactactggatggagtgtctttgtgagctccaagaagttgatagctggtgatgcctttatatttttgaggggtgaagatggagaattgcgcgtcggtgttaggagattaatgagacagcaaagtaacatgccatcctctgttatatctagtcacagcatgcatcttggggttctggccactgcatctcatgccattgcaactggaactctcttttctgtattctacaaaccaagaacaagtaggtcagagttcattgtgagtctcaataaataccttgaagcacgggcccacaagctatccattggaatgaggtttaaaatgaaatttgagggtgaagaagtttcagaaagaaggttcagcggcacaatcattggtgtaggagacagcatgtcatctggatggactaattctgaatggagatccttaaaggtccaatgggacgaaccttcatcaatcatgcgtcccgacagagtttcatcatgggaattggagccacttgttgtgactgctccttctaattcccaacaggtacagaggaagcgagaacggccaactgtattaccatcatcatcagtgcaagaactttctgtgttcggtggacctaaagctcctgagtattcttcagattttctacatggcgattcccagaggggaagagatgtctatctctctcccaagttttctccatctgctaggtcaaaatctttaaattacaatggaaatggttcaccagctgcattatctggctacacagtcaactggcctagtcatatggaaactattactgatccatgtacaccagtcaatgggaaagaatctagtgaaaagagagagagcggtggtagtggctgcaggctatttggcgttcagctacttgacagtgccaaaaaagaaagtttatcagtaaccttggctgcaggacagagggacgatgataaaactgctctatccgtagatgatgattccaaagagcaccaagaaccctcatgtgtgaatcattttgataatccttctgcatgttatgatccagagaaatcatgcccaaattcttctcaggatctacaaagcaggcaaatccggacctgtattaaggttcacatgcaaggaattgctgttgggagagctgtcaacttggcacagtttaatcgttacgaggacctgctcatgcgatttgaagaaatgttcgagattggaggcgagctctgtggatccatgagaaaatggcaggttgtctatacagatgatgaagatgacatgatgatggttggagatgatccatggaatgaattctgcagtatggcaaagaagatttacatctacactacagaggaagtcaagaggttgttgcccaaaataaagcttccagtggaagatgtcggcccagccaatggagggtctgatgtcgcggtcaacacagatgatcgctcatcagttgtgggttctggctgctaatatgattcctgccatggaggaagagtggtatgcttcattttctgcgtgtagcttgtattgctagaggtgaacagcattgtctttcaattttgctctgtgattgaagttgtgattgtatatatcccatcgcagtcttgtaacttgaacctcctgtatgagttttaaatggcaagttagtgcaaaacacctgaaagataaaaaaaaaa

SEQ ID NO: 41 - DNA, 2815 bp, Eucalyptus sp.
ctctcactctcactctcactcctcctcttggctctccctcaccatcttcccaggtcccgcgccgcggtatcgctgccccgaccattctcgccgtctgctcaataataatcggagcaaagatgattgatctcaacacggtggaggacgacgaaacgccgtcgtccggctcctcccctgcctcttctctgtcctctgccataagcgcttcgaatattaactccaaccctgcgtacccaacttcgtcttcttcttcttcgtcctcgtgctctcccttgtgcttggagctgtggcacgcctgtgccgggcctctgatttcgcttcccaagaggggctctctggtggtctacttccctcagggccacttggagcacgtctctgattttcccacttccgtgtttgatctcccttcccaaattttctgtcgtgttgttgatgtgaagctccatgccgatgcgagcaccgacgacgtttatgcgcaggtttcgctggttcctgaaagagagcaaattgagcataaattgcgcgaaggggacaacgaaatagacttggatgaggatgaaattgagccggccgtgaagtcttcgacgcctcacatgttctgcaagactctgactgcttcagacacgagcactcatggcgggttctctgttcctcggcgagccgcggaggactgcttccctccactggattataatcaacaaaggccttctcaggagcttgtagctaaagatctgcatggcctagaatggagattcagacatatataccggggacagccacgcaggcatttgctcactacaggatggagtgcatttgtaaaccggaagaaattagtctctggggatgctgtgctcttccttagggcttcgaacggagagttgagattgggagttcgaagggcaattcaagttaaaggagcttctgcttttccatctctttgcatccagaccctgaatcagagtgcccttatggatgtaccgaaggctgtatctctaggaagtgccttcagtgtttactatgatccaagggccagctcatctgagttcctaataccagctcgtaggtttttcaagagccttaaccagactctcgcccctggcatgaggttcaagatgcgttttgaagctgaggatacagcagagagaagacattcgggtctgatagccaacataagtgacatggatcctgttagatggccaaattcgaaatggaggtgtttgcaggttaggtgggatgacgttgagcctgatcgtggtagtaggatttgtccatgggaaattgagccatccggttcagtttccagtccaatcggttttatgatgcctggttctaagaggactaggtttggaataccttccatgaaaccagaatatccggttccaaatggaattggagcatcggactttggggaatctttcaggttccagaaggtcttgcaaggtcaagaaaacttgggttttggcactccttacgatggtatcgaaactcaaagtcatcggctatctgaagtgaggaggcatcatcctgatgattcaggtggttctgaagctgctgccaccagaaatggcatcacaaacccatccgtgaatgctagtgtcacttacaaaggcatgggctttggcgaatctttccggtttcgtgaggtcttgcaaggtcaagaaacatttgccaacccaccatatacaagaccctggtttaccagtggagcccaaggaaatggtgcatttggtgttcgtgatggctttcaaatggttccttccaggaatggttgctctgccctaagtcagggttcagacaatcgtttcggtcttccggtttcctccgtacaagtttcttcaccatcttcagtattaatgttccaccagccaagtaggaaaagctccaacaggagttctctttgtaatacattgccatgggatgagaagctctcttcgccaatgaaggtgagtttcggtggcacgagtccgctgggtttgttgaacgaagaaaatagattgagtttccctcattcttccattttgttgccatcggagggcgtagttagcgaggacatggccccgcctttgaagagtagttgccgtctctttggtatatcattgactgaaggaagagatgtttctcacaaggaagttagcatgagctcgtctaggttgaatggcgaacccctttttggtcatattggagagaacttccatccaaaggccaatgtgagtagggtggttggtagcaattgcacgagagtactcgacttgcctcctgtgagtgatgtgctctttgatgtcgcatcctagagacaatggtatattgggaaaagccccccagaaaatcgtgtattcagaagtagggaaggtagtggaagttgacctcttaagctttcatttcttttgggcgatttagtatgatgaagccatgctgtcatgagtggagattatctgtctgtgtgaatttgaagtttgtgaattgtggcaagtgcaaaaccagtgcggtggtatgggagtactgtcttatgtgattttgaagatgcttgcatttgtcaagaatggctgagattgaaggtccacaagtctcgtgatttcatacctggacagcttttgcttccaggcaagtattttctttggggttgacctctatttatgaggcaaccttttaggtaggcattatgcaaattgggggtagagaagtgggcgatctactcttaagtctccttttaggtgggattgccttgatggcctcgcactttgtcaagctagaattcgtgtatatgacctctctattcagatcttttgtactgtttttatttggcccaaaaaaaaaa

SEQ ID NO: 42 - DNA, 2908 bp, Eucalyptus sp.
ccttcatctccctccccaccgctctctccctcttgctttcctcctactctgtcactctcactctcactctcactcctcctcttggctctccctcaccatcttcccaggtcccgcgccgcggtatcgctgccccgaccattctcgccgtctgctcaataataatcggagcaaagatgattgatctcaacacggtggaggacgacgaaacgccgtcgtccggctcctcccctgcctcttctctgtcctctgccataagcgcttcgaatattaactccaaccctgcgtacccaacttcgtcttcttcttcttcgtcctcgtgctctcccttgtgcttggagctgtggcacgcctgtgccgggcctctgatttcgcttcccaagaggggctctctggtggtctacttccctcagggccacttggagcacgtctctgattttcccacttccgtgtttgatctcccttcccaaattttctgtcgtgttgttgatgtgaagctccatgccgatgcgagcaccgacgacgtttatgcgcaggtttcgctggttcctgaaagagagcaaattgagcataaattgcgcgaaggggacaacgaaatagacttggatgaggatgaaattgagccggccgtgaagtcttcgacgcctcacatgttctgcaagactctgactgcttcagacacgagcactcatggcgggttctctgttcctcggcgagccgcggaggactgcttccctccactggattataatcaacaaaggccttctcaggagcttgtagctaaagatctgcatggcctagaatggagattcagacatatataccggggtcagccacgcaggcatttgctcactacaggatggagtgcatttgtaaaccggaagaaattagtctctggggatgctgtgctcttccttagggcttcgaacggagagttgagattgggagttcgaagggcaattcaagttaaaggagcttctgcttttccatctctttgcatccagaccctgaatcagagtgcccttatggatgtaccgaaggctgtatctctaggaagtgccttcagtgtttactatgatccaagagccagctcatctgagttcctaataccagctcgtaggtttttcaagagccttaaccagactctcgcccctggcatgaggttcaagatgcgttttgaagctgaggatacagcagagagaagacattcgggtctgatagccaacataagtgacatggatcctgttagatggccaaattcgaaatggaggtgtctgtcggttaggtgggatgacgttgagcctgatcgtggtagtaggatttgtccatgggaaattgagccatccggttcagtttccagtccaatcggttttatgatgcctggttctaagaggactaggtttggaataccttccatgaaaccagaatatccggttccaaatggaattggagcatcggactttggggaatctttcaggttccagaaggtcttgcaaggtcaagaaaacttgggttttggcactccttacgatggtatcgaaactcaaagtcatcggctatctgaagtgaggaggcatcatcctgatgattcaggtggttctgaagctgctgccaccagaaatggcatcacaaacccatccgtgaatgctagtgtcacttacaaaggcatgggctttggcgaatctttccggtttcgtgaggtcttgcaaggtcaagaaacatttgccaacccaccatatacaagaccctggtttaccagtggagcccaaggaaatggtgcatttggtgttcgtgatggctttcaaatggttccttccaggaatggttgctctgccctaagtcagggttcagacaatcgtttcggtcttccggtttcctccgtacaagtttcttcaccatcttcagtattaatgttccaccagccaagtaggaaaagctccaacaggagttctctttgtaatacattgccatgggatgagaagctctcttcgccaatgaaggtgagtttcggtggcacgagtccgctgggtttgttgaacgaagaaaatagattgagtttccctcattcttccattttgttgccatcggagggcgtagttagcgaggacatggccccgcctttgaagagtagttgccgtctctttggtatatcattgactgaaggaagagatgtttctcacaaggaagttagcatgagctcgtctaggttgaatggcgaacccctttttggtcatattggagagaacttccatccaaaggccaatgtgagtagggtggttggtagcaattgcacgagagtactcgacttgcctcctgtgagtgatgtgctctttgatgtcgcatcctagagacaatggtatattgggaaaagccccccagaaaatcgtgtattcagaagtagggaaggtagtggaagttgacctcttaagctttcatttcttttgggcgatttagtatgatgaagccatgctgtcatgagtggagattatctgtctgtgtgaatttgaagtttgtgaattgtggcaagtgcaaaaccagtgcggtggtatgggagtactgtcttatgtgattttgaagatgcttgcatttgtcaagaatggctgagattgaaggtcccaagtctcgtgatttcatacctggacagcttttgcttccaggcaagtattttctttggggttgacctctatttatgaggcaaccttttaggtaggcattatgcaaattgggggtagagaagtgggcgatctactcttaagtctccttttaggtgggattgccttgatggcctcgcactttgtcaagctagaattcgtgtatatgacctctctattcagatcttttgtactgtttttatttggcccaaaaaaaaaaaggggaactcgaagaggatgattttagttgaaaaaaaaaa

SEQ ID NO: 43 - DNA, 2908 bp, Eucalyptus sp.
gctgctgctacttctgctccctcataacagtacctgcaaatggaggaggaatcactatatgagttcctcgttattatttgcttcgcctccttttttcccttctcatcttccacttactcatttttgtccaaacacttcatccctcttaatcatgatttgaactcatttcccagtttcacgccctcctgattgctcaaaggtttcatatttcttgatgttccactctcctctcggcaaaaaagctggatttttagttgagcttgtgtggaacatcaattggaaggaaagtgggtgttcatggaaattgatctaaatcatgcagtgagtgatgtagagaacgccagcaatgcatgttgtgatgggcattgtgagaagggcaatggttgtctccactgtttgtcttccacttcttccaactcttcatcatcatcctcctcatccgctgtgccttgctcaatctactctgagctgtggcatgcttgtgctggacgactcacctcactgcccaagaaaggaaatgtggtcctgtacttcccacagggccacttggaacaagttgcctcagcttctccttattcgcccatggagatgcccacctttgatcttcagccacaaatcttttgcagagttgtgaatgttcagctactggctaataaggacaatgatgaggtatacacaaaagtcacactgcttcctcaactagagctggtagggttggattctgaaggcagagctcttgaggagctgggggtagatgagaatgatatcggaggatctcctccaagatcaactcctcacatgttctgtaagacactcacagcttctgatactagcacccacggagggttttctgtcccacgtcgagcagctgaagattgctttccccctctggactataagcagcaaaggccttctcaggaacttgtcgccaaggatttgcatggagtcgaatggaggtttcgccatatttatagaggtcagccaagaaggcatctgcttaccacaggatggagtgtttttgtgagccaaaagaatcttgtttctggggatgcagtgcttttcttgaggggagaagatggtgaactgagattagggataagaagagcgcatcgaccaagaaatgttcttcctggttcaactgtcggtgagcagaatatgtgccctgccgttctttcagctgtcgctagtgctgtatccaccaaaagcgtttttcatgtattctacagtccaagggcaagccatgcagagtttgtcgttccctatcagaagtatctcaaaagcatcaacaacgtgatatgcattgggacaaggttcaaaatgagagttgacgtagatgatgcaccagaaaagaggtgtactggtgtagtgactaggataggcgacttggatccttataggtggcccaactcaaaatggagatgcctgatggttcaatgggatgatgatatcacgaatgggcatcaagatcgggtctcaccctgggaaattgatccatctgtttctcactcacctttgagcattcagtcctctccaaggcttaaaaggccgcggactagtctgccaacaatgccgcctgtccctggtggaggggtcaggcttttggactttgaggaatctttacgatcctctaaggtcttgcaaggtcaagaaaagttgcatttggtgtcacctgtctatggacgtgacaccctaaactgtcaggttgatttcgaacaatcccctgcacatcagggtctagcatctgttgtagtagaaaaggccaacaatatcaatgagtacatgagggctaatgcccctagttatgcaggctttgtggaatccgatagattcccaagggtcttgcaaggtcaagaaatatgcacactgaagtctttgacgactaaacctgagtacaacctagggacctgggggaaatccagtctttcgtgcagttctttcggtgtgcatcaggcacccaagtaccatttcgaccaagtgaaatcatccgaaagccttcagaaagtgtactttccatataatgacattcttaaatccagccaagatcgcacaaggtgttccgattcaaccaacttcctccgagaggttgcctccgttaggtcattgagggttcagaatgaagcgattgaaagaaccaaagttgacgtcaggaatctggagagcatatgcacttctcccaatttcggggacagtcaaagagctcaggcaaatgggagtattgacagcctcttaagtggttgcaaattattcggttatcccttgactgcagaagcgcctacttctactctgcaaaattctggtaagaggagttgtaccaaggttcacaagcaaggaaatttggtgggacgagccattgatctctcaaggctgaatagttaccaagacctgctaaatgacctggagcgactgttcagcatggaggggctcctgagagatcatgacaaaggttggcgaatcttgtacaccgacagcgagaatgatgtgatggttctcggggatatcccatggcatgagttttgcgatgtggtgacgaaaatacacatctacacccaggaagaagtggaaaagatgaccacagggatgatcagcgacgatactcagagctgtctggatcaggcgccgctgatgatggaagcatccaagtcatcttccgtgggccagccagatggttcacctactgtcgttaggctttaatgtccaaggtttgctgtcttccaacgtatcccttaactagaataagcttgagatgctgaccctgtggcggcatttgcacaatacaacatgtcgagttctggaccaaaaactcgattcagcctcctgaatatgtcgaggtacttggagccatttaggctcgctgtttgtgtgtgtgtgcatcttttgtaaaagcagttcttatcggctaaaaaaaaaa

SEQ ID NO: 44 - DNA, 3801 bp, Eucalyptus sp.
ccaccaccagctgatttcgcgcctctcgttcgcgttctccgtctcttccttccttttgccggtgggtttccggtcgagatagcggagggttcctgattcagagggcggcggcggcgacggcgacgaggaggaggaggagctccgacctcgaagcgcttcggtccgattcctcccttgcggtcgcgcgtgtctgacggacgagtcgttttttggcgggagatgagagatctgtgcctcgaccagagagaaatggcgtcggggagctccagggtcgaggcccgagctgatgcggagatggcgctctacaacgagctctggcaagcctgcgctggtcctctcgtcgccgtccctcgtcaaggcgagcgtgtcttctattttccccagggccatatcgagcaggtcgaggcctccaccaatcaggtcgccaaccagcagatgcccctctacaatcttccctcgaagatcctttgccgtgtcatcaacgtccaattgaaggctgaaccggacactgatgaggtgtttgcgcaaataaccttgcttcccgaggcgaaccaagatgaggactccctggacaaggaaccccctcctccgcctcctccgagattcaaggtgcattctttctgcaagaccttgactgcctcggacaccagcactcatggtggattctcagtgttgagacgtcatgcggacgaatgcctcccgcaactggacatgtcaaaacaacctcctacgcaagaactagccgccaaggatctgcatgggaatgaatggcgttttcgacatattttccgaggccagccaaggaggcacctactgcaaagtggttggagtgtttttgtgagctccaaaagacttgtcgctggggatgcatttatattcctaaggggcgaaaatggggaacttcgtgtaggtgttagacgagctatgaaacagcaaggaaacgtttcaccatcagtcatatctagtcacagcatgcatcttggtgtccttgctacggcatggcatgccatttctacaggaaccatgttcactgtttactacaaacctaggataagccctgctgagttcatcatcccttatgatcaatacatggagtctctcaagaagaattactccattggcatgagattcaaaatgagatttgaaggggaagaagctccagagcagaggtttactggaacaataatcggcattgaagatgctgacccaaaagggtggcgagatacaaaatggaggagtctcaaggtgagatgggatgagaattctgccatacctcgtccagaaagagtatcaccttggaacgtagaacctgctctggctcctcttgctctaaaccctcttccagtgtccaggcctaaaaggcccaggtcaagcatattgccctcgtctcctgaatcttcagttcttactagggaagtagctgcagacccttcatcttcaaatgggcattcgaggatcttgcaaggtccagaatcatcaaccttgagaggaattgccaccgataatgatttggatgtcgtggagaagtctgtaatgtttacaccttcaatggaggaagaaaagattgatatgctttctgcttctaaaagacatggactggatagctggatgacttcaggcaggagggggccaacctgtgctgatttactatcaggtttcggtggaaatactgatgtctcccatgggttcagcttgtcctccgaacaatcttctgcagctaatccagcgagaaagcatttagtagatcaaggaaggaagtttcatataattgggaattcttggtccatgataccttctagtctatcgcttaacttgtcagaatctaatagaaacagttctttacatggaaatgatatgcactctccgcaaggtattgggaaatatagtgggtccaaagaatatccagttgttcatggccagagagttgagcagccacatcagaactgggtgatgcgtccacccatgtcgcctcattttaattttcctcacgcaagtgagtcaatctcaaagtctccctatgcacaacagcatgaagccattaaagcaaagggaggcaactgcaagctctttggaattcctctggtcagcaatcctgttatggctaagtctgctgtctcagttagaagcgcgacaaatgtgttcacggaccatgtggattccccatcatgtcaagctcatgggtttcgactggatcagccaacggagccactaaatgcagcaaatggtggagatgatctggttgccaatgagctggagaaggagaagctgttccagaatagtcaaccacataacagagatgtccatcatagggttcaggctagctcaactagaagttgtaccaaggttcagaagcaggggattgcacttggtagatctgtggacctagccaagttcagcaattatgatgaactgagggctgaattagatcaattatttgaattcggtggggagttaatgaatccaagaagcaactggctaattgtatataatgatgatgagggtgacatgatgcttgttggggatgacccgtggcaggaattttgtggcattgtccgaaagatttttatttatactagagaggaggttcaaaagatgaagccagggactattagtgccaaagatgaggacaatttgatggtcgatgaaggggtgttttcaaagaaaatgacttcggacacgctgccttcggcgtctgacccaaagaactgttaaaattctctcatgtctgtgaggtctttaaagtcgttggagaagcctaatccagccgtgtcaaaagagtaagctcattggtatctgcgacgggatggtaaacccttatacgaactgtgtggtatctgctcattggtacctcctgtttgcctattttttaattagttccctgatgctgaaattcatctttgtccacggggactgcacataatcttctctgtctatatcctctgtgcttcagtgaccattttctgccccgcaaagccgtatttgtatcatcaatgggattcttggatttggcttcaagatgcatggccccctgaggaggccagagagcttgacagagaactacggcagattgaaaaggagagaaatgaggcctgttcgtattcagcattttgagaaggccaggggagttgaaatggatcacaactgggggggcttccgcagcgaatggacttcactttacagagtagtcgttgcctacctcttcatggtgtttggttactacttaagcgtgtcatccgcttcttgaggaggatattagctttatgcggcgagtttcgattgttgctgatgtagttgtggtggatgaatgatgatatttggatcatactgacattgcggatttgatgatgaatggagaggacggcagagcagtttttgcttatgggatttttgacgaggaagttggtgcaggaggtgagcaagagtcgaagcaaaagagagccaagctatgctgagtgcctttttttttttttcctctcttaagattggactgacccgaacacccttctgtttgggttttctttccggtgttcaagtcagtttctcacaacgtcaatctctcccccgcgccacaaaccccgccccgccggggcgggggttatatctcggcttcagataatctcagatatcaggtggtcggcgaagtgtagggaaaaggacagaatagggattgtcactgctcaaccctatttgtatatggttacggaaaagggattgttactggtcaaccctatttgtatatggctgctttgggcgtgtgaacctataaaaaaaattgcgtctccttgttcggtaaaaaaaaaa

SEQ ID NO: 45 - DNA, 3605 bp, Eucalyptus sp.
gcctcgcccccccctacatcatccctcctcgctccttccgtcctttctctctcctctgcttcttcttcttcttctccttcttcttctttctctctctagctctctcgctctggcccacgcggctgctcctccttcctgctctctcccccccatcgcggccgagcttaatgtgagctcagcttcgagatctgcgtagattagggttttttcgcgagccgagcccgccatgcgcccggccctgtccgcggggcccgccgcctgaatgcgctcgccgcctgctcggtggagccgacgccgcgcgcgggggggtcgagggggaggggaggaagatctagcgggagcctgctacgatggttagggatttcgtctactgtatcggcatcgatttcggttgaggcttttcgtttcctcttctttttctgttggggggtggggggtgggggcgcgcgagggatcggttttcggctcgggcaatggatgcgttcgcgtaggaggcgcggtccgtgcgaggggaggagggcggtttgcgcgggggggttttgggagttgaagacgggaagaaagtggagcttgtgctgaagaatgagactctcgtcgtcgggcttcaaccatcagtcgccggaagcctcaaatgcaggggagaagaaatgtttgaactctgagctatggcatgcatgtgctggtcctcttgtgtcgttgcctcctgttggaagcagagtcgtctactttcctcaaggacatagtgagcaggtggctgcttctactaataaggaagtagatgctcatatcccgaattatccaaacttatccccacagcttatctgtcagcttcataatgttaccatgcacgcggatgtggagacggatgaagtgtatgctcaaatgaccctgcagcctctaagtccgcaagagcaaaaggatctatatctactgcctgctgaacttggaactcccagtaaacagccaacaaactacttctgcaaaacattgactgcaagtgataccagtactcatggaggattctctgtacctcgtcgagcagcagaaaaagtcttccctcctcttgattactcacagcagcctcctgctcaagagttgatagccagggatcttcatgacaatgaatggaaatttagacatatttttcgaggtcagcccaagaggcatcttctcacaacaggctggagtgtatttgttagtgcgaaaagacttgttgctggagattctgttctttttatctggaatgagaagaatcaattgcttcttggtattcgacgggcaaatcgtccccagactgttatgccttcttcagttctatcaagtgacagcatgcatattggccttcttgcagcagcagctcatgctgctgccacgaacagccgctttacaatcttttacaatccaagggccagtccatcggagtttgtcatacctctggcaaaatatgtgaaagcagtctatcacacaagggtatctgttggcatgcgattcagaatgctttttgagacagaagagtcaagcgttcgtagatacatggggacgataacaggcattagtgatctggatcctgttcgctggcaaaactcacattggcgttcagtaaaggttggatgggatgagtcaactgcaggtgagaggcagccaagagtatccttgtgggaaattgagccactaacaacattcccaatgtatccttctccattccccctcagactgaagagaccatggccatctggacttccttcatttcatgcccttagggatggtgatatgagtatcagttcttcactgatgtggcttcaaggtgttggggatcagggagttcagtcgttaaacttccagggatttgggatgactccatggctccagccaagatatgacacttcaatggctgctttacaaactgatgtgtatcaggcaatggcaagcgcagcactgcaggatatgagggcagtggacccttcaaaatgtgcatctcagtctcttctgcctcttcagcaatctcaaaatgttcctatggggcaagcttctatcatccagaggcagatgttgcagcagtctcaatctcaaaatagccttcttcagggcttccaggaaaatcaggccacagctcaaggtcaggttttgcagcacccctcttataatgatcagcgtcaacaacagcagcagcatcaacagcaacctcaacagtcccaacagttcaaccatacgtctcttcagcaacagatgccgaacatcatcactactcttccgcagtatggatctattggtcaatcccagtcatcatctctgccggccatttcacagtcccagcagaatatcttttctgatggaatggagaatcctatagttgcatctgatgtttcccctatgcagagcattttaggttcaatttcccgtgatggggcatcgcagttgctcagtgtgaatggttctgactccatgatatcatcgtcattgttgaagaagcaaaattcagtagaaccacatcttctttctgaagctgctcactgcattctgcctcaggtggaacagttggctacaacacacaccaatgtctctgaatttgcaaactacttacctccatttcctggaagagaatattctgcatatccgggtgccactgacccgcaaagtagtcttttatttggtgttaacattgattccacgtctcttatgatgcaaaatgggatgcagcatctgaggaatattggcagcgaacatgattccttgtctgtgccatttggtacttcaaattttgctagtgttgctggcacagaatttccacataattcagacatggcgacgtcaagttgcgtggatgaatcgggtttcttgcagtcttcagaaaatgtggaccaagtaaacccaccgaccagaacctttgtgaaggttcacaaatcggggacctttgggcggtcactggatatttcaaaattcagcagctatgatgagctgcgcagtgaactcgctcgcatgtttggccttgaaggccaattggaggaccctcagagatcaggctggcagcttgtatttgtagaccgggagaatgatatccttctcctgggtgacgacccttggcaggagttcgtcaacaatgtgtggtacatcaagattctttcccctcatgaagtaaaacaactgggcaaacaaggcatcaaccctgcaaattctgtcccaaggcaggctctctgagcgcatcacggtatttgatgagcatgtttggtcgacagagttgaccgatctgagctttggggtaggcagatgatgggggtcgctggactacttgaagccgagtcgtttggtgtaagaaacggacttggcttctgatagtgtttgaccgtgttgtagtgggtacctatgagaaaaaagagttgtagtaatatattgcttcgagagatgtagtgacgtggtaagtctatctcaagtttgctttataactgtaaagtttaacaccacggatgattgaagagaatgacatcgacattcccgtaatttatctgctgctatatgctatttgtgcctgtaacttgtaagatggactccggacattttcatgaaatgcgaactaaattactcccttcgtaggagatccaaaaaaaaaa

SEQ ID NO: 46 - DNA, 3018 bp, Eucalyptus sp.
gagatttcagagttccgctgaaatttggattttgcagtgctgattgcctaaaaaaatgaggctgtcttctgctggtttttctcctcaagcccaggaaggtgaaaagagagttttgaattctgaactttggcatgcttgtgctggtcctctcgtttctctgcctgctatcggaagcagagttgtctacttccctcagggccatagcgagcaggttgcagcatcaaccaatcaagaggtagatgctcaaattcctaactacccaagcttgcctccacaacttgtctgccagcttcacaacgtgaccatgcatgcagatatcgagacggatgaagtatatgctcaaatgacattgcaaccacttagtccacaagagcaaaaggaagcataccttccagcagaactaggctcccccagcaagcaacccacaaattacttttgtaaaacattgactgccagcgataccagtacacatggtggcttctcagttccccgccgggcagctgaaaaagtgttcccacctttggattactccctacagcctccagcccaggaattaattgcaagggatcttcatgacaatgaatggaaatttaggcatatatttcgcggtcagccaaagaggcatcttcttacaacaggatggagtgtgtttgttagtgcaaaaaggcttgttgctggtgattcagtgctctttatatggaatgagaagaaccaattacttcttggggttagacgtgctaatcgacctcaaactgtgatgccatcatcagttttatcatgtgacagcatgcacttgggccttcttgcagctgcagcccacgcagctgcaacaaatagccgcttcaccatattttataacccaagggctagcccatctgagtttgtcatatccctggccaaatacatcaaagcagtttatcatacacgtgtttctgttggcatgcgctttaggatgcttttcgaaacagaagaatctagcgtcaggcgctacatgggaactattacaggcatatgtgacttggatcctgttcggtggccgaattcacattggcgttcagtgaaggtcggatgggatgagtccacagccggggagagacagccaagagtgtcactgtgggagattgaaccacttacaactttcccaatgtacccgtctccctttcccctaaggctcaaacgcccctggccacctggcctaccctcttatggccttagggatgacgatatgggaatcgcttctccatcaatgtggcttcgagatggagaccgaggaatgcagtccctaaatttccagggaatggggttgacaccatggttgcaaccgaggctggatgcgtccatgcttggattgcaaccagacatgtaccaagccatggctgctgcagctctacaggaaatgagagctgtggatcactccaagctggctaccgcatcccttatgcctgtgcagcatgtgcagaacataacaagcgcttctgcttctctgatgccatcccaaatgttgatctcaactcagcctcaacagtctcttctccaagggagtcgagagagcccacatcattcagtttctcaagatcaagtgcagtctcaccttcttcagcgacagttgcagcatcagaactcatttactaatcaacagcagccacagcaagagcagctgcggcagcagctggtcaaccaggagcagattccaagtgcttcttccccatctcagtttgctttggcgtctcagtctcacactgcatcattgcaaaccatgccttccctttgccagcaactgagcttttctgattcaactggcaatcctgtcactagccccgtcgtctctcccctgcagacactcttgggctcttttactcaagatgggtcaacccatcacctcaacttgcccaggaccaattcctcagtgtccccttcttcgtggccgtcaaagcgagctgcaatcgaatctctcgttccttcagggccttcccaacgtgttttgcctcagatggatcagctgggtccgccccagaataatctttctccaagttctgtctcattgccaccttttcctggcagggaatgtttggaccaagaagtcactgatgtgcaaagccatcttttatttggagttaatttagaaccctcttctcttctgatgcaaaatgggatctcgagcctaagggccgttggtagcgaaagtgactcaacatccatgcccttcccttctaactatatcagcaacagtggtgcagactttgcacctaatccatcagtggcccctcccggtggcattgatgattcgggttttctgcagtcaccagaaaatctgaatcaagtaaacgtaccaaccagaacctttgttaaggtttacaagtcagggtccttcggcaggtcactagacatcacaaaattcagcagctacaacgagctgcggagtgagcttgctcgcatgtttagccttgaaggccagttggaggaccctgtgagatcaggctggcagcttgtattcgtagatagggagaatgatagtcttctccttggtgatggcccttggccggagtttgtgaacagtgtgtggtgcatcaagatactctcacctcaagaagtccagcaaatgggcaaacaagatctggagcttctgaattccatccctgttcaaaggcactcgaacggcggttgcgatgaattcacaaaccgacaggattctagaaccattaactccggaataccatctgtggggtctcttgattatggaactctatgacctgttaagatgcaatttcttgctgtaatattcagtgttgtccaagccatctgtggttggaacgactcgcttagttcttaccttagattgtaacactcatgcagaatttagcactgtaatgatatttgcttctctcccatgtttcccgaattgttatatacgccatgttgctactaggaaattagtgattgcgacacgaggtatgctgggtattgtagacgttctacttgcttattcatcgatggtcttttcatgtagtaaaaaaaaaa

SEQ ID NO: 47 - skipped

SEQ ID NO: 48 - DNA, 1673 bp, Eucalyptus sp.
gtcctttggtattctgcatattctgctgaacacttgatgggtagttactaacttaactgcttccttattaattataagggtaagtcctgttcttttttatattgctaattctttatcaatattggaatgaaggtggaggtcgatattggagctttgctgcttgaagaggaaccgccggcggatggcatcaacttctggtgggaaccaaagtccaatgtctccattgaaggagcaaatgcagacctctggatatcatccataccctccacctcttgcagagtatgatgatgttgtggcaagtcctagcctctttatgactactctggagaagctccattcaactatggggaccaaattcatgattcctattattgggggcaaagagctcgacttgcatcggttatttgttgaagtaacttctcgcggtggcattgaaaagatcattagggagagacgatggaaagatgtgactgcaatcttcaatttcccctccactgcaacaaatgcctcatttgtgctgcgcaagtattatgtttcactgcttcatcattatgaacaaatttactatttcaaggccgatgattttcttgtcctaggaactctgcagagcccccctgtgccaacatttttggcacaacagatggaagctatgcatcctgcgcaagaaaccaaagtgccaatgactctgcaaccaaggacaacagcatcggacttgcctcgagcaggcactacctcacctgcgaattctccagtggtgggagttattgacgggaaatttgaaagtgggtacctagtaactgttacaataggctcggagaagttaaagggtgtactttaccaaacgcctcagagcgctgctggaaaaatgcctcagcaattcaatttctccatcaataataacaatgtagctggaagttctggcattcaacgtcggcgcagaaggaaaaaatctgagatcaagaggagggatcccgcacatccgaaacctaacagaagcggttataatttcttttttgctgagcagcacgcaagattgaaacctctccaccctgggaaggacagagagattagtaggatgatcggcgaactttggaacaagctaaacgaatctgaaagaactgtttatcaagacaaagcgctcaaagataaagaaaggtacaagatggagatggagagctacagggagagattgaggatgggccaggtcgtcagtgatgccgtgcccctgcaacaacgacttcccgaattagatgtggacatggcagatgtggatgcaaatcctgaagagactgaagaggggaattctccccaaacccaagataatgagagtagcaccgataaaagcttttctgaggaggatgacaaagacactgagaaggaattggatgtggaggcttcacctgtatgtgctgcagtcctcgagagtagcaatttggatgtcaatgaggcacatcctcagatggatgttgcaaatgtagaggagggtcgtgagaagcaggacatagccattgacaatgttgaagtggcagaaagcgtcagagatgggattgaaaatgtcgaagatgtagacaaagaaaaattgggccaatcttctagctgaatgatgaatttttttgctttgaaatatttcagggaagataatcggcagtgatttttcagctctaaaaaaaaaa

SEQ ID NO: 49 - DNA, 1069 bp, Eucalyptus sp.
gcctcgtgccgcacacgagcagaagagttttggaaatctcgctctacgcaggaaggcaaaggactcaccgagaagactcagtcggcgttcgaagttggagttctttctcttgagcttcatcgtccgtagtagcttttcgagactcagttgcgtcgcgatcgagcctgcgacacatcggggagatcgggatggaggggtctaagagcaacgggtacggcgagtgcgatcaggccaacctgaaggcgaccgagctgaggctagggcttcccgggaccgaggaggaaccgccgttgaaggtggagtctccctctttcaatagcagaaagagggctttagcggatgatgcggaatcagttctgcaagatggaagaaagagcacctctggtgtccctcctccttccaaggcgccgatagttgggtggccaccagtccggtcgtacaggaagaacatttattcgtcgccagcagaggtagctgagggtggcgcaggggctggctacttgaaggtgagcatggacggtgctccgtacctcaggaaggtcgatctcaagacgtacaagagctaccaggagctcatggaatctttggaaaacatgttcaacatcaccatcggtgattgctcggacaaagggtctgattatgcgcctacctatgaagacaaagatggggattggatgcttgtcggagatgttccttggaacatgtttacgtccacatgcaagcgactcagaatcatgagaggtggatcaagaagctagacatgcaaaacacggccattaaagcttttgttgattgttttcaaggtcctgttcagatgccgcgaggagaagacactaaaaaccagctgaaaccagaagagactcgtgcagatctgaagctgccatgcaatgtttccagtccacttcgggcttttttacagatttttctttaccaagacatgtgtacaagctattgagatttgcaaactatacaaaaaatagggtacagacacactgatcaagccagattcttattgttcaaattttcttctcaataaaaggagaaaaaagcacttttcttaaaaaaaaaa

SEQ ID NO: 50 - DNA, 1311 bp, Eucalyptus sp.
ctcgtgccgcaactcctcacctttctttgtctagcgaaaaagttggcgcctttatgccctttttcccctcctctgtcatcgctataaagaacaggaacccaccgcccaagttcctcttctgctcgcatttctctctgggtcttgactttttggaggctgtggtgtgttctgggtcttgggtcggggactgtttcatcagggaagaaaagggtcttttctcttgaaaggtggggggaagtttaggtgctgaaagatttgagcttttttgatggagtttcgagaaatggagagaggggttggggatggagtgttcgggaaggatctcctcaacctggaggagacagagctcaggttggggttgccggggacggaggaatctggccagaagaaatcgaggaccggcaagaggctgttctctgagtcgagcgatgtgtctggatcttcaaagggtagctgtgttgctcctcaccatgatgaagaccatgaatctgctcccgctcctaaagcacagatcgtgggatggccgcctgtccgatcctaccgaaagagtgctcttcagccgaagaaggcggaagcagagggccctggtatttacgtgaaagtaagtgttgatggagccccttatctcagaaagatcgatctcaaggtttatggtggttatccagagctcctgaaggctttggagaacatgttcaaactcaccataggtgactattctgaaagagaaggctacaaaggatctgaatatgcacctacctatgaagacaaagatggtgactggatgttggttggagatgttccatgggaaatgttcattttgtcctgcaagaagctgagaataatgaaagaatcagaagctaggggcttgggttatggtgtttgagaacatcccaaaggtaaagaagattgatttgcctcggaaaaaaaaaattctccagctcgggttcttggagaattttcaatcttgatgtaggtctccccggtggagacttgttgaagtttttgaaaggactctctagtcacgaaagggaagttatttacattttgcagtttgtctttgaaaatttggcagctgctcttttgttggtttgggcatctgcctgatgttttctttacctagtgatctttctttttgaatgaaaggaggacggcgcccagatagatactgccttacatgtaaagtactgtaggagggaaatgggtgaaaatatattggcattttcatccaatgtttgctttttccatcggtttttgattgtcatcgagtcttatcaattcaactttttacttatcaaaaaattaaaaaaaaaa

SEQ ID NO: 51 - DNA, 807 bp, Eucalyptus sp.
tatcatttcctgcctttatactttatattgctgtctaaaggcgactcgacaggaagaaaatttcattttcgagcgaacctgtaaggtcgagaagagaggagatgggtctggagaaggcgaaggagtcgccggaagtcgacgctaacccaggctcgagcttggaggagatcaccgagctccggctagggctgccgggggagaaccgggggaagtcgggcacaaagcggggattctccaagactgtcgatctcgatgaatcagccgtcggtcgcgacgatgaggccaacaattctcctgtgggcggtgcacgggtgaaggatgaagtttccggcgcagctaaacctcctgcagccaagacgcaagccgtggggtggccgccggtgaaagcgttcaggaagagcgtgatgaagagctgcaagtatgtgaaggtggccgtggacggagctccgtatttgagaaaagtggatctggaggcgtacgacagctaccagcagcttttggctgctcttgagaagctcttctcttgcttctccatatgcaattatgcaagcgagaggaagatcgttgacccggcaaacggtgctgaatttctgcctacttatgaggacaaagatggtgactggatgctggttggagatgtgccttggaaaatgtttgtcgaatcttgcaagcgactgcggttcatgaagagctcggaagccaccggtctaggtccaacgacccagtctgcgtgcacaagttcaagttgaaaagaagggacatcaagcttcccgagagagagagagagagagagagagagagagagag

SEQ ID NO: 52 - DNA, 1381 bp, Eucalyptus sp.
gcttctctctctttctctctctctctctctatctcttccccaactccactcaacaactcctgctcctccctcctctcgccttccccaggcttccctcaaaagcgccagcccaagaagctctctctccttcaaacacacactctctctctctctttctctgtcttgtcatctctgcttgtgcttgtgtgcgtgctatattcatggaagctccacctgctcgcggccgtgaggcggcggcgccgaagcgcgactcggccggagaggaggcggagctcgagctcggcctcgggctcagcgtgggcggcggcggcggcggcggcgagcgcgccggggccaagcgcggcagaatcctgacggcccgcgacttcccttcctccgtggggaccaagaggaccgccgacgagtccgtctcgcaggagggtggcggtggatcccccacttctgcaagtcaggttgtgggatggccacctataagggcatacaggatgaacagcctggtcaacctcgcaaaggcacctcgagctgaggacaacatgtcgccgaatgaaaagagcaagtcaaaggatggttcggaggacaatacgcgtactggtggcatgactgatgttgacggcagagagcaaaagcatatcgggtttgtgaaggtgaacatggatgggatccccattggaaggaaagtggacttgaatgctcatgcttgttatgaaactctagctcaagctttggaagacatgttcttccgacctgccaaaactattgatttaaccggggctgaagaaaataggcaggtcaagaagtcctcgaagcttctcaatggatgttctgagtttgtgctaacttatgaagataaagagggagactggatgctcattggagatgttccttgggggatgttcctcactgccgtcaagagactaagaatcatgaggacttctgaagtgaatggaatagctccaagattccaacaaaagagcgagaggcaaatgagaaagccgatatgatagcttttctcatcagtctcctcaccctttcaaatctgactacacaaaagaagaaatacctcggaagcgtataatttaggaaaaactatagacacccgatgagagcgcaccctgacgaaatgtgctgatcttcctggtttacattctgccgaccgtcctccggttgtcttttatatttgttatatttccttttttggttttgtgtcttcaaagggtagattcatctccatctttagtccttccaatctctccattaggtggagtcatgaggtgctctgcatattttgctgaatgttctttttggattctcatactgtaaatatgggaaaactgagttatctagagagtttgagtttgcattgatgcttgtaaaaaaaaaa

SEQ ID NO: 53 - DNA, 1555 bp, Eucalyptus sp.
tcatcgcgagcatctaccagacttttttctttagctttgcgacattattgcgcacacgcactgctcatcctcgtcctcttccgctagcaaaaaacggtgcagaacaggagaaaacaaagcggcccccgtcaaaaacaagaaccgaggagagacaggagaggcagagagaagtagagagagaaaggtgggattttgaggccttcttgggggagtgaacggaggtttcttggtgggttcttggtgatttgggtggggttagcgattaatcgagcagagaaggtgagagagagagatagtagcagaaaagaaaggcaccatgagtgcagagactgcagagaggttcactatagacttcgaggagacggagctgaggctggggctggggaggcccgcgggggttagcagcaacggcgagggcgcgacgcggagcggcgggaagcgggtgttcttggagaccgtcgatctgaagctcaacttctcttcgaaggaagacggcgggagcgtcgagaagatcagggcgtcggcccccgcggagaagaagatgaacagcagtgacggtaaggagaagagcgtcgctgctgctgctgctgctgctgcggctcctcctcctccttcgagctccagcgaggtggcaaagccccctgccaaggcgcaagtggtgggttggccacccgtgcgatcgttccggaagaacatcatggccgtccagaagagcggctcccacgaggccgagaagggtggcagcagcggcaacggcgccgcgaccagcggtgcagcgttcgtgaaagtgagcatggacggtgcgccgtatctgcgcaaggtcgacctcaagctgtacaagagctatcaggacctctctgatgccttggccaagatgttcagctctttcaccattggtaactgtgggtctggagggatgaaggacttcatgaatgagagcaagttgatagacctcttgaatggttctgactatgtccccacttatgaggataaggatggggattggatgcttgtgggagatgtgccttgggacatgtttgtcgattcgtgcaagcgcctgaggatcatgaaaggatctgaggcgatcggacttgcaccgagagcagtagagaagtgcaagaacagaagctgaaggaccccggctctgacgtgtctaggtatggcaaagtccccctcgtgcttgtgatcgtcgccaaaacggaggaaatcagaccggctcgagagggatcgagcacggagtttggatgcttctttttatcaatgcctttctttctctttttttcctacccttattctcttttcttttcttttcctcttgatctcaattaagtctgagaagaaagtactggaaaaaaaacctgttagggaaaaggaagaaaaaggacctgtgaaatgggttatatgtttataagacatgttcatgtgtaacctctttggtttttttggtttcactgttgtagctgtactggttgttttcgttccctccattttgtaatgccgtgtattttgtcctaaatgatgaaaaattatgagtctttgtattgtaaaaaaaaaa

SEQ ID NO: 54 - DNA, 1143 bp, Eucalyptus sp.
gaaatgatggaagtgggactgaagatgggtgggaagctgatgcagagtgaagagagggatcagaagaagaagcatgaagatgcagaagcagaggagagagagacagagctgaggctagggttgcctggtggcaacaatggaggatccggatctgatcaagcaccagacctccaagtggtggtgggggcgaggaagagaggttatgcggagactgaggtggacttgaagctcaacctcaatctctcttcttcttcttcttccggttcaccaccaccatcatcaggctctgatccaaatgaccagaccaactcgttgcccggcaggctcgacaagaggaacctgttgccttgtcccacttctgatattcctgtcaagcctccagctaaggcccaagtggtgggttggccaccagtgcgatctttccgcaagaacatggtggcagcgcagaagagcagcaccgaggacatgagcagcggtggcgccgcctccttcgtgaaggtgagcatggacggcgcaccgtacctgcgtaaggtggacctgaagatgtacaagagctaccaagagctgtctgaggccttgtgcaagatgctcagctccttcaccattggaagatgcgaatcccaaggagtgaaggattttatgagcgagagcaagctcagggatcttctgaatggctctgactacgttcccacctatgaggataaagatggtgactggatgctcgttggtgacgttccctgggagatgtttgttgaatcatgcaagcgccttcggataatgaaaggaaccgaggcagttgggctcgctccaagagccatggaaaaatgcaagagcagaagctaaaagaagtgtgtggatcacacgcagcctgcttctttgatctggtggttgaaagacagcacagatggattgagcaggtggtgatttcgatgtgttttattttttgtatcatgttgtcctgtgattacgttgaagtttgagatatatgtctatgaatttgagcaaatatgaaccccataaactttatgactctttcgtatgtccaaagactcggttttgtctttgctttgtcttagtgttaaccaatgttgtgtggctctagcctagcaataacatgtacggtgcttcgttgtaaaaaaaaaa

SEQ ID NO: 55 - DNA, 1704 bp, Eucalyptus sp.
tttccctacaacaactcatccaaacggggcaggaacaaggggaatgaaaccattttaagggtgccaacacgccacaggagagaaaaagagaacactacaaaggaaaagcttgatatcattccattccacccttctcactctctctctctctctcactctagccctgcttttgccttcctgctctcgtgacgcctccttctcttgggaaggtttatgccggtctctattttagtccttcaggtttcgagtctagcgtcgtttggctctccgtctcttcgaagtgggtgctcctaagttgtgcttctcgtggctctcaaggttcaagctcacgcctttcccttggatttccaacactccgagcatttccatcttgtccagcttcatgcgaggcttggtagtgtggttcaacacttgggagctttaacggaagaatttgaagtaaaagagtgtttctttctgtccactcccaactggcaaaactcaaaacactaaacgcatggagcgagtttcaagaaatggggaggcttctcagctgctagatttcgtagcaaaggagggagagtggctcatgaagagactccaagagcaaagacgtggccctactcctccagaggacaaggcgctggagctcaagctcggcccccctggtgatgaagaccggtccaagaaagacttcaccatgaagtacaaattagaaaaggacgagtctcttctctctcttggctacttcaacggtggaaatcaagctcaagcacagaaccttgctccatatctccagctctcaccctcaatctttcggacccaattgcctgttttggcaaaggataaatcctctgaaacggtggacttgcagaacaataatgatgctgcagagaaaaagagagcatttttaccagcttctgctgctgcaactacagctgtgcccaacagctctcagaaaaggactgctccagctccagttgttgggtggccgccactgcgaatgttccggaaaaatctcactagcagcgatggccatggaaaaccagcccccaagactcatcagaacatgctctcgagcaaaatagtcagtgaaaagcctgctgaaagtagtggaaaaggcttgttcgtgaagatgaacatggacggtgtccccattggccggaaagtggatctcaatgcctatgacagttatgaaaaactgtccgctgctgtcgatgaactcttccgaggccttcttgcagcacaaagagattcctctggctgtgatatcaagagcacacaggaagaagagaagccgattacaggtttacttgacggaagaggggaatatactctggtttatgaggactacgaaggagacaggatgcttgttggcgacgtcccttggcatatgttcatatccacggtgaagaggctgcgtgttctgaagagctctgagatttctgtgctcagtgccggtggacagaagcaagacaagatgtcgtcggattctgcaatgcaatgagcggactctatccctcgcacgaaggagggatctagttcagattggtacttaacattgaactgcatataacgatcgatggagtatcatcaatatccttatcttatcttactgcttgtaattctacactttttgtgaggacgaattcgattgtgtctaaacacttctcatgttcctcggcctcacgtaagcaatgcaattttttttccagaaaaaaaaaa

SEQ ID NO: 56 - DNA, 1444 bp, Eucalyptus sp.
gcctcgtgcctaaccagctctctctctctctctctctctctctgttgagctaaccagagtgacttctcactcctctctctctctctctctctctcgcgacggtcccgtctctacttctccctcacatatctctcccaactttcatctctgcgaacttggagctccttttcattttgagtaactttgatgtctacgccgttggtacatgattacataggcttaaaagaggcttctttaatgtcaagaagctctgagaaggccttaccctcatcttcggcaggcgaagatgagaagaaatctgctctcaacctcagagaaaccgagttaaggctcggcttgcctggttccctgtccccggagaggaagcaagctcttggcgtccctctgttcgggaaagatttggagagcaagagcggcgtcttgggttttgctctgagcccttccaagaactcggtttcgggagccaagagagtgttctgcgatgccattgacgggtgtcccagcaaatgggtgttctccgcgagcaacggtaaatctgaggtggatttggccaagggaggtcctgttttgtcgtctccgagaagtggcaaggagagtgataatggggttaacgccctgcaatcttgtgtgcccaaacctgccatgacagagggtcttggtggtgttcctcaatctccgaagcccgagcaagaggagaggaagaatcaaggtgctggtgggagtgagcatggctctgctccagctgcaaaggcacaggtagtgggatggccaccaattcgatcgtttcgcaagaacaccacggcctctactttggcgaagaactgcgacgatgcggaaggcaaatgcctctacgtgaaggttagcatggatggagctccctatctgaggaaggtcgacctaagaacctacggcagttattcggaactctccactgctcttgagaaaatgtttagctgcttcaccatcgtatcagggcattgcgattcccgtgggcctctggggcaagaaagcctgagcgaaagccgtttggcagaccttctcaatggttctgaatatgttctcacatacgaagataaggacggcgactggatgctcgtgggtgacgttccctgggagatgttcaccgactcatgtaggagactaaggatcatgaagagttccgaggcaattggtctagctccgagggccacagagaagtgcaagagccgggattagcgcgcgtggcgctaaggacttcctctaaaaaggattttgagtcgtataattttattgaattccctatgtatgttgctaattgtcctttgaagcgttggaaagtttcctcgaatggaagtttttcatttgaagcgtgtctagatgatatgtttgtttttccggttcctaagatgttgtatgtccgaattcctgttgatgtaaatggtctgtttgctgcttaaaaaaaaaa

SEQ ID NO: 57 - DNA, 1587 bp, Eucalyptus sp.
gcgtcggacagccaaaaccagctccggctgctttgtgccaaatggagggtccttagctttctctctcctctttctctctctctctcctctctctctctctctctaagctcggagcacactcctcctcctcctcctcctctgctgcactaacccgacgcacctctcaatcagccctttctcctccttcccaagattcttcccccagaacctcgtcaggtttctttggcgctccagctagtgagacgataaatagaaatcaaaaactttgatgtccccacctcttcttagtgttggggaggaggagtgtgagagcaatgtcactttgctggcttctccgtcctccttgggaagtgtatgccagaacgctgagttgaaagagcgtaactacatgggcatgggcgatcatccttcagcggacggttccgtcatccccaatgcctttgatggttgcaagatcacccttaacctgagggctactgagttgaggctcggacttcctggatcccagtctccagaaagagatgcagacttttgcaccataagctcagcgaagcttgatgaaaagccgttctttcctttacacccttcaaatgatggtcactactcttcgcagaaaattgttgtctcaggcaataagagaggctttgctgatgctatgggtggtgattcagaggcaaagttcatggcaaatccagaggcgaatgtcgtgctgtcgcccaggccatctcccaatttaggactgaaaaatggttctggccttgaaagctttggatctagacctgccaaagtcaaagagataccaaccgcacaggttgcaccagaaaagccctattctaccaaggaaacccaacctaacaatggttccagaagtaataatgccggctcacctgctcctaaggcacaagttgtagggtggccacctataagatcattcaggaagaattccctagctaccacttcgaagaatgctgaagaagtcgatggaaaactaggatctggtgctttgttcatcaaagtcagcatggatggtgctccatatctgaggaaagttgacttgaaacattacagtgcataccaggagctgtcttctgcccttgaaaagatgttcagttgtttcaccataggtgctctgggccgggagatgctaagtgagagcaagctgaaagatcttttagatggagcagagtatgttctgacttacgaggataaagatggtgactggatgcttgtgggtgatgttccttgggagatgtttttggatacatgcaagagacttcggatcatgaagagttgcgatgccattggactagcacccagggcagtggagaagtccaagaacaagaactagctaacatcactcgcgatgaaagatatcaggtagcccgtggggtggaagtcagctcaggatgaaaagtcacttgaaccagaaaaagagtggaagttgacaagacagacgacatcagatcagctaaggaccgtgtatggctaatctactctgttgctatgtaattcctttcacttgtgagggactcaaatgtccttgaaccacgtttctactatagtttatgcaaaaaaaaaaaaaaaaaa

SEQ ID NO: 58 - DNA, 1576 bp, Eucalyptus sp.
ggtctctctctctcattcccatccatcccagcttgccaaagtctccagctttcttgagcaggacctcgttttccccctcaagattctttctttccagtttttgttcatgtttctttggcgctccagctagtgagacggtaaatagaaatcaaaaactttgatgtccccacctcttcttagtgttggggaggaggagtgtgagagcaatgtcactttgctggcttctccgtcctccttgggaagtgtatgccagaacgctgagttgaaagagcgtaactacatgggcatggacgatcatccttcagcggacggttccgtcatccccaatgcctttgatggttgcaagatcacccttaacctgagggctactgagttgaggctcggacttcctggatcccagtctccagaaagagatgcagacttttgcaccataagctcagcgaagcttgatgaaaagccgttctttcctttacacccttcaaatgatggtcactactcttcgcagaaaattgttgtctcaggcaataagagaggctttgctgatgctatgggtggtgattcagaggcaaagttcatggcaaatccagaggcgaatgtcgtgctgtcgcccaggccatctcccaatttaggactgaaaaatggttctggccttgaaagctttggatctagacctgccaaagtcaaagagataccaaccgcacaggttgcaccagaaaagccctattctaccaaggaaacccaacctaacaatggttccagaagtaataatgccagctcacctgctcctaaggcacaagttgtagggtggccacctataagatcattcaggaagaattccctagctaccacttcgaagaatgctgaagaagtcgatggaaaactaggatctggtgctttgttcatcaaagtcagcatggatggtgctccatatctgaggaaagttgacttgaaacattacagtgcataccaggagctgtcttctgcccttgaaaagatgttcagttgtttcaccataggtgagatatgtccacatggtgctctgggccgggagatgctaagtgagagcaagctgaaagatcttttagatggagcagagtatgttctgacttacgaggataaagatggtgactggatgcttgtgggtgatgttccttgggagatgtttttggacacatgcaagagacttcggatcatgaagagttgcgatgccattggactagcacccagggcagtggagaagtccaagaacaagaactagctaacatcactcgcgatgaaagatatcaggtagcccgtggggtggaagtcagctcaggatgaaaagtcacttgaaccagaaaaagagtggaagttgacaagacagacgacatcagatcagctaaggcccgtgtatggctaatctactctgttgctatgtaattcctttcacttgtgagggactcaaatgtccttgaaccacgtttttactatagtttatgcaaaaaacaaaaaaaaaactgtcaagacctgtgtttaagacttttttagtacctgaatttcgaaaattatgtaaacctgcctgtttttaaaaaaaaaa

SEQ ID NO: 59 - DNA, 1648 bp, Eucalyptus sp.
gttgctttctgcttaatggaaggcccttaatccctttctctctctctctctctctctctatctctctcttcgtttctctctgtctgcaattcgtgcatttctgcgtcttgggtcgagaagggtacttcgtgtccggccggttggggaggtgttctccagttcaagagaatagattgattgtctttcaagtctgatgtctccaccacttctgggtgtggaggaagggggtggcaatacctctacagtagccacctcaccctccatagatggcgcctctcatgactgcttggggttgaaggagcgaaactatctgggtttgtctgactgttcttcagttgatagttctgcagtttcaagcttgtctgatgagaataaaagtaatctgaatctaaaggctactgagttgacgcttggtctccctggatctcaatctcctgaaagagaaccaaaactgtgcttgctgagctctggaaagctcgatgagaagccattgtttcctttgcttcctttgaaggatgggatctgctcatcgtcacttcagaagaatattgcttcaggaaacaaaagaggattctctgataccatagatgagttctcagagctgaagagctctaaataccctgatggaaattggatgtttcatgcaactggacctgctcctgaaactgcgcagtgtggaggccaaggaaagtttcctggtaatgcagggatgaaggcaatgctcccatcaaggacttctggggcccaggcgactgtgccgaaggaggcactcccaaaaccagcaccagaatgccctcgtgcccttaatggagctggagttagtcagacgagagcttcaaacaatgctcctgctgcgaaggctcaggtcgttggttggcctcctattagatcatacaggaagaatacattggctacaacttcaaaggacaatgatgaagttgatggcaaaccaggtcctggtgctctttatgtgaaggtcagcatggatggtgctccttatctgaggaaggtagatctgaggaattactctacatatcaggagttatcttcttctctggagaagatgttcagcggattcaccataggtcaatgtggatctaatggtactccaggaagagagatgttgaacgagagtaagctgcgagatttcctgcatggatcggagtatgttcttacttatgaggacaaggatggcgactggatgcttgtcggggatgtgccctgggagatgtttattgagtcatgcaagcggctcaagattatgaagggtgctgatgcaattggactagcacctagagcgttggaaaagtcaaaggcgagaaactagtgcaggttgctatgcttgcctagttacatctgtctgtctactggagtggtatatgtggagatatttgtttgttaatgggaaagagtactactcggcccggtgctaatgtccatcatgagtctttgtttattgcctgaaaatgtcgctgttgttagtctgaagtctgtctcaaccctatgattgttgtaagtactttcataagtcgctagaagaagttgtgcttgtttgaattttagtgacccagtagaattcttggttcactgtgtgtatgtcacgagattgttcctgtcagaaagagatctgttggatgcaaaaaaaaaa

SEQ ID NO: 60 - DNA, 1567 bp, Eucalyptus sp.
tctctgtctgcaattcgtgcatttctgcgtcttgggtcgagaagggtacttcgtgtccggccggttggggaggtgttctccaggaggcgtttctttcccgtgattctactctaatttggtctcttctttcaagagaatagattgattgtctttcaagtctgatgtctccaccacttctgggtgtggaggaagggggtggcaatacctctacagtagccacctcaccctccatagatggcgcctctcatgactgcttggggttgaaggagcgaaactatctgggtttgtctgactgttcttcagttgatagttctgcagtttcaagcttgtctgatgagaataaaagtaatctgaatctaaaggctactgagttgacgcttggtctccctggatctcaatctcctgaaagagaaccaaaactgtgcttgctgagctctggaaagctcgatgagaagccattgtttcctttgcttcctttgaaggatgggatctgctcatcgtcacttcagaagaatattgcttcaggaaacaaaagaggattctctgataccatagatgagttctcagagctgaagagctctaaataccctgatggaaattggatgtttcatgcaactggacctgctcctgaaactgcgcagtgtggaggccaaggaaagtttcctggtaatgcagggatgaaggcaatgctcccatcaaggacttctggggcccaggcgactgtgccgaaggaggcactcccaaaaccagcaccagaatgccctcgtgcccttaatggagctggagttagtcagacgagagcttcaaacaatgctcctgctgcgaaggctcaggtcgttggttggcctcctattagatcatacaggaagaatacattggctacaacttcaaaggacaatgatgaagttgatggcaaaccaggtcctggtgctctttatgtgaaggtcagcatggatggtgctccttatctgaggaaggtagatctgaggaattactctacatatcaggagttatcttcttctctggagaagatgttcagcggattcaccataggtcaatgtggatctaatggtactccaggaagagagatgttgaacgagagtaagctgcgagatttcctgcatggatcggagtatgttcttacttatgaggacaaggatggcgactggatgcttgtcggggatgtgccctgggagatgtttattgagtcatgcaagcggctcaagattatgaagggtgctgatgcaattggactagcacctagagcgttggaaaagtcaaaggcgagaaactagtgcaggttgctatgcttgcctagttacatctgtctgtctactggagtggtatatgtggagatatttgtttgttaatgggaaagagtactactcggcccggtgctaatgtccatcatgagtctttgtttattgcctgaaaatgtcgctgttgttagtctgaagtctgtctcaaccctatgattgttgtaagtactttcataagtcgctagaagaagttgtgcttgtttgaattttagtgacccagtagaattcttggttcactgtgtgtatgt

SEQ ID NO: 61 - DNA, 1066 bp, Eucalyptus sp.
cccggttttactccacgaccggctccgacgtctgaccacctcctcgttcccccaaatctctctccctctctctctcgagcggcctgcgaattttttccaattctccgtcccggaaggcggtaacggcccggagatccggcggctggtcttcccggcgatcgtcgcccgagatggtgtctccggagcacacgaattggatctacgactgcggcctcatcgacgacatcgccgccgtggccgacggggatttccaggtctccggctccgggtacacgtggcccgtccagcccctcaacggatcttccatcttcagcacggaaattgatggttcctttggggagtcagatggagtgaaggaaaatggctcaaaaaagagggttagaactgaatcatgcggcacttctagttccaaggcatgtagggagaagttgcgcagagatagactaaatgacaagtttttggaattggcatctctccttgaacctggaaggcctcctaaggctgacaaggccgctatattgatagatgctgttagaatggtgacccagttgcgtggtgaagctcagaaattgaaggactcgaacagtagtctgcaagagaaaatcaaagagttgaaagctgagaaaaatgagcttcgtgacgagaagcaaagattgaaagccgagaaggagaagttggaacaccaattgaaggccacaagtgcacaacctaacttcttgcctccacctcccgcaatgcctgcggcatttgccacccaaggccaggcccccggaaacaagttggtgcctttccttggttaccctggtgttgccatgtggcaattcatgcctccagcggcggttgatacctcacaagatcatgttctccgcccaccagttgcttaagttgcaacattggatcatatgggctggctttcatttggtcctcaatatttgaatcagtttgtcatgtttattggctgttttagctttcgctggaagtgtactgacttctttttgttggacgagtaccatgtgtacaatcagaactatcatgacttatgatggtttcacttgtaaaaaaaaaa

SEQ ID NO: 62 - DNA, 2223 bp, Eucalyptus sp.
ggaagaactctccacggacaagcctcgatccttcacatggcttgatgaacaacaatccagacatcggacccaagagaactcgtgcgacagttgtcggatttcttcctggtccagcaaccattttcgtctttgctctctgcccagaatcgattggagtgagtcgagctagaaagtctcgatttttacgtttttcgacttgatccataatcaggatttattagagccattgctggttcacagtggtggtgattcttctctctgtgaggtcctacatctagcgggttcgagctcgaggatggacgactcggatttcgaggtcttgagcgatgatcctcgggttgagcctgggattagagcactgcagagaaatgggtcgtcgtcgtattcgtcgttggtgctggacagcgagaggggagagctggtcgaggcctccgtgagcgccaagaggaaaacgccgcctgccgagaggaatgttgatgccctgaagaatcacagtgaggcggagagacggcggagagcgaggatcaacgcgcatctcgacacgcttcgtgggctagttcccgaggcaaagaagatggacaaagcagcgctgcttgccgaggttgtcaaccacttaagaaagctgaaaggaaatgccgaagaagccatgcagcagtatgtgataccaacagatgctgatgaaataaaggtggagcaagaacggggtgaagtagtggatttagaatttgaaacgatcaaggcatcactttgttgtgactacagacctggccttctctccaatctaaggcgagtgcttgtcgaccttgggttgatcgtgttgagtgcagaggttgccacccttgaaggaaggatgaaaagtattatggagctgacaagccatgtaggagataagacattgtgtcaggtactttcaagctctctccgtttggccctttgttcaatggtcgatcagttctctacttcagaggagtctccaaggccctcagtgtcagacaagaggagaagggcttaattatcctgttgtgaaagatcttggagaagctagagaaattcgacttctgtgatagtctgacttctatagtacatggaacgtcctttggtaagagctgcgtcataagtactgatatagttccatgtgttcttttcttccttctttagtgaggtgagcttgtaaagatgttttgtgcctgaagctataaccaactggattattgttggtactttgaaataattcagggaaattatagttgagtgtcggatctgttgtacagaaagttttcctggatggataatgcacgactggctaatggaccctcctcaaaatagatagtttctctgttaatggacactcatcaagctatggctgcctatccagcaaatagatgccaggaatctcgagcagttgtgaagcgatcagtggaataattataactttcactgatgggtgtggaatttcatcccgaatcaagtggtcagtgttctgatgtcaagtcagcaaactggtgataatcatcaggagttagctcccatctgccaccacgtccggacggtcgatgcatgtttgttctgcaggttttcacctcaagttacgaattaagtttgccaagactcgggacattggcaaacaaagcctgcctcgactagagactgcatttcttgagggggtggttaatacagtaacagcactggggcataagagaatcaggcagatcgctatgggaacaactaaggagccaagttggcatcaagactcaacagcacatctaaagatcgcagcctgctagacgatctccaccggactggatgtctcagcgagtcccttggccgactttgacatgatttcgacggatgagacttcctggcgttgtccaaatgaagatattagatgcctttagaaatgttttccaatgtgaactctgtcggatgctagagtcaagatgtaatgctcctgttattgtcgctccaagtggctgatctgtttagagcaacttctatcagcaagcgtgcacagtgtgtgctgtcctggctttattgttctcaaattctgcttatttcgcctaagttctcttttaactttaatcagcatcagtggcgaaatcgagcgtggtttgcttgcaaccgtcgaattctttgaggaattaaaagcatatcctactgtgaacagtcaaaccagaattaggatggttcgggtatcacaaagtctagttaaccccaaaaaaaaaa

SEQ ID NO: 63 - DNA, 1049 bp, Eucalyptus sp.
gatctcattccctcccaatctctctcgtccttctctctcccctgcgtaaaacctttgcgctaatccttccgcttgccgccggggaaggggcggggaattccggccgtccggaccgagatggtgtcgccggagcaggcgaattggatctacgactgcggcttgatcgacgatatcgccgccgccgcggcggacggcggccccttccaggtctccggctccggattctcgtggcccgatcagcccctgaacggatcctccattttcagcgcggaaattgatggttccttaggggattcagatggagtgaaggaaaatggctcaaaaaagagggttagaagtgaatcatgcagtgcttctagttccaaggcatgtagggagaaattgcgtagagatagactaaatgacaagtttttggaattggcatctatccttgaacctggaaggcctcctaagacagacaaggccgcaatattgatagatgtggttcgaatggtgacccagttgcgtggtgaagctcagaaattgaaggactcgaacagtagtctccaagagaaaatcaaagagttgaaagctgagaaaaatgagcttcgtgacgagaagcaaagattaaaagcagagaaagagaagttggaacaccaattgaaggccatgaacgcacaaccaagcttcttgcctccacctcctgcaattcctgcagcatttgccacccaaggccaagcccccggaaacaagttggtgcctttcattggttaccccggtgttgccatgtggcaattcatgcctccagcaactgtggatacctcacaagatcatgttctccgcccaccagttgcttaagcaacagtagatcatatggcctggctttcatttgatcctcaatatttgattcagtttgtcatgtttattggctgatttagctttttctggaagtctactgactgctttttcgttggagtatcatgtgtacgatcatagctatcatgacttatgataatttcacttgtaaatttcgccaaattttataaggtagctatcttccaaaaaaaaaa

SEQ ID NO: 64 - DNA, 1090 bp, Eucalyptus sp.
ctctctctctctctctctctctctctctatctttgatacccaaacaaaacacacggaaaagaaaaacccacaagcacgccatggacaacaatgttgaggaataccagaactattgggagacgaccatgttctaccaaaatgaagagctcgacagttgggtggacgaggcgatatccgggtactacgactcgagctcccctgacggggcggcgtcgaccgctgcttccaagaacatcgtgtcggagaggaaccgaaggaagaagctcaacgagaggctattcgcattgagggcggtggtgcccaacattagcaagatggataaggcatccatcatcaaggatgcgattgactacatccaagagttgcacgatcaagagagaaggatccaagctgaaattttggagctcgaatccggcaaattgaagaagggctccggcggctacgacttcgatcaagatcttcctgcctacttgagatcaaagaagaagagaaccgacgcgttctacgactccgggggctcccgaatctcccccatcgaagtgcttgaactgaggatcacatacatgggagagaagacactggtggtgagcttgacgtgcagcaaaaggacggacacgatggtgaagctgtgcgaagtgttcgagtctttgaagctcaagatcatcaccgccaacatcacttccttctcaggccggcttttgaagacggtcttcattgaggcggatgagaatgagaaagagaatctgaagacgaagatcgagacggccatcgcagcgcttaacgacccacagagccctatgagcatttgatcgaatggcatgagaaaacttgcccgagaaactcatctctctctctctctctctctctctcaatctctatctctgtgtgcgtctgttgtcattgttcctcggtattctctcatccgtgccgcgatgaatgtattaccagttccgttactatagttactcaagagtcgagactgcttgtatgttgctcagcttgtctttgcaaatcccgaagaaaagaaaaagcgaaaaaagagtgtttcaatgaatacagagcgtagattagttcttcttgaaaaaaaaaa

SEQ ID NO: 65 - DNA, 1006 bp, Eucalyptus sp.
gcttaccaggtccagacatagtaaggattgacagactgagagctctttcttgattctatgggtggtggtgcatggccgttcttagttggtggagcgatttgtctggttaattccgataacgatatcgccgccgccgcggcggacggcggccccttccaggtctccggctccggattctcgtggcccgatcagcccctgaacggatcctccattttcagcgcggaaattgatggttccttaggggattcagatggagtgaaggaaaatggctcaaaaaagagggttagaagtgaatcatgcagtgcttctagttccaaggcatgtagggagaaattgcgtagagatagactaaatgacaagtttttggaattggcatctatccttgaacctggaaggcctcctaagacagacaaggccgcaatattgatagatgtggttcgaatggtgacccagttgcgtggtgaagctcagaaattgaaggactcgaacagtagtctccaagagaaaatcaaagagttgaaagctgagaaaaatgagcttcgtgacgagaagcaaagattaaaagcagagaaagagaagttggaacaccaattgaaggccatgaacgcacaaccaagcttcttgcctccacctcctgcaattcctgcagcatttgccacccaaggccaagcccccggaaacaagttggtgcctttcattggttaccccggtgttgccatgtggcaattcatgcctccagcaactgtggatacctcacaagatcatgttctccgcccaccagttgcttaagcaacagtagatcatatggcctggctttcatttgatcctcaatatttgattcagtttgtcatgtttattggctgatttagctttttctggaagtctactgactgctttttcgttggagtatcatgtgtacgatcatagctatcatgacttatgataatttcacttgtaaatttcgccaaattttataaggtagctatcttccaagtgaaaaaaaaaa

SEQ ID NO: 66 - DNA, 943 bp, Eucalyptus sp.
caaaaaagttacggttggattgcggtaaagaaatggtgatggatatttcaaatgacgaccgctatcttaatgaagagattggtggtccgaaggatgcacttgatgatggaactcagcctaataacaagaggaagcgcggtagagcaccaaagagggctatgaaggctgaaagggaaaagttaaagcgtgatcatctgaatgagcttttcgacaaactgggtagtcttcttgaattgagtgagccgaacaacgggaaggcctctataataaatgagactatccggcttttaaaggatatgatttctcagattcaaagtctaagaaaggagaacacgactttgttgtccgaatctcattatgttgcagcagaaactaatgagctgaaagacgagaattttgcactcgaagctcaaatcaagaatgtacaaagggaattagaagacaagttaggccattctaagcccgacctaaacgtaacccctcctgaatgttggcaagcggaaatgggttcacacttcctaggcaaccatcatcctcaactcccccctaccgatccttcaacacaacaaccgccaattcttggtccgatgtacgtcatccccatgaatcccgactatcaatctgttcaaaaagccgatactacttctgatcaacctatacctgtccgtaaacctcatcctagatatcctactccagccgattcgtggccattgcatgtgttatcaaagcaacatcacgatctagcccgtggcaacggcgggacttgattagggatgcaaatgaccagattgatagtttttttctcggttcgatccgacaaataactgtaatgtcaataggtttgacctcagaagttatatttgttccagactcagactcatatttgtaaatgaattcacaatttaaagcatcctttagctaaaaaaaaaaaaaaaaaaaaaaa

SEQ ID NO: 67 - DNA, 1065 bp, Eucalyptus sp.
gagagagagagagagaggaaggggtgtcatggatttgttcttccacgaagaggttcaaagcgacatcttctggtgcgatcaactggtggagccgccgccgccgccgccgccgccgctgccgccggctaacccaagcgccttttcaccgtatacaaaccggctgccgagtcaagaccgagggttcatgccgaacccggggaataatatgaacaagcgggtgatggagttcttgaggaggagctgggccgaaccgagccagatccaagaattcgaccgcgaacggggttttcgacacatgctgagcgagaggatgaggagggagaagcagaagcgtagctactcggcattgctctccgaattgcctcatggtaccaagaatgacaagaactccatcgtccaaacagcttgcatgagaatcaaggagctggtgaagtacaagcaagagctggagagacaaaacggggagctgaagtctggactgaacgagaagagcggaggggacaaagctgaagggaccaagatcagagtcaagattgcgaacccgacgtccgggattgattctatgttggaggtcctcaagtgcctggacaacatgggactgaaagctacggcgattcaaacgcagtgctcggccgaccaactcttcgccgtgatcgaggttgaaaatgagattgaagccgcagatgttgaaaaggtcatccagtggaccctgctcgaagccgagaggaaacttcttcccaatagctacgagggcaagttggactggttgagctaacgagagatgaacatcgacgccaggtttcttccacgtcggttcgagacttcccttacttgcatgttcgtaaataggacgaagtttccctccgggtgcttttagtcgagtggtcacaaattatggatgtcatctatgtacagatctgatcaaataaaatgtgggtcacgtctgtatttgtagctcactaatcgaaagtatagttagagtcttcttcgattaggattgttgggaactatacttctcgtaaattaaaacttcaaattttcctaaaaaaaaaaaaaaaaaaaaaa

SEQ ID NO: 68 - DNA, 1019 bp, Eucalyptus sp.
gtctctctctctctctctctatctttgatacccaaacaaaacacacggaaaagaaaaacccacaagcacgccatggacaacaatgttgaggaataccagaactattgggagacgaccatgttctaccaaaatgaagagctcgacagatcatcacatcagaaaagtttggaaaattatggcagttgggtggacgaggcgatatccgggtactacgactcgagctcccctgacggggcggcgtcgaccgctgcttccaagaacatcgtgtcggagaggaaccgaaggaagaagctcaacgagaggctattcgcattgagggcggtggtgcccaacattagcaagatggataaggcatccatcatcaaggatgcgattgactacatccaagagttgcacgatcaagagagaaggatccaagctgaaattttggagctcgaatccggcaaattgaagaagggctccggcggctacgacttcgatcaagatcttcctgcctacttgagatcaaagaagaagagaaccgacgcgttctacgactccgggggctcccgaatctcccccatcgaagtgcttgaactgaggatcacatacatgggagagaagacactggtggtgagcttgacgtgcagcaaaaggacggacacgatggtgaagctgtgcgaagtgttcgagtctttgaagctcaagatcatcaccgccaacatcacttccttctcaggccggcttttgaagacggtcttcattgaggcggatgagaatgagaaagagaatctgaagacgaagatcgagacggccatcgcagcgcttaacgacccacagagccctatgagcatttgatcgaatggcatgagaaaacttgcccgagaaactcatctctctctctctctctcaatctctatctctgtgtgcgtctgttgtcattgttcctcggtattctctcatccgtgccgcgatgaatgtattaccagttccgttactatagttactcaagagtcgagactacttgtatgttgctcagc

SEQ ID NO: 69 - DNA, 1111 bp, Eucalyptus sp.
ccgagtttttctgctgtcattagtttcatttaggagatcgaagagtttctatatggctctctacagtaactattgcgatggcttacatggatcggacccgcatcaaatgttcgacccgctcttgcgggctaatgggtcggcacctgcgatggacacgccacagtcgttggtgttggatggcgagaagagcgagcttgtgatcaaggctccgaatagagcggcgaagaagaatgttccggaggagaaggcgttggctgcattgaggaatcatagtgaggccgagaggcggaggcgagagcggatcaactcacatctcgccactctccgcggcttagttcccggcgaagacaagatggacaaagccacattgcttgctcatgtcatcgaggaggtgaaagagctgaagaagacagcactggaggcaagcaaaggccttctcgtgccgctggatgccgacgaagtcaaagttgagccgcttgatgacgccacaggaaatggtacgttctctttcaaggcatctatctgttgccaatatcgacccgagctgctttctgatctccggcaggctattaatgccctccacctgaagattgtgaaggctgagatatcgactctcgaaagccgcttgaggaatgagttcatcttcttgagcggcaaagagcagtttagttacaactggagtttgcaacggcagctcctcgcgagctcgattcgccaggccctctgtagtgtccttgctaagacttctatatcgtctgagtactcgccaagaacgacgctcccaagtaaaaggcgaagagtctctttcctcaattcctcgagcccatcgttgtgagggattggattatgaaatcggcagacagagagtaatgtagatagtcggtcacaacatactcatatacatcctaataaatgtctgtgtacgtagttaagattaatactttcagaaatgttgaacgtttgatatgcgaaagctgacgagaagtttgtatgagacttgtgctaggagtttgtgtacactgcgatgtacaatagtaagtgtgctgtataaccgtttctggactcggttcatgctgaaataaaaggaagaaactaagttctaaaaaaaaaa

SEQ ID NO: 70 - DNA, 1213 bp, Eucalyptus sp.
cttacacttcaagatttcctgagagccctccttgttgtttgccaaagtccaccagaaaattcatgctgaagtgacaggcagatatggatgatttgccatctcttgaccatattcgtagagtttctcttcaccaacacatcacaccaatcgcggtctagtaccggttccagtggcagagattattagttcaagaacagtggttcttcatacggatgaaggagatataaagctgggaatcttgcgctgatttgccagtgaaagattgtggctttgtgatggagaacttgaattggctctctgaatggtcaggagaagcagattgggttcattctgatgaacaattgaaccggggttcatatccgataccgtctcaagcggccatgtttaatccgattcaagtatgtgatgaaaattttccctggttgatccccatcggaggagtcatggcggacgatagagcgacgagcgcaagtgcaagcgcgagcgcaagcgcaagcgtttccaagagtcacagccaagccgagaaaaggcgcagagacagaatcaatgcgcagcttgccactttgaggaagctcattcccaagtctgagaagatggacaaagcagctctcctagcaagcgtgatcgaccacgtcaaggacctgaagcgaaaggcctccgaaatcagcaagtccatcaccatcctcccctccgaggtcgacgaagtgatcatcgactgcgaagaccccgaactcaacaagggcggcaatgacagtggcgccgtcctcatccgggtctccatctgctgcgacgaccggccggagctgctgtcggagctgacacgggtcatcaagggcctgaagctgaccacggtcaaggccgacgtggcctccgtgggcggccggatcaagagcgtcctcatcctgtgcggcgacaccgccgatggaggcggcggcggcgatcgaggagcgtgcctgagctcgctcaagcagtcgctaaaagtggtggtgagcaggatcgcctgctcatcgatggctgcctcgaactgtcgcatccgaagcaagaggcagaggtttttcttgccttgccagagtccattgccataataacatgctccggtattatgatctacgacagactttaatggtattgatgttctgttgtatgtgtatgtacatattttgcatgtgaatttgggatgtaatctgattaataattcttaggaaaaaaaaaa

SEQ ID NO: 71 - DNA, 1063 bp, Eucalyptus sp.
ctttagatctcccccacattaaactaatctatcagctttttgacattgccttgatttggagagagagagagggagggaatggcacttgaagctgtggtctttccagatgacccctttaattattataattgcaaagaagtccaaagcttgttgggagagtgttggagctttgactttggtgatcaagagcagtgtgagaacagccatttccttagtactctggagatccaaacagaagaccacgaatgtagtgggtggaatgatcagtcaaatgtatcatcaaaggctttgatcgaccggccaaagcggtgtcggtacaagaggaggaagaacaaaaaagagatggagagtcagaggatggctcacattgccactgagaggaatagaagaaagcagatgaatgagcacctctctgttttgcgttctctcatgcctgactctcatgtccaaaaggttgatcaagcatcaattataggcggtgccatcaattacgttaaagagctagagcaacaattgcagcagcttggtgctcacaaagaaatggaaggacagagttcaaaatgtgaagatgacatctcctcccctcctttctctgaattcttcacctgtccacagtactcggcaagcccgggtcaaggcaatgactcagtgcccatgaacgagtggacgagcctcactcagtctgcaatcgctgacattgaagtgaccatggtggagacccatgcaaatctgaaggtaaggtcaaagagaagacccaagcagctgttgaggttggtttctgggttgcagagtgtgggactcactgtgctacacctcaatgtcaccacagctgaacccttcgttctctattgtctctctctctctctctcgctctctctcaattcaatatttagtgaatgatgagatgagatgccgatcttctagaatctcggtctgtaccaagttgcagcaactggcaactggcaactgatgtcaatttgcacacgattttctgttgtctcttgaagtgtttcctattggttgccgtttagaggaggcttgcccttcacatggaaaaaaaaaa

SEQ ID NO: 72 - DNA, 1303 bp, Eucalyptus sp.
ccaacaccccctgggacttcactccctgcaactgcacactgcccactgccactcctcccaatcccaagaacccacctttcctctccccccctcctgctgatccggatccgcctcccgggtcggggtcgggtcggttcggttcgggtcgtgcgtggacaggacggacccatcgtcgaccgcgatggacgcgccgctggtcaacgcgtcctccttctccgccgccaacccctccgcctacagcttggccgagatttggcccctcggcggggacaccggcattgtcgggccgggcctccgggccgggaacctcgacgggtcggtggaggagtccacggtgacggagcagagcggcagcgggaggaggaggaggaggatgaaggacgcgagctccgaggacgagtcgtccaagatggtgtcctcgagctgcgtcgtgggcagtgatttgaacaattcgaatggtgccaaacgcgcgaagatagccggatcccgtgatgaaaatggcagttccaaagctgaagtagaggcgaattctgttgcttgtaataaatcgtcggcggaacagagtgctaaaccgtctgagccaccaaagcaagactacatacatgtgagggcgaggaggggccaagcgacggacagtcatagcttagcagaaagagctaggagagagaagattagtgagcggatgaaaactcttcaagatttggtccctggttgcaataagatcattggaaaggcactggttcttgatgagattatcaattatatccaatcattgcagcaccaggttgagttcttgtcgatgaagctcgaagcagtcaattcaaggatggacatgagcccagcagtggaaggctttgttcccaaagatctcatgtcacagcattttgacggtactgggatgatgtttgcctcacaagcagcgagggattacctgcaaggatcacaagcacaaccggattggcttcatatgcagaccggtggcggatttaagagggagacatgatgacaacggacttgctcgacttaacttaggatcgtgaggagccagattaactattcaggtccacgtcgatatgtaacatgaactttgttgctgatatcttattgtttagcaccaaatccgcaaatcgaaaattgtcggtccattctctaaattatgtaatacttaatctcagcaggaaatgcatctgatttccgtctgtactgtctaaccggatcagataccttgtacactgtttacttgtggctttgggaacataatatgaggcggcaattccacgacgtatttttcttaaaaaaaaaa

SEQ ID NO: 73 - DNA, 1559 bp, Eucalyptus sp.
ggcgttgtgtcgcgttggagcgatggactctccgagaaaacctcaccgtggggaagtgacttgcgcgcggctcccgaggcccctgtcccttcaacagtaccagtactaataccgtcccccagcgtggccagccaaaccccaacacgcagagcgcaaaatctcgcgcacgagccccaaaatagcgaggacgcccgatgcgctccgccgcgcactgatccccggagatcgccctatcctcattcccactcactctccactgaccgcaccccccttgctgcgtcgtggccttcgctcagtcgcgtcctccattgtcgttcgttcggtactgcgtacgtgtccggggccattgtcgtcgcgagatattctgcaccgcgagcagcgaaaagatcggttgcagattcgttcatggtggtcgagctcgctcgggcttgaggtttaagcaaaaggtgcaaaaggtgctccctcccgtgtggcgccatggatccgcccgcggcgatgatcaacggcgggggctcgttccccggcggcgacccggtgccgtacaacctggcggacatgtggctgccgccggccggcggagggctggggctcgggaggcatccgggggcgcggggcatcgcccagttcctgaatggcagcggcccgaatctcgaggcctccggcggtgatccggcggtgagtgcggcggaggccagatgcggcggcggttctagaaagcggcgggacgcggaggacgaatcggcggctgggagcctctccaccagcaatggcgtgccgaacggcgctgatggcgagaaacggcttaaaacttccggatgcaaagacaggagtggagattccaaagcagaaggacagcccagctcggccaaacccacggacgaaagtaagccgcagccagagccttccaagcaagactacatccacgtgcgagcccgaagaggccaagccacggatagccacagcttagccgaaagagccagaagagaaaagataagtgagagaatgaaaattcttcaggatatagtgcctggatgtaacaaggtaattggcagagcgctggttcttgatgagattatcaattacatccaatcgctacaacatcaggtcgagttcctgtcaatgaaactcgaggcggttaattcaagaatgaacccaccaatcgaagtattttcttctaaagaatttggtcaacagccgtatgatactggcggcatgcctttcggttcacaagctcccagagaatatagccgtggttcttcgccagactggttacatatgcaggttggtggtggcttcgacaggaaaatttgatctgcgatatacatgtctactaggaataagagtataagaagcaaagcttcaactcaattcttcgttaggttgaaaaatatatctcccgtgtcaatggatagaaaaagacagtggagacggtggagacagtggatctccattttcaaaatcacccctctagctgttagtgctgtctagtaagactgatgaagttagtattcaagcactggcattgatattctaaattaattctttttatccagcttttt

SEQ ID NO: 74 - DNA, 1302 bp, Eucalyptus sp.
ctcacttgactcgctctctcactccttcaaaagcttcagaaccaactctcatcagtcatggccgagggagaagattataagctgtaaaaaaaagagaaaaaagaaaggatgaaacaaggaaagtttccgcctttttgttagctgagctctcggatcagattcctgtacggcggttgattctgggtccgtgtcaaaagatggatcctccaattgtcaatgaatcttcgttctccgctgcgaacccatcttcctacagtttggctgagatttggccgttcaatggggagccgggtaatggcgggttggggctccgaatggggaatttgagcgggttcttggatggtcagatgaaccgggacgggtcggcggaggtgtccaccgtgacggagcaaagcggtggtggaggaattgggaggaagaggaaggatgtgagttcggaggacgagtcctccaaaatggtgtccactagtagtgccaatgatctgaacatgtcaaatggaaagcgcataaagtcactggtttcaaggcatgacaatggtggatcaagagctgaaggagaatcaagttctgctgctggtgataagcaggctggacagattgcaaagccctctgaaccaccaaagaaggattatattcatgtcagagcacgaagaggccaagctacagatagtcatagcctagctgagagagcaaggagagaaaagatcagtgagcggatgaagattcttcaagacttagtccctggatgcaacaaggttattggaaaagcactcatccttgatgagattatcaactacattcagtcactgcagaatcaggtcgagttcttatcaatgaagcttgaagcagtcaattcaaggatgaacatcaatcctactattgatggatttccagcaaaagatcttggtgggcagccatttgatgcaactggggtgatgcatgcttcgcaagcagcaagacagtacagtcaaggatcgcaatcagaatggttgcatatgcagttaggtgggggtttcgagaggccgatgtgatctcaagaagcacggcacactggatctaaaagcactgtggaataagatggctgtgagagattattcaccaaagagaaattacatcctgcgcatgaattattacacacgccccattgatttataatgtcgtagatccatctctttgtagaaagcgcatctggttccatacaacatcttaagtgtatttaatgtgattactttttgattttcttttgcactcagaaggtcaatttctagtggaaattctgaacatcattagttaaaaaaaaaa

SEQ ID NO: 75 - DNA, 1390 bp, Eucalyptus sp.
gggctcctgcaacaacgcatttttcgtgctaaacagttgctgtccaagcgcccctcccaccccatttctcgtacccatcgaaccccgcgtctccttctccttccgggtcttcgccggtacgccgattccccatcggactctcggccggcggcggcggaattctgtctcctcctcctcctcctccccctcctcccgtttccgttcctgcgcggctcgcgcgcgaattcgagctccgcgggaggatgagatcgggcaaagggagccaggagtacgaggatttcgaggaggaagatctcaattccaagagagatggcccgtcctcgaacgtttccaacagtagcaacagtgcgaatcccaaagataagagcagtgataaagcacatgccataagatcgaagcattcggtcacggagcaacggaggaggagcaaaatcaacgagagatttcagatattgagagatctcataccgaatagtgaccagaagagagatacagcgtcttttttgttagaggtaattgagtatgtccggtatttacaggaaaaggtacataagtatgaagactcctaccagggttggagttcagaacccaccaagttgatgccatggagaaatagccattggcgtgttcaaagtgttgtcagtccacctcaagccatgaaaaatggttctggtcccgcgtcatcatatccaggaaagttggaagataatagcactggcacaaccccaaacatgcttgccagctcacagaatacatcagaaatagatcctggaagagatctctcaagcaaattcatggttcagcaatcagagagaccgtttccagatgctcaaccgatggagtgcactgcagacactgcatctgatcagcaggaagatctgactattgaaggggggacaatcagcatttcaagtgtttactctcaagggttattaaattccctgacaaatgcattacaaaccgccggtgtggatctatcacaggccagaatctcagtccagattgaccttggaaagcgggcgaatagaggagtgcttgcgactggaacgtccattcccatggatcatggcagtcctaatcctggcaattcaacaatggcgcatgttacagatgcgagaggtgaagaaggtttggatcaggtgcagaagcgccagaagacgtgaaaagttagatgtttcttccaaatctccattttcactacttctttactttgtttccatttgacctcttctctctctctcctctcaggctcttgtttttttcccctttctttctttcttttgagggggcggataccgtcttgtcatctcttgtggatatttatgatctgatatggaatcgaatcgtcactgtttgatgtggctaatggttcagagattcaaaaaaaaaa

SEQ ID NO: 76 - DNA, 1505 bp, Eucalyptus sp.
atcgtctccctccggataacgcgagctacgaaaaagactcgaactttatcgcgatctcgccgccatctcgtgccagcctgcaccagatgcatcacccgccgaacccggattctctctcgctgcttcaatccgcgcgaaccccaaatgcacctccggagcatcccgttccctccacttccaggagggatgaagttgctgtgttgaaaagtcagaaggcaggccgtgagaaattgaggagggatcgactgaacgagcactttatcgagttgggaaatacgctagatcctgataggccaaaaaatgacaaagcgacaattttatcagatactgtacaactgctgaaggatttaactgctcaggtgaaccaactcaaagctgaatatagtacgttctgtgaagaatctcgtgagttgacacaggagaaaaatgatctcaaagaagaaaaggcctctctaaaatctgacatcgagagccttaatgctcagtatcagcagagagctagagccatgtttccatggcccattatggatcactcagtggttatggccccaccttcatacccatatccagtgcccgtagctgtgccttctggtcccattcctgttcatccacctatgcagccttaccctttctatgcaactccaaattccaatgtcttccctaactcccattcgactttgcttccatttgcaacacctaacatgcagtttgagcagttgtcgggccattatgcacatccgcttatgcagatgggaaatcagtcccttgtctcgagcaataaaaacgacaaaggcaaggagaggaagcatgaaaagtctggtagttcaaacgatgtcacaacagacttggagctgaagacacctgggtctgcgacagaaaatgattcatcgtcaccacatagatcatctatgaaatctatgagaaaggatgatgacactgcagaaaggagttcttctactcatagttcatcgccacatagtgtacaagatagctcttccagtagcatagctggtggttcgaactcaagggcaaacgattaagtattcagccgcagagaaacccttcaaaagaaagcaagtcttcatgcagtcgtctcagcagagttcctggaattttgcccatttgttgctgtggcggtgtcatttaacgccttctaatccaaacggcgttagacacaaacaagactcactactattgctgtttagaggcatgtgcgcagatgcgatggcattcaagcatcatgttttgcagaagcttctgacctgcacattgaggacgctactgaaacgccaagtcttagtttgagcgacaaccatgaagttctcgctttgccgatttgagaaagggaacaaaaagcttgcaacttcttgtttttgagaaagggaacaaaaagcttgcaacttgttggtaatggcaaatgttatgtctatgcaatcatgccttggctggtttagcaatggtttcgcacccgcttgcttcgatgcctggttcatccaaaaaaaaaa

SEQ ID NO: 77 - DNA, 1836 bp, Eucalyptus sp.
gagcactttcacttatcagaggccgaaagcaaaaccccctgaacacttcaaagaaaagaggttttttcagacaccctctcgccctctctctctctctctctctgagctgagagacaataccagcttataaaacccgagacccataaaacctcccatcggaattcccgaatcacgttaccgggtcatcgggtttcggatctgccacccagttcaccaacaccaccaccaccaccttccttccccccctcctttttgggtttcccaatgagcacatctcacctccacttcctccctccccttcccttaaacattctctcccaccaataatttccacattggcaaccaatttcttattcatcatcccctccccgagtcccaccaaccttaggctctctctctctctctctctctgccactcaatctttccacttagaaagaaaccaactttttgctgggtttcgcatagagcagaaaacccatcgtagactttgatctccagttgacacttctatagagaaagggagatagagtggagagagagagagagagtttataatcatcggcttatggcaggctcaaatccgcaggaaggactgggggatgagttctttgagcagatcttggccgtgccgcccggagcttactccggtggctccacgcccatggtcttgcaactcggctccggccgcggcggcgtggaagatggcggcggcagaggaggcggcggggggctgaggggcatgggggtgatgatgcccctggggctgaatttggagcaaggtggattgtttaggcacgaggatgttgagaacagtactagtgcatcttccaccacttctgccatcaatatggagagagaagcaggagtccaccacggcaacaacatgacaagctgcttgtttccagcatttggacagttccagactcatcagtcagtccagccacctcctccccatccaccccctcctcaacttcacccggccttcttgaatcagcccgcagtgggatcgccgaaccagccggcgatacgcccaagggcacgagctagacgagggcaagccacggatcctcacagcatcgctgagcggttgcgccgagaaagaattaatgaaagaatgaaggcgttgcaggagttggttcccagttgcaacaagacggatagagcagccatgcttgatgaaatcgtggattacgtgaagttcttgagactccaagtcaaggtcctaagcatgagtagattgggcggagctggtgctgtggctcaacttgtagctgatgtacccctctcatcagctgagggcgagatcatcgaaggcgggaacaatcaaccggcgtgggagaagtggttgacagacggcacagagcagcaagtggctaagctgatggaagaagatgttggggctgcaatgcagttcctccagtccaagacgctctgcatcatgcccatttcgctcgcctccgcaatcttccgcacaagccaaccagacatgccccggtccatcaagcccgaatccagcgccccttcctgaagcaccctgaacaagttcctggcgacatcatagttgcaacaatgcctaggtttctcaggtctgaccggttcgaggttgtccccaagtcgacgtaactcctttgccaaccaagttgcttagtgccctctgttcatagttcactgtcgctgtcttagagtgggtgtgaacttgtggttctcatgccttaattacaacctaaaaaaatgcatcagtttcatgttttttccaattcatccaaggaaaagtcaaaagcaactttattccaaattcagcttattaaaacctatcttctgatgaaaaaaaaaaa

SEQ ID NO: 78 - DNA, 1241 bp, Eucalyptus sp.
ttttctcccacctccttctctctcctctctctctctctctacagtttcgcggcgaaatcaagtcccccggcgagctaggtttcaaccggcgaagcagccagaagaagaagaagaagccgaagaagaagaagggcggagatggatcagtggaggacggatttgggagcgtcgacttccgtccacccccagcagcaccagcaccagcaccagcaccacccgtccagcaggctgcacgcctcgcacgacgagcccaggcaaagggaggaagcggacgtcagggatcccgtggccgcgaggaaagtccagaaggccgaccgcgaaaagctaaggagggatcgtctgaacgagcacttccttgaactggggagcacgctagatcctgatagacctaagaatgacaaggcaaccattctcacggacacaatccaggtgctgaaggatttaaccgcggaagttaacaaattgaaagctgaatgtgcagctcttactgaagaatctcgtgagctgatgcaggagaagaatgaactcagagaagagaaatcatctttaaaatctgaagttgaaaatcttaatgtccagtaccagcaaaggatgagggttatgtacccttgggctgccatggatccatccatcatgggttcagcctacccatatccagttccaatacccgtcactccaggtccaatgcccatgcactcacaacttcagcctttccctttctttggaaatcagaatgcaagtgctattcccgctccgtgttctacctttatcccatattcaatgcctgccaatcccacagttgaacagcagtcaacccaatatgcttccagttctcacgtgtcaaataaaaaagactccaaaagcaggtcttcagatcatcaaagcggcagcaatgcagagcaagatgaagagtcaaatgacgtggcaacagaccttgaacttaagatgcctggaacatcatcacagcaggactctggagaaaagaagggcaagcagacccagagaaaggagataagtattactgatgggagctcgtcgagcaagttttcctcatctcaggcttttccagatagttcctccaatagtgttagtgacaacccaaagtccagtagatgaagagttaagtccttattctccgttaaaccaacactaacgctaacttatgtagcttgtatcttatcattggtgtcacggtcgtagttttttctggctcgagaaaatttgatgtgcaggtagccatg

SEQ ID NO: 79 - DNA, 1263 bp, Eucalyptus sp.
ggagagagagagagagagagagagagagagagagagagagagagagagtaaaaatggcactggaagctgttgtctttccgcaaaatccattgagcaactacacaagcagagagctctacaacttgctcgaaagcaattggggttccttcgactttgggttggatcggaacgagcacggggaatttttagactacccaacggagaaggatttcccttgcggcgagtggaacaacaattcgtgctcatcagatgctgggaacaacacagcacaatgtcacttgaataatgacaacagcaatgatgggtcgtccagccaccgagccgcagctgtcggtcgcacaaagcggcgccgtacgaagagcaggaagaacaaggaagacatcgagagccagaggatgacgcacattgctgtggagcgaaaccggaggaagcaaatgaacgagtatctctccgtgcttcggtctctcatgcctgaatcttatattcaaaggggggaccaagcatcaatcataggaggggccataaattttgtgaaggagcttgagcaaaagctgcaactacttggtgttcaaaaggagatggagtgcttaaaatctgatgatgaccatgatgataagccagtttcacctttctctgagttcttcactttccacaagtacaacaacagcaacagcagcaacaactcctctagctcgccatccccgtcgacagcaacgacgacgacagcttactacggctccactgacgaaacagctgctgggaataagcggctgtcggccatcgccgacatagaagtgaccatggtggagagccacgcgaacctgaggataaggacgaagaggaggccgaagcagatcctgaaggtggtttctgggttgcactcgttgaggctgaccgttcttcacctcaatgtcaccaccgttgatcgcgttgtcctctactccatcagcgtcaaggcagaagatgattgcaagctcacggcagtggatgaaatttcgtcatctgtgtatcagatattcgtccaaattcacgaagagtcgatttgattagattttattgttacctctgattccctcatcctcctcttattctacttctttcattttgtaatttcttttctctttttcactctctcccctttctttccccgtttgtaaccttttacagactcataacgtagctcctctctccttcgccccctagattgtagcctattgtcatgtgataatccaaaagttcgccaatttcattcgaaaaaaaaaa

SEQ ID NO: 80 - DNA, 1835 bp, Eucalyptus sp.
taaaaagcaagagagggaaagaaaaaaaggaaagcacacattttaaaaaaggcaatgagaggggaaaaaacagacgagggcaaatatatttaaagagtaaagttgggcaacaaagacacaaaagggttctcgtagagcaatgagtctctccgtctctctcagagactactttactttgcaacacatcacttcctctatttaatcagaggccgagaaaacctcccaaagttttccacaaagactaccttacacactccctgttttcactatccttcgagagacagagagacacagagagagagacagagagagaagaagcacagagggggggagagagagagagagagaggaagcacagtgtgaaatatttgtgcagacttttccttttctgttccttgggtttgagagagagagagagagagagaggcatgaagcaaggtttttatttgcagagctcatcaccagtgcaacacatgatgtctggtaaccctaattactggtggaacaacatcaatcctccaccaccacgctctcctttttgccactcttcttcttcctctcctaacctcttccttccatacccacccagttcttctctttcttctttatttcatctcaatccttcctgggtctataataataatgttaaccaagagcagcttccagagtcattgagccaactcctcatgggtggattggttggagaagaagataagagcagtgtgatgatgaattacttacaagaaaagagggtggaggattgggaggagcaacaagtgcttcagcaatccccgaatgatgcttctgttctcgacaatcagcatcatcatcttcatgtgaagcaggaagattcagcaagcagctacggtgtgtatgggggtgcagcaagtgatcatcatgctcttcaagggacaacaaacaagtctgcttggtctcaacatcatcaccacgctatgattcctaattcaccacccaagtcgtgtgtcaccacaagtttcagcagcagcatgttggatttctcgaacaagaagccagttaataagaggcaaaccccaccagatctatcctctgagtgtaacagcaatgcaactggtggggtacaaaagaaagctaaggtccagcctccttcaaccagccaatctaataccttcaaggtgaggaaagagaaattaggagacagaatctccgccctgcaccagctagtttccccatttggaaagaccgacaccgcttcagtactattagaagctatcgggtatatcagatttcttcagaatcaaattgaggcgctcagttcaccttacattggcagtgcttcaggaaaaacgaggcaccatcaatctgttcgaggggagaggagtcctatgttttctgaggattcgggtcaggaatccatcaatgaagagccaaagaacgatttgaggagtagaggattgtgtctggtcccggtctcgtgcacgctccaagtaggaagcgacaatggagcggactactgggcctctgcttttggaggaggaggcctacgatgagacttcttcgaatgacttggggttttagggaaaatagtacagcaagagcttcatgatcagatgatataacatcatgagccgtcaatctgctaaggaaataaaagaaaaaggtgaaaggctgattgctcatgatgccgtatatcatgttaaagagaaaagatggagtcatcttgtgctgtgtatctcgggggacaagggcatccttcgataaattaacctagctcatccctgtcaatttagtggtattttctagtgcccttttgctgtaattattatgcttagaaaaggtatttgcctttcaaaaaa

SEQ ID NO: 81 - DNA, 2201 bp, Eucalyptus sp.
ccgaactcccccaaacttccaagttccaagttcactcccttcctcaagctacgattccagctctccggaaggaggaagaacgtcgcgaaattcaccggaatctctccgacccatcaacgctcgggaaggaaaggcgcgacctttgatccgcttttttttctgtaccgtccgatgagtctctgggcggactacgaccacgccgccgcgaccgacctctccgccttctggccgccgccggccaccccccctccgccggcgcctgcgccgccgctcagtcaggagtcgctgcagcggcggctccaggccctgatcgagggggctcgcgggagggacggggaagaaggggccggggggcccgccgcggcgtggacctacaccatcttctggcagtcctccggcgactactccggccccgtcctcgggtggggggatgggtattacaagggcgacggcagagccaggagcaggggctccgcttgctctcaggccgagcaggagcaccggaagaaggtcctccgcgagctcaattcgctgatttccggggccccgcccgccgacgacgcggtcgaggaggaagtgaccgacaccgagtggttcttcctggtctccatgacccagtcgttcgccggcggcgtcgggttgcccggtcgggcctacttcagctcgaatcccgcgtgggtcacgggggccgagaggttggggaattgcgggtgcgatagggcccggcaggcgcagatcttcgggttgcagaccatcgcgtgcgtccctgttttgaacggtgtggtcgaactgggttccaccgagccgatctaccagagctccgatctgattagcggaattagggggctgttcaatttccatgaatcggagatgggatgcggtggtagggttttgaatagcgagcatgacccagcgtcgctttggatctgcgatccgccagtcacgatggagattaacgatcgtcctatgacatttcagatagagaaccccagctcgagcagtcttaccgaaagccccagcgcgatctgcgcgataaatgatcagcagagcgaccaaaaccagcagcagaatgaggggtttttcgcgaaagagttgaactttgcggagtacgcgattaattcgagtagcaggagcaataatggagattctcatcctatgaagccggaatctgttgaagtactgaatttcggagatagtgggagcggaaggttgctttcgagtcattcacaggtcgcagttgcaggggagaccgcgaagaagaagaagaggtcggctacttcaatcggcagcaatgaagaggagatgatgtccttcacttctggagtgattgtgccctcttcaggaatgttgaaatcagtcagtggagcaggggattcggatcattcagatgtcgaagcctcagtggtcaaggaagctgagagcagcaaagtcgtggaacctgaaaagaggccaaggaagcggggtagaaaacctgccaatgggagggaggagcctctgaaccacgtcgaggcggagaggcagaggagggagaagcttaatcagaggttttacgccctcagggccgtggttccaaatgtatcaaagatggataaggcttcactgctccaagatgcggagtcttatatcagggagcaaaggttaatggtggctcttcaagaattgaacttggagttgcagcatgctagtgtttctgtggtgaacgagctcatgatccagcaagccacagttaagatggggagtcagttgtacactcaggagcagctcaaggcagctctattggccgtaatctgaggatctttgaaggatttcgttcaatgcaagttggcatcgactagacaatggaattgaagtttctccattgaaagcaagaacctgcccaatattttcaggttccgggtggtgcaaactctttgaacaatgggctttgtttagttgtgtggcttcgtctggtagattgaacccctagattgcaagttgaagtaaatacctagttctagcagatagtaattttttttccacgttgatctcctgcctgtcttcgatgtaaatagatgctccaaatttgaaactgatggggccgtttccttatcctttgttagcttgttctgccgtttgttgggttcaaccaagatcatgtctcttgtacaccaagcatcctgtaatcaatgcgcaagtgtggcgcaattaatttaaaaaaaaaa

SEQ ID NO: 82 - DNA, 2271 bp, Eucalyptus sp.
atttcttcctggttcttgatagaagattgaaggttctagaacaagaggaagaaagctagtgcaaaagaaagaaagtaaaaagaggtatttctgctgctttattagtttattgtggagtatggcaagtggaatggagaaccggggggaaattcctgcgaatttgaagaaacagcttgctctggctgtgagaaaaatccaatggagctacggaatcttctggtccatctcaaccagacagcctggggtcttggagtggggtgatgggtactacaatggagacatcaaaaccaggaaaacaattcaagctgtggaacttaatactgaccagattggtatgcagagaagcgagcaactgagggaactatatgagtctctatccgctggtgaatccagcccacaagttagaaggccttcagcagcattgtcccctgaagatctcactgacacggagtggtattatttggtttgcatgtcgttcatctacgacattggccaagggttgccaggaagaacattaactacaggccagcctacctggctctgcaatgcccattatgcagatagcaaagtcttcactcgctctctattggcaaagagtgcatccattcagactgtggtgtgctttccatttcgagggggcgtgattgagcttggtgtgactgagcaggtttcggaggaccctggtgtcatccatcaagtcaaaggtactcttctggaaatccaatacccaatagcttccaagaaattcagtgctcttattggagatacgatagaccaagacgatgttgatattctcgatcacgacattctcgatgtcaaattggttcctgtggcaagagaactggatatggcttctccagacaccagctcaaatggttttgaggccaatcagctaccggagaattcatttgtggttgaagcgataaatggagtagcttctcaagcacagagttggcagttcatggatgatgagtatagcaactgcttacaccattctgtgaactccagcgattgcatatcccaaaccatagttgaacctacaaacttaaggtcagtccaagaagatgacaaggcaaatgaccctcaaggatgtggttacaggaagccaaccatcttggagaatgaaattgatgatgtacattaccagagtgtcctttcatcgcttttgagaacgtcacaccagttgatcgttgggccacattttcaaaggggtaatagggagtcgagttttgtcgcttggaagaagggatggtttccatctcggcaaaccacacaaggtgggacaccgcaaggggtactgaagagaatcctatttcaagttccacgaatgtatgataatgctcttcagtcccccttagaagatggcggggaaaatggagtttggaggccggaggctgatgaaattggtctgaaccatgcagtatcggaaaggaagcaaaaggaaaaaataaacgatcgcttgggtgtactcaaatccatggttccctcggtcagcaaggttgacaagctgtctatattagacgacaccattgcgtacctgagggagctccagaggaaggttgaagagttggaatcttgggggattgggatggaagtagaagcgaaatcgagaagaaagccccatgacatggtcgagcggacttccgataactgcgggacccatgtgacaggctcaggcaagaagccggtcagaaacaagaggaaggccagcaacattgatagcatggagctggagaccaattctgtagtgcagagagatgtgtctgctgataatttgacagtcaagattaacgataggactgtgctaattgagatgcggtgctcttcgagagagggagtattgctcgagatcataaacgaggtgaacaatctccatttagattctcactcagttcagtcatcgaccatcgacgggattctgtccttgaccattaaatctaagttcacaggatcgacggtaatgtctgctgcaacaatcaaacaagcactatggagattcgctcagaaatgcggaaattcatctccatactagcaactgcatgtcagtttacatgacacggtgatattagcgtagtcctttgtattgcaagaccactgtagaagcctgttgagtagttcttcacgacagttgttctcggtagatagtccaataaaatgaaggtgaattctgcaaacattttgtaatttgtacttaatatgagacgttcatcacatgccgttgtacctaagagaaatcaatgacttaaatctgttttcttgctaaaaaaaaaa

SEQ ID NO: 83 - DNA, 2429 bp, Eucalyptus sp.
gctcttgtccatggaatccaatttaatagagtccaaccgaatctggctcaaaagaattgcaagtgacagcaaacagtagctacctcttctgggtcctgtctggaggtcttctgagctgagagatttaaaaggtctgtaaaagattcaaggtttcttctacccagaggaaagaacctacttcttcctttatcacccatgggttcttaaacctcgtgacagtgcaatttaaacattagagcaaaacataaaaaaagaagagagctgttcaaatggctactggcgtagaaggcaatgaaggtgtcccagcaaacctgagaaagcagcttgctgtggctgtgaggagtatccaatggagctacgcaattttctggacactatcagctacaaaacaaggtgtactgcaatggggtgatggctactacaatggggacatcaagaccaggaagacggtccaagccgtggagcttaaacctgataagattggtttacagaggagtgagcaattaagagatctttacgagtcgctgcttgaaggggaaactgatgcacaaaacaagcggccctcggctgcattatctccagaggatctcacagacgaagagtggtattacttggtttgcatgtcctttgtattcaatcctggcgaaggtcttccgggaagagcgctagcggatggccaaactatctggttatgcaatgctcaatatgcagatagcaaagtgttttctcgctcactacttgcaaagagtgcatctattcagactgtggtatgttttccctatctcggaggtgtgattgaacttggcgtgaccgagctggtcccagaggaccccagtctcctgcaacatatcaaagtttctttactagatttctccaagccaatttgttctgagaaatcttcctctataccacaaaatggagatgctgataaagagcctatgtgtgccaaggtcgactgtggcatggtggatgagttggttttggagaacctatattcaccggctcaagaaattaaatttgacccagagaaaataagtgaattttgtgaaagtatcccgaaagaactggatatggactctcctgatgagtgttctaatgggtgtgaacacaattaccaaacagaagattcgtttatggttgatggtatgaacggaggggcatcgcaagttcaaagttggcattttgttgatgatgacttcagtaatggtgttcaaggttcaataaactctagtgattgtatatccgaagctattgtgaaccaagacaagtatatttcatctccaaggcgagaaaatgccaagaattcccacttgaaagaacttcaagaatgcaaccactcaaaattaagctccctggatcttggacctgacgacatctcgcattacagaagaacaatttctgctgttctaaggaaccctgatcaattgcctgagacacggtgtatctgcagctgtggatgcaaatccagctttctgaggtggaggatggttgaagttcataaaccgcgagcacaccaggaaactctgaagaagattttgttcgaagttccactgatgcaccgtggtcaagctcttaaatctgaactacagaatggtgtggaatcattgctgggagatgttgatttttgcgctggccacatattgtctaccaagaaaaaagaacatgaaaagtttctggtcctgaggtccatgattccttccatcgaggagatagataaagcatccatccttgatgacacaattatgtacctaagagagcttgaagcaagagtggaagaactagaatcttgcatggactcaacagaccttgaggggaaagttaccaggaaaaagtttccagacatgatagagcagacatccgataactgcaaaaaacgttggataaacaagaggaaggcctccgacattgatgaaaccgatgcagaacttgatagaaatgctcaaggagatgggcttcagacagatgtcaaagtcaacataaaggagcaggaagtatcgatcgagatgaaatgtccctatcgggagtacttgttgcttgatattctggaggcagtaaacaacctgcacttggatgcttattcaattcagtcatctacacttgatggtgttctcaaattaaccctcaagtctaagtttcgaggcgcagcagtatctccagctgggatgatcaaacaagtcctttggaagattactggaaagtactgagaagtgtagttataattgattgtgtgcttggttattcaagtgggtaggcgatctctttatgtttctgtaagtgtatggttcggctactttcaaaaccagttcttgctaaatgttcatctcttaggatttataagaattttcttgtcctagtaatgaagaaccttgctgttgtattgaagtaattctgccagtggctgctgattcaattaaaaaaaaaaaaaaaac

SEQ ID NO: 84 - DNA, 2244 bp, Eucalyptus sp.
ggtgtgtgtgagagagagagagagagagagagagagagagagagagagagaccaagccagccagtaagagtgttggtcggcggtacgacatggcaaccccgccgagcagccggcttcagtccatgttgcagtccgccgtgcaatccataaaatggagttacagtctcttctggcaaatctgcccccaacaagggatattgatatggggagatgggtactacaatgggccgatcaagacccgaaaaaccgtccagccgatggaagtcagcgcggaggaggcctccctccagcggagccagcagctccgggagctctatgagtcgctctccgccggcgagacgaaccagccggcacgccgcccatgtgcggccctctcgccagaggacttgaccgagaccgagtggttctacttgatgtgcgtctccttctcatttcctcctggggctggcttgcctggaaaagcgtacgcgaggaggcagcatgcgtggctcaccggagctaatgaggttgatagcaagactttttcgagagctattcttgcaaagagtgctcgtattcagaccgtggtttgcatccctcttctagacggcgtagtggaatttggcaccacggaaagggttcaagaggacatttcactcgtcaatcatgtcaaaaccttcttcgttgaccaccacccccctcacccaccgaaacccgccctttccgaacactcgacctccaaccccgccgccacctcgtccggccaccaccgcttccactccccgcccgtcccctcctacgccccggccgatccacccgctgcagccaaccaaggggatgaggaggaagaggacgacgacgacgacgacgaggagggagagtccgactccgaggccgagaccggccggcagggggcggcggcggcagcgcagaaccctcacggcgcagggcccgcaaacaacgccgagcccagtgagttcgagatgtctgaggacatccggctcggctcgccagacgacgggtcaaacaacctggactcggacttccccatgctgaccataaactcgacggccgcggaccaccagcgccaggttgactcgttccgggccgagacgacccggaggtggcagatgatgcaggatccagcgaggagtggccttcaaaccccgccgtcagttcctccggcgctagacgagctgtcgcaggaggacacccactactcccagaccgtctcgaccatcctccagaaccagccgcggtgggccgactccaccagctacgtctcctactccacccaatcggcgttctccaagtggacaagccgctccgaccacctcctccacgtcccggccgagggcacctcccagtggctcctgaagtacatcctgttcaccataccgttcctgcacaccaagtaccgcgacgagaactcgcccaagtcccgggacggcgactccagctcgcggttccgcaaagggaacccgcaggacgagctcagcgccaaccatgtcctggcggagcgccgccgccgcgagaagctcaacgagaggtttattatactgaggtcactggtgccgttcgtgaccaaaatggataaggcctccatattgggggataccatagaatatgtgaagcaacttaggaagaagatccaagatctcgaggcgaggaatcgacaaatggaggctgaccacaggacaaaggaaggagagttgcagaggacgactagtttgaaggatctacgaagcgcggcctcgtcagtagaacggtcctcccgagcaagcttgcctgggtctgggtctgacaagaggaaaatgaggatcgtcgagggcggcagcggggccaagcccaaggccgtggagtcgccgccacctcctctcccgcccccgacatccgagactagcgtgcaagtgtcgatcatcgagagcgatgcactgttggagctccaatgcccgcatagagaagggttgttgctcgacctaatgcaaatgctccgagatctgaggatcgagacgacggcggtccaatcctcgttgacaaacgggttcttcgtggccgaattgagagccaaggtaaaggaaaatgtcaatgggaagaaggcgagtattgttgaggtaaagagagcaattcaacagctcattccccacacagactcctaattacatcaggtgtcatgtatcaggcaaaaatgcaccaagaactgaccatttcggacgatttctgtgtaggcatgtacaacataagtaccttctgacaaaaaaaaaa

SEQ ID NO: 85 - DNA, 856 bp, Eucalyptus sp.
ccgttgtgttgctgtattggttctacgtgttttcatgaacctgatctgtcctgaataaattgcattcgtatatttgtgtctcgccatccaccagtttgtcttggcttttcactcgctgtcggatcgattcatttgaccaagagcccacgaagttagcgaacccgaaggatgatgtccctaacacaagggagctcggggtcggatgccgatgtccggtacttggggacggacgagaagaagaggaagcggatgctgtcaaaccgggagtcggcgaggcggtcgaggatgagaaagcagaagcacctcgaggacctgacgagggagatgggcgcgctggagagagagaaccgcgagatcatcaaggcgtacaaagagaaggtgcacggccaccttggactccagtcggagaatgaagccctgcttgcagagaaggcagcactgatgaatcacctgaacggcatggaatcgatgatcggaagtttcaacaagagcgggccatgccaaaggttcagttccgcggtccaagagccgtggcaggcccacagctcatcgcaacagatcgtggcttctgctagcatgtctaggatttaggtgacatctaattctcatgttaaggtgtctgtagctgccgcccaccccagtacaagtcattgttaggctcacctcgtctgtctgtcatcgttgctcattccttcgttgttcttgattgcgtgtgtgaaagatgggaagatatgtccgtgctgatatttgactgcatcggaggcagcatgctgctttgttctatctttcagctaaactacacgattcatagatgcaaattgatctcaaatcattaccagtttgattaaaaaaaaaa

SEQ ID NO: 86 - DNA, 1419 bp, Eucalyptus sp.
ggcgtctctttcgctcctgcttcgtctccctcgaagagctaagtattctcctcttcttcttcttcttcttggttttctcctttcgtttttttctccgttttctcgttttcttccttagcgcgtccttcgttagggtttcgattccgctgtcgtgtcgatcgcttgtccgattcgcgttctcgatcgatcggaatccaggtctcgcgcgggataatcggttgccgatcgcttgatcgggagctgccggttccttttcttcccgattcggattttcgagggattcttccaggatccgcgccaatgtccctagggttcttcccgtgggaaatccacttatagcgtcctccgttttatgagctgctccatcctgatgcgtcgcgttcgcatcctccattccttctccgtcgtgttcctctactggttctacgtcttttcatgaactcgccttccccccgcccgtgaatctccccccgccccaggtcccagtgttcgggaaacgccccggaaccttgcgaaattttgtagatactagtggttgaagtcggtcttttagaacgcttttaaagcgattgaattcgaggagagaaggaggatggcttcgtcgcaaccaacgagctcgggatcggaatgcaaccagcggccagtggctgtcgatgaaaggaagaggaagaggatggagtcgaaccgcgagtccgctaggcggtcgcggatgaggaagcagaagcaagtcggggacttgttgggccaagtgagtgagctgcaaaatgccaacagtcagatagcgcagggtatcaacgccaccactcagaagtatgcggagatcgaaaatgccaataatgtactgcgggcgcagctgatggaattgaccgataggctgcggtccttgaattcagtgcttcaggtcgtggaggtggttagcgggctcgcgatcgatatacccgagatacctgatccgcttatgaacccatggcagctgccctgcccgatgcagccaattacggcatctgccgacatgttgcagctgtgagcatcagattggaagtgcaaaagttggggctgattcttttggagtccccttctggggggatggtagatccatagccatttgctgcttttgtttttcttgtcaattccgttctctttcttgaagttggaactccaatatctgtatgcgtctgtctagatggactggcgcttttatgtctgcttgacattgtacttggctgttcttgcttgttacttatgggatgttcctgttcttgatggttttcaacaagtttatgcttctctctctccacttagtcaaaagccatctcttatgcttatggtgagatttggcttgggaaagttaatgtttcgactcggtctatcgttgaaatgtgacacagtgcaaaattcatatgagttctaaaaaaaaaa

SEQ ID NO: 87 - DNA, 716 bp, Eucalyptus sp.
gggaaaggccctcgaaaatgggttcggttcggcgtcaggcgagctcaggatccgatggcgacccgaggctcggtggggtggccgatgatgaaaggaagaggaagaggatggagtccaacagggaatccgccaggcgctcccggatgaggaggcagaagcagctgggggatttggtcggagaagtggggcaactgcagcaggctaacgctcagctcgcggtgagtatcaatgctgctgcgcagaagtatgccgaggtcgagttggcaaacaatgtcctcagggcccaggccatggagcttaccgagaggctccggtccctgaactcggtactcgagatcgtggaggtggtcagtgggctggtgattgatattcccgagattcccgacccgttgatgaagccctggcagatcccatgtccgatacaacccataatagcgtccgcagacctgtttgagtgctgatgtatcgattgctgttgcaaatgtggaactagcgctttggattttagtctctttacctctgtgtttgatgtgaatattgtccgatgtctctgatgttcttacttcatcttgttggcagcggtaaaatgtcagtttcgtgtctgttgactggattggctctcttttttgtacaagggggtgtcgtttttcaccctcattagcttgtgaaatttgcatgatgatgaatggttgtaacaaacctaaaaaaaaaaaaaa

SEQ ID NO: 88 - DNA, 1076 bp, Eucalyptus sp.
ggtctcgcaatatctaagtcaaaacctgaaagaaccaaaaaaagaaaagaaggatttgatccctgttctattatcgtaatattttcctaaatctgctcgttcgaaacgagattatttaatggcttcgtcgagcgggaattcctcgagcaccgcccggcttcagaactccgggtccgagggcgagccgcagcagctccggatggaccagaggaagaggaagaggatggagtcgaaccgcgagtcggcgaggcggtcgaggatgcggaagcagaagcacctgggcgacctcacgtgccaggtgactcggctggcgaaggagaacaaccagatcctgacgggaatcaccgtcgccgcacagcacctgaccaacgtggagtcggagaactccatcctgagggctcaggtgacggagctgagccacaggctcgactcgctcaacgagatcctgaactccatctatcaatccagtgggaccgccgacgccgaccaaggccttgatctgtgttctccctacgacggcttcttcacgagtccggtgaatttgggctgcgtgagccaccagatcatggcagcttccgacgtgttcgagtgccgatgatgggctggattatccgggggcggtggttgttgactttcttgaagctggtcacgaacgggtggccaagggggaagactagattagggtactttccggttatttttgttaaataatagggttgattaggtaaatggcctagatgggtttcttaaattaaatgtgactgtttggtagatgtcaatgtcaatgtcaatgttgtctaggcaattggtgggggctttcgatctttcttggtgttttgtgggtttgtatcctgtgaaagggtcgattggggtagggacatggcgtggaggcctagggagtgttcgaggtcaatttggtcatataatatgtactgtgtacttttgttattattaatgtcggtgtcgtggcccgagttttggttggtagttcggaaagagagggcgcttgaaatgcgtgcaaaaagccgcccaccgggggactaatttaatggccaaattgattcgcaaaaaaaaaa

SEQ ID NO: 89 - DNA, 927 bp, Eucalyptus sp.
attatatcgtcgtgtctatttcccgaaatatttgcataactactagctgggtcctgtcgtaagccttacaataaatctactattagctgagtattgggtgtcgaataatttgcacgaagccacgaactattggcaatcgatctcatggcttcctcgagcggaacgtcttccgggtcaaccttgatccagaactcgggatcagaggagagtctgcaggccttgatggatcagaggaagaggaagaggatgatctccaaccgcgagtcggcgaggcggtcgcggatgaggaagcagaggcacctggacgatctgatgcttgtggtggctcagctcaggaaagacaaccagcagctaagggacaacgtgaacgtggtgaaccagcattacatgaccctggagaccgagaactccatcttgagggtccagatgaacgagctcaccaacaggctggagtctttgaaggatatactcggtatcctggatgccggagatggtggcagaccaggaaatggtggcggatcgggatataatggcggtggcggatggggaaatggtgggttcggatcacctgaggaaattggtggtggcggtggctggacagatcagcctatcgattacttcttcaacccaatgagctgtgcttatgctgtgaaccagcctattttggcctctgcagacatgtttcagtactaatctcagaagacagcgagagaaggaagttgagatctgtctgatctatcccatgaagcatttaggcagtgaatttttagtttgtttggtaagagtgtgagaggataaggggcttcgaactgtaaatgggggttgcttgctttctatttgatcgaagaaccgtctgtaattggccagcttagtaatgataactagtagatgttaatcctactttcttgttttgcttgctaaaaaaaa

SEQ ID NO: 90 - DNA, 805 bp, Eucalyptus sp.
gaaaatgtctgcgcaaaggcatggagacggcggcaaagtcgacgtagcttcggtccaggtgggaatggagccaacagggtcgtcttcctcttcttcttggcggaccaggcaagatgggaatgatctcacctctccttcttgcgccctcaagaagaagaacaagagagaggaaaacgacgaggacttgttcacggttccggacatggaggctcgaccggctgtgaattctacggggaacagtaatgtccatgtcagtgagcaacaagaagctgatcaggctcagacggcgattcccgggaagcgacggaggggacggaaccctgttgacaaggagtataagaggctcaagaggttactgaggaacagagtctctgctcagcaagcacgcgagaggaagaaggtgtatgtcaatgaactggaatcgaaagcccgcgagttgcaagacaacaacgtgaagctggaggagaagatctcaactttgatgaatgaaaacatgatgctcaggaaggttctcatgaacacccggcctaaagtcgacgagagtgcagactcaaagcaatagtgttcttgtctgggttatattagaagctctagataaactgttttcgacccatcgcattatagccagaatcacaagaacagatcagatgttattacagctctaatctagagtctagatattaaagtgcagcttgaattaacctcatgttagatcttccaaactgtaaaatgagcatcacgacggagtaagcagacgcgcatgctgttttgatctagttacaagccgtttgtacgacaaaaaaaa

SEQ ID NO: 91 - skipped

SEQ ID NO: 92 - DNA, 1104 bp, Eucalyptus sp.
ttcttcttcttcttcttcttctgttctaatggagaacccagatttaccgggagatgacttagcattggaattcgatttccagagcctgttcgacgaattatcgcctgatgctgcgggccttctcgacgccagcgatgtcgatgcttcgtctccgggatcgctgtcttcgtggatcggcgagatcgagggcatgctgatgaaggacgacgaggaagccgtcgccgtcgagccgagtcaggaggtcttcgatcgcttcttcgccggcttgctcgttgattcccccgagggcggaccggccgaggcgaccgacggcgcgagcgacaaggagtccaattcatccgacggcggcggcggcggcggcggcgaacgggatgagaagctggtcgtcggagataacgagctttccgaggacgctgatgatgatgatcccgtctctaagaaacagagaaggcagctcaggaataaggatgcggcggctaggtcgagggagaggaagagaagttacgtgaaagagctggagatgaagagcaaatatatggaaggggaatgccgcaggctggggcggttgctccagtgctttgtggctgagaatcaagctctgcgtctgaatttggagaatggcggtgcgtatggtgctaccatggccaagcaggagtctgctgtgctcttgttggaatccctgctgttgggttccctgctttggttcctgggcatcatgtgcctgtttacccggcccgtgtctctccaaccgtgtccggtggctccgccactggaaaatgtcggagagaaagatctgagaagctgggctccaagaggaataagaggtcacgcgtttgaagtatcggcagcacattctttcgtcatgaccaggagatgcagagcttcaaggacaaagatgaaactatgttatctcgttcctcgagctttggcatgaggtgatctttcgttcgtgggatgcgtgtcacttttgatggtcgtcatctagaaacaaacctaaaagaagccgtccgggctcttgcttagtttagttttcctgttgggtttttgtaaatggagtgacttgagattgctatatcgatggttactgttagtataaaaaaaaaa

SEQ ID NO: 93 - DNA, 1707 bp, Eucalyptus sp.
gcccaaacagccatcgcacgctctttctctctctctctctctctcctctttctttctctctcctccgctcgctccgacacgcttctccgtgtaggcgcgctgcaactgtagacccgacgccgccactctctctctctctccatctctctatcgccgccgccggcgattcgcgtctcgtcctggtccctcggccccggccggcgggcggcgattggttggagagtccgccgcagccctaattgtcgagcgcttcggatccgactcgaagaggaggaggaataagaagaagaagcagaggaggaagtttccagtagcttccgtggaattccagctggatttcctcccccgtctctctctctttctctctctccccaggtgtctcatagatattacaaactttcagtgtaattagctagggacaattaaccttggaaaggttttgggaactctcctgaatggggaccggggaagaaaccacagcttctaaaccttccaaacctacttcttcaattcaggaagttccaactacaccatcatatcctgattggtcaagtcctatgcaggcttactatgcccctggagcaacaccacctcctttttttgcttctactgttgcttctccaagtcctcatccttatatgtggggaagccagcatcctttgatgccaccgtatggcacgccagtgccatactcagccatatatcctccttatgttcatcctaatatggctccgactccagttgcagcacaaacaaatgtggaaccagatgggaaaggtgctgacggaagagatggagcttcagctaaaaaatccaaagtgacttctggaaacagtagtttggttggtgggaaggctgcagatggtgttaaggctacttcaggctcaggaaatgatggagcatcccaaagtgctgatagcggtagtgagggttcatctgaaggaaatgaggacaatagccaacaggaattcactgcagggaagcctggagtgcccactcctgcaactaatttgaatattggaatggatttgtggaatgcatcctctgctggtggagctgcaaagatcaggccaaatcctggtgctgcttcatcaactcttgtcccaacaggaatgatgcctgatcaatggatgcaagatgaacgtgaattaaaaaggcagaggaggaagcaatctaacagggagtcagcgagaaggtcaagattacgaaagcaggtggagtgtgaagaactacaagcacgggtggagacactaagcaatgagaatcacactctgagagatgagcttcataggctttcagaggaatgcgagaaacttacatctgagaatagtgctatcaaggaggaattgacccgagtctgtggaccggaggcagtcgctaaccttgaacacgactccacttcagcccttcaatcgcacggaagtgaggagaacagttgaaggagagatttctcttgataataatgaaacacagtatgcagcggaaataacattgaccttgtcaaactattttattgacagtggcaactcgacacgcatctcctttgtctcactaatcttatacccttgacccattttcctttttgtaactctagttatacatagtttcttctcaagtttgagccatagtagacaacatgcacattgcttgtaacactaattggcagagcagatgaggactgatctggaggttacaacaaaaaaaaaa

SEQ ID NO: 94 - DNA, 1664 bp, Eucalyptus sp.
gctttttgcttgccggagctgaactggatctcaagatcactccttttccgttccgacgccatcgccgctccagattcacaaaagggtgtgcgccgatttgttgtcggatccggagcatgtgaagcaatgccctcaaatcatacgtattaggcctcgcaatttggttccctgaaaatgggatctcaagtcggtggttttggtggcggcatcggcggcgagaccgcagggcggccgctgtcgaggcaagggtctctctatggcctcacgctcgatgaggtccagaaccaactcgggggtatggggaagccactggggagcatgaatcttgacgagcttctcaagagcgtgtggagtgtggaggccaatcaaggcctgaatatgggcgctgccgagcccgagagcacgcaatccggcctattcgctccgctgcagaagcagccgagcttcacactctcgagggctcttagcaagaagactgttgatgaggtgtggaaagatattcaacagggcgagattgatgatggtagtaataagagcaagaagaagaagaaggatagcggtcttggtgaccaagatgcaaagccttccttgggtgagatgacacttgaggacttcttgcacaaggcaggagtggtggctgaatctcctgtgatcaacaagaatgggaatcatgttgttgacgttgattctgtgactagtggcggtcctcaaagtgctcagtggatgcattaccagctcccttcagttcagccgcaacaaaatgtggtgccagtcttcattccaggccatcacgtggtccagcaaccggtcccaatcatcacgagtccctttctggattcagcattcggcgatgccgcgcagatgactgtttcgccctcctccttgttgtgcacattatcggataccccaaccccggggcgcaaaagagttgccccaagagatgtggtggagaagacagtggagaggaggcaaaaaaggatgattaagaacagggaatctgcggctcggtctcgcgccaggaagcaggcgtatacacaagagttggagattaaggttttgcgtctagaggaggaaaatgagagacttagaagaaagctggaggcagagaaagtgttgccatccgcaccgccggctgagccgaagaatcagctccgaagaactagttcggccccactttaacagtgtaccatacgtgactgctaaggacgagattacgcctaacctccgttgtttctttgactgacttcagcatgttgatctcctcaattatttcaaagccgatgcttccatgctctgccgaccgcagttcaaacttctaggattgtgcattttcttccgccggttgtaattgtcgttggcgtccttctatggtgtttactctgtgtacattaattatgataacccagtttatgcagcattacagatccccttgcttctcatgtcgctgctccatcgatcattcttctcctttgtttagagcaggcttgttcaatgtactttgcataggtaacaaaactgagcagaagattgcaatctggagtatcttttgcagattttatgcacaagagccagaatgacaattcatgctgtgtcattcgcattgttgtagaaacagtgtatatctgatctgagccgttacttttgttttgaagataaaaaaaaaa

SEQ ID NO: 95 - DNA, 1206 bp, Eucalyptus sp.
gcgcagggaaagctcacgcccaaggacgagccatggagatgcgagatccgcccccgaaccctagccacagcccccacattccctctccccagaacccccgcgccgcccccgccatcgccccgccgctcgccgcccctcgcggcgggcaccaccggcgggcgcactccgaggtcaatttccggatcccggaggacctggatctggggccggatccgttcgagaacgggccctccgggagcttcgaggacttcggatcggaggatgatctgctcagcacctacatggacatcgagaaattcggatccaagctcgacgacgggcaggggccgtccgatccgaagcccgagaacgcgggcggcggaggcgacgtcggggagaagagcgcgaggccgaggcatcggtatagtaactcggtggacagttcttccattttggagagtatagaggcgaagaaggccatggctcctgataagctggcggagctgtggacgattgatccgaagagagctaaaaggattcttgcgaaccggcagtctgctgcgcgatcaaaagagagaaaagcccgatatatttcagaactcgagagaaaagtgcagacccttcaaacagaagcaactacactctctgcacagctcacacttttccagagagatacaagtggtctgacagctgaaaatacagagcttaagctgcggttacaggctatggaacaacaagctcagctacgtgacgcgctgaatgaagcacttaagaaggaagtagagaggctcaaagttgctaccggagaagcaatgaccccatcagatacctacaatttggggctgcaccactttccatacgccaaaccttcctacttcccacaccagccacaatctggccacgtcgatccccagaacttgcagatgacacagttccatatgtttcagcctaatatggctcatcaacctctggttgctgcagcccattctaatgccttttctgatatgatgcagcaagagtctcttggtcgattccaaggattagatattagtaacaaaggctctcaaatagtaaaatccgaagccccctccatttcagccagtgaaagcagcagcacattttaatgcaacccctgccaacccactaatgaccgccccgcttttgttggattgttaatagactaacttgttgactgccagaaggtattgtttgttgttaaaaaaaaaa

SEQ ID NO: 96 - DNA, 1905 bp, Eucalyptus sp.
gaaaagagggggagagaaaaggaattcaggcacggcaacaactggaaaggaacggggttcaaaggttctctctcttttaagcagtgagtgagggggtgcaaattctcattccaaccatgattctgtcttgagctcgtgtggggtgagggagagggagacgtctccagctcgagtcgtcatctgggtccgcgtcttctcttcccttcttccaatggtttgatcctaggacagagagagaaagagagagatatacaaaaagagagatacagagagatagagggagagggagagggagagggagactcgtggcgctgtttcgagctttctagcttgcggaggaggagggctggtgttgagcgaaacttggagaggtcatgaattcgacaaccactcagtttgtgtcctctagaaggatggggatgtatgacccgattcaccaaattggaatgtgggacgagaacttcaagcagaatggaaatcctaatgcgccgccagctctgatcatacctatgcacgcgaatttggacaaccagtcggaggatacttctcatggatcacaggatactgctggcaagtatgagcaagaaacatcgaaaccttatgataaggtgcaaagacgtcttgcccaaaaccgtgaggctgcgcgcaaaagccgtctgcggaaaaaggcttatgttcagcagctagaagcaagtcgtttgaagcttgtgcagttagaacaagaggttgaccgagctagacaacagggtgtgtacatggcttcaggagtagattcagcttatccaggatatggtggatgtttaaattcaggaatcgttgcatttgagatggagtacgggcactggattgatgaacagaatagacaaatatgtgagctgagggctgctttgaatgatcatagaactgacgtagagcttcgcatcctcgtggaaagtggcatgaaccactatttggaactttttcgcatgaaagcggttgcctcaaaggccgatgttttctatgtgatgtccggaatgtggaggacatcgtcagagcgattcttcctgtggatcgggggatttcgtccttcagaacttcttaaggttctcatgcctcagctcgaccccttgtcagaccaacaatgggcgtttgtttccaacctcaggcaagcttgtcaacaggctgaagatgccctaaagcaaggtctggataagctccagctcaacctggccgaggctgtggccagtggtcatctcggcgaagggaattacatcccgcaggtggctactgctttggagaaattggaagctctggtcagttttgtgaatcaggcagaccatctacgacaggagacgctgctgcagatgtccaaccacctaacaacacggcaagccgctcggggcctgctagccttgggggagtacttccaacgcctccgagctttaagtaacctttgggctacacgtccccgcgaacccgcttaaattcacttggtcaagtcgacatggatatttacaggatgaaatctctcgtggagccataataagtgggccaaaggtgctgttttgcatgtcagctgtagacatcgtgtagaaagttgctactgccgataatttttttctaggcggcgtctgaaagatgaagatgtgaataccaacatttatcttggagtcgtaatctcttttaccctctttcgggcgtgctgcagttaatgtatcgggtagttcttgagttaggtttacgacgattgcttggtgaaccgggtttactgtactcgataagtttgacagaacacagttgtgtatagatgagttgtgctgtgtattttgcgctgcttattgatctctctgtaaataacagatgctcatcttggaatcactagacagttgattcatgaacccgagttattttgatttaaaaaaaaaa

SEQ ID NO: 97 - DNA, 1722 bp, Eucalyptus sp.
cagccggatgtaccttagtgtactgaatagcctaaagccatgttcctatcagatgttaacttgcatatggaaatgaatattacaacatgcgcgctttcttgagttttttttccctctgtagttgcacgcgaagaagcgctgagttcttggtcaaagtctagcagtttcgggttctccatcaatcgagtcggagtgggaggtatgaactctcctttagcccagcttgttaacccaagaaggatgcacacctacgagccatttgaccagttccccatgtggggagacaccttcaaagctgacaaggttaaaaatcttgaggcatcgtcatctgtgattgtgcatgcagtagatgatggattggacaagaagtttgaatatgtttctcatgaatcggcagaaaattccagctccaggagcgatcaagaagcaaatagacctgacaaggtacagagacgtctagcacagaaccgtgaagctgctcgaaaaagccgtctgcggaagaagaaatatgtacaacaactagaatcaagccgcttgaagctagcacagttggagctggaactcgggagagctaggcagcaagggttgctcttgggaaatggattcgacgctactcacttcggattctccagaacagtccactcgggaattgccacattcgagatggaatatgcgcactgggtcgaagagcaacaaagaaagacttgtgaacttaggactgcgctgcaaggccatgtaggcgatgtggagcttcgattcatggtagaaagcagcttgaaacactattatgaacttttccgcatgaaagcagaagctgccaaggccgacgtattctttttgatgtccggcgcatggaggacatcagcagagcggtttttcctttggattggaggatttcgtccatcggaactgctgaatgttctactgccacaaattgagctcttgaccgaagagcagatgctgcaattgtgcaacctccgacatttgtcccagcaagctgaagaggctctatctaaaggaatggaaaaacttcagcagaatttagctcaggaagtcgccgatgaccaactaggcgcagggaattatagctctgaggtggctgctgctatggagaaattgggagcattggaggactttgtgagccaggcggatcatcttcgacagcagactatgcagcggacgtatctctttctaaccacccgccaagcagcccgtgcattgctcatcctcggaacattttggcaccgccttcgtgcactgagcgctctgtggaccacccgtcctcaggatcccgcctaagccaatcgactccaggacagcgtttcaggaaaagaaggccttcattgctggaaagagtcccctgcgagcgagcaaggcaggaactaaaacttgctgctgtcagttctgttaactgcatcggatgtgcctactgtaatcaaggactcccaagttcggatcattgtgaatatagcgataagctgtgcgtgcgataaatagctaggaacggtagttcttccgcggcgcgcgatgttattgtatacatagtaaatgtctttccggagacgctcgcattgcaggcttcatttgaatggagtttgcagcatgattcggcttgtgtaaatttctgctaatttgaaagtagttgcccggtgttgttgtaactgatggaaggaaactcccaatcattatatcgagtacaaccttttttttttaaaaaaaaaa

SEQ ID NO: 98 - DNA, 1709 bp, Eucalyptus sp.
ctttcttgagtttttttccctctgtagttgcacgcgaagaagcgctgagttcttggtcaaagtctagcagtttcgggttctccatcaatcgagtcggagtgggagaaaatgagcacaaatggtttgctgaagtttgaccaaagtctttagtgagatggttgctgtctccccgttctcctccaaacagatgtctgatcaaataacttacttgaccgccagtatgaactctcctttagcccagcttgttaacccaagaaggatgcacacctacgagccatttgaccagttccccatgtggggagacaccttcaaagctgacaaggtcaaaaatctcgaggcatcgtcatctgtgatcgtgcatgcagtagatgatggattggacaagaagtttgaatatgtttctcatgaatcggcagaaaattccagctccaggagcgatcaagaagcaaatagacctgacaaggtacagagacgtctagcacagaaccgtgaagctgctcgaaaaagccgtctgcggaaaaagaaatatgtacaacaactagaatcaagccgcttgaagctagcacagttggagctggaactcgggagagctaggcagcaagggttgctcttgggaaatggattcgacgctactcacttcggattctccagaacagtccactcgggaattgccacattcgagatggaatatgcacactgggtcgaagagcaacaaagaaagacttgtgaacttgggactgcgctgcaaggccatgtaggcgatgtggagcttcgattcatggtagaaagcagcttgaaacactattatgaacttttccgcatgaaagcagaagctgccaaggccgacgtattctttttgatgtccggcgcatggaggacatcagcagagcggtttttcctttggattggaggatttcgtccatcggaactgctgaatgttctactgccacaaattgagctcttgaccgaagagcagatgctgcaattgtgcaacctccgacatttgtcccagcaagctgaagaggctctatctaaaggaatggaaaaacttcagcagaatttagctcaggaagtcgccgatgaccaactaggcgcagggaattatagctctgaggtggctgctgctatggagaaattgggagcattggaggactttgtgagccaggcggatcatcttcgacagcagactatgcagcggacgtatctctttctaaccacccgccaagcagcccgtgcattgctcgtcctcggaacattttggcaccgccttcgtgcactgagcgctctgtggaccacccgtcctcaggatcccgcctaagccaatcgactccaggacagcgtttcaggaaaagaaggccttcattgctggaaagagtcccctgcgagcgagcaaggcaggaactaaaacttgctgctgtcagttctgttaactgcatcggatgtgcctactgtaatcaaggactcccaagttcggatcattgtgaatatagcgataagctgcgcatgcgataaatagctaggcacggtagttcttccgcggcgcgcgatgttattgtatacatagtaaatgtctttccaatgacgctcgcattgcaggcttcatttgaatggagtttgcagcatgattcggcttgtgtaaatttctgctaatttgaaagtagttgcccggtgttgttgtatctgatggaaggaaactcccaatcattata

SEQ ID NO: 99 - DNA, 1869 bp, Eucalyptus sp.
ctccctcctgctccctctccctttctctctcgtcttctctctcctctactccgctccgagcgagctcgaatcgtccgtcgcgttccagagagagaaaatgcggtttcgagaattgagattcctttgactgcctccgggcgctgcgcttcctcgtctcctgctgacctcccctttctttcctttctctctccgccgcgataatccgagcttcgcgtcccttgtaaattcaggcgctcgaattccgcccctcgttctccggattcggcgaccgggaagaagcgggggctccagtcgtgcagcagaagctgattgcataatatcattgccaagagaggaatcatctgagttttttagttggtgcttcataatggggaacaatgaagagacgaagtcatccaaatccgataaatcgtcttcaccagtacctccgcaggatcagacgggtgttcatgtttatcatcctgattgggctgctatgcatgcatactatggtccaagagttgctcttccgccttattataattctgctgtatcatctggtcatggtcctcatccctacatgtgggggccaccacagcctatgatgccaccatatgggccaccttatgctgcaatatactcacatggaggtgtttatggacatcctgcaattcctcttactccgactcccttggctgcggaaactcctaaaaagtcatctgctaattctgataatggactggtgaagaagttgaaaagttttgaagggcttgcaatgtcaataggcagtgggggggatgcagacagtgctgacgatgggactgataaaaggtcatcacagtttgtaagcagtgcagactcgggagactcaagtgatgaggatcaatcaggggcagataaagccaggaggaaaagaagccgtgaaggaacttcatccaatggcgatggaaaatctgaagtgcaaggaaaggctgctggggaggtggatgctgcttctgagaatgtgtccggtggagccatcgaacgtcccagagccacgggaaaattggctgcgcctgtaaactcgcccagcatgtcctcatcattggacctgaagaattcttgcatggatgcaaatgccaaccctgtgagcattttgcaacctggtgtagtgccacctgaagcctggttacagaatgaaagagaactgaaaagggagaggaggaaacagtcgaaccgtgaatctgctagaagatcaagactgaggaagcaggctgagactgaagaacttgccaaaaaggtggattctctgagtgccgagaatagggctcttaaatctgaaattagtcaactaaccgagaactcagataaattgaggctagaaaatgccacattgatggaaagactggaaaatgcacagggagtggaaaagggggttgaatcactgggtaaattcaacgacaatgggcttctctcggacaaaacagagaacttactttcaagggtaaacaactctggtgccgttgatcgaagaagtgaagatgagggagaaatttatgaaaggaagtcgaattccggtgccaagcttcaccaacttttggattcaaaacccagaaccgatgcggtggctgctggctaacagctctttctaatttatgttatatagtttgccttacttattgagcttcggaaaatttcgaaatcaatgtcacagctaacaggagaaggatgggatagctgggtagagctagcatccaagaatatgaggactctaattttatttgtagtatagttctctcatggcagaactgatggctttttttatcatgttcggaatgccgtgatggtcccagaggctatgtacatttggatttggttcgtaattgggtgtttttacggttaaaaaaaaaa

SEQ ID NO: 100 - DNA, 1869 bp, Eucalyptus sp.; identical to SEQ ID NO: 99

SEQ ID NO: 101 - DNA, 1683 bp, Eucalyptus sp.
tcatcgtggcgaagatgaattccgttttccccgtcgacgaaatcggcgactcctactggcagccgccgccgccgccgtcgtcggcggccgatcccgcaccgggggcgatggggaggagccaatcggagtgggcgttggagagttttctggcccaggtgacgtgctccggctcgatctctccttccgcctcttcgatcgcgccgccgccgaccccggggcggccgggggagggaggcgttctcgaggacgtcgtcgagatcaagaagccgaacggccagctcgcgcaattgaaccagccgcaaccgccgccgccgccgcagccgcagccgcagctgcagccgcagccgaaggtgccggagggaaccatgaagccaggagagcctattggttatcccaagatgccgttacaggcttcaatttctacacagtcagacttccaagctgatggttctggtcatggtgtgccaataccacaaggtgcagatagtggatcattaggcacttcagccttacccaccatacaaagagattcgggtgtgcatgttaagcaaacaacaagtgagtcatcaagggaggattcagatgatgaagaatttgaaggtgacacgggaaccactgaaaacaaagatcctgctgaagtcagacgcgccagaaggatgcagtcaaatcgggagtcagctaggcgatccagaagaagaaaacaggagcacatgagtgaacttgaaaaccaggttggccaactgaaggttgagcacactggactactgaagcgtctcactgatatgagccaaaagtatgatgtagcatcagttgacaacagaattttgaaagctgacattgagacattacgagcaaaggtgaaaatggctgaagaaacagtcaagcgggttactggaatcaatccacttgtcatcgctatgtcaaatttgcctagttcagacatcccatttgggagcagcccaatggattcattcacaactgctgctacgccgatgcaaccaaatgccgaccacttctttcatcatgcagctcctaatataacctctatcaatccgcatcacccaagatttgacagcagtggcttccccaggaacaacccacttccagtgctcacaaacatacaagccgatgccatttcaaacaatgtggctcccgtttcatcgatgcagggtgttcccggggcccccggggctattcctggttggagctcaaacattcctcctccgttggcaaacactaacattaaacataagtagaccccgcctggcatcattcctttgtcagtcgatagaatctgctgaagtatctctatctctacctgtacttctgcatgcatctggattgtcaatgcatcttttagggtgtgcaactaaactttagtccagctaaggagtatgtcatctggtgtcacactatgttatgtagcctatgcattataaaataggagggaaaaggaggagcatttgatggaagttctcgcgaagccttttgtacttgcgggatcttcttgaagtgcattaattgctaaacgatgtccggggtattgaagcagcaggttcatttatatgcctgccttttcattactcttttaagtgcaatcgctcggtttggtttgtgaaggctggcccccttaccatgaaataataaggaggtagcgatcaccattggcgtttaaaaaaaaaa

SEQ ID NO: 102 - DNA, 1957 bp, Eucalyptus sp.
gtgaagatctgatctctctctctctctcttctctgtctgacttcgcctgcaagaatttgtgtccctcttacaatccctagacagagaggtgcataaaaatcgaaactttcacgcccccttccagctcctctcactccccacccgccctgctccttcgtttccgtccattctccggctctccgctctccccggatcttcctcgctctagggttttgcccgcctccatcggcttccttgtaaaggcgggatttttaagctgcggaagttgacctccgggggtcttctcgattgggtcgatcgtgtttggtctctaggggtcgccagcttcaaggtggattgcggggattcctttgggtcgccatggataaggacaaattgaccggccacagcagcgggttgccgccgcccccttccggtcgtttcgccgggttctcgcccaatgctaacgccttctccgtgaagccagagcagccgtcggccgccgcgagctcctcctcgttcctccccatggcccagggccagaacctggtctccgacttcagccacgacattagccggatgcccgacaacccgccgaggaaccgcggccaccgccgcgcccattccgagattctcactctccctgatgacatcagcttcgacagcgatctcggggtcgtgggggccgcggacggcccttcgttctcggacgatacggaggaggatttgttttccatgtacctcgacatggataagttcaattcgtcctccgcgacttcgtcgtttcagatgggagagccttcttctgctcctatggccatgccgggtgctggggactccggttcgggtgctgccccgtcttctgcggagaacgtggcttctgggtcgactgagcggccgagaattagacatcagcatagccagtctatggacgggtcgacgagtattaagcccgagatgcttatgtcgggttcagaggatgcatctgctgcagatgccaagaaggccatgtctgctgcgaagcttgctgagcttgcactgattgatcccaagcgtgcaaagaggatctgggcaaacagacaatcggctgcaaggtcaaaggaaaggaagatgcgatacatagctgagctagaacggaaagtacaaactttacaaactgaagcaacaactttgtctgcacagctgactctgctgcagagagacacaaatggtttgactgctgagaatagtgaattgaaactgcggttgcaaacaatggagcaacaagttcatttgcaagatgctttgaatgaagcactcaaagaggagatacagcatctgaaggtactaactggccaatctatgcccaatggtggacccatgatgaactacccttcgtttggaagtggccagcagttctatcccaacaaccatgcgatgcacactcttctggctgcacagcagtttcaacagttgcagattcagtcacagaagcagcaacaccagtttcaacagcatcaactgcatcaccaacttcagcagcagcagttacagcacgaacagcagcaaccagctggggacttgaaattcagagcacctattccttctccaaatcagaaagatggtaatgcagcagagtcaaattcttctaaaatggagtgagtagctgcctctgggctttgtatcaaaaacagccgtctcctcttagtctgtcactagcagtattaattaccatctgtcatcagattaggcgcatacccctccctttggaaaattcccccccccccaaaaaaaaaaaaaaaaaaagtaggacaagatttaggcttttcatgggacacatactgttgaatgcatttatttgtttattttttgttgccatgctgtttaaatctttgatctggattcaagtttctcatagtaggtttgctttgtgaattagttacttgttgggtacctgtagtgattcagtataactgagaattttagtctaaaaaaaaaa

SEQ ID NO: 103 - DNA, 1549 bp, Eucalyptus sp.
gaccggagccccagaggaagttcgacacttgtcatcgcccagcgcgactcgcagattcggttcgatctcggaggggaaatccaacttgcccgaaatagcaatcgcagcttgcagaatgggtcctcaaatgaacttccgaaacttggccgatgtgccagcagccgaaagaagcaccggagggcaaccaggaattcccctattatctcgacaatcctcagtatattccttgactttcaatgagtttcagaacacatggagtggactttctaaggatattggatccatcaacatggatgagttcctgaagaacatatggacagctgaggagagccaactacagctacaagacatggcgccttctggtaatggaggggaaggaggtggtcaagtagggaatttgctgagacaggggtcattgactctgtcgcggactattagtcaaaaaacagttgatgaagtgtggagagaattattcaaagagacggaggatgtgaaagaagggagtagagaaggaggtgacataaatttgccacagaggcaacggactttgggagagatgacattggaggagttcctagtgagagccggcgttgtgagggaggacacacaaatgatggcaaggcctggcgacaatggagttcatgaagaaatgtcacaattcactagtaatggtctcgccagtagtgcggctgctggaaacgatttcatattctctagtaagcctgctggttcatcgttagattttattggaactagacctactcagctacagcaacaaccacagccacagccgcttgaaccaccggctccgctttttccaaagccggaaactgtgtcatttgcaacctccgtgcatctaccaaatacagctcatatagcaagtccagggtcaagggaagcgattggaatcacgcactcatcgttcaacaaagcattagttcacagtggtgctatgcaggctggaggactgtgcttgggggatttgggccgagcaggtttcgctgttgaatctccagcaaaactggtatcaccggatgcaatttccaacaatagtacagatgtatcctcgttgtcaccagttccttatgcttttggccgtggaagaagatccaaagatggattggagaaagcaattgagcgaaggcacaggagaatgataaaaaatagggagtctgctgccaggtcaagggctcgcaagcaggcctataatatggaactggaagcagaaatcgcaagactgaaagagataaatcaggaactacttagaaaacaggctgaatttatggaaatgcagaaaaatcagatctcgcagaaggtgaatggactgtaccgggaagataagaggcaatgttgcttgaagaggacgctgacaggtccgtggtagatttgatggatcggacagcatgtatttagtttgaaccgattgctagagcgtggcattgtgtttttcgctgcacatcgttgcttattccaatcttgtatcgcaaaggatgcgtatcacttgtaataagagcaacggcacttgatttgtttcgagtaaaaaaaaaaa

SEQ ID NO: 104 - DNA, 1845 bp, Eucalyptus sp.
cggccgcctgcagctttcccctccgtgtcgacacgacgacgactccgccgccgctcccccctcgcgtcgtctctccttctctcgccctgtatatatctctcgtcccccgacaaaaaaaggagaaatctgaagagaggggactgaaattaggttattgagaaggattcttcccgtgaccaatcttttggagaaagatggcttctcaatttaatttcaaaggcataaccgatgcatcgcaagctgaaggagtagctgggaaatcacacggaaatcactctttaactcggcagccatcaatatatgctttgacttttgatgagtttcaaaacacatggggtgggcttggaaaggattttgggtcgatgaacatggatgaacttctgaaaaatatttggacggctgaagagacccaggcaatgacgtctaccacaggtacaggggatggcagcgttccagggggtaatatacagagacaagggtcgttgacgctgccacgtactcttagtcaaaaaacagttgatgaagtttggaaagacctgctcaaagagagtactgttgctaaggatgggaacaggggtggaggattcaatatgccgcagaagcaacctactctgggagagatgaccttggaggagttcttactcagagcaggagttgtaagagaagatgctcaagaggtcggaagacccaacaacagtgggtttgtcagtgatttttctctgatgagtactagtactggtttgggtctaaactttcaacatccgagccagaacaatggatttgttatgaatcagatttccgagaacagtaaatcaatacctggtcagcatcctaatttagcattcaatgttggcagtattagatccaaccagcagcagcttcagcaacagcatgatctgcccctcctccccaagccagcaacaatgccttttgcctcttcagtaagtatagcaaataattcccagatgcctggtttagggttaagaggggtaatcgggatgacagatgcatccatcaaaagttccttagctcaaggtggtgggctgcagactggagttggcatgactgggttagacactaggggagttgctcttcagacagtatctcctgctaaccatatatctccggatgtaatctctaggaacacgatggattcgtcttcactctcaccagttccttatccatttggccggggaagaaaatctggcggtgctctggagaaagtcgtcgagagaaggcagaggagaatgataaagaatagggagtcagctgctcgttctcgagctcgaaaacaggcctatactttggaacttgaagctgaaattcaaaaactcaaagaacttaatcaagaattacagaggaaacaggatgagttgatggaaatgcaaaagagtcagatcgtagagaaagtgaaccggcaatggggaggtaaaagaatctgcttgaggaggacgctgacaggcccgtggtagactgccttgagattgaacatagatgttcgagtgcagggtgttggacatgttgacaactccagtgttgggatgtacatcttataatctgatcgtgctctttaaagaaagattatgcagagattaggtagctgtatctatagatcggcaagaagggatgaacgtttgtaaataagttgtgaaccatacttagttcgatgtctagagagatgtggaactcttttggattagcgcgctctgtctgtggggtgaatagcaccaaccagtcagtgttttggccactagagagttctcaagaagatgcatcatatctgtatcataggatgatcttaagtcatgaaacaaaacatctttaggtttgatgttaaaaaaaaaa

SEQ ID NO: 105 - DNA, 1396 bp, Eucalyptus sp.
ggagagagagagagagagagagaatggataggggcttctcggtggacgaaatctccgaccatttctggtcgtcgccgcggccgccgccggccgccgcgctgacgtcgtcgtcgtcgtcgtcgtgccggtctcagccgccgccgtcgaagatgaacaggagcgagtccgaatgggcgttccagcgttacctacaggaggcctccgtctccgccgcgtcgtccgggcgcggcgacgagggcgacgtggtcgagatcaagggcccgcgccccgatcggggccgggatcagggcccgatccggaagcagccgccggacccgaatgcggtaaacaaggacgcgagcgaggtcagcagtgccagcccgccgccgccgccgccgccggctccgtacgtcgacagcattgctccgccgccggagccgctgccgacgaactccgaggagtaccaggctttcctcaagagcaagctcgagttggcttgcgctgccgttgctctgtctcaggcaccgtttgtcataaatcaagattctggaactccagctgacaactctcaggcttcaaaggcatccttagtgggatctcaagctccttcaataggagttgggcctgagttgtccaagtcacaagaggaggatgctggcggactagtcggaataccttcattaccagccatgccaaagaaatctgggatacctgtgaggtcgacaacaagtggatcatcaagagacttatcagacgatgatgaaattggagaaactgcaactactgaccatttgggtcctcttgatgcaaagcgcgtgaggaggatgctttccaaccgagagtctgccagacgctcgagaagaagaaaacaagctcatttgagtgagcttgagacacaggttgctcaattaagagttgagaattctactttactgaaacgtctctcagacataagccagaagtacaatgtagcagctgttgacaacagagttttgaaagctgatgtcgaaaccttgagagcaaaggttaggttctttattggtagtccttctgatacatcagcggatgctgcagttcctgtgcgagatgacccaaagcaccaattctatcaaaccaattctagtaaccccgcatcatctgctgacgatatgagaaccaacaatgggttggcagatattcctgcagctgaaaatgcgcagcagaatggagctgccaagatcggacgaacggcctctatgcagagagtggccagtttggagcacctgcagaagcgcattcgtggtgattcaagtcctcgtggccccccgtacgatggagaacagtagtagcaatagactagcgagagggtcgatcattttggtggatatttactaattcattaatcgaagcacaataatacagttcgctaaaaaaaaaa

SEQ ID NO: 106 - DNA, 1822 bp, Eucalyptus sp.
cgctacttctctgggcttctttttctttgcttcccttccttaaactctccctctccccgtttcttgtctggtttttctgggtgctctcgcttttcgctgctgaaggagtgagtttgaccgtcgggttcctttcttgatcctccaattcgatcgtcagctcctcgtgtcgacttttttcgggtttcctgtcggcactgttcgattcggattcctcgacggaatggggagtaacatcaacttcaagaacttcagcaccgatccgacgccgacgaataacaggcctcctggcaacacgctgttaacccggcaaccgtcggtgtacacgctgacctttgaggagttccagaactctataggcaaggactttgggtccatgaacatggatgagctcataaagaacatttggtctgcagaggagaaccaatctatggcatctgctagtggcgctggtggtggcggcggacaggacggaattggagtacctggtggtcatttgcagcggcagggctcgctgacgcttccccggacgctgagccaaaagaccgttgacgaggtctggaagaacatttcaaaggaagattcagttgggaaggatggtggccttgtgactggaggaccggttgtgccacagcggcagcaaactctgggcgaaatgacattggaggagtttttgttcagggccggcgtcgttagagaagacgcccaatactctggaaagccaaatggtggaggactgttcggtgaattgccacgggctgggaataatgccggattagaattcggattcccacagccgggaaaagctgagaatttgatggggatgaggaacttggagggcggtaatctgaattccatgcaccctctgaacatgccggtgaatgcgaatgcgaatggaatcagatcaaaccagcagcagttaacacaaccacagccacaggcgcatcagccacagatcctcccaaagcagcccattttgccattctcgcagcagatcccttcacctaacaatactcaactcaacggtcatggatttaggggcggactgatggcaattccggatcaagtgatgactaacaacttgattcagggaggcgctttgcatggaggaggaatggggatggtcggtttaggagctggacctgcaggcatgccaactggatcacctgctaatccggtctcatccgatggaatgggaagaagtaacggggatacctcctcggtatcacccgtaccatatgtgtttaatggcagtgtgagaagaaagtgcaacagtgctgtggagaaagttgtggagagaaggcagagaaggatgataaagaaccgagagtcggctgcaagatcgcgtgctcgcaagcaggcttatacaatggaacttgaagccgaggtagcaaagcttaaggatgaaaatgaagaattacgaaaaaagcaggcagagatcatggaaatacagaaaaaccaggtcaaagagatgatgaatacgcaacggggagctaagaagcgatgcttgagaagaacacaaactggtccatggtaattgagatgttaggttagtggttttttgtgtataggaaaatatgtatggttaggtactgtacatatctaggcaaaaacatgacctctgttgtagatgcagaatatgagagcctttttacttttgtattacactttcctgatctctacatgttctttgcttccgttagaagttatggaccaataggaaggaaagtaaaactatgtggctgcactttatcgagatgtaatacttatagagcatgccgttctcactatataatatgtcagttttacaataagaaaaaaaaaa

SEQ ID NO: 107 - DNA, 2740 bp, Eucalyptus sp.
gctctctctcttcgcgtttcgaggttcggaccggcgaatttctccggggaagaccggcggagcggcggcggcggcggcggcggcggcggggggaaaagctcccgcctttcgtcgtttcgcggtccgtggaataggcgacaagtcggattgcgttgcgtgtcgcgcctcgcttcgtatataagggcggcttgctgctgctgctactggtctgaggagtcaaccgagctcgagcgttacgcgcttcccgaaggttccgccggctagggttttttttttatttccctctgtttttcctccgttcggccacggtcgttgcttcgctttaaaaggattggcgcgattgagctgggcggagcttgagggttcgggcggtggcggcggaagtggagtggagcggggggtggtggtgctcgacatggtaatcgggttctgacgatgccgagctttgttccagcgacaccggcctccaattccattggttcggagggaaacattgtccagtctaatcaaaatacagattttgggtcgtttgagcattctcttggattccgcatagaggatgccatcaaccttagcagaaatcctgtctttaatcagataaaaccaaacggtcgagctcttggaactgacattcaagctcgtgcttttaataagtctgttgtagcctcggaaagagatcagtcttccaccgcgtcagcttctcagagaatacctttgcaaaaagagtcacagcccaatctgctttccatacctggtggttgttctgaaaattggggggattcaaatatggcagacaccagtccaaggactgattcatcaagtgatgacacggatgacagaaatcaaaggcttgaagcaggtccatcagctgctttgggagcttccgattccagtggtagatcaaaagaaaaggctgtggatcagaagacgttacgcagacttgctcaaaatcgtgaagctgcaaggaaaagccgactaaggaaaaaagcgtatgtacaacaactagagagtagccgtctgaaattaactcaacttgaacaagagctccagagagctcggcagcagggaatattcatttctagctctggtgatcagtcccattccagcaatggaaatggtgccatggcttttgatgtagaatatgcacggtggcttgaggagcagaacaggcatataaacgagctgagaagtgctgtaaattcgcatgttggtgacacagaactccgaataattgttgacaatgtcacgacacactttgatgacatctacagactgaaagataccgcagcgaaagctgatgttttccacattttgtcaggaatgtggaagactccagcagagcggtgtttcttgtggcttggtggcttccgttcttctgagcttcttaagcttctcataagtcagttggagcctctgacagaccaacaaatgatgggcctctacaacctacagcaaacatcacaacaggctgaagatgctctttctcaaggtatggaggcattgcagcaatctctggctgagacgctggccaattccccacctggttcaactgaatcatctggtaatgtggcaaattacatgggacaaatggccatggcaatggggaagctgggaacgttggagggcttccttcgccaggctgataatctgcgtcagcaaacactactacaaatgcaccgtttactgacaactcggcagtcagcacgtgctctcctcgcaatacacgattacttttcgagactccgagctctcagttctctatggctcgcaaggccacgagagtaacagaagatcgagattttgtcctgactgactccctgttggccgttatgttgataaaggtgatatcattccacagacagtgagtcctttgattgaaagtgctgccgtcgtcgcaactgctggtcttgagagcctcggtttaactctaattaaggggtgagcaaaaagtcacgtctctgtaacaaaatcatgtgcttgttgttgtagcattttagctagtggttgtatattgttgtaatgcctcctttaggacggttgagctgacaaaactgttcaggtcgaatgttgtcattgattaaaaacaaatcctatttggcagtgaataaatagagggtatcattgtaaaaaaaaaaaaaaaaaacctcgtgccgaattcgcacgaggcccgtgcgacgcgcgatctcctgctcctgctctgctcctccgatggccggcaaccggtggatcaggcccgaggtgtatcctctctttgcggccgtcggcgtcgccgtcgggatctgcgggttctcgttggtccgccacatctgcatcaatcctgaagtcagggtgaccaaggagaacagggctgcaggagttctggataactttaaagagggtgaaaagtatactgagcattctctaaggaagttcgttcgaaacaggtctccagaaatcatgccatccctcaacagcttcttcacaagccctgatcggaattaaatccacataaggaaaacctgaattcttctattggatggagtaaaactcaattgacttcatcatgactgcggtggtgtgattgtaaccttctcatacgatggatatgactgctcaaaaaaataagctcagcggaactttttgtttgattttatgtgataccatcaatgggtcaactattgtctacggaacatggcttttatattcttctcgacatggattggtgcatatttttagctcttcggcttctgtaaaaaaaaaa

SEQ ID NO: 108 - DNA, 1811 bp, Eucalyptus sp.
gatggttgggggttgttggtggcggcggtgatgatgattcatgggtagtaggactagagttggcggtggtggagatgatggcagagttgtgaacggcatgccgagcttcgtccctcaattacccacttcgaattccatgggatcagaaggaaactccattcgttcttctcgaattacagactttggaacacttgagcagtctcttggataccgcatagaagatgcagttgacctcagcagaaatcctgtcttcaatcagatgaaatcaagtgcccaggctcttggggctgatgtccaatttggctctttgaataagtccctttcatcctcagacagaaatctttctgtgaatattgtggggtctcagactctatctatgcatagagaatcacaatcaaacttagtatcaatacccggtgctcatcgtgagaactggggggattccacaatggcagattccagtccaaggacagatacctcaaccgacgacacaggtgacaagaatcacaggttcgaagggggtcaattgggtgttgcagcagcttctgattccagtgacagatcaaaagaaaaagccacagatcagaagactttacgcaggcttgctcaaaaccgtgaagctgccagaaagagtagattaaggaaaaaggcatatgtccaacaactggagagtagcaggctgaaactcacccaactagagcaagaactgcagcgagcccgtcagcagggcattttcatttcaggtagtggagaacaatcccactcaatgagcggaaatggtgccctggcctttgatgttgaatatgcacgttggcttgaagagcacaacaaggttgttaatgagctgagaaatgcggtcaatgctcatgctggggacactgagctacggacaattgttgacaatgtcgccgcacactttgatgaaatcttcaagctgaaaggcactgcagcaaaagctgatgttttccacattttgtctggaatgtggaaaactccagcagagcgatgctttatgtggattggtgggtttcgctcatctgaagtccttaagcttcttgtaaatcaattggagcctttgaccgagcaacagttggtgggaattggcaacttacagcagtcgtcgcaacaggctgaagatgctctgtcacaagggttggaggcattgcaacaatctcttgcagagacattagccaacagcacaactgcgacagcaggaccttctgggaatgtggcaaactatatgggtcaaatggcaatggctatgggcaaacttggaactctcgagggtttccttcgtcaggcggacaatttgcgccaacaaactctgcagcaaatgcaccgagttctaacaacgaggcaatctgcacgagctcttctcgcaataaacgactacttttcccgtcttcgagcgctcagctctctctggcttgcccggcctcgggagtgatgatcctatttaaggcgagttcatatagtatttaaccttttgaaatccactgcggcccctatgcgtcctgacaggagatgaagaagattacctttacttgggtcaaagaccgttgaacgtccaaactgcaatgcgccgacgattggctgttgtaattatagactcttcttgatgtcacaacactacagcgatttcagtgttcatgctgttgtaacattatagcgatgtcatgtttagttcttgcgtaactcctaatgtattctgtttaatgtgcattaactttggggaatagaaagtggggagatgttcatgtcacaatgatactgttgaaagaaatcaggaagttacaaacggaaaaaaaaaa

SEQ ID NO: 109 - DNA, 2438 bp, Eucalyptus sp.
atcgtctccattccatatgtagagagagaaagcgcccaccataccccggccgagttagagagagaaagcttcctccttttctagtcatagagagagaacagcgcctgcctgcttcatttctgccgccggaggaagaagatcgccgccgccgccgcctccgcctcctcgtcggagggagattctccgattcgccgatgcgcgcgcgcgtttgtcggtggcattgagctgcgaggtgaagtgaattgaagtcgaattctgcttgtccggagctgtccgtgggaagtgaatccgaggtttctgtaagggcattgtagagagagaaagaagagagaagaaagtttgggttttggtgagggggaaaatcatgggcgatgctgaagattctcgtaacgacacatcgcgagggcttcaatcttcgttcgggactctacagcctaagcaggcattctccatgaaccacctcgatataccgcacctgagcgctccggacatgcgcgcccccatgcggcaattcgcgcagagcttcgtcggcggcggcgacggtaacaagagagccggcatcccgccgtcgcatccgaaccagatccctccgatttcgccctactcccagatcccaatgccgcgccccctgaaccagcagatgggttcttcgaatttcagccacggtccgactcactcgaggtccctgtcgcagccgtcgattttcaatttcgacaatctgccgccgttgagcccgtctcccttccgggactccccgtcgtcgacctcaatctcggaccatgtctcgggcgatgtgtcgatggaggatcgagatgcgagctcgcatcctctgcttccgccctctccgttccctaggggaaatccttcgcggattggcgagagcctgccgccgcgcaaggcgcacagacggtctaacagcgacatcccgtttttatcatcacttatgcaatcgtcgccacctcttataccgtcgtcgtcgtcgaaaggattgggtacgttggagcgctcggtttctgggagggagagcatgagttcagctaagccggctcagctggttaagaaggaatctagctgggacagaggtgtctacagcaatgcagaaggcatgggcgagcggaagtctgaaggggaggtcgtggatgacttgttttccgcttatatgaatctggacggcatcgatgcgctgaactcatctgagaccgatgagaaaaatggaactgaaactcgtgaggatttggatagtagagcaagcgggacgaagacgaatggaggcgacagcagcgacaacgaagcagagagcagcgtcaatgaatgtgggaatagtatgcagaggcttggaatgaattcatcaagtgagaagagggagggaatcaaaaggtctgccggaggagatattgctccagcttccaggcactacaggagtgtttccatggatagttttatggggaagctgaatttcgctgacgagtcgacgaaaatgcctccttctcctggagttcggcctggacagctctcccccggaaattcaattgatggaaattctaataccttcagcttggagtttgggaatggggaattcagtggggcagaattgaagaagattatggcaaatgacaaacttgctgagattgccctgaccgatccaaagcgtgtgaaaaggatactagcgaatcgccagtcagctgcacgttcaaaagaacggaagatgaggtatattcaggagttggagcacaaggttcagactctacaaactgaagctacaacattgtctgcgcagcttacacttctacagcgagactctgttgggcttaccaaccaaaataatgagctgaaatttcgtcttcaagccatggaacaacaggcgcaactacgcgatgccctgaatgaagcattgactgctgaggtgcaacgattgaagcttgcgacagcagagctcaactcggaatctcatccttcaaagtgcatggtttcacagcttcctgtgagctcccaaatgttccagctccatcagatgcaacagcagcagcagtctcagcaacaaactcaatcacagcagcaaaatggtaacacaaccacaaagtcagagtcgaatcaataggacgtgggtggtccaacaactccggcgcctggacaaacctcacttgtctcggttcttcgacaccctgcagtagttctctagtgcatccattcattcattagtttttgcatatgcaatccaagtctcttttgcatggtaatgttatatatattcaaatatatattgctccatttgcattgcatccgtagttccgaattaaggtatgaagtcatatatacttatacaggctgtaatatctaagttatgtccacagcattcattttatttttccccggttttgtttcgtgaaaagtccctgtgtccagattataagcccaaaaaaaaaaaaaaaaaaaaaaaa

SEQ ID NO: 110 - DNA, 737 bp, Eucalyptus sp.
gctctctctctctctctctctctctctctctctctcagattagaatataaatccatttcttgatcttatggcaaaccctagccatggcgtccaagactcaaaagggatcaagctctttggagcaacaatcactttgcaaggatttagggatcaacaggtcaagagtgaagccccaattagcacagaagcgacgacaacgatgacgacgatgacgacaacaacgaagatggcgacgatatcaacaaccaacagaaatcaagatgcactcgcagaggcaatgaagaggccagacaagatcataccatgcccgagatgcaagagcatggagaccaaattttgctacttcaacaactacaatgtcaaccagcccaggcatttttgcaagggttgccagaggtactggactgctggcggggccctgaggaatgtccctgttggggctggccgccggaagagcaagccaccgtgccggggaatggatgggttcccagagagttgctctttcgaagggtcagaggtaaaccatcatcaatactatgatttggattatggggtggtggagaattggcatcagttggttccacaaggcgctttccaacatgttgttagggtcaagaggaggaggaatggggatcaaagctattgatagttttgatgctttttagtcttcttcatctgttttcctattttgtttcagtgatatcaagattttgaagagggtatattcaaaaaaaaaa

SEQ ID NO: 111 - DNA, 1000 bp, Eucalyptus sp.
accccgcttttgtctcctcactatctcctcttcctctcctatgtatagcaaaagcaactgaacaagcaaaccaaattcaaggtggttaagctgtctttcacactccattcggccatatctcctgtcaatccatccatccatcaaatcaaagcccaagaatttatcaacttcaacaaaaggaaaagatgaacatgatgtcctcttcctcatcgtcgtcgtctggtttcgcaccagatcaccaccaccacctctcgtctcccaccgagcagctctgttatgtccattgcaactattgcgacaccgtcctcgctgtaagtgttccttgtaccagcttgttcaagacggtgacagtccgatgcggtcactgtaccaatcttttgtccgtcaacatgcgcgggatgcttcttccctcagctaaccagcttcagcttggccacaattactttactcctcaaaaccttctggaggagatccggaacgccccaccaagtttactgataaatcagctgtcgccggccgactcgataatgcagctacgaggaggagctgagcagatccctaagcctccagtagttaacagacctccggagaagagacagagagtaccttctgcctacaaccgcttcatcaaggaggagatccaacgcatcaaggcaggaaatcccgatataagccacagggaagcttttagtgctgctgcgaagaactgggcccacttcccccacatccatttcggactcatgcctgaccagcccgtgaagaaaactaatatctgccagcaggaaggagaggatgtgctgagaaaagatggtggtctctttgcaactgcgaatgtgggagtgtcgccttactgagaaactctacgttgggtgtctgtttaaatttctggaactgttcttccttccccctccccccccctttagggttcttcatttgcggaggactctcgactgttcacctgttttgggattgcttaaattcgtgtttgtcaaaaaaaaaa

SEQ ID NO: 112 - DNA, 1050 bp, Eucalyptus sp.
agagacttcacttgttgaggttgataggtgaagaagaagaagaagaagaagaagaagaagaagatgaagatacagtgtgatgtgtgcgagagagcgccggcgacagtgatatgttgcgcggatgaagctgcgctgtgtgagaaatgtgatgtggagattcacgcagcgaacaaactcgcgagcaagcaccagaggcttctcctcaactgcctctccaacaaactccctctctgtgacatttgccgggagaaggcggcgttcatcttctgtgtcgaagaccgagctctcttctgtcaggactgtgatgaaccaatccattccgcggggagcctctctgcgaaccaccagaggttcctagccaccggcattaaggtggctctaagatctagatgtgccaaggacggtgacaaaacccactccaagccaccgaaccagagctctcaaccagttaaaacaccccaccaacagctttccatctcaacttcgccatggggcgtcgatgacctgttgcagttaacggattttgaatcttctgacaagaaagagcagctagagtttggagagctagagtggcttgcagacatggggcttttcagtgatcacgtccctcaagaagcggctgaagttccccagctgccgatgccacagtcgagcaactacacttcctccaggacctccaaattcaatgtctcacacaagaagccgaggattgaaatcccagacgatgatgaggagcacttcaccgtccctgatctcggatgagaatagaggagttaactttgagggtagtggttgataggtttgatcatagtctggtgtgttggtacatagatacgcgtatatatttacatatgcacgcgtaatgcatgtacaacttaaagtaactgttgaactgctatagaagtcgtccttaatgtcatgggttagaagaaatagacaggtctttcttccactagatttcctttctttttctttgttagaattacacttaaaatttgtggctatgtattaaaagtatccgcttatgcattactttgtgaaaaaaaaaaa

SEQ ID NO: 113 - DNA, 1117 bp, Eucalyptus sp.
aagaacgtcgccccatcaactccacccggcgttttcaagaactcgcagagatcaagaactcgagccggcttctgcagcgtgcaccgttatgccgtcggagtgcgccgaccgcaagcccgcgaaggccccccacggcggccacctccacgcggccggggcgggggccgccgcgccgcagccgcaggagcaggagcacctcccctgcccgcgctgcgactccaccaacaccaagttctgctactacaacaactacaacttctcccagccccgccacttctgcaagtcctgccgccgctactggacccacggcggcaccctcagggacatccccgtcggcggcggcagccgcaagaacgccaagcgctcccgcaccggcgcctcctcgtcgtcgtcgtcctcctccgccgccgtcgtgctccccggcgtcgccccccaggagcaccacttgcacgccgcctccctcctcctgcccttcgccgggagccacggggggcccgtacacctcgccggcggcgacggcgacgggaagccgggcctgaacgtgtgcgggagcttcacttccctgttgaacgctcacgggcctcctgggttcctggctctgggcgggttcgggctcgggctggggccgggcgggctcgacgagatggcgttcgggctcgggagaggggtctggccctttcagggggtgggagacggcgtcggcgcgggcgtggggagcaatggcgggccggcggggatcgggaacgcgtggcagttcgagggcggcgacgagggcgggctcgtgggcggcggcggcggcggcggcggcggaggcggcgactcgtgcttctcttggccaggactcgccatctccaccgcttggagcggtctcaaatgagtggtgttacattcccacctctttcctcttctctatttcttcctttctttttttttcttttttttttcgttatgacgatagctttttagggtttaatcagtattgctaggtgtgaaaattaaaggaattgcaaggcccttttagacatgtccatctccatgtaatttgagaggagtttcatgctgtaccgttttgttgatgcttgtatggcacggaaaaatttgctctttaaaaaaaaaa

SEQ ID NO: 114 - DNA, 1527 bp, Eucalyptus sp.
tttgttttgctctcttctggcataatcactcttccaaaagccttcaaagcacaccttctttgctttggttttctgtctttttgtttgtttgtttctgctcttattccccttgtctgtctctattcattctgttttcttcatgccttccttccttccttcctatggttgtttgaatttcagggattccttggggtgattaataataaccccccaatggaaatagcatcatcaccgaggcccgtgtccgtgagcttgcaagagatcaagcctacatgtggaaccacaacaacaagcaggccgcataaggatcaagccctgaactgccccaggtgcagttcaagcaacaccaagttctgctactacaacaactacagcctctctcagcccagatatttctgcaagacctgtcggaggtactggactgagggtgggtccctcaggaatgtccctgtgggtggcggctccaggaagaacaagagaccctcttcgtcattttcttcttcgccatcatcgaagatcatcaagcttcctgatctggtggtgggcccgtcaagtcttcctcaaaaccctaagacccatgaagcccaacgagacctaaacttaacatacccacctgatactactcctactactgatcaacaaaatcccaagagtagcagtggaattattgcttcttcttcaatgggattgagcttaagctccttcatgccgcacatgcctgtagcatctgactcaagctccaacttttatgcggccggtggcttgaatttccagcatctccttggtctcaaaccgacgacatcctcattcggtagtttttctggacatgggtttgagagtggtggctttcttgggagcctccaagggttgcaagagagcggcaatggtgacgacagtaatgatggtgcgaagctgttttttcccgtggaggatggtttgaagcatcaagtgaccagtactcctcgtgttgatggtcagtttggtcttcaaagtagaggacaaggagatcattcaaatgggtattggaatggagtgctgggcactggaggatcatggtgattgattgagaaagattggtattcgatcatcatcacacgcttcaagggttttgatttttttttctttaaccttttatttcttctcttcttgggattggatcgacttggttgggctggggcgtttgatgggaactaacaatcagggttacatgggattttcaacccttttcctttctttctttttgcctattattttctctctcccctttgtctttgaagctcattttggggttggcttcagaagctagtctgggaatactgtattaggtgttctcaagcgtggtatagagagttagagatttaaagcttaaacgaagtcagatgggtctcgtctactcagtttgtacagtttcaagatgtctgaatggttgattgctaattatctgtacgagcatgttcactgttgtttgtgtttctttttacccccctgagcatgaatgagttggaatgatggcagccaaaaaaaaaa

SEQ ID NO: 115 - DNA, 1486 bp, Eucalyptus sp.
ctctcaccttcccccccgtcgccttaaaccctctccactccttccactcgtctgctgctccatctttgacgcgcattaaattcccgcgactccgaaatatctcacctccctctcccgcagaatccctagattccttccttagctcctcctctctccctctctctctctctctctctatagaaaattcctcatctttggtggcggcgagaggcggttgcgagggatttccggtcgcgggtgtatgtgcgtggggttggggttggggtgggggagatgaagattcagtgcaacgtgtgcgaggcggcggaggcgagcgtcctctgctgcgccgacgaggcggcgctctgctgggcctgcgacgagaaggtgcacgccgccaacaagctcgccagcaagcaccagcgcgtccctctctccacctccgcttcccagatgcccaagtgcgatatctgccaggagacggctggatttttcttttgtctagaggatcgagcattactctgtaggaaatgtgatataaccatacacacagcgaatacatatgtgtctgctcatcagaggtttcttcttactggagtgacagtgggtcttgaacctactgagcctcatccctcctcttcttcgataaattcacggcctggggaaaagatctctgaaatgaaatcaaagtcttcttctttgtcaaatggaggcaaccaattgccatcacataatgagtacaacgatattccatctgtacacactgatggcgttggaagcttgataaatgctaagttgccattttctgggggttctgcagcatcaagcatgccacagtggcacctagatgaacttcttgggttcagcgactttaaccaaagtttcagcttcatgggcaatggatcgtctaaggcagacagtggcaagcttggagactctgattgctcctcaatcatgagaagttctgaagaaacagttgacgagtgcttgggccaggttccagatgcttattgggctgtgcctcagatgtcttcacctcctacagcttcaggtttatactggccaaaaagtgctcggcgtcaactggatgctgctgtttatgttcccgatatatcttccgcaccagagaatgatttcctgtgtcaaagaaatgatcgcagcataaaacgccgaagacaatcttaggccatgggttcagcacaatcaggtcctgtagagaaagaaagaagaaaaagggagggggggggggggggtgtggggttggatttacttttgtggcgtgccttcttaaacttatttcagtagtctcattatgtcttatcgctgacagtttaaagcttcccaacttctgtagtaggtcaagtagatatctcaagatggtatgacggaccgagtaaggccgaagtgaaatttcgggcaagaactcatggatagcattagttccagtttgctgtactgtaatgactccaggttgtatgctggagaaagtaaattcaatctcaataaa

SEQ ID NO: 116 - DNA, 1381 bp, Eucalyptus sp.
tttttttttctcctctctttcctctcttttcccagtcttcccttcaccttttcagctcccctcttaagccatggacaacgcagccccatctcagtggactgcacagggattccttggggtgattaataataaccccccaatggaaatagcatcatcaccgaggcccgtgtccgtgagcttgcaagagatcaagcctacatgtggaaccacaacaacgagcaggccgcataaggatcaagccctgaactgccccaggtgcagttcaagcaacaccaagttctgctactacaacaactacagcctctctcagcccagatatttctgcaagacctgtcggaggtactggactgagggtgggtccctcaggaatgtccctgtgggtggcggctccaggaagaacaagagaccctcttcgtcattttcttcttcgccatcatcgaagatcatcaagcttcctgatctggtggtgggcccgtcaagtcttcctcaaaaccctaagacccatgaagcccaacgagacctaaacttaacatacccacctgatactactcctactactgatcaacaaaatcccaagagtagcagtggaattattgcttcttcttcaatgggattgagcttaagctccttcatgccgcacatgcctgtagcatctgactcaagctccaacttttatgcggccggtggcttgaatttccagcatctccttggtctcaaaccgacgacatcctcattcggtagtttttctggacatgggtttgagagtggtggctttcttgggagcctccaagggttgcaagagagcggcaatggtgacgacagtaatgatggtgcgaagctgttttttcccgtggaggatggttcgaagcatcaagtgaccagtactcctcgtgttgatggtcagtttggtcttcaaagtagaggacaaggagatcattcaaatgggtattggaatggagtgctgggcactggaggatcatggtgattgattgagaaagattggtattcgatcatcatcacacgcttcaagggttttgatttttttttctttaaccttttatttcttctcttcttgggattggatcgacttggttgggctggggcgtttgatgggaactaacaatcagggttacatgggattttcaacccttttcctttttttctttttgcctattattttctctctcccctttgtctttgaagctcattttggggttggcttcagaagctagtctgggaatactgtattaggtgttctcaagcgtggtatagagagttagagatttaaagcttaaacgaagtcagatgggtctcgtctactcagtttgtacagtttcaagatgtctgaatggttgattgctaattatctgtaaaaaaaaaa

SEQ ID NO: 117 - DNA, 1018 bp, Eucalyptus sp.
ctctctctctctctccaaaagccaacttatatctttgccatcccttttaatcaagagctcccatccatggacaccgctcagtggccacaggagattgtggtgaaaccaatagaagatatagtcacaagcacatgcacggcagcagccaccccaaagccatcatcatcttcggtttcggagaggaagccaaggccgcaaaaggaacaagccctcaactgcccaagatgcaactccaccaacaccaagttctgctactacaacaactacagcctcacccagcccaggtacttctgcaagacctgcaggaggtactggactgacggtgggtccctcaggaacatccctgtgggcggtggctccaggaagaacaagagatcatcgtcctcagcatcatcttcttcctcgtctttcaattcctcatccaagaagctgcctgatctgatcagcacacctgcgtcgaaccctaacaacaaagtgacacttcatgaaggccaagatctgaacctggccttcccaaaccctcaccatcatgatttcaagtccatctctgagctggtccaagtgccaagccttgaggccagcaagaaccaccatatctctgctaactctagctccgccggtgcttccatggcaccgccgcagctctcggctctggagctgctctcggggataacgtcgagaggtagtttcagttcgttcatgtcgatgcccgtccacgatccaggctccgtctacacgcctgggctgttcgcactgccggacttcaagccgaccctcaatttctctcttgatggccttgggagtgggggttataggagcctccctagtgtgcaagagggtggcactaatggagggaggctcttgtttccctttgaagatttgaagccagtctcaagcacgagtgatatggagcagaatagaggagatcaaggagactccaatggatactggagtgggatgttgggtggcggatcgtggtaaagaattagtttcagattaatgaaacagaaaaaaaaaa

SEQ ID NO: 118 - DNA, 1284 bp, Eucalyptus sp.
tttctccgctctctctctctctctcgtgcccaaatcataagttcgggtttgccgtgttcagtgcatgtatggatccttcaagtggaacaaaccaggaaatgggagctcattcattggaaagcatgttgatatcccctaaaccacagcaagatcaaaggaagccaaggcctcagccagaagaggctctccactgcccgaggtgcgagtccaccaacaccaagttctgttactacaacaactacagcctctcgcagcctaggtacttctgcaagtcctgtcgaaggtattggaccaaaggagggaccctgaggaatgttcctgtgggtggagggtgcaggaagaaccgtaggtcctcgtcctcatcatcatccagaagagcccaagaccagggaggaccaatctcaacgttgatcaacaacaatgattacgacaccccaaacccatttactaccttgcactctctaacttatgatcagtccagtgatcatatgtcccttccattccttgggctccacaagttcccataccagcttgggcctcatgagctgagccatgatatcctctcctatgccaacagatcaaagaacggccatggtgacatgaacggaggctttcttgattcactgaagaacgagtttggcttgcttgagaacacccagaataatgttcatgacagtcatcatcgtcagaatctgtattatgggtatggatcagatgggatgcacaataacatgggagatccagtggacagtggtggtgctccatcatcatgtgatcatgaaatgatgagccctgctggttctgcaaatgaagctcttggagcgacatcaatgaagcaagagctgttgtgttctgatagagacggcgaaaatagggttttttggggttgtccgtggcagatgaatggagatcaatatcgcgggaatggtgtaattggtgatgttaattcagggaggggaagttggaatggtcttggttcatcttggtatgggcttcttaatagccctctcgtgtagtgtcgtgtcctacagtttcaaatgttcaaacctggaaaagaatggcagtagattagaatgttttgttcttgctgtgcatgatcaggcccaactgaatcatctcgggagttcttcagttttatcttttcttacatcttttgattcctccttaaaatgtggtactgaagtggtgagtttgtctgaaatcggtctggaaggaccatgtcctgtcattcttcagtgaagaaaagagaattgagtagtcttcagaatgattttaaaaaaaaaa

SEQ ID NO: 119 - DNA, 1434 bp, Eucalyptus sp.
ctctctctcgctctctctctctccctccctctcgatcatatccacagtaatatatactaggaaaaagaaaggaaaaatccctactttgctttagcttttgcactactcaaaaagactccctcatctttgcttttcttgtttttggattgttgttagatccacccaaagagaggggaaaaaaagatgattcaagagctgttgggaagtcctgcacttataggagagaggaaaatctccatgaaccatggcgcggttattttagagggcatgccttctccttctccttgcttctctccatctcccacgccttcgcctccttcttcttcctcctctgccatcacaaagacgacagcacaagcgacggcaacggcaacaaccaccggtaacgggacttcgacaacaacgaactcatcaaatcccgagaacctgaggtgcccacgctgtgattctgcaaataccaagttttgctactacaacaactacaacctcacgcagcctcgccacttctgtaagacgtgccgccgctattggaccaaaggaggagcactaaggaatgttcctatcggaggaggatgcagaaagaacaagagctcagctgtgtcatcctctgcctccaaatcgagcgcttccaagttcaagaacttatcgtctgagatcggacggtcgagttttgtcagtgctttcgatcctgaaatctcacagagccaggtcctttgggcctcaccccagagttcccacatcctggccctcctgagagccaatcagaaccctaaccctagtagccttggtcaccaagcctctccctttatgactctgaaggaagagaccaatctgattggaaaccacatgatgcctgagccaggaattgcagagagtgcaatgaataatgcgagaaacctgggcatgattgaccctctcattcatgttccttcctcttgcacctcctttttgagaggtaaccatcaacaagtcccacaccaactcagccatcaccaacaaaatggtattatcctcagtggtgaagctcaaaactccgggatacaatcgctataccaaaggctcagagcttccacaggtaataattatggttacagtgagcactcgccggcaattctaagcagcgtggcaagtaccccgccgctgtcatcttccctgtcctcgtccattctagagtcagtcccagccacggcgacaagtgaactcgggtactggaacccggctttctgtgtgtcagatcttcccaacgcaaatggttcatatccttagagacaaatcacactctttctgatgaattttatgcatgccacttcattttctctgttttcacaaaattagcttaggacatggttgtgatagtttcttctctgctttttctttgggattgtgtgctttaatgagctagactttagcgtcagctctctaaagctacggcac

SEQ ID NO: 120 - DNA, 1329 bp, Eucalyptus sp.
cctccctcactaaattctctctctttccctctctctctctctccttctacagaactaaatgactccaccaggtaccgccccgccgaagccaccgccgatggcgggaaaggaagaggccgccccgagctccggctcgcgcaaggcggcgtcgtcctcgtcgtcggggaagcagccggagcaagccttaaagtgcccgaggtgcgactcgtccaacaccaagttctgctactacaacaactacagcctcacccagccccgccacttctgcaagacctgccgccgctactggaccaggaacggcgccctccgcaacgtcccgatcggcggcggctgccgcaagaacaagaagcttaagccctccttggcctcgtccaggctcttccccggcgggggcggcgaccctaaggagtactactccgtggcggcggccccaccccacccagagctcggcggcttcaagctcttccacggcttggccccggccgtggatttccatctcggcgggctttctaatttctctaaggcggttcagaatcacaaccctccagcccctggaatttacagccagttctcttctttttcagatgcatcggccatcgaaacggccgccgctgctcctactagtgctgccacttgtttctctctagaccagatggcgggtcccagcggcactattcttgggttcaacaattatcacgcgctccctcccttcatcgcggctgctccggggtttggtacttccggtgcacttcacgagccgggcggttcgatgaaggtcgacagcaatcttgcatcgtccatcgagtcgctgagctcgatcaaccaggatctgcactggaagctgcagcagcagcggctggctatgctgttcagcggcgacaataacaacaaccataatcccaaggccaacaacggcggcgacgttgctgcctcatcgatcaacatcgccaccgcgcctttcgaggatcagtcgcagaacttgcgacagcctgtcttgttccagaatctggacgctgccggtagctcgagaaaggaaggatcgtcagtgaccgagtggttcttcgggaatgcgtacgcatcagttacgacgccgagcccgaccaacagtagcagtaacgggaacgacaacaacaacgccggcaactggaacagcaaaggaccgggtcaagggtttcaatacactgctttgccctagctgaggatgttagagagacgcagaaatattaagaaaaagagtaagtctttcaagggttttcataatttaaaagctaaaaaagatagcctcagaaacaaagaaattgattagaatcatttaatctaaaaaaaaaa

SEQ ID NO: 121 - DNA, 1432 bp, Eucalyptus sp.
ccagtttcagagtttcattgagaaatatgttgaaggaagacacgagtggcagcggcggcagcagcggcggcggcagcggcagcggtggtaatagctgggcacgtgtgtgtgacacttgccgctcggcggcatgcaccgtgtactgccgtgccgacttggcttacctatgctccagctgtgacgctcgtattcacgcagccaaccgtgtggcctcgcgccatgagcgcgtgtgggtgtgcgaagcgtgcgagcgcgccccggctgccttcctctgcaaggctgatgcagcatcactgtgcaccgcctgcgatgcagacatacactcagccaacccgcttgcgcgccgccatcatcgggtccccatcttgccaatctccgggtgccttcatggcccccttgccggcaacgttggtgggcctgtgatgggccacgcagcggatactgaggaaggctttctaaccccggaggacgaagaagccattgatgaggaggacgacgatgaagcagcttcatggttgctgataaatccggtcaagagcaacaacagccatacaaatggattcatctttggtggtgaggttgaggactacctggaccttgtggagtacaattctggcgccgagaatcaatacgttgatcagtataaccaacatcagcagcagcagcagcagcagcagcagcaacattatggtgtttctaggaagaattatggaggtgatagtgttgtgcccattcagcatagtgactgtcaacgacacaattttcagttgaatttggactatgaaccctccaaagctgccaacagctacaccagatcgcttagccacactgtttctatttcatccatggatgtgggcatcgtaccagaatcaactccaactgacatctcaatctcccatccaaggcctccaaaaggaacaattgaccttttctcgggacctcctattcagatgccatcccaactttcaccaatggacagggaagctagggtcttgaggtacagagaaaagaagaagacgaggaaatttgagaagacaattaggtatgcctcaaggaaggcatatgcagaaaccaggcctcggatcaagggacgttttgccaagagaacagacgttgatatcgaagtcgaccagatgttctcagcaacactaatgacagaaaatgcatatggcatcgtcccatcattctagattcagtgggaaatgagtatcagactatcagattggagttgtaacagctagtagtgaagatcttttgcttatactgtatctttcttgatctattacgtataattgatataaatgctgggtgattctgttaattcacttgtaacggtttaatgtctatattatgcaactccatattgtaaatgtgttctacgcttatattgttctaaaaatccaagtgctttctttgatctctaaaaaaaaaa

SEQ ID NO: 122 - DNA, 1935 bp, Eucalyptus sp.
cgagcatctgctgtgctgcacaacaagcctcaagttccacagagagttagagagagagagagagagagagagcgaaccccggagaaagatttcttagcttgactttggcgcggaagaaatgcaagagacccaggaccccgccatcaagctcttcggtgccaagatccccgtctcctccgccgcagacggcgcggccctcgcggcggcgaaaccggaggagagggaagatggaggcggaggaggaggaggaggaggaggagaggaggagtacgatgaagatgaaggaggaggaggaggagaggaacaagaaattgaagatgcagagcagaacgcttcacctgaaaaggcttctgagaatatgcaagaagattgcgaaccgcctccaaattctcaggaactggatccctccaggacttctccagatgctgtgaaccctatgacaccctctattcaagaagagagtacgacatcacatatcactgagactggagcacaagaagagcatggcacgcccaaaaattcgcaagacaaaacactgaagaaaccagacaagatcattccttgccctcgatgtaacagcatggacacaaaattctgttactacaacaattacaatgtcaatcagccccggcacttctgcagagcctgtcaaaggtactggactgcagggggtactatgaggaatgttcctgtgggagctggacggcggaagaacaagaacgctgccacacgttatcgccccatcaccatctccgaggctctccaagcagccagagttgattccccaaatggggctcaactcccccatttaagaaccaatggagccgtccttacctttggtttggactcccctgtgtgcaattctcagtcccccattccaaacatctccgagaagaagaaagtgttgaatggttacaaaaatgggtttcgggacattgaaaatggggatgatagctccacctcttcctcggtcacaatatcgaattccatgaatgagaaaggcctaaatttcccacaggaacaagggatgggaaatgttaatggattttctacgcagataccttgccttcccggcgttccttggccttatccatggaattccacaattccctcacctgccttttgcccttcaggatgtccaccgatgtcattttaccctgcagccttttgggcttgtggtgttcttcctaatgcctggaacattccttgtatgtcacctcagtcacccttttgcaaccaaaaggccacaacttctggtccaaattcaccgacactgggaaagcattctagagaatctgagccacttaaatcagatatttcactggaacaagcggaacccccaagacagaagaatggtagcattttggttccgaagactctgcgtatagatgatcccagcgaggctgccaaaagttcaatatgggcggccctcggtattaaggccttcgaaccaaagtccagagaaggcaaagttaaagatgctgaaaccttgccgcatttgcatgctaatcctgctgcattgtctcgttccctcaatttccatgagaacacttgaaaacggagctcatgactgtaaattgaggaattgtgtggtttttgaggagcaggattctgtcaaattcacttgagcaacgatggcggagctttgggtgttatattattagcccacaaaacggtgtgctcgttgcttaagacttagaacagatagagaagattccatccgcagagctcttaagtggattagttttgtgatctttttaaccttggaaacatctgcctttgctgaacgaacttagcctgcttttcttgtgttctgtacattgatagtgtctgcaacttgaagctgtgaatgtatagaagatatggagatttccgtgacaccataacgtcctgaatcattataaataatttcagattattgcttcaaaaaaaaaa

SEQ ID NO: 123 - DNA, 2047 bp, Eucalyptus sp.
ctctctctctctaaaaagttgccatttttttgcctttttaatttttcggaaggggggaaaaagacaaagcgcgagcaaaaatgtcgggggaagcgagagacccggcgatcaagctcttcgggaagacgatctccctgcccgatattcctcctggggatgcggcggcggccgccgtcgacactggccaggttccgtccgcggatcctccctcgcccgcccgcgaggatataggcatggccggcgtcgacggaggagaggaagaggaaggggaggaagatgaatacgaagaagacgacgacgaggaaggccgcgatgataaggaaacacaggatgaaaaaccagctatagccaagctggaaaatggagcccaattcatgaatctcgaggagggcacaaaccgggacgcaatatcggtgacaaatgagaaccctaggacgccttcagtcgacaaggagagcactactccaaggacgtcgaaatcagaagaggagcagagcgacacgagcaactcgcaagagaaggtgctcaagaaacctgacaagatacttccttgccctcgatgtaatagcatggacaccaaattctgttactacaacaactataatgtgaaccagccccgacacttctgcaagaactgccagagatactggacagctggtggaaccatgaggaatgttcctgtgggtgctggccgccgcaagaacaagaactcggcatctcattaccgtcatctagccgttcctgaagccctgcaaagcgtacggacggacttccctaatggggtccatcacccgccattgaaacctaatggcactgtcctcaccttcggatcagacgcaccactatgtgaatccatggcttcggttttgcatttggctgataaggcaatgcataacagcaggaaaaatggattccataaacctgaaggagtgataatgccaagcccttgtggaagtgtgagaagtggggttgagactatgaatggatcttctgccaccgcagcgaattccaaccttgcagagagtaaaaatggaaccaaagaaatcgtgatgccgaattgtcagggttttcctcctcagctaccgtgctttccgggggctccttggccttatgcatggaattctgctccatggagcccgccaatatcccctggcccgcaaactttctgtccacctggttttgctgtgccgttttacccagggccagcttattggagttgcagtgtgccaggtgcgtggaacattccttgggttgcccagccaacttctccgaaccacagcgccacgagctccgcacctaattctccgaccttggggaaacactcgagggatgagaaaatcgggaaaccaaacgactccactgaagaggagccaaaggaggctaatcctgagagatccttgtggattccaaagacattaaggattgatgatccaggagaagctgcaaagagctcgatctgggcgacacttgggattaaaaacgaagcttctaattcagctggcaggggagtactcttaaaggccttccagtctaagagcgaggaaaagaaccacgtggtcgaagcttcttctgtgttacaagcaaatccagccgcattgtctcgatcacgcaacttccaagagagctcgtaattgggtaattcggaggctttgtcatcaactggcgttgtgaacatctgttctgctcgcccggtgaatcaaaaaaccagctgtgcgatccttaagatcttatcgattcaccgtccgcatctctgaggatctatcctgaagccattcggagaaagaaaaaggaaggggattctttcccgtccctctttctcaatgtgaaagagacttctcagcataagttacaacctgatgatcctcccccccttcttttgttagtcgatagtataagcgggcgggcctcttttttatttgtcagcatagtgatttggtgagttcatgtacgtactagatgtgaaataatgagagctataaaataagtgagaattgtattgtactagttttattgtaatgtacatcaaagttttagtttaaaaaaaaaa

SEQ ID NO: 124 - DNA, 725 bp, Eucalyptus sp.
tctccctcgaagggcttccgaagttcgagatgtgtagaggcattggaagagagagtggccccagtgggctgttcaccaaagaagaggttccgtgtaagtcgccgcccggcaaggccgcggtggcgtgcgagctctgcgggtcgagggcgtgcctgtattgccaggccgacgacgcttacctgtgccggcagtgcgatcggtgggtacacgaggcgaacttcctggcccagaggcacatccggtgcctgctctgcacctcctgccagaggctcacccagagatacgtgctcgggccgtcgctggtggtggtgctccccagcatggtcgagagctgcgcggatggggaagactcgagcgacggtcaggacaagtcctcggagaacatcaggacgccgttcctgttcctctgagggcttctccttttcccttcgttcttgttttttttttctttgataacccctttttagtattctttcatcggggattttctggggagaagttaggaggaggagaatgatgaaatgttcttcttttttcccttttttttttccttttgaagtttgcttgaattggaggattagtgtgggttttgaaagcattatgtattcaaggtaaggaaagtgagaatgatgatcacgcaaagtaggaactaggaagcgaacatcaacatcggttgtagaaactctgtaatttgaagatgttgttgccactttttaaaaaaaaaa

SEQ ID NO: 125 - DNA, 1341 bp, Eucalyptus sp.
ctctgccgaaccggagaggggccgacaaatgaaaaggaggcggaggaggagatgacgatgccgatgccgatgccgatgacgatgccgatgccgatgatggaccggattagcccgtagagaggaatcggattgctttgccggaacaagagatttcgcgacgacgacgacgacgacgacgacgaatagggaaggaaaaagatgcggacgatctgcgacgtgtgcgagaatgctgccgcgatcttcttctgcgccgccgacgaggccgctctgtgccgcgcttgcgacgagaaggttcatctgtgcaacaagctggcgagtcggcatgtgcgcgtcgggctcgccgatcctagtgaggtccagcgttgcgatatatgtgagaatgcccccgccttcttttactgtgagatagatggtagttccctctgcctgcaatgcgacatgctcgtgcatgttggcggcaagagaacccatgggagatatctcttactgaggcagagagtcgagtttcctggggataaacctggtcgattagaatcgcaaacgcctaatcagaatgaggtgaagagggagaaagatcagccacataagcttgcaatgaaagaggtccagcagaatcacagggcatctccagtacctgtcggagatgctatttctagcggagaaggcaagatgcaggacaaaatgattgatctcaattctcggcctcaaaggactaaagggcagacttcaatgaacgaggatatggacgtaacaaatggctctaatcttgaatctgccggtgttgttcctgttggatcatttgatagacagcctgagatgaagcaaagcacatgaaaaacttttgtagcttgttggggcagcatctgcactgtaatcgcctgcttgtcctgctcaccatctctgctcttttagctgggagattcacttaactttctgaaggaataaggatgcttgtgttatggtgagagaagggatttcagacgattctgatgtgtcacagaatgttctaatgtgctacaacctagtcaacagaatcaactcttggtacatggtggcttttgtcagcttcatttttaatggacactctgtgatgatagaataacttttggcatccaagagcaagtagcaaacacatttagtcgactgattgtttagcatccacttttaggtactcatctggcaagagatttttctctgaaacttgtgttttgtctatcatgcttgtttcagttggcgtggggcctatgtctctttttcaagggataatatgagagttatcctagaaggaattgatgggatgttgaatattaaattgcagaaaacttttactaaaaaaaaaaa

SEQ ID NO: 126 - skipped

SEQ ID NO: 127 - DNA, 1049 bp, Eucalyptus sp.
gctcagcaccgacccgcgattggttcgtcgctccggtagcgacctctgagcttcttcctcggtttctgcttctgggtcctcctcggcggcgggaaatctttcggctttctggagtttttccgggggaaaaaagaagcaagaaccgacgatgaagatacagtgcgacgtgtgcgagagggcgccggcgacgatgatctgctgcgccgacgaggccgcgctctgcgccaagtgcgacgtcgaggtccacgccgcgaacaagctcgccagcaagcaccagaggctcctcctccactccctctccagcaagctccctgtttgcgacatctgccaagagaaggcagctttcatcttttgcgtggaagacagagctctcttctgcaaggattgtgatgaatcaattcatcccgccggaagcctgtctgcaaatcaccagaggttactggcaactggaatcagagtcgctcttagctctagctgcaccaaagaagctgagaagactgaacctgagccaccaagccggaataaacctcatacctcggtgaaatcgccccaacaggaagctcccagtttcacatcttcgtggggtgttgatgatgaactgctacagttgccagactttgaatcctccgacaagaaggaacaactcgagtttggtgagctagaatggctcgccgatatgggtctctttgctgatcaggttcctcaagaagccctagccgcagctgaagttcctcagctcccgttgccaccctcaagcaactgcacttcataccggaccgtgaaatcccagatgcctcacaagaagcctaggattgaatacgtagatgatgacgacgagtttttcaccgttcctgatcttggctgataagaaagagacaccggtggatcctctctgcactgacatatgtgtatgtatatctacatatatgcgtaggcatctgcttctatgtaatgaaggaaccttagattaagaatcgcctcgtgatgtgaggatataactgcatcctttcatttttaatttttttggtctttttgcaataaaaaaaaaa

SEQ ID NO: 128 - DNA, 1448 bp, Eucalyptus sp.
gcgttgaaaggccactcttttattgttcaacttcaagcccgcaaccctctctctccaaacccatttccattttctccctcctccttcgtcccactttcaacgcctctctctctctcgcagggtcaaattctgggaagcttgaaggaagagagggagaagaaaagatcaggaggaggaggaccagatgaagatcctgtgcgacgtgtgcaataaggacgaggcgtctgtgttctgcaccgctgacgaggcggcgctctgcgggggctgcgaccaccgcgtccaccacgccaacaagctcgcctccaagcaccaacggttttcccttctctgtccttcccctaaggaattccctctctgtgacgtctgccaggagaggcgagcgttcttgttctgtcaacaggaccgagccattctctgcagggagtgcgatctcccgatacacacggccaacgagcatacccagaagcacagcaggttcttgctcacgggggtgaagctctccgccacgtcggaagtctacacgtctgccgccagcagtgcctctctgtccaacggatgcgatttcgtccccgacttcaagtccgaggcatcgtcctcgttcaagaagccggtctctgtttccgcggcgatctcgggccctcgaaaggcggcggcgagcgcggcgagcgcggcgtcggcggcggctgcttccgcggcggcggcgaacaacaaggatgggaacaataacggcatgttggccagccaggaaagtggctccaacgggtcaacgagtagcatatcggagtacttgatagagatgctgccaggctggcactttgaggactttcttgattcctgctctgcttcctttggttttaaagatgatggtttattgccattcacggacaatgataacgtgagttccttctcatctgaaagtttgggaatttgggtccctcaagctccaacccctgtgccgtgtaatcagtcgccttacctaaatggtgggatcatcggaggattcaagcagacaaaagagcccgcgaccacgaggcccggcaagaggtggaacgatgatgtcttcgcagttccagaaatcagtccttcatcagcgggattcaagagatctagacccttatgactgtgaatttaggaagttggtgctatccatcttgtgaagaaggaggagaagaagaaagcctcaagctaatatttttccaacatggctttgagtttccctctacttttctaacctgtacctccatgtttgatctgttttgaagtttgatcttccccttggtttctccttgcgaatgacccttcccgggtccggtcaggtctcataattttgtcccaatgtttggctggctctgtactggagaaaatgcttgtaaatagttaccgaacttctaactcttgcttttctgccaactagtaggaaatctctctcgttcggtataaaaaaaaaa

SEQ ID NO: 129 - DNA, 1379 bp, Eucalyptus sp.
tagcactaaggggtgctggagatggagaagagtgagaattgcacggccgggaacacgaagaagaagaagaagaagaagaagaagaagacggcgggaagctcgagattcggtctgttcaggtccccgagcggcggtccgacgatgaaaccgactccctgcgagctctgcaaggaggccgcctccgtctactgcccctccgactccgccttcctctgccgcggctgcgacgcccgggtgcaccaggccaacttcctcgtcgcccgccacgtccgcaaccccctctgctccggctgcggctccctctccggccaccgcgtctccggcgccggcgtcgggccccgccgccccgctctctgcctctcctgctccgatcgcccctccgtggacgccggccctctctccggttcttcgtcgtcctcggcctgtgtctccagcaccgagtcttcggccgtggctccgaagaaggagggcagatgctcgagcgggggccggaagctccagaagaccggcgtgtcgagctccctgacggacgcgtccggcgagggttccgattccccggcgaggttcggcggcgcggccgcattctccggtgaggtcagctcagggaagaggagcggggggacggacgatcggagagctggagccgcgagattccgagagacgacgcgcgtggatgccaagacggagggcgttttcgcgatctggtgcaagaaattggggctgagcggcgccgaggcgttcgccgtcgcttctcgcgccctgcgcgtgatcgcggggacgccgacggccctgccgctgcgagtcgccatggcggcgtccttctgggtggcgatgaggtcgtgcaagggcagggggatgtccacgtggcagaacgtgaagagggtggaggaggcgtcgggggtgccggcgaagctgatcctggcgggcgaggcgaggctggtccgccgggctcggggcgagaaggcgcggcgggaagagcgtctggaagaaggctgggccgagtgcacggcctgagcgcggtgccgctcgcctcgcaatgccgtatgttccgctctcatctgtacgtccgaggaggttaggttctgcgtatagcttaggtggtggtagcagcagtagatccaatccccatttcccaaaccgacccaagttttgaggttgtcatagttattgtttcttctttctttgctcactgaccggaaaggaaaagaaaaggacaaggaattttacagtcgcccttttgatgacaggccgatgtctggtcgcgtggctcttattacagtatgttgtatatcgcttgatgttcgtgtacatttgtcgcggccacgagagtacttctagagcggccgcgggcccatcgatttttccacccgggtggggta

SEQ ID NO: 130 - DNA, 1728 bp, Eucalyptus sp.
gagaagaagaagaagaagagggagagagagagagagagagcgagaagagcttcgcattgcccgccgatctgagctgagttcagctgagtcgagtcgagtcgagactcggtgcgaacggtgaggaagattcggtaatggcgtcgaagctgtgcgactcgtgcaagtccgcgacggccgcgctgttctgccgcgccgattcggccttcctctgcccgagctgcgacgccaaggtgcacgcggccaacaagctcgcgtcccgccacgcccgcgtcgtcgtctgcgaggtctgcgagcagtcgccggcgcacgtcacctgcagggcggacgcggcctccctctgcatctcctgcgaccgcgacatccactccgccaaccctgtcgcccagaagcacgaccgcgtccccgtggtccccttctacgactccctcccccccaaccaccaccaccaccaccaccccgccgtcgcccctcccttcgcgaagcccccggccgccggcgacttcgtcctcaagtcggaggacgacgtcagcagggaggaggaggaggaggccgcctcctggctgctgcccaacccctcgaaggccgccgagagccccgacgtgaactcggcccaccagttcctgttcggcgacgacgacgtggatccgtacctggacgtcgactacggcccggttgaccccaagttcgagccgagcggggaccagaacagctccggcacggcggacggcgtcgtcccggtccgcagcgagggcgtcgttcacgggcccttcgtgggggagggcgggttcgacctggagttgaccgctggatccaagggttacgggtacagctatggcgctccctgcctgagccacagcgtatcgtcgtcctctctcgacgtcggagtcgtgccggacgggagcacggtcaccgacatatcaaacccgggcgggagagcggtcggggtgggtttcgagtccctgagccgggcgctgcagctgtcgtcggtggacagggaagcgagggtcctgaggtacagggagaagaggaagaaccgcaagttcgagaagaccatcaggtacgcctcgcggaaggcctacgccgaaacccggccccggatcaagggcaggttcgcgaagcgcgccgacatcgaggcggaggccgagcgcatgttcgggttcggggtcgtgccctccttctgatgtcatctgaagcgttggaaggtctctctctctctctctctctcaagagagaaattttgggctcttttccttgctggttttgtgctgctgcttttctcttgcagcgatatcagtctgttttgtatatacagtaggagactgttgtgtgctccctggatctttgaccgttgcctgatcttgaatgttttatggtgaattttcatggaatttgatgatgcaaattgaagggaaatttgctgaagcccggactttgtaatttaggaataaagtgatgattagggaatatgataatgtttaggcagatcaaaaatccgaatgatcattggtttttacgtgatgaaatcaatcattgtgactgtcttaacagtgcactctctattgcttgcttttctcgttgctttatcatcgggagttggaacagttggtagagatttataatcattttttctttgaaaggaaggaaacttttaaagacagtattatttgctttattcaagtgtaaaaggaaataatgagagttctcatagactattcctgaaaaaaaaaa

SEQ ID NO: 131 - DNA, 1720 bp, Eucalyptus sp.
ggcagggactccccggaaaaccagaagataagaacagaagcagacgacgaagaagaagacgacgacgaagaagaagaagaagaagaagcagctcgaagaagctctccccgagaaatgaaggagacgcagatcgaggcctgaagagatagagatagagacggcgacggcgacggcggcggcggcggcggcggcggaggcaatggcgaagggcggaggcgggaagcggccctgcgactactgcggcgggaccacggcgctgctctactgccgggccgacacggcgaggctctgcttcgcctgcgaccgggaggtccacgccaccaacccgctcttcgccaagcacaaccgctccctcctctgcgacgcctgcgactccgcctccgcctccttcttctgcgaggccgagcgcctcctcctctgccagaactgcgactgggaccgtcacgacggcggcggagggggagggggggcggcggcggtgcacaaccggaggccggtcgaggtgttcaccgggagcccttcggtgggcgagattttggggatcttgggggtggaggatttagggttcaagggcccgcctttgggtggtgatgagggtggggatgacggcggcggcggcggcggcggcggctgcggcggcggcggggatggtgggttctcggatgttttgctttgggacactcctgcttttgttactctcgatgatttgatcgttcccagggaggatgcgtgtgcacttcgggctgtggatgtccctcctctgcctaagaatagaaatgcaacctgtggtctgcacatgaaagaaatgctacgccagctccgcttacttgctaaaccagaatataacttcaactttgaagagggggagattgaaccgttggatgattttcacttgccagttttgactcaagctcttcagccagcaaatattcacactggatgtgaggatagagatcaagttggatttcacaaaattgaggcaactgactttcagtgcttttctaatgacggcaacaccagaaaccaagcttatgacgcttcttcattctctggtggctataaagaggaaagaccgacagctttagacaaatatccaaacggcagtattccgagttctaccaatgaatgtcatgaagtaccatccgaaaatcagatcaatccaaatcctttgcctctggttccattaactagccaggagagagagtctgcaatctcacgctacaaggagaagagaaaaacaaggaggtatgataagcacatcagatatgaatctcggaaagtcagggctgagagcaggattagaatcaagggacgttttgctaagacagacaggacctgatattataagcaactgaggtatggatactgagtgagtcgctgttgatcaaatcgggacaagatatggaagatacgcatcttcgggatcaatgagtgcatcccatggtaaatgtttatggtagtatatacttatgtacatggaaatagctgttagttttgggtttgattttcgtttgctagtatcagtgtcaatcatagggtagtcaagagcattcttgctctccccgtactgaaattcagagtcaaatgatgcatagcctctgtatagtcagtaaacaaagtgtctgtacatacgtggattctcttttatatgcccgtccagtagcccatgcttgctattgcaggtccacgtatccaattctgttgaccttcaaaaaaaaaa

SEQ ID NO: 132 - DNA, 1703 bp, Eucalyptus sp.
tccagccccacctttgaaaaatcagaccccaatatcaacgccaccccattgcacgatcctctcctccgactgttgccagaagaagaaaagcttcgaaaatcccatttcctctcgacctgtgtagcttgcaactcttggagtcttgatagagaaggagagagaaggagaaagagtgggtgatgggtttcgggggaagttggagcgtgcccgcgaaggcgtgcgactcgtgcaagaccgcggcggcggccgtgttctgccgcgccgacgcggcgttcctgtgcctcggctgcgacgcccgggtccacggggccgccaagctgtccgcgcgccacgagcgggtgtgggtgtgcgaggtctgcgagcaggcccccgccgccgtcacctgcaaggcggacgccgcggcgctctgcgtcacctgcgacgccgacatccactccgccaaccccctcgcccgccgccacgagcgggtgcccgtggagcccttcctcgacgccgccgagtccatctccagggccgcctccgccttcaacttcctcgccgtgcctaccaagaccggcagcgccgacacgtgcggcggcggcggtggcggcttcggcggctcgtgccagaatgaggagctggaggaagcggcttcgtggctgtacacgaacgccaccggcgcgagtgctaataagattgtggaagggatggacgtgaaagtagcgccgggcggtggtggagatgtgttcttcaacgacgtggagacgtttcttgatttcgagtgtggcaacaactcgatggatcggtttcatgggtcggccaccgatagcctcgtgccggtccaaaccaagcccgctccggccccggtggttcatccctcgtcggagaattgcttcgacatcgatttctgcagatccaagctcacatccttcagctacctcagccatagtgtgtcgtcgtcttcgcttgatgttggagtcgtaccagaagggaactccatgtccgatatctcgtaccctttcgtccaaagcatgagcgggaacagcaccgacctgagcatcacgaactcggcagccacaaccacaacggcgaatcaaccaactccgatgagcgggatggaccgcgaagctagggtactgaggtacagggagaagaggaagaaccggaagttcgagaagacgatccggtatgcctcgaggaaggcctatgccgagacccggccgagaatcaagggccgtttcgccaagcggacggagatcgaatcggaggtggacaacatctacgggactgcctccgcagcattcatggccgactcgcggtacggggtcgtcccgacattttgattgaaatcaacgccgggagctacagctagtggcttagcagatccttgttcaactaaacgtgcttatgtagctttgtattttgcttgaatgtgattttcaattttttgcacctaggtctaaggttacggtgtttgtcttcgtcataatatattgtgcaaaatactggaagttttttatgggcagatccggcttttttctccctgattcctgattctgagctgttgcatctgaacaagatttctttcagctcagaggaagaagaaagcccatttgcttttcactttcaggctcgtgtagatttcaactttttcctgttatctttggctttagtcgtatctaaaaagtaaaacccttttcttgtcaaagctttcaaaaaaaaaa

SEQ ID NO: 133 - DNA, 2580 bp, Eucalyptus sp.
ggcccacaccatatctctctctctctctccctctccctctccctctctctctctatctctactttctctctctaggatttgttcttcgtgctgagcgagattctgcggagctccgctgcgcttccgctcgagggtttcccgatcgccgccgccgtcgccgccgtcgtccgcctgagaccggccgtccgccggagctggctgcggatctcgtctcctttcgacgaggaaggaaactgtgtgactgaggattaagaggggccgtgtggaatcttggagattgaagaagcctttctcgctgtttaatcttgagatcaagtatcgtggttttgagttgaagaagtattgcaattatcttaattgagttctggtctcaactcggaattactgtttgaaaatgggttatatatgtgagttctgtggagagcagaggtctatggtgtattgccgatctgatgctgcatgcttgtgcttatcatgtgatcggaatgttcattctgccaacgctctttcgaggcgccattcaagaacgctgttatgtgagaggtgtaattcacaacctgcttgtgttagatgtgcggaagagagggtctcgctatgtcaaaattgtgattggatcggtcatggggcctctacctcggcatcaacacacaagaggcaaacattaaactgttattctggttgtccctcggcagcagagctttcttcaatatggtcttttgtgctagacttcccctctggaggtgaatccgcatgtgagaagggaatggggttgatgagcatagcagagggtaatgaaaacgcagcttgcattccgccaaaagacagcagtagccaagatgcatctgtttgtgctgatgatgaggctgggaatgcaaatgcatgggttgggtcatcttcattgccggaacttaaatcagcgtctctgaatatgggtcagctggctgcatctgcaagcacggcgactcctaaggcgtgccttcctattacaagaagtcctgggctttttgaagatgatagtttctacgaggatttcaacatggatgaagtggatttggatcttgaaaattatgatgagctttttggtgttgccctaactaactcagaattgctgtttgagaatggtgggattgacagcttatttggagcaaaggaaatgtctgctgctgattccaactgtcagggtccagtagttatacagcctgcatgcagtgttgcctcagctgagtctatgatgagctctaaaaccgagcctattatttgtttttcaacaagacaaccccattccaatctctcattctccggtcatattggagagaataacactggtgattatcaagattgtggggcttcctcaatgcttcttatgggagagcctccatggtgtacccctggccctgagaattcattcacatcagcaagcaggagcaatgctgtgatgcgttacaaggaaaagaagaagacacgcaagtttgacaagaaggtgagatatgcctctcgtaaagcaagagctgatgtgcgaaggcgagtgaagggccgctttgtcaaggctggtgatgcttatgactatgacccattgagccaaaccagaagctactgagttgacatatatatgcttagagggaaggaaccctcaccttctatttgcaaatagttggttcaatgggaagtggatggtgcaggtgcaatcttattgagtgcagatgcatgatggtgacactgaagccacagttatagccaagacagccgaagatgaaagggatggtgggatggcaatactgaaatgtgggatctgaccatagtcctcgtcgccataaagaattaactaatcgcgaaattcttcccaccaaattgtacgaatattagttgcttggcagtttctgttgctttgccatcctctgggcttcttcactgtggtatgagggggaaatcataattgatgccagctagacatagttaggcacgtcataaatgacaatatggggtaggctttcgtctacctcttttttttgaagctcttcctgcatttggctgctcctctctgtgattagtcaaatttacagtttcaactgaagctcagatctgttttcctctctctggtagaccccggtggttaagctcgagagtggttaacgactgcttttgtgcgctctgggtttcgaaccgatgtggaactcatagcgcggcaagctgttggtggtaggttggtgcagtctgagaatgttggaggcgcatgtgttctttaatgaaactcgctcgcccacacgcccattgtcgactcaggccgtggatgcaaagtagttgagttcacgtgtctgattctgttgccatcggacagcccttgtgtgccctgtggagacctcgcaggacgaagggaaagtgttgtgattgtctgttcttgagtcggattcttgtatctgctttttgtgtcttatatgatggacatcataggacatttatccattggattatcgttcttgcagctgattcgcagcaacttttttcgataacgaattgtgtatggaagacgcttttagtcagctgaatttactgtatctctgttgtgttcgcataaaaaaaaaa

SEQ ID NO: 134 - DNA, 1801 bp, Eucalyptus sp.
ggagataaagctccaaagtcagagatgaaattttcccggataaatgggaaatgaaagggaaggagaaaaagcggggctcctgatctcctctggaagcagacagaatcatgacaccaaaaaattgaagcttatgatccaaactaaaaggagcatggagaaagtctgtgaattctgcagggctttgaggcccgtcatctactgtcaagctgatgcagcacaactttgcctctcttgtgatgcaaaagtacattcagccaatgcactgtctagccgccatctccgatctctcctatgtgattcttgccagtaccgcccagcatacgttcactgtctggaccacaagctgtatatctgtcgtaattgcgaccggaggatccacgatgggtcttgtcagcatcggacgcaggcaatctacagttacatgggatccccttcagctaatgactttgcagaattatgggacttagacttgagccaattgggcaatcttgcttgcaccggtccatctgattcctcttcccatgaattcgtggatttgggcacaataactgtggatacttcaggttcagtctatccaggggaatgtaatgttggatcaagaaatcgagaaagagctaagacatcatgtgacggtcagcagaatcagtcatcttgcttcattatgcaacagattcttgacttgagaaagcttcaactaaatgagaagaaggacagcttgccattgatttgtgatcaagagcaaaatgatttttcttcatcattttctcatagtccaaggaagttcaatgagaatactgatcagagtttgcggagctgccacgatctttccagtgaaaggattaccttgctccaggatctgaaagcggagaactctccttcagcattttccacactagggaacttaccatcatcttcaacttctggcactcctagcccttggcaaagcgaatccatctggcaatgcagaagcccttttcagactagtcagttttggacccaaaatatgcaagatcttggggtttgcaacgagcttgcttgccatgacgattttgacattccagaagttgatgtgacgttccaaaactatgaagaactttttggaggagagcaagacacaatcagagctctacttgatgaaagcaagctggaatattcttctttggacaaggatgttcctcttgatgactcagagaatagccatgccgaacttttcgaggatatttcagtggctacatctgtttgctttggcgccaccaatgttatggatggcaatacagttcttaaaaaccaggttaatttcatacggcagggaaccttggatccctgcccctccattcgagaatcttattcgacattgtcaccctcaatttcaaggctcaattcagaaagcaccggtttagattctcttgaaagccgtctttcacccagcatcattggaggagaacaacaatgcgacgtgcgtgaggaggacattgtcaagagggatggtagacaaaccgacatgatgaacaacatagacagagagaaacctcgaaggcacgagaaaagaacgcagaatgcatcccaaagagggaaagcagatgcacggaagcgtgtaaagggaaggttaaagaccggggggtacgattcttgataccgctggcgtcacgagaagcgactgagagtggtcttccttcatcttcatgttctgtagctgtgctgtacataagtgtcgagctctaattactggggctatggatctcgtcctgctgtgctacttgtgtttttctgaatgtagattaattttcccgtaaaaaaaaaa

SEQ ID NO: 135 - DNA, 1453 bp, Eucalyptus sp.
ggtctgatcttcctcctcttcttcagagatctctctgcttgtgctaagatccaaaggctagcttgaaacgaatttcgtcgactctctttcctcactttccctttctcctttcgtgtttggtattcaatcaactgctagtttttgaagcccagctagctttggagggtgaatttgataagggaaactagagatgggtctgagtacaaaacaagtttccaatgatgggtttgattggaaccagtctttattgcaggatcatcaccaaaccctagagattcccaaatctcttccaatgaagaggcctctgcagcaacagaaccagcttaatcagccatcagaaccattgaagtgtcccaggtgtgactccacaaacaccaagttctgttactacaacaactacaacaagtcacagcccaggcacttctgcaaggcctgcaagaggcactggacgaaaggcgggaccctccgcaacgtcccggtgggtggcggtcgaaagaacaagcgcccgaaaccctctcacccctcctcggcagcagcgaattccagttctgccgcctcgcgcagaatcttgaccgccaacaccaccaccgcctctgatgccccagttcaagctcgtgaaaaaataattcgaggtcttcaaagtgaagtttgtgatcagaaggacttgaatgaaatgttctatcaggcattcctttttcaaccacctccacgcgagaacttatgcagcaacagtaacatctttttgggctcatcactctctacacctgaaagtgcaaatctgcacttccctttgcttcaaagctcgagccctttggtgagaaacacttgctcttcgacaccaatctcgtcctttggcttctcatcgactgtagatggtcagacaagagaatacaagccagttcttgaggagagctcaacaatcatcaccaccagtgtcatgcccacctcaacatgtactcagccatggaatttcggcaatattggcatggaggtgatgaacaacaccagtcataactgggtttgggatgatatggataagttggtctctaccaatctgagtttgcctgattgggacaatgttgagaccaaaccacaatgagggctgcttagttttttactatacataaccctggtttttctctttttgtttctcttcgggacgtaactctgatgatggatgtttttgaatccctaaaattaaagtgtgtgtctgtgacatgattcttataacttgtaacaaatttaggcagagaaatggactagactgtttgaagccgtctgttttggtacctgcatctccaggtctctctctctctctctctctctctctctctctctctctctccctctctctctctctctccattcatgtaagcaaagctgtgtatgcacgtgagtgcatgcatgtgctgcgcaagaaataataatatgtgatttgagttgaaaaaaaaaa

SEQ ID NO: 136 - DNA, 1520 bp, Eucalyptus sp.
ttcccactcacctctctctctctctctctctctcacttactcccattatataatcagaagcttctccgaggagtgaaacgatgatctgggggagttctcttctggagtgattcggtttcagtcctggtctttgcatgcgcgatcttgatccgtcggagggtcggtctgctgttgtgaattttcgataaagtggagtcatcaaacaccgaatggcattcacctccctgcaagtctgcatggattcatctgactggctacagggcactcttcacgatgactcgggaatggacacgtcctcgcctaactcaggcgacatgctcgcgtgctccaggcccttgatggagaggaggctccggccgcagcacgaccagcccttgaagtgccccaggtgcgaatccactcacaccaagttctgctactacaacaactacagcctttcgcagccccggtacttctgcaagacctgccgccgctactggaccaaaggcggcaccctccgcaacatccctgtcggaggcggctgccggaagaacaagaaagcctctaattccggcagtaatagcaacaacagtgccagcagcaagaaattggccaacaatgatcatcaaggatatggggtccctagccaccccgggcagtcgtcagcgtcctcgtctcgtggcgaccactcgaccgacctccacctctcgttctcgcctgaggtgcagctttcgcacctccacggcttgctcggcgtccatggggcccccttcgcgggcccgggcaacaatttctcggggctcgagaacccgaggcccatcgatttcttggagggcaaggtaatgagttacgacagcaacttcatgctgagcggcgatagccctcatcctcacatgggcgtggtcggagatctcggtggctcgactgggatggccccgggcttccatggcttctgcggtccatacgggatggccatcgacggtggtcatagcggaaatgctaacagtttcatggagaattgccagagattgaacatgctcgttccatacgatcagggccatgatcaggagcagatcaacgcgatggatgtgaagccgaacccgaagctcttgtcgctggagtggcaagaccaaggctgctccgacgcgagcaagaacgggtatggctatttcaacggcctaggaccgtcgtggaccgggatgatgaacgactacaacgcctccgcgagcaacccgttagtctgaaatcgagctgatgcacagtaataggattgctatttccagatcggttattccaaattgacctggcattgacgacaacagagtgtgaaaatgagaaagcctgagagggttcaacaatggcagcctttgagcatcgtcactattgattgtgatagctttttttttcttttttatcctatttttggtttttgagtttctttctttttttttttggtcgtcctcgtgtcgtctgatgtcgtctagtgtgaaagatctgaattcaaagccgtaggattttgtggcaaaaaaaaaaaaaaaaaa

SEQ ID NO: 137 - DNA, 1445 bp, Eucalyptus sp.
gctgatatttgtcgctcccctctctctctctctctctctcttccgcaggctgaagccgctcgctctcgctctcgctggcttttttctaaatcatcatcatctcgccgtcgccgccgtcgccgtcgtcatcattatcctccacgcactgcgagagaagatggcgtccgcacgcgcccaccaaatgtgatcccgttgcaaatctctctcgagcatcgccgcgacgatcccccgacgaatcccgggtcgctcgtcttcgaggaagaggaggtaggcggaggaaggaaggaaggaagggagggaggaaggaagcgaggaaggaggaggagaacatgcaagatatccactcgatcccaggggggcggatattcggagccgctgccgccgcctcgtccgccgtcggggaccggaggctgcggccgcacggtcaccacggccaccaccaccagcacggccaccacccgaaccaccaggcgctgaagtgcccgcgctgcgactcgctcaacaccaagttctgctactacaacaactacaacctctcccagccgcgccacttctgcaagagctgccggaggtactggaccaagggcggcgtcctccgcaacgtccccgtcggtggcggctgccggaagtccaagcgctcctccaagcccaagtcctcgcccgccgccgctgctgcgccggcggatcccccgccggctgctgcggccgcggcggcggaggatccgccgaaggagccgaagacgagctcccactccagcagcgagagttcgagcctcaccgcgacgaccaccgccgtcgcgaccgaagcggtctccgcgccgtcttcggcgtcgcaccagtcgagcttgctgaacatcagcgattacaagtcgatgatgtctcagggcatgaacgcgaaccccagcgacgccggctacgagcatccgggctccgcggagggcgggctcgggctgttctccgacatcgggagcttcacgagtctgatcacttcctcgagtgacggccctctatcctacgggttcagcgccgtgatggcgcagcagaatcaggaccaccaggctcagcagaaccagtggcaccaaatcgccgccggcgccggcgccggccccggcgacgagatgaagatgccggagctgggcggcggcggcgggttcctcgaccagaacgtgctcgtggacctgcccacctcgacgtcgcaggggaacagaccgggcggcggcggcggcggcggcggcggcggaggtttcggggcgttggactggcagccgggcgccgatcaggggctgttcgatctccccaacgccgtcgatcatgcttactggagtcaaagtcaatggagtacggacggagaccaagacccgacgggcctgtacctcccgtaaaatctctctctctctctctcactcactgcctttactcccgaaaaggcggacggaaaaaaaaaa

SEQ ID NO: 138 - DNA, 1970 bp, Eucalyptus sp.
tggcgcccacctccctccctgtccctctctctcatggagaaacagaggagctcacgagactttaaaggctgacgctttaacattcttccccttccatgtcaaccccaggaacccgaacacacacccgccaagcacgacagtgaaggagaaacagggccggaacgctcgggaggaggagtcgagtacagtgaagagagaggagagagaatggtggagatgaccagcgaccctgccatcaggctcttcggcaagaagatccccctgtcgtacaccggggagtcgccggaggcctcgtccggcgacggcgtggtttactcgggcgtgaattcggaggaggacgacgagggctccgagaagtgtcattccattgaacactttgccatggaagtgcaagaagatgatgaccaggtttcaccagaaacggtgaaccccaaaacaccctctattgaggaagaatctgctaaaacgaaagcttccggcatcgatcaagaacagggcgattcgtcgaactcgcaggagaagccccccctgaagaagccggacaagatcataccttgcccgcgatgcaacagcatggacaccaagttctgctactacaacaactacaacgtcaatcagccccggcacttctgcaaggcctgccaaagatactggacggccggcggtaccatgcggaacgttcccgtgggagctgggcgccgcaagagcaagagctcagcttcgcattatcgccagatcactctctctgaggctcttcaggcagctcgaattgatgctccgaacgggactcacctcccaaatgggaagatcaatggtactgttctcaccttcggcttagatccatctgctggtgattccatggctgttgccttgaatctctccaataaggaaggatcagctatgaacagaatgcagaatgggttttgtgacttcggaaggaatggggtttcggtccctcaaagaagtggagagaagaatgacgattgctctagccgatcttctgtcgcgatctcgaacttgacagatgaaggaaatgggaattccaatctggagggatccagtgccaatggattccatcctcagtttccatgctatccgggtgttccacagccttatccatggaatcctgcgatgcttccaccacccttttatccttcaggatttgctgtgccgatttaccctgcgccgctttggaactgtggcctccacagcagctggaatttccctctgctgtcgcctccgagccaaaagggatcgaattcaggaccagattcgccgactcttgggaagcatgcaagagaaggcgagatggttgaaaaggttgattctgtggaagacgagcccaggaaacggaagaacggatgtgttttggtcccgaagactttacgcatcgatgatccaagcgaggcagcgaaaagtactatatgggctactctggggatcaagaaggactggctagggaaggacgggttgtttcagggcttccaatcgaagggcgaggagaaaaatcacgtatcagaaaccgcatctgttttgtgcgctaaccctgcagccttatcgagatctatcaaattccacgagagctcttgcgtttagctcatgataactacaggtagaaataactacagaaaactcttgaaactgggctgtcatctttctttggtgattgcagtgacttgcattgtttagaacagagaaaggcaagacatttgatggccgagacaagcagaggatagcaatagaccgtgacttgctggagtttgcagccagttagttttaacccgatggggttgtttccttttcttgtgtgctaattaggttgaatgcacgcgcttgtacataactcttgtaaattattcggatgagatggagagaacttttttctgaattttgtaccagttcttcatgtctcttgagagatgtttgttaagtgcatcctgaatcaaaacagtgatgttttaaaaaaaaaa

SEQ ID NO: 139 - DNA, 1282 bp, Eucalyptus sp.
gaaaaaactccccacagcttttcgccgagaccatcttcttccgataataatagcccctcccgaagaggagagcgagcagcctcctttctctctcttccctcctttctctctctacagtaccaagcgactctcgccttctctctctctctctctctctctctctgtgtctagagcgaacgcgtttcgaccctttaaagcgttatggagtctctgggtttcatggatgacctccttgacttccccgacttgggcgaggtcgtcgacgaggaagacgacctcggcaagagcagctgctccaaggccaaggccgccgccgccgccgccgccgccgctacctcgctgcccgactccgcgagcttcgacgcttcctcgaccccttccctccctgaatgggaggaagagttggaatggatatctaacaaggactcgttcccgtctttggaatcattcgtcattttgcccgagcaaccggggaacaactttaaggaagacaacctaattcccccgcttgaaaatagcagcagcagcagcacaacaaccagcacacacagcagtggcaacaggagtggtaccgtgactattgcgagttgttgcggcgggccccccctgccattccgccgtgcccgaagcaagcgggcccgtgagcgccggcacggggacttaagtgtttttgctgccgagagattgttaatctcgcgggaccaagagaaggcaaataagaagacgaagttgggtggtcaaggcagtgtcaagattgggaggaagtgcttgcattgtgggtcggagaagacaccgcagtggcgtgcagggccgcagggggccaagactctctgtaacgcttgcggggtgaggttcaagtcaggccggctcgtgcctgagtataggccggcgaatagcccgactttctcaagtgagttgcactcgaactcgcaccggaagataatagagatgaggaggacgaagcaaatggggggtgggggggtgaaaggtgtggatataagagtaaagtagtggagagtaatgttagtagtctagtcttcttttatataattcatcatttaggtctcttttcccttttataggcatagtcttagtgtttaggagtgagggctttggtttaaatttaatgggagatttcaaagttctttatcatgctgaaagaaataccatttgggaattttgacattggcaatgttggcttgtcatgctttagaacaagaaaggagaaaaaggaggaggaagaagttagagctcattttctttgttgcttatttcgaattct

SEQ ID NO: 140 - DNA, 1560 bp, Eucalyptus sp.
gctctgattccatcagtttcaccacctgcatccggcagctgcgcaacacccctctggtttctctcgtcaggaaccgtgtttatctcttgcaaaaacaagccatctcactcgtcccatttcctgtcactgagcggaatggctgatcagtttgctaccctcgttggctgatcagttcagttaacgctggacatgaaggtgattctggcaatgcgggtgtgaagaaaggctgtgaagaaacatggacgggtctcgtgggggcgatgatgggatggatgtgggggatccgacccacgatcggcatcccatgcaaccccattaccggcatcaccatgggttgcaggcgcaaccgcatttgagcaatgggaatgatatgaatgacgatcacgacggcggcggcggcggcggcggcggcggggagggcgttgaaggggatgtcccctctgacgccgggaacgattcggacaatcgcggaggaggcgatgatgcggaccagctcactctttctttccagggccaagtttatgtttttgactccgtgccgccccaaaaggtacaagcagtgctgctgttacttggcgcgagagaagtgacgcctaatccacctgcaatcccagtagccaccaaccaaaaccaggatcttatgggtactcctcaaaggtcgaatgtcccacagaggctggcttcactgattcgatttcgtgaaaagaaaaaggaacgaaattttgacaagaaaattcggtatgcagtccgtaaagaggtggcacttaggatgcaaagaaataagggtcagttttcatcttcaaaacccaacaatgatgaatcttcttcagctgtgacgacatgggaatcaaaccagagttggggacctgagagtaatggatccccgcatcaagagatcctatgtcatcactgcgggattagtgagaaatctactcctatgatgcgacgtggccctgaaggaccaaggaccctttgcaatgcatgcggactgatgtgggcaaacaagggaactttaagggatctttcgaaggcagcccacccaggtgtacaagtttcttccttaaacaggaatgagatgcagagcgcaaatctgggggctgattaagtggtccttagaatcactgaaaatgctagtgattcatcataactacagtccttggcccaaccagcaaaaagatattgatgttagacaattcgagggagcacactcggaggtttataagagacttcctttcggatggtgacatactcaatttactgcttaggatgtcctttctggctttccagatggatgcaggtcttggaaaatttccctatacgctggccaagcaactgctgggttttgggatggttttcctgttgttaggtttcagaggaactgcaattttccctcgttttgtaaatcttgacctaaactgtgtataaataagcgagatggttcttcgcagtcttatctagagtttcattactcgaaagtgcccttttgtgttaaatggctgaacaataatgttaatcgcttcccgatcctacgcgtttacttataattcttgaaaaaaaaaa

SEQ ID NO: 141 - DNA, 1363 bp, Eucalyptus sp.
gcacccctccacactctcattttcacagtttttcagaataagccccctcttcaaaaaaatcatcatcattcgcaaaccctcaaatccgtcctcctcccccttcccccccacaaattccgccattcccttccccctcttctctccttccgtcctcttcccccccacaaaagagaaaaaaaatcgaagctttcgtcctccgccccgccgcggtcgttagggttccgcccgccccgccccgcaattcgggcctcccccgccgtgtgatgcgccggactccgccctgcgcagccggaatcgatcccacccaatgtacgcccaccctcaccacgtgaacctccccaagccgatcgccggcgacgaggacggctccgggaactccggcggcgactccatggaaggctcccacatccggtacgagccccaggccctggacgacggcgccaccgccggggccagcatgggcggcatgatcgaggacatcccgcccgacgccgtctacgtccccggctccggggcggacatggggatggccggcggggaggaggccagccagctcacgctgtcgttccggggccaggtctacgtgttcgatgccgtcacgcccaaaaaggttcatgctgtgctattactgttgggaggatgtgaattatcatctgggacgcagagtatggacttggccttgcagaatcaacggggcgttgtggactttcctcctcggtgtagtctaccacaaagggcagcttccttgaataggtttcgtcagaagaggaaagagaggtgctttgacaagaaagttcgatacagtgtgcgtcaagaagttgcactcaggatgcagcgaaacaagggtcagttcacatcatccaagaagtccgaaggggagtctggttggggctcagcacaggattctggacaagatgaggcaccacaagaaacatgttgtacgcattgtggtacaagctcgaaatgtactccaatgatgcggcgtggaccatcaggtccaaggtctctttgcaatgcttgtggtctattttgggcaaacagggggaccttgagggatctttccaagaggacccaggatcatcctcttacctcagctgaacagtgtgaaggcgaggtaaacaactcagattctggaactggcattcatccaaacaacagtctcgttagtttctcaaaagctgactccggagctttgatagctgaacgctgaaccaagtttggtttacaagttatagtggacactacttgcttcaggggttggtcaagtgggacgtgtccagtaattttttctgcttgtgctattaaatgtacagttatcgaactgcttgcagaatacaaatcattttactgttgaaaaaaaaaa

SEQ ID NO: 142 - DNA, 1722 bp, Eucalyptus sp.
gtcctcctcctcttctccccaccccccctcaaaatttcccttacctcttgatatatataattagcaccattacttgctctgcttctacttccactcacttcccatctctctctctctctctctgctctttacaagaaaaggcactgaaactctagtgtcaacctcagctgtttcactcatccactctactcctcaccagcgcacgactgtcgtttcaagctccaggtgaaaaagaaaaagggaaggcggaaaaagagaatttcaggaggcgagagaaaaaaagaatgccgggccagaacataatggaggagatagattgcgggagcttcttcgaccaaatcgacgacctgctcgacttccccagcgacgacgtcgaggccgggctgccccccatcgaccacgactccttcccctccttctggtccgaccagccgcagtccctgccgggctccggctccggcgtcggctcggtcttcgaagctcaccccggctcggacctctccgctcacctctccgtcccgtatgaagacattgtccagatggaatggctgtccaatttgatggatgattccttctccagcgaccccctcaccatcaacgaccaagatccgtcgaaggcccagccggtgagccacgctcagttccagacctctagtcccatatccgtcctcgacagcagcagctcctgcacggacgagaaggcggcgccccgcagccccgaggccatcaacctcgcccggtgtggccgcgcccgcagcaagcgacctcgccccaggaccttcaacccgcgcccgccggtgcagctcatctcgcccacgtcctcagtcggggagaacccgcaaccagtcgattcggagagccatgtggaatcccgtcccgtgatcaagatcccgagacaggtcaatcccgagcagaagaagaagaagaagatcaagttcactatgtcgacagccgccgcggccgcggcctcggccgacaccagccagagctcggcgactgcgcaagcagtcaggaaatgcatgcactgcgagataaccaagaccccacagtggagggctgggcccatggggcccaagacactgtgcaacgcgtgcggcgtgcggtacaagtcgggccggctcttccctgagtaccgccccgcggcgagccccacgttcatcccgtcattgcactcgaactctcataagaaggtcctcgagatgaggagcaatgtgggcgatccggaggcgatggccagtcctccggagctgattccgaatcgcgccgttgaaatggagtacatgtgaggaaggacgtccagaaggacagcgttcctcgtcgaaaaatacgtctcttccttgcgggaaatttcctcaagtctcatttacattaattgggttagcgtcatttcatttctttgttcattggttattgtacaggaagagaaagctggcggggatttagcgcaattaggcgatccatgttatgtagtttgggttggacaaagatggaagctttaaagggtgttttagagtcgtcgatgattttaggagtattgggtaggtcttagctagcgtcatttaggagtttctagtgctgtttttggtttttctacctttgcatattccttttttcagtctttgttccttttcaagggaaattctttttgcagtctctacttgtagtcgaaaattctgagttgagcaatgaaatcttgcagtattacctcttataaaaaaaaaa

SEQ ID NO: 143 - DNA, 1645 bp, Eucalyptus sp.
ggctcaatggaacagtcttcgctcctgagctgctccgacgtccgttcccggctcgggctccgccgtcgccgccgccgttgtcggtagggtttttccctctcctgctctcttccccccccccccccccccgggccggtcttccgtctttcgcttccggcgggatggcgagcgcggacccggagcatctgcaggcgcgcgggccgacgagggccgaggacgacgacgacgacgacgagctcgaaaacggcggcggcggcggcggaaccgatgactttgccgacaaagtggaggaggccggtcggggttatgtggattccgtgggggactacgagcaccggcgtcgtcgcggtagtagcgctggtgttggtgcgggaggaggtggggtggcgccttcgaggacgagcgagctcacgctctctttcgaaggggaagtgtacgtgttccctgatgtttcgcatgaaaaggtgcaggcagtgcttttgcttctaggaggacgtgatataccaactgctgtgcctacatttgaagttccttatgctcaaagtactatggatgtggttgacatgtcaaagcggtctaatctttccagaagaatagcctctctggttaggtttcgggagaagcgcaaggagagatgttttgacaagaagattaggtatactgtgcgaaaagaggttgcccagaggatgcatcggaaaaatgggcagtttgcttcaataaaagaaggttcaggtgctggtagtttggatttagctcaaagttgtcaccaggatggtactccccctcctgaaactgttgcccgaagatgtcaacactgtggtgttagtgaaaatgcaactcctgctatgcgtcgtggaccagctggaccaaggactttatgtaatgcctgtggtttaatgtgggcgaataagggaacattgagggatctcagcaagggaggaagaaatctttctctagaccaaactgaattgggaaccccagatgtcaagcctttgattatcgatggtcaacatttctctagcaataaggatgatctttccatgcagggaatttctggagagacttctacgtctgacattaaaagattatctgatccttcaatcaaccccggtggtgaagtagacaatcaaatggactttcatggaactgctgctgatctgacaagcacgttgcccatgaatatcatgcattcttcagctgatgatgatgagcagggaactctggttgagctcgctaatccatcagatacagacatcgatattcctgctaactttgattagaagcttaaagttaccttgtctttgtaaaagaatggtgaatcctagaagctgtgcttgtgaccaccatgccatcaaatcttgtgagctgagggtgatactcttgttaactctagccatgattcattttaaacctattgtatgtatgaaaactaagatagcgtgagtgcatcctaccagcctattctctgtaatttgcctttcagggctgttgttaaggcatgtgttagtatttgtgattaacatagcttgactttgacatgtgctgcatgggtagtagctctcttgagggatcccccaatgtaaatctaaagaagaagcagcacttcggtaatcaatatcaaggttcattcatcttaaaaaaaaaa

SEQ ID NO: 144 - DNA, 2364 bp, Eucalyptus sp.
gattagatacctctttaatggtgttctctctcttccattggattgtacagattcacagctaaattacccatctcaatctctctccagttctcgttcttgattttctcctctttttattttctcttggctaatcttctgattttgattggactaaaagacataaaaactcttctgggctcgtgagttctgctcccttccgcagaagttttcttctgggtttttttttttctcttcttacagcgacgcttgctgtgcccagttgcgtctctgccaccaaaggcttgaacaaaatcacttgtatatatgttttttgcacaaatttggaactttttggaccttttctgaataaattttgccttcccacctttgtttcctctctctcgatttgggttgaaccgtttttttttttggcacttgtgggaaaaaaaaaaaaagaacatgggcaagcaagggccttgctaccattgtggagttaccagcacccctctttggcgcaatggccctcctgagaagccagtgctgtgtaatgcatgcgggtctcgatggaggacaaagggtacactggctaactatacccctttgcatgcacgggcagaacctggcgattatgaggatcatagatttggcagagggaaaaacatatccataaacataaacaagaacaaggaagtaaaagttcccaagagaaagcagtacacagacgatatggtttttggagggatcatgtctgattataatcaaggcttccaaaagtttatagatgatgatacaagtaataggtccagctctggctcagctatatccaactctgatgcacagtttggcagtgcagatgctagtgatttgacaggtccagctcaatcggttgtgtgggattcgatggtgccttcccggaagaggacgtgtgtgaatcgtccgaaaccttctccagttgagaaacttacaagagacttgcacactatattacatgaacaacaatcttcatgcttatctggttcctcagaagaggatttacttttggagagtgaaatgccaatgggttctgttgagataggccatggaactgttctcatcagacatccaagtggaatagctcgagatgaggaatctgaagcaagctctctctcagttgatcgcaagcattataagagaagcgaggcctattctcgtcctgcatctatccctctatataacaatgcaagaatggtgagttctccaagtgcgaaacctggaatggagaggagtaaaaactctagtggacaaggaatgagagtcgaacatcttagaagggacatatctcagcatgagaaactgcagggtctaggaaatcataattcgccactatgtcacataaatttgaaagaattgctaaactttgaggagttcacaagactcttgaatgatgatgagcgacggcaacttctaaagtacctgcctcctgttgataacagccaacttcctgacagccttgagtacttgtttgatagtcctatcttcgaggagaacttatcttccttccagaagcttctctctgaaggagtctttgatcgctcctttttgggggtgaaagccgaagattataagactctgagaaggcttgcactttctagttcgatgaaatgcaaatgggtggagtgcctccagcagctccaggatagtaaaaatacctctggagagtccactgctggcagatatcatgccaatctcgctagaaacttaataaacggcaagagagtacgtgacatccaaagtcaaaacttcccagaagcaaagatgatgatgaaaagtccaaaagggggggcttggaagggtagctgtgaaaacaaggacctcttggacaatgatggctcttgcttcagtccaagaagcctctttgccttgcctcctgataatagcactctaatgctggattctttcccagtcatagatgaaagtaatgatcaggatcttctggtcgatgtgccatctaatggctcctttgctcaagcagagctccttcacccagcactgagttttggctcccaacaggcaagtactggtagtagttcaggatacccgaatgctcttcatccctgataatcattttgtcgggtgttaggctttagtctctagggtttatttgggcgtgccattgtgcgaaatccacgacaggtcacttgcatggctaactaaggaaagtttgtgaatggggtttatggatgctcttcttagcttcagcttttgaacttggaatcttcttgacatgagtataggtgggttgtctttttcttcttctttttcaatttgtataggatgacgcacaggatgtaatatagctctcgatgcagaagagatggtcactcacagggttctgttgcgaaaaaa

SEQ ID NO: 145 - DNA, 1082 bp, Eucalyptus sp.
aagaccaaaaaccaagtccccgtgcaaacttccgtatctgcaaatcgcagtgcaggtacaacgttatgacctggtgttcacaaaccctagattttccttttgacgcttctcccatccccttctgcttcagtcactcgctctcttctctcttctttaatatcgttacatagcccctcaacccctagttctctctctctctctctctccttagatatataccttttcctctggttgggttgaaggagtcgtgaatcatatggaagacaaggcgagcatggaagtccccccgtccgagcatctgtgctatgtccggtgcaacttctgcaacaccgttcttgctgtggggattccatgcaagaggatgctggacacagtgacggtgaaatgtgggcattgcagcaatctctcgttcctgagcaccaggactccccttcaaggccagtgtcttgatcatcccttgagccttcaggggttttccagtgattttaggagaggccagtcatcatcctcctcgtcctcaacttcgggcgatcagccattatcacccaaagctgccccctttgttgtgaaacctccggagaagaagcacaggcttccatctgcttacaaccggttcatgaaagaggagatacagcgcatcaaagcggcgaatcctgagataccacacagagaagcattcagtgcagcagccaaaaactgggcgaggtacattccacattcgccttcgggatcggctcctggcagcagtagccatgaatgaagagaattgcagtcacaaacggcatgatagaggacatgcagagagcacaagggcatatcggatgttccgtcctgctgatgctgtgtatccacataagcagagccgttttactttcctttctccttctgtgtcctttttatttcgctaaataacaagctactagattgagcgatttagagctatctaatgttgtcatgttaattaagattgatgaccatgtgaggtgtataagtgttttctatgtatgtgtaactttatgttttatcaatccagatactatcttagattattaggtagttcaacttaaaaaaaaaaaaaaaaa

SEQ ID NO: 146 - DNA, 990 bp, Eucalyptus sp.
caatctcctccatgtgcagcagttcattcctttgaaggagaagaagaaggagaaggagaactcctcgtctctgatcttcccccacggcgacggcggcggcaacgacgacggcgacaaccacggcgacggcccaccacccatcggaaatgtcagtcgaaatggcctccgagcgcgtttgttacgtgcactgcaacttctgcaacaccatcttggcggtgagtgttccgagcagcagtttatacacaatggtaacggtgaggtgtgggcattgtggcaacctgctctctgtcaacatggctggtgctgttcagtctgcccctcttccagatacttcccagaaacagcagcctagctcggaaaacatggcaaggggaagtggctcctcttcttcctccagacccaacaacaacaccagcaacaagttctcttcctttgaacccatagaggcggaggcgcctcgtatgactcccattcgccccccagagaaaaggcaacgagttccttctgcatataacaggttcattaaggaagaaatccaaaggattaaagccagtaatcctgacataagccacagggaagcctttagtacagctgccaaaaatttggcacattttcctcacattcactttgggctaaagttggatgggaacaagcaagggaaggcggaccaagcaattgccggtgatcatcaaggaactcacaagtcccatggattctattaaagaatagtaaagatgaactctaattcgtgtctacgagagagcttgctttaatttcttgatttgtcatttcaagaagtcaatgagggcttgataaaagcaagaacacatcccctcaattaaaaccctcaatgatatcatcatcctgtataatttgtttttatgtggccctctcatctttttcaaggtcttgctcatgaatatgtgtatcgattcttgtaatttatttcgaaagagaaactcagtatttatgtaaaaaaaaaaaaaaaaa

SEQ ID NO: 147 - DNA, 1068 bp, Eucalyptus sp.
gcttctctctctctctctctcttcccccacctcttttcttcttcatcctacagaaactgaacaatcaaaagtgagagagagtgttcagatccaaagcagttaagctgtctctcatatatcaatcccacctctctatcacacttcacttcacgcactgatcggtcaatcctatcaaccatcaaatcaaagcggaacaacatgtcctcctcatctgccttttcaccggaccccctctcccccaacgagcagctctgttatgtccattgcaacttttgcgacaccgtccttgcggtgagcgttccgtgtagcagcttgttcaagacggtcacagtccgatgtggtcactgcacaaatctcttgtcggtcaacatgcgaagcctccttcttcctccggctcctgcaaatcagcttcaccttggccattcttactttacccctcaaaaccttctggaggaaatccggaacgtaccatcgaacatgctgatgaatcagacgatccccaacgagccgatgatgcagctacgaggagggatagaagatatcccgaagcccccaccggttgtgaacagacctcctgagaagagacagagagtcccttctgcatacaaccgcttcatcaaggacgagatccaacgcatcaaagctgggaatcctgatatcagccacagagaggccttcagtgctgctgcaaaaaattgggcccatttcccgcacatccatttcggacttatgcctgatcatcagcccgtgaagaaagctaacttgcgccaacaggaaggagaggacgttctcatgaaagatgggttcttcacgcctacaaatgtgggtgtctccccctattgataattggctaagtactttgaaaagaaaaaacagcgcccttgtgtgtgtgtgtgtgtgtgtgtgtgtgtgtctttctctttctaagttcatccgttcacttattttcttccttctacttccctcgtatgaaagtgtcactactagttagtctcttattgttctaagcttcgtttctaagagagacttctctaagctctatggctcttgctcagtttccatgcccct

SEQ ID NO: 148 - DNA, 747 bp, Eucalyptus sp.
ccgactcagcaaagccaaagaaagaaaccagaaacagcagaccagaccattccattccattccatttcgcattctctactacagactcgcagagatggtgaagagagacagagaggacgcggaggtcgaagccctggccgtggccaactgcttgatgctcctcccccgagtcggcgagagcgccgtctcgaaccgcgaatcgcggtctacagagcggatgttcgcgtgcaagacgtgcaaccgcgagttctcctcattccaggcgctcggagggcatagaaccagccacaagaagcagaagctgatccccggcggcctcttccacctcggctgcaccgcggattcctcgccagccaagccgaagaggcacgagtgctcgatatgcggcctcgagttcccgatgggccaagcccttggcggtcacatgaggaggcacagggccgccatggcggagggcttggcggcagaggcggcgaagcctgtgccggtgttgaagagatcgaatagcaagagagtcatgtgcttggatttgaactcgtcgctgatggaggacgacttgaccttgcgtttaggaaaggttgcgccgcctttggtgctagatctccttctgtaggcccgagagaacgtagattgagtacagagcagttcttagtcggtgccttactgttcttctttttttgctattttggattcattgattgatatattgaattagacactgcattttgccagcgagtaaaaaaaaaa

SEQ ID NO: 149 - DNA, 669 bp, Eucalyptus sp.
cagcaagcaaaagaggaaaccagaaaaaagcagacacctcggtttcacgttctctactacagaattccggagatggtgaagagagacagagaggacacggaggtcgaagccctggccctggccaactgcttgatgctcctctcccgagtcggcaagagcgccgactcgccatggctgaaccacaaatcccggcctacagagcggatgttcgcgtgcaagacgtgcaaccgcgagttctcatccttccaggcgctcggagggcacagagccagccacaagaagccgaagctgtccggcgatctcttccacctagggcgcaccgcggattcctcaccggccaagccgaagacgcacgagtgctcgatatgcggcctcgagttcccgctcggccaagcccttggcggtcacatgaggaggcacagggccgccatggcggagagcttggcgacggccgaaaagcctgtgccggtgttaaagaaatcaaacagtaagagagtcatgtgtttggatttgaactcgtcaccgacggaggacgacttgaccttgcgtttaggaaaggccgcgccacctttggtgctagatctcgttttgtaggccttagagaacgtagatcgtgtacaaagcagtttttagtggatgccggactgttcctttttcgttttttgggta

SEQ ID NO: 150 - DNA, 1350 bp, Eucalyptus sp.
caaatctgcaactctctgctctctgctccaaccccctcctcttccactcttcttcacaatccctgtctcgcgaatttatggcactacccgcacgacagtccgtcccttcctttgatcactagcaaatgtacgaccgaggattagcaacccaaaagctgtcgaattccatctgatttggtgcctctcatggtgtgaaaagcagaactgttctctcgtattcttggcatcagtacaactggctcaacatgctgttactcttactcaactaaaacttcagcaccacattgtcgttggccttaaagttacagctcagtaatgaaaccaaccattgatctggaagtggaggccgtctcggaaaatgactctgagattagtagccaagtcgcctccaatctatccaatcaagagccctccatgggtccctccaatgacagcctcgctaactcttcctacctcatcagcccttcggctgtcggatcaggttccgaaactgtgttcctagacttgagccttggttgcagcaatgacgagtccagcgggagggattctgtaggagtcgccttctcgagcaccagcgaatgtagcaatgagcccgaatctcatccggcagctgcaggaccaaccacttcaagagtcttttcttgcaattactgtcaaaggaagtttttcagctcacaggcactcggtggccatcagaacgcgcacaagagagagaggaccctggcaaagcgggcaatgaggatgggcatgttttcttcacagagatactccagcttggcgtctttgcctttgcacgggtctcccactgtcagggatctggggatcaaagcgcattcttccgtgcaccaggtgcaccaaggcatgttgcaacagacaagaccacatgatctgagcagtggtccaagattcggagacggctttctaggtgttccgatcttcatagaagatgatgatgttgagctgttgtggcctggcagcttccgtcaggcggcacaagcacacgctcctcaaccgagttttgttctaactggaggttctaacataagcttcgtcggggtgaatcccccatctgatgcaggcaattcagctcctgacttgacactgaaactttaaaagaggttaatcttcagttaagtctcatgtttgcttaacccaacattgcacttctgctttcttttggtatattcccaaatgttctttccagttcctttcctgtaagtgctcactccagtatgaagtctataaatttttagttgttctagggttgatattgtaactctcctgcttgttgtactgctgatcatgctctgattgcttgttatgcttgttgctttctgcttaaaaaaaaaa

SEQ ID NO: 151 - DNA, 1033 bp, Eucalyptus sp.
ctcgcagaatccacgcgcagagcgacccaagagtgtttcagaacagtccgtccatggccttggaagctatcaactctcccaccgcggcctcagcgccgttccagttcatggaggagcccttgagctcccgcttcttggagcccctgaacaagcgcaagcgctccaagcgcccccaccaccctccctccgaagatgagtacctcgccctctgcctcatcatgctcgcccgcagcggcgccgcccccaagcccaaccaccacgcctcgcccgctcctcttcctcctcctcctcctcctgcgcccactaagcctgaagaagccgcggcgaccgccacggcaaccgcggccccggcgaataacttgagctacaagtgcgccgtctgcggcaagggcttcccctcctaccaggccctcggcggccacaaggccagccaccgcaagtcggccgccgccgccgccgccgccgccgcagccgcctcctccgcgggggccgacgagccctccacctccgccaccaactccggcggcggggcggccgccgcgagctcgagcgggggcgggaggtcgcacgagtgctccatatgccacaagtccttccccaccggccaggccctgggcgggcacaagcgttgccactacgatggcggcgccagcggctccgccaacagcggggtcaccacgtccgagggcgtggggtccgcggccccgcccgcgctcggatacgacagcggccgccgcaacttcgacctgaacgtgcccgcgctgccggagttcccgaccgggttcatcgtgtcgggcgacgacgaggtggagagcccccacccctcgaagaagccgcgcttctcgacgcccctgaagatcaagctctctccagaacagtgaaatctttgcctgtgcttttaggattagcgcttgttaattgatttagctagggcttttgtggatcttttgatctggaaatttgggtgtacatatacagctcgatccccgggtggatctctcagtttgccttgttttttcattcaaaaaaaaaa

SEQ ID NO: 152 - DNA, 2317 bp, Eucalyptus sp.
ctctctttctctctttctctctttctgtctttctctttctctctctagaacaagatttttcctctttaatcaggtttcagaaacccacactctaatatgctgaagctgcaaccaccgtttcaggttttccctagataagatttcagacaagctcaattttcctgctgggttaagtgttcttgaggataaggatagagagtgcaagttgaagaagaacaagaacaagaacaagaacaagaagaagtgatggcggcctcttcgtcgtcggtgccgccgttttatcgaattcaagaaggaggagatcaattgattcagatggagcaacaccgccacgcccagatggagcaacaccgccatgccccatcagctccattggcttcatcagcagcagcatctgcacctccagccccagctccagctccccagaaaaagaagcgaaaccaacccggaaacccatatccggacgcggaggtgatagccctgtcgcccaagagcctgatggcgacaaaccggttcgtgtgcgaggtgtgcaagaaagggttccagagggagcagaaccttcagctgcaccggaggggccacaacctgccttggaagctcaagcagaagggcaccaacaaggaggcggtacggcgcaaagtctacctgtgccccgagcccacctgcgtgcaccatgacccgtcccgcgccctcggcgacctcacagggataaaaaagcactactcccgcaagcacggcgagaagaagtggaagtgcgagaaatgctcgaagcggtacgcagtgcagtcggactggaaggcgcactccaagacctgtggcacgagggagtacaggtgtgattgtggcactcttttttccaggcgtgacagcttcatcactcaccgtgccttttgcgacgcgcttgctcaagagaatgctagacaccctcccaccttgaacagcatcggcaaccactccatctatgggagcaccaacatgggcttgggcttgtcacaggcgaatcgccaaataccctcgatgatgcaaggccaggggataaaccactccaacaataatgacatctcgccacttggccgtgctcggagtggacaattattcgatcacctgcttgcgccatccatcggaactgcttcttcgacgtttaatcaaccgcttccctcaatgggatcaccatcccctaatagtttcttgttccaagctcagtcaaatcaaagctacaattctcaggagcaagcatcacctcagcaagggttgctccagaacaagccattccatgggctgatgatgcagcaaatgatccctgatcatgtcaagagcaacaacaacgacccatcaccatcctcatcagtggcaaatatcttcaaccttggaatgctttcgagtagcagctcgaatagcaacaacaacagtagcagcaccagtagcttgctcaattccgggcttttggtcccagatcaacatcggttcaagagcgagattggaagcgaaggatcgaacctcttgccgagaagcatacccggtgatcatcatcagatcagctcatcaggagtgccttctctctacagcacttcacttctgcaaaccggtaaccaccatgatttctcaccgcctcacatgtctgcaactgctctcctccaaaaggcggctcagatgggctcatcaacctcaagaacgaacaccaacaacaatgcctctttcctaaaaaccttcgcgagctactcttcctcaagcggcaccaaatccgaccggtcgccgctcgccccagttagcttcacaggcattttcggggtcgacaacaacctccaggagctggtgaactgcgccttcggaggtgggcaagaccatcatcaagaatcagctggggacgcttacgatgggatgtacgacaacgcgaacaagactgggtcggagcagtcgacgacgacccacatgggccaacatgggttgacgagggacttccttggggtcggagagatagtgagacgcgtgagtaataacgttaacaacaacggcaacaatggagggtttatggacgtgcagagagaggacgaccagcgacgacagaaccaagaaaagtatggcctgatgatcagcgacgacaaggcgatcagctcctccttggattcagcgccgacaagccaaaccttcggagatttccgttgaaaaatacgacgaggagctctctgtgtgaagaaaagaccgagtacaggaacgcaaagactcaggccaattgctgaacaggaacgacacagcatcgggcagatcgaactcaaagaagttgaaacttttatctcttttattgtcccccttttcttct

SEQ ID NO: 153 - DNA, 664 bp, Eucalyptus sp.
aaagaagaaagaagaaaccagaaaaatcagacacttccgtttcacattctctactacagaattccagagatggtgaagagagacagagaggacacggaggtcgaagccctggccgtggccaacagcttgatgctcctctcccgagttggccagagcaccgactcgaactgcaaatcgtggcctacagagcggatgttcgcgtgcaagacgtgcaaccgcgagttctcctccttccaggcgctgggagggcacagagccagccacaagaagccgaagctgatctccggcgacctcttgcgccttggccacgaagcggattcctcgccagccaagccgaagacgcatgagtgctcgatatgtggcctcgatttcccgatcggccaagccctaggtggtcacatgaggaggcacagggccgccatgctggagagcttggcggcggcagccacaaagcccgtgccggtgttgaagaaatcgaacagcaagagagtcacgggcttggatttgaactcgtcgcccatggaggacgacttgaccttgcgtttaggaaaggttgcgccgcctttggtgctagatctcgttttgtagggcttagagaacgtagattgtgtacagaacagtttttagtcggtgcttgaccgttccttcttttttccttcttttt

SEQ ID NO: 154 - DNA, 725 bp, Eucalyptus sp.
aaccagaaaaatcagacactccgatttcacatcctctactacagacttcaagagatggtgaagagagacagagaggacgcgggggtcgaagccctggccagggccaattgcttgatgctcctctcccaagtcggcgagagcaccaactcgtcgtcgccgaatcacaaatcgcggcctacagagcgaatgttcaagtgcaagacgtgcaaccgcgagttctcgtcctcccaggcgctcggagggcacagagccagccacaagaagccaaagcttatctccggcgacctcttacacctcggccacgcagcgtattcctcgccggccaagccgaagaagcacgagtgctcgatatgcggcctcgagttcccgattggccaagcccttggcggtcacgtgaggaggcacagggccgccatgctggagagcttggcggcggtggccacaaagcccgtgccggtgttgaagaaatcgaacagcaagagggtcatgggcttagatttgaactcgtcgccaatggaggacgacttgaccttgcgtttagggaaggttgcgccacctttggtgctagatctcgttttgtagggcttagagaacgtagattgtgtacagagcagtttttagtcggtgcccaacagttcctttttctttttctttttttccttcttttttgtattcattgattgatattttgaatcagagactgggttgtgcatggaaaaaaaaaa

SEQ ID NO: 155 - DNA, 775 bp, Eucalyptus sp.
cccgactcagcaagcaaaagaagaaaccagaaaaatcagacactccgatttcacattctctactacagacttccagagatggtgaagagagacagagaggacacggaggtcgaagccctggccagggtcaattgcttgatgctcctctcccgagttggcgagagcaccgactcggcgtcgccggaccgcaaatcgcggcctaccgagcgaatgttcgcgtgcaagacttgcaaccgcgaattctcctcgttccaggcgctcggagggcacaaagcaagccacaagaagccgaagctgatctccggcgacctcttccacctcggccacgcagcagattcctcgccggccaagccgaagacgcacgagtgttcgatatgcggccttgatttcccgatgggccaagccctcggcggtcacatgaggaggcacagggcggccatgctggaaagcttggcagcagcagccgcaaagcctgtgccagtgttgaagaaatcaaacagcaagagagtcacgggcttggatttgaactcgttgccgatggaggacgacttgaccttgcgtttagggaaggttgcgccgccattggtgctagatctcgttttgtagggcttagagagcgtagattgtgtacaaagcagtttttagtcggtgcccaactgttccttttttttccctattttggattcattgattgatattttgaatcagagactgtatttcgcaacgatattcatttgtttcatgaacgcatatcgtatttgaacgaaaaaaaaaa

SEQ ID NO: 156 - DNA, 729 bp, Eucalyptus sp.
taaaaaccagcagtctctcagccactgaacatggcgcttgaagctctcaactcgcccaccgccgccgcccccttcggccacgacgacgcggacggccacccgtgggccaaacggaagcgctccaagcgcccccgcgcggaccctcaggaccagccctccgaggaggagtacctggccctctgcctcatcatgtcgcccgccgccgccgccgcacccggcagcagcggcaggctccacgagtgctccatctgccacaaggccttccccaccggccaggccttgggcggccacaagcggtgccactacgacggcggcagcagtagcagcgccgcccgtgctgcctcttcctcagaagccggcggtcctagccacacgactgtcagccaccgcgagccgatcgacttgaacttgccggccttgccggaattctgggccggcgccgacgagagcagcaacagggaccgtaaaatccaactctccggcgagcaagaggtggagagccctcatccggcgaaaaggccgaggctgttcatggatcaagaggatgtgggatcttcccaaagatgatttcagacatttacgtgaattacaaagcttacccttctttttcattttcattttcatctttcttttcgaaggatttattcgttcattaggcttttgtatttagctagggttgatccgattgttctgtacagcaaaagaaactgatgattgtcaaaaaaaaaa

SEQ ID NO: 157 - DNA, 863 bp, Eucalyptus sp.
gttttctccatatattctactcttcttcacacagcgaagggtctttctaagagtcagccatagtcattttgccaaagccctctaattttctttcaaaacttcctgcagcacctccccaccagatccctagggatgatcttcgaaaaagaagaccaaattttgaccatcgatgaaaggcaggatggattgaatcccagtgacaattaccaggaggaaaatgaaggagacaatcaagaagagtggctcaatttgagcttgggaacaaattcagcttcaacagctggagactctgaatcgcaatcgaggccagcttcaaccaaagttttttcttgtaacttctgtatgaggaaattttacagctcacaagccttaggaggtcaccagaatgcccataagagagagaggggggcagcgagaagataccagtcccagagaatgatcacgatgtttggttcacatacaaatgctcctatcatccgctcacttggtgttaggccccattctctagtgcacaaaccaagtagagatgggacagcaatggtagctagattcagtgaccataatatagggcatgcaccaggatggccatccttcatgtttgaggatgcattagacttgatgtggccaggcagcttccgcttggatgcacaacaatcgaatcctccatcagagccagttaagcttgacttaaacctccggctctgatcaacttgttcatccttgagcttcatctgaattcccgtgttcaaacaaattcccagtttttttctttctatcatgtaagactgcagatgcaggccaacaacatcaagattcaggcagcgcttctgtccaataaagtccaaagaccacgaaaaaaaaaa

SEQ ID NO: 158 - DNA, 907 bp, Eucalyptus sp.
atcacttcaacaccatgaccttacaaaaacaaagcaattgttagaaccatggttgctcaactgaagaacttcgatgctgcgctacaagaattggaggagaagaagaagaacgaagtcgaccctagctcgagcatcggttcgtggatgtggaaccctagtgccgcccaggaggatgatgactcgtgggaggtgagagccttcgccgaagacactagcaacattatgggcgcaacctggccgccgaggtcctacacttgctctttctgtagaagggagttccggtccgcccaagccctcggcggccacatgaatgtccaccgcagagaccgtgctaagcttcaccaatcacaattccggccgctggcgaaccaaaattctcctttcgcttcttgctcttccccgtcctcctcgactctgctattcccgaatcaagaattcgggtacccaggtgggggattatgttttctttaccagctgcctcatcctactggcatcttcgacccggtaaaggcgaatgccgcgtgcctcgaatctacccccgccgttctatctatctcgccttatccgccttctccttcggttaattttccgatgcagtcgcaaggtaataattcttctcaccactactcgtcaagcgaagcccatagttcggcagtcgtgggcagttacaattgccgtaatactagtagcaagtgcgaggatccagaaaacgaagaagagctggatctcgagctgcggctcgggcacaaatgaatgctcatctcgaaataatttttgattttttttttttttgggagtttgtccatcttcaatttgagcaaagagggtactagagaagttgtaagcgataagagtcctagtaactctcagagacttatgtgagtttttttccccttcaaaaaaaaaa

SEQ ID NO: 159 - DNA, 861 bp, Eucalyptus sp.
gcctgcttttccttacctaagatcgccagtagatcatcgctccatttcgctccttctcctccatcgtcttccggttggtgtttcgggaagccatggatcttgagtacccagaagagttcttgggcggtgcccacgaccaccattcgcagatctccaagggcaagcgcacgaagcgccagcggccggcctccccgagcggcggcggctgcgtcggcgccgacgccggcgtggccaccgggagggccggcttctacgtctacgagtgcaagacttgcagccgcgtgttcccgtcgtttcaagcgctaggagggcaccgtgccagccacaagaagcccaagtccacggccgatcctgaccagaaaatcaagccgtcgacggtggtcctgggcttggacgcaattgacgacgaagacgaggggcactccggtaaaatcagcccgcccctctccgcccacgtggccagccacaaggggctccatcaagcgagcaagcccaagatccacgagtgcaacatatgtgggtccgagttcgcgtcgggtcaggccttgggcggccacatgaggcggcacaggtccgccccgccgccgacggccaccagcgccgacgcgacgagccccaccaacccgccggctgctgcggccatcaccaccgagaagtcccgcaacatcctctccttggacctgaacctgccggccccgacggaggaggatcaccaccaccaagcgcaccgccgccgggagaactcgaagttccaattcgccacaagtcaacagcccatcatactagcctcgcccgccttggtggattgccactactgaaaaaaaaagaaaagacgggttcacatgtcaatcaatgtaactt

SEQ ID NO: 160 - DNA, 1004 bp, Eucalyptus sp.
ctgaaactattactcccactggttctctctctctctctctctctctctctctctctctctctctcaaacatggctgaattagattattgccaaaccaaaagcagacccggcgctgccgccacgcgcttaaagctcttcggcttcaacgtctccgatgaggaagactcagccgtcagcgaccccattactgttggcgcgaacggcggcggcggcggcggaggcggcaaggccacgccgtcgggctcgccggaaggcagcgtcccggtggggggcggcggcgagcggaagtacgagtgccagtactgctgcagggaattcgccaactcgcaggccctggggggccaccagaacgcgcacaagaaggagaggcagcagctcaagcgcgcccagctgcacgccagccggaacgccgccgtgtcgtcgctcgtccggaaccccatcatctcggccttcgctacgccgccgcacctgctggccaccgtggggccggtggtggtgacggggggggcgcccacctccccgtcctgggtttacgttccgcgtggcgccccgcccttccaagtgtcgcacggctgcgtgttcacgaccggccagggagggggcgggaggtcgccggggggtctggtgccgtacggcggaggcgcgggcgattccacggggtcgcaagtccaaaatcaggtcaatgggagagcggtcctcgacgggctttcgttgagcaagttttcgaaaggaagcggtggcggagggcctggttttgacgacgctttggggcttgacctgcatctgagactagctccggccgcaccgtgaccggaggactcgggtccactcagctagcttcgcggggataaattaggcttgaatcgtgttgggataatctagaagtgcagattcgagttcaggttccggttcggttcggaaataggcagacgggatcctttgtacatctctctttaaggaaattaattcgattaattaattttttctactcttcaaaaaaaaaa

SEQ ID NO: 161 - DNA, 1679 bp, Eucalyptus sp.
cttttctctctcttctctctctctctacccaccattgtttagctgttgaggaactgaagagcccaaaattcaaccaatggttgtgcaagtgtcatctgctttttctctgactcccctgactttccccatctctgcataattattgctcttgtacatttctctctctctctctcatgcccacactgagtgactctgatgatggttggaattccatttattctccatccacttccatacccactgtggaataaactaaaacccacaagcatgtcttgttctttctgaattggtgacactctccctcttttaaggtgccttctctctctcccccactgctctttcaccctgaagcatcggctccaactcaaaggaaaactaggaatgtcatgatttgtcgctgcaggtgacacctagctaatcttacaattttcagctgcgcgataattaccatagacacagaccacaattcagctgtctcatccagacatgctgccacgaaactctgattcaggaacagaaaacgagtcctcggacttcagcacccaggtagcttccgacgcatgtgtgcaggaaatctctgtcgacccatccaaagttacctccgccacttccttggatcaggacgatgtgtcactcgacttgacccttttctgccacagtaatgctcctgccgaggcgaatgctgttggagagagtaataacaccgaagccgttgaccgagcttccgtggttaaactcccacgggtgttctcttgcaattactgcaagcgcaagttttacagctcgcaggcacttggtggccaccagaatgctcacaagagggagaggacgatggcgaagcgggccatgcggatgggaatgttctccaacagatataccagcttggcatctctgccgcttcatggcgcaacctttcggtcccttggcattgaagctcactcaggggtgcaccaccagaatgtagtggctccagaaagtcggcctgcagttttgagaggcggagcgaagtttgagaagggctgtatgggattgccgatgtttgttgaagaagatgatgtggtgccgctgttttggccgggaagtttccggcaattggacacaagggattgcactagtgatcccagcccctctgtggattacgtaatcaaaggttcaaatgtgaactttgtgcaggtgacgaaattgccacagattgagactccctcacccgaccttacattgaaactttaggaacaaatccaatgcggtgttaattcttagttcttctacacccattgctatgccgtgccatatgtttgtatttgtacagtgagatctgatgaaaaatggctgcgaggtatgaagttttgatatctcgccttctctcttgccgtcttttgctctgacgtgctatgacaatgttaccagttgctataatttaatttgcagcactcttatttgctgtcctaactgtaatagaagaggagatgatcgtttcttaagccttcgagtaatctttgacaggtaatttctgtggccatgcgtcagtgctgcgagattcaccaagaattcgctagtctgcctgctagagatgtttcttgcttcgagaattgatttgtgattttgtccttaaataaacgtttaagccttttctaatgctattcaaaacggtgctctgcttcattgagttaaaaaaaaaa

SEQ ID NO: 162 - DNA, 1237 bp, Eucalyptus sp.
gaattcgcggccgtttcggggaagaacacctcagaatcaacaccactccccaatttctctctctaagatcccacacccaaccgccaccctcaatctctctctttctctctcttcttcagtgtctgccatggctttggaggccctcagctcccccaccgctccctccgccccgttccaattcatgaaggactcctcccccgccgccgccgccgccgccgcctcctcctcctcctccgcctacgacctccccctcgccgagccctgggccaagcgcaagcgctccaagcgcccccacaacccgccctccgaggacgagtacctcgccctctgcctcatcatgctcgcccgcggcggcgccggccggaccctccccccgccgcctccccccgcggtctcttccgaggcggccaaggtggcctacaggtgccccgtctgcgacaagggcttcccctcctaccaggccctgggcggccacaaggccagccaccgcaagcacgcctcctccgcctcggccgccgccgggggtgacgaccagccgaccacctcgagcacctccgcggcgacgacctcctccggcgtctccgggaaggtccacgagtgctcgatctgccacaagagcttccccaccggccaggcgctcggcgggcacaagcggtgccactacgaggcccccgcccccatccccgcctccttctccgccccctccgccgccgccgccccggccgccagcggggtgagcgtgtcggagggcgtggggtccacgcacacgcagagccaggggcaccgcgagttcgatctgaacatcccggcgctcccggagttctcccccaggttcgtcgtctccggcggggtcgacgacgaggtggagagcccgcacccctccaagaagccccggttcctggcgccggcggtgaagacggaagcggcctgaactgggtcggatcgaaaacgcacagaagccaaaccaaaactcggcgagacttggaaacgggaattcgatcgagtttcagataggaatagagaaatatactagaaacgattggttttttcttctttctcttcttgttttgctgggtgatgctggagttcttctcggggggaaggaggtgtacatacagcttcaaccgtgggtatagttagctttgcttagttcgtttgaacttcgaagccagtttgattcattgattggttgaaattcaattcatttcgatttccatttacttcaaaaaaaaaaaaa

SEQ ID NO: 163 - DNA, 1558 bp, Eucalyptus sp.
gcctccctcccccagtctctctctctctctctctctctgagtgaattcctctccgagtgaaagatgggtttcagggactacctcgcaactggcaaggaagagccgtgtcatcaacctccaactttcattgagtggctcaaaccatcaatctcaacctcttctccatcttcttcctcttcctcttgcctgaccgaacccgttcatcttgcgaaaccgtcgactttcgtggactcgcccaactcattccaccagcaacagcagcaagaacagcgcttcctccgtgagaccatccagtgcttgcctctcctgagcaagctttccgagacaaagccgctgaagcaagaggaaggcgatgaagaagaggtcacggttgtcggagagggaagagagagacagcatggggtcggagagctgagagcagcgaacgttgctgtggggttgcacattggattgccactcggtggcgtggactgcggctatggcgacaatcttgagaagagcaagcatggctttgatgagctcctgatcaaggaagcggttcacaagaggaacctgctccatgggtactccggcttcaatgcggagagcaggttttggatcccgacaccagctcagatcctcgtggggcccatgcagttcgcttgtgccatttgcagcaagaccttcaataggtacaacaacatgcagatgcatatgtggggacacggatcggaatatcgaaagggcccagactcgctgaagggcacacaaccagcagcgatgcttaggctgccatgctactgctgtgcgcaaggctgtaagaacaacatcaaccacccaagagccaagccgctcaaagatttcaggaccctccaaacccactacaagcggaagcacggcgccaagcctttcatgtgccgcaagtgcgggaagaccttcgcggtcaaaggcgactggcggacccatgagaagaactgcgggaaattgtggtactgcacctgcggttctgacttcaagcacaagagatcgctcaaagaccacatcaggtcatttgggagaggccactctccacacccttctctcgagggttttgaggacgagaaggagtgtgtcactactggatccgaggacgaacttgctcgctcgtgattaactataagtggtgttcctttttttttcttttgtcctttcgtccgctgggttcttatggcttgcttgaagagggttaagtaattgaaactagatggacttatctgatgagctcgtgctcggtaacaaaaaattctcgacgacttgcttggaaggcaagttagggttagggattggtttgttacggagcacttgccaagcgataagctagtaaaaatgttagagagagttggagtagtatgattgccactaataagctgattgccttggtggtgaagcagatgaattttcttcactagattagcagctcaaagagagggagaggcttttgttgtacctcaacaaggagaaaatttgtcagcttcatcgccaactggtaatcttactttgtatgagaattgtggtgttgttccaccgattaaaaaaaaaa

SEQ ID NO: 164 - DNA, 1956 bp, Eucalyptus sp.
gagaagaagaagaagaagaagaagaagaagaagaggaggaggaggagctcaagagagagagcaacgaaaagaaaaggagatcattttgaaaagcctgaaagctgtttaaagctcaaaagagaaagctgtttcgataaccgaaagagagtattagctttttcccccttcctctcgcatcatgcgtctagcttagcttagcatccttccaaactctctctctctctctctctctctctctctctctctcggaaacacactttcgcgctcccattaagcatccccaaaagaaagacacacaaagccaaagatcatcctcacaccatagtttctctctcgaaagcagcgagcgagcgagcgagagagagtttggctttggttctcgagccttgtaccgtacgcacatccataaaatctcactaaagagatcgaggaaagaagctctctcaagccccatgataggaaacaacgccatcatttctaatcccccatcagtccctcctccatcggatccattccccgattgcttagagaataatggcaacaccaccaacaagagaaaaagaagacctgcgggtactccagatccagatgcagaggtggtttcgctgtcgccgaaaaccctactggagtcggaccggtatgtgtgtgagatctgcaaccagggcttccagagggaccagaacctgcagatgcaccggcggcggcacaaggtgccatggaagctcctcaagcgggagacgccggcggtgcggaagcgggtcttcgtttgcccggagccaagctgcctccaccacgacccaggccatgccctcggcgacctcgtcggcatcaagaagcacttccgccggaagcacagcaaccacaagcagtgggtgtgtgaaaggtgctcgaagggttatgcagttcaatcggattacaaggcacatctcaagacttgtggaactagagggcactcgtgtgactgtggcagggttttctcaagggtcgagagcttcattgagcatcaggactcttgcaacatgggtcgtttaggatcagactcgcaccataataacctgcagcctccatgcctgtctaggacagcctcaagcccgagcccttcaagtgataccaatctcaacacaccttcttggccaacaacaagggctttagcattgcccaagccagccaaagatgcaaccatcttctcgaaccctattgtcaacaaaccatcccccaagaaagatcatcatgatgacttgcacaacctcgagctacagctctcgacttcgtcgaaccccactgaaacaatttccaccaatcttccaaagagagatgagaaatacccaccccatctgcagctctcgataagctccttatgcaccgattgtgcgtgtgaaagaaacagtgactgcagtcgcgatcaatcgaccaatcagttgaggatggccatggccgagaaggcgtacgcggatgaggcaaggcaggtggcgaagcggcagatcgagcaggctgagagggagttggccaacgcgaagcggatgaggcagcaggcacaggccgagctacagaaagcgcatgcactgaaggaacatgcgaggaagaagatgagctctgcgattctgcagatcacatgccaagtctgcaagcaaaagctccaagcaagggagttgctgaggctagctccaggtcacgagagctctttggcattgagttacatgtcatctgcaatcacggagggagaagtggataatgatatcaatagagtatgctagtggaaaaaagaaaagaaggttggtttatataggtcttttatgatttctggttgagtatataagttcttttagtttgatttcattaggaggtgtttgaggaggtataagttatgatttgattttttgcatggagtgttttggtactattaatttgttaattagtttccaataaaagttgtagtattgggtttcaaaaaaaaaa

SEQ ID NO: 165 - DNA, 1986 bp, Eucalyptus sp.
agagagagggaaagaaccaaactccatggttgctagcttttacacacttctcttataataagagtgatgactcagatgtgaaatctgcagcaagagcctgattgaactggtagagtaggaacctaacgggttcattgatttcagggaccagaaattggtctgtctccctcactccgctcttttcaagttctcttagattagcatttttgtagattttgaggttcgtttttcccttctacaaaagaccacccagttacgaatatcagtgcagaagatgtctggaaatgggctcttttcagtcagagatcctgttcaagaacccaaggctaatccaatcaataaaaggagaaacttgccaggaacaccagatccagatgctgaagtggttgctctatccccaaagtctctgatggccacccaccgcttcgtgtgcgacatatgcaagaaaggttttcaaagggaccagaacctgcagcttcacaggagaggacacaaccttccatggaagctgaagcgaaggaccaaagacagagagcagccaagaaagagagtttacatatgcccggagacaacctgcgtccaccatgacccatcaagagctcttggggacctcacgggggtgaagaagcactacagcagaaagcacggtgagaagaagtggaagtgcgagaggtgcaccaagaaatatgcggtcaagtcagattggaaggctcacagcaagatttgtgggactagagagtataaatgcgattgtggcaccgtcttctccaggaaagacagcttcatcacccacagagccttctgtgatgctctagctgaagagagcacaaaattcaatccctcaaacttcaggaatgagccaacactggctcctcctccatcagctgcgacaatccctgataatttcagaatactcggcccggaatttgctattccccatcttaacagctgtggattttccggttcatcttccagtgcattcttagcttcagttttcggcagcgaccgaccagaatttgttcctaccgtaccgatgagtattttcgggtcgccgagcgcatccttccttgggtccggcgcatccgtcttggagttgcctcagtgtgtgaaggaggaagaagagagcaagagttcgatatctgatgcagtgagttctttgtatggttcaagcgatcagaatcatccgcatcaacaaagccaaggtctcatgtcagccactgcactcttgcagaaagcagccatgttgggagctaccatggccaatccaccactcctcaatgacatgggtctcggactaatgaactcatcgtcatcttattttcccaacactacaaatttctgctccctttctcagaacttgaatgagtcactactgagttcattgtcctctacagtcacttgctctcctggaggagatcatgtgctggtgtttggcgattcggactcgagctcaccgacagccgacactgagaacacgctgagtaacatggtgatgcaagccaatgggaatgtgagccgaccgagagtcgttcaagggaagctgaatcatgcattggttgaaggcaatttgacaagggattttcttggtgttggaggcaaaccaagaacacacgtcaaccagcaggggctagcagattttgcttcactgggttcgttgtccgcggatttgagcccagtacagttcacttagctatgctaatataaattatatcttgttctagaaatctttcatgtactaatagaattgatgaaagaagctatttcatgcttaaacatatcatgggaaggtagaatggtgaaagcttaaagcttcaaccaagcctgtctttagctagtccgcgcaagtggcagcccgagtatattgaaacgactcgtcactgagcattaggtttaacaatcgagaggacgaaggcgagaatgggagatgcttcgatttctctatgtaatcaaagctcgagcaagtttatatttgagtcaaaaaaaaaa

SEQ ID NO: 166 - DNA, 1819 bp, Eucalyptus sp.
tttcagtaaagctgagttgaacccactattcaacatagctccaccacgaccacaagagctctgtgcaggtgtgtgtgtgtgtgtgggcataagattttctctctcacaccagcaccaatccagatacacacaacataaatattagcccgagaccctcccatatgttccataactctcctcctcccaactctcctccttccaacgctgcttgttctgccgtcaaccccccagagatcaatgccttctccaacagcaaaaggcggagaaggcccgcaggcactccaggtaataggagaagacaagcaacggcagaaaaagatggacccggattcacccaccaaagctctctctttttctctcacgacacaattgcaaatcagattaaaaatacccgctcgagcaatgatctggacctaatcaagtacttcccccttttcttttttccaacagatccggatgcagaagtggtttcgctgtcgccgaagaccctcctcgagtccgacaggtacgtgtgcgagatctgcaatcaagggttccagagggatcagaacctgcagatgcaccggaggcggcacaaggtgccgtggaagctgctgaagcgggaccgcggggcggccgatcaggagcaggcgcggaggaagcgggtgtacgtgtgccccgagccgagctgcctccaccatgatccgtgccacgcgctcggggacctcgtggggatcaagaagcacttccgccggaagcacagcagccacaagcagtgggtctgcgagcggtgctccaagggctatgccgtgcagtccgactacaaggcccacctcaaaacctgcggcacgcgaggacattcctgcgactgcggccgcgtcttctccagggtagagagtttcatagaacaccaagactcgtgcaccgtccgccgggctcagccaccagagatgcaggcggctcagccagcctgctcgtcccaaactgcttcgagcactagcccttcaagcgaagccaatttcggcgttccgctctcatcttttccggggttccgaatgccaaaaccagcggagatcctcttcctcaactcagacatgtacaatccctcaaccccttctacccaccacaaccttgagcttcagctactgccgtcgtcgagcctgtgtgggacgcggaacttgagggaaaatttcgcggacaacctgaagctttcgatcggcacattgtccaccgatgtgaacaaggacgaattagccttcaccaagagatcttctacaatgtgggaccattattacgggcgcgaacccgagatgtcggaggccgcgagcatgagggagtttgcgagcgagcaaataaagctggctgtagccgagaaggcgttcgccgaggaggcgaggcagcaggcgaagagacaggtcgagatagcggagctcgagctggccaacgccaagaagatgagactgcaagctcaggccgagctcgaacgagctcaactgctgagagaacaagccaccaagaagatcagctccaccatcatgcagatcacttgcccggcctgcaaacgacagttccagacaacgtctgtcggtgcggcagcatgcgacgagacctctctcgccataagctacgtgtcttcagctaccacggaaggagagggagagtaattattgtgttgaataggttgaacaataattttatatttttttttctttgagctctaaattagaatggtttttattaagttctactctggttgagaagtccctccttatttgtgccttctctttcctcttccccaactaattcattgttcgtcctcaattaatttgctcaaaaaaaa

SEQ ID NO: 167 - DNA, 2031 bp, Eucalyptus sp.
gtcttcttcctcctcccagaatcgcagccgccgccttcggggaccagtgttctccggtcaagacccggccagccattatcctcaatctggaactccgcatttcgttttcttttgaataagctcgagctgaatgcgagtgctggaagaactcttggagaagagagagagagagagagagagaaagagagagagagggaggcggttctctttcagatgatcctttcgccggagagtgcttcatcttgttcttcagcctttcgatggtgttgtaagagctttaggaccgagtcgagcctctaagacccatctacccatcttcggttcagttcgatatagtcgaagaacgcaggaactgggattttggccgagctcgttggagtagccattgatggtggagatgccaaatccgtcttcgcaagaggtttcttccagcgacctatcggcaccgccggcaaagaagaagcgtagtcttccggggatgccagatcctgaggcggaggtgatagctctgtcgccgaagacgctgctggcgacgaaccggttcgtgtgcgagatctgcaacaaggggttccagcgggaccagaacctgcagctccaccggcggggccacaacctgccttggaggcttcgccagcgggacagcaatgcggagccgccgcggaagaaggtctacgtgtgccccgagccgggctgtgtccaccacagccccgccagggccctcggcgacctcaccgggatcaagaagcacttctgtcggaagcacggcgagaagaagtggaagtgcgagcggtgctccaagaagtacgccgtccagtccgactggaaggcccacatgaggacctgcggcacccgcgagtacaagtgcgactgcgggatgctgttctctcggagggatagtttcgtgacgcacagagccttctgcgacgcattggcggaggagagctcgagagctcagaataacaactcggtgcaagacgagcagaatgccaggaggtctgggtcggccgccgccgccgcctccgcctcgtcgcctccgcctccgccgcttaccccgtcgaccacggtggtgtctccggtcctctcccttcaaagttcagatttgcctgaaaacgcaattgaacttgtgccatctgctctggcgtcgtcttctgttgctgccaccgcaactgcccccactggcccggacagcagtgcggtcactggcagcaacactgccttcacctgcatatttccggcgtcggctccgccattgccgcaggcctcgccttcttcgctctccctcttcctctccagcactgcctcgtccctcttctcgaggcctgatcagaaccagcagcacctctacgccctgcctcctcagcccgccccaaccatgtctgccacggccttgcttcaaaaggccgctcaaatgggcacggcagccaccaatgcgtcactgcttcgtgggcttggcttagctatttcctcacctattgcttcttctagccacgaggcaactctggtgactgccggcgatggctccacccggtggagcagccaagggaaggtggagagctcctcggaaggagctgggctcgggctgggtctcccgtctccgccaacgctgttcggcaacaggcccatgacagtggattttctgggactgggaatgggtcctgccgggggccacacaggcaggctgtcggctctgctcacttcaattgacggcgggctgtcgtcggatcgtggattcagtggcggagtgcctggtgttttgtttggaggaggaggaggagggagagagagggtggatgacctcagtcgaggttcttgggaggagtttcctgagtcgaagcccgacgggccagacgggccaaatgggcctcctcactatctctagtgaccgtctaagtgcacttcccgggctctttttgctcctggcctcttggggaagttcacgatcaagcttgggactgctttttttgtaataacaacagtataggtgtgatttattttacgaatgtatatcgttctatttatctaaaaaaaaaa

SEQ ID NO: 168 - DNA, 2529 bp, Eucalyptus sp.
ctaacttgcacacaatcctctctttctctctctagcttgctggcggtcttttgcttagcctcgaaccccgtttacacacgacgaggcttgggaacgcggaaaaagaggttcaagaaaccggaaaccaggtgcttaggagagctgggttggcgttttcttgatcgttgaatcggggttgggggggcggccggggactttgtgtctggttggtggtgatcatgattcgggagctctgctaaaagagaagggagacgagagctttatcatcttgccctcttctttttttacagtcctgggtttaatcattgagttctttctttcttctttttttgggttaatgtgtctttgagcttctttgggtcagagacttcatcagagctgttaggtagaaaggaaaaagagagaggggggtggaaaagaaaaatgggaaaagcggacgattgactggtagctgagcagagctagcaaagaggggcaggcagacagcagcagcaagcgagctctgaccgaaaccctagaaagataggaactttcttttggccctttcctgtgttggttttttcttttattttcttttgtgtgaaggggggatttggaatttgcctccaagataaatgaacttggattttgcccccccttctcttgtccactaggttgaatccaaaagccacccaacacacacccaagaaaattcttagagcctccttagatatgcctacagacctggacaattcgtccacagcttcaggggaagctagtgtctcgtcttctggcaatcagccgcctccacaaccaccgccaccgccttccaccaccaagaaaaagaggaatctccctggaatgcccgatccagatgcagaggtgatagctctgtctcccacgaccctattggccaccaacaggttcgtctgcgaaatctgcaacaagggatttcagagggaccagaacttgcagctccacaggagaggccacaacctgccttggaagcttaggcagagatcgggcaaggaagtgaagaagagggtttacgtgtgccctgagcccagttgcgtccaccacgacccatcgcgagccctcggtgatctgaccgggataaagaagcatttctgcaggaaacatggcgagaagaagtggaaatgcgacaagtgctcgaagaaatacgccgtgcagtccgattggaaggcccattcgaaaatctgtggcaccagggagtataaatgcgactgcggaactctattctcaaggagggatagcttcatcacccatagagctttctgtgatgctttagctgaggagagcgccaaggctcagactcagggtcagggaccgggtcagggctcggctccggttaagccgaacttgcaggccgatccgaaagtccagaaacctgcctctcctcctcatcctcatcctcctcctcctcctcctcgagcatctgctccaccaactgtacagtcctcagctgctgtgttgtctacagttttggctgatcaggcagcagggatgcaagagaacccatcccaaattcttgaagagccaccagtgacaagcagcttgatagggagctctagcagcagcaccagttctagcagcaatagcaaaacaagcactagtgtaatagcaggcttgtttgcttcctcaactccgtcctcatccttacagcctccgcagcagagtactccttacactgacctgattcgtgccgtggcaccacctgaccgctctgaccatggacctgcctcatctgttgaacccatttccctctgcctctccacaaatcacgggtcgtcgctctttggcagtgcagggcaggagcgtcggcaatatgctcccgctccacagcctgctctttcagccactgcgcttctgcagaaggctgctcagatgggggcaactgcaaccaatgcatcgctgcttcgtgggctcgggattgtctcttcctccacctcggcagggcaacaagagaacttacagtggaaccctaataatgtcgagcatgaaaatgcctctgttgctgctggactggggctagcgcttccttgtgatgggagttcaggtctgaaggaactgatgatggggactccaaccatgtttggcccaaagcatcctactttagattttcttggattggggatggcagctggtggcaacccaagtggtggtttctcaggtcttatgaactctataggtggtagccttgacatggcagcggcggcagcctcattcggcagcggagactttgtcggcaaggacattggacagagctcgtgaacttaaccagaagtcgcagggaatttgtatgtacaggtgcatattgtcctaaaagaatcaatgttgctcaagaaaccaccaaagaaccatcgagcagacgcttcccttggatgaaagtcggaagagaactgttgatgtgaaagattccataaaaactaaaatctggggagacttctattttttccctgtgaatctgtgatgtgttgttagaggtacgagctatatcaaaagtgatcagatgatgttttaaaaaaaaaa

SEQ ID NO: 169 - DNA, 2391 bp, Eucalyptus sp.
ctcaacccttcacatcacaaccaccccaccgaaaagaaaaaaaaagaagagagaagaaaaaggggtaaacgagagggtttaattagatttgtgttatctgtatgttgcatgacttggtcagatgttcaagaaccacagaaacagctcaagtacatgcctactggtttctttgttgaatcggattacttttttgataattcagctgggctaggtttgaaggaggaggagagcaggacggaggaaagatatcgaccgggaaaagattgcctgccgaacacagagagagagagagagagagagagagagagaggggaagctggtgttagatagagagatatggcatcaacatcgtcgacgcagttctttggcctcggagatgagagccaaaaccagatgatgcttcagcagcagtcctccacgacaacctcttcgaccggcccgatgcaggcgccacccaagaagaagaggaaccagcctggaactccaaatccagacgcagaagtgatagcactatctcccaagaccctaatggcaacaaacaggttcatttgtgaggtatgcaacaaagggttccaaagggagcaaaacctacagctccacagaagaggacacaacctgccttggaagctgaagcagaagaccacaaaggacgtgaagcgcaaggtctacctctgccccgagcccacctgcgtccaccacgacccgtcccgggccctcggcgacctcaccggcatcaagaagcactactcacgcaagcatggcgagaagaagtggaagtgcgagaagtgctccaagcgctatgctgtccagtctgattggaaggctcactccaagatctgcggcactcgggaataccggtgcgattgcggcaccctcttctctaggcgcgacagtttcatcacccacagggccttttgcgacgctctagctcaagaaagcgcgaggcacccatcaagcttgaacactttggggaacaacctctatggcaacaacatcggtttgggcctctctcaccaggttggctcccaattgcccatcctccaaacacataaccacccaccaagcaacatgctccggcttggcggcgcctccaactcctctaacttctcgcagccgccccacccaatgcctcctcctcccgccacgtttttcaagcctgaagctgccgactccctgcacgatctcccaagccacaatcccctctccgggttgatgcagctgccaaaccttcaaggtaactctagcgcctcccaatcgaacctcttcaacctcagcttcttcggcaacaatgccgccgctgccagcgacaatgccaccactgccacagccgccgctgccaactttccatctcaaggcttcttgggccagttcaatggcgggaacaatggcagcaaccaaccgtctggtcttttctcagatgaccgggtcggatcagggttttcttctttattcaatgcctcagcgcagaatgagagcgtggtggctcacatgtccgcaactgcgctacttcaaaaggcagctcaaatggggtccataacaagcggcaacagctcctccttgttgggcggattgggaagctcatcaggcggcggcggcagtgctgtcaaccggcaaatggggtccgtcaacttcagtggaggcagtggcagttttcctgacagtggcgggaagctgccaccacagatggaaagcgagagccatctccggggtttgatcagttccttcgccggtggaagctcttcaatattcggaggtggcggcggtcatgagcatgagaacagcttcagcggtttcaatgaaagcaatatgtcgttggatcatcatcatcaccatcaggaccaaagtagtgcgagcttctgcaatgtgaacgacgccaagttgcaccagaatctcacgacgagcatgggagggtccgataaattaactttggacttcctgggtgtgggagggatgatgaggaaaagaacggacggtggtttcgcgcatagagagcagcagcagcaacaacatgggacgatcaacatgagctccctagacagagacaggaagtcagagcagggaagtcaaccatttgggagttcgaaaatgcattgaaggaattgacagttgaccgagaacgtgaggagggaaaaagaggtcagtccatcagctggtaggttttataaaggataaatatgtgcggccaaaacaaaattgtaagaagaacaaacgcatgtcaaagtagggtttgtcttcattagggctttttctgtttttttttttttccccgtatcttcagggagaatgcaccatcccactctcccaccttcatattttttctcttcgaacgattcagtttgtaatgttggctacaattgaatgtgtacttgcttagttagagcaaaaaaaaaa

SEQ ID NO: 170 - DNA, 1826 bp, Eucalyptus sp.
gctgcaacttttcgagctccgtcaggaggaaaaaaaaataataaaaaaaagagatgatgctcggagagcctcaccgtcctcctaatccgacgatcgacgttcctccctggccgatcctggacgatccgacggacgacgccgtgcctcactctccgtactccccttacacgctcaatgctggctacggcggcggctgcgactcctctccctccgccgccggccccggccacttccaggacgtcatggcggcgctccggcggttcctgccgtcgaaccgccccgacacggacccggacccggatatgacgtcctcccgcgaggcggacttccccatggacgtctactcctgcgacaacttccgcatgtacgagttcaaggtgaggcggtgcgcgcgggggcggtcgcacgactggacggagtgcccgtacgcccatcccggcgagaaggcccgccggcgggacccgcggaagtaccactactccggcaccgcgtgcccggagttccggaaggggagctgccggaagggcgacgcgtgcgagttcgcgcacggcgtgttcgagtgctggctccacccggcgcgctaccgcacgcagccgtgcaaggacggcgccgggtgccggcgccgcgtgtgcttcttcgcgcacacgccggagcagctcagggtggtgaccccgcagcagagcccccggggagccgcgacgcagctcccgttcatggcgtccccgagcacggtctcgccggaggattcgccgccgatgtcgccgatgtcggccgcggtgacgcaccagtcgctgagccgctcgctcgggtcgagctccgtgaacgagatggtgatggcctcgctgaggaacctgcagctcggtaaggttaagtccctgccttcctcttggaacgcaaacgctcacgtcaccacggccgccgctaccaccgcctcttacgggtcgccgctgcgacccggtttctgcagcgtgccgacgacgccgacgcgtgtgccggcccggccggggattggttacagggatttctgggaccaggtggaggaggaggaggagccgctgatggagagggtggagtcgggaagggacttgagggccaagatgttcgagaagctgagggaggagagctctctggaccgggccgacccggagcatcctagcctaggcggcggcggaccggacgttgagtgggtatcggatctggtgaattgattcggatcttggtaagtgggaagcgacaagcgagtggttcttcgtgttccttttttggggttcttctgtttgcagtgtacaggacatggatggatggatggatggagagggagagaggaggggctatggtatccggaagagaagcagcaattcaagattcggtgtatatatatgagtctttagtgttaaattattaattaatcaccatatatatatatgtggtagatacaaatattgtagaaagaggtttccttgggggggttttctgagaagaagatcagatggaagctgtcctgatcttttgtatttgtggggtggttttctgggaagatcagcaaaagattgcgtcattttttttgaggtcgggaagcagaaattggatttggcaaaattttatgccctcttttggaaatgtcaaaaatttggggcagagtgattaaggtaaaagctagcactctcaactgattgttattagtgttcgttctggcaccttttatcttttttaccgtcgtatgtatggactggccgaggtttttcatcccagtgattcctgggtgtctgtgtatatctgaagcaccgtatgataaatgaaaaactgttcttttgtcaaaaaaaaaa

SEQ ID NO: 171 - DNA, 1226 bp, Eucalyptus sp.
cgcccgttctctctcctttcccctctgcgcgaaaccctagctctccctctcttcccccctctctctctctaaaccctatacgtcttcttctccttctccgagtcggggggccagtccgcggcggtgcgagcgagagccaatggacttcggcggcggccgcaagagggggaggctggacgcttcctccaacggcaatggcggtcccaagagatctagggaagaagcggagaccttttcaactggtataggaagcaaatcgaagccatgcacaaagtttttcagtacttccgggtgcccatttggtgagggatgccacttcttgcactatgtacctggaggctttaaggctgtgtctcagatgcttaatctcggtggcaaccctactcttccccatgcctcgaggaatgcggcaccatcttatccagaagccccatctcctacagctgtgaagactcggttgtgcaacaaattcaacactgctgaaggctgcaagtttggtgataaatgccattttgcccatggcgagtgggaacttggcaagccaactggtccctcctatgatgatcctcgtggcatggttccaccatctggtcggtatggcggccgcaatgaacctcctcctccaggtcttgcagcagcagcaagctttggggcttccgctacggctaagataagtattgatgcatcacttgctggaccaatcattgggagaaatggtgtgaactcaaagcaaatttgccgagtaacaggagcaaaactctcaataagagagcatgactcagatcctaatttgaggaacattgagcttgagggtacatttgatcagataaaacaagctagtgccatggttcatgagctcattgctaatgttgcctctgcctctagacctgccatgaaaaattcagctgcgcattctgctccccgaagcaacttcaagacgaagctctgtgagaactttgctaaaggctcttgtaactttggagaaaggtgccactttgctcatggaactgaagagttgaacaagcccgggctttgaagatggttattgtttgttttgtctctactctttggaatttcaggtagtgtggcacaacgccaaatatttgagaattttgttgtgatgagaatgttagtttgttattagttagctcctttggattctgtagctatctttgtggatcttattagcaagcttttcccgtggtattggccctttaaaaaaaaaa

SEQ ID NO: 172 - DNA, 1695 bp, Eucalyptus sp.
gttgaattgggagcaggttagttggttcagccctggcgccgaaatcccaccaccgcgaaaatgatgatcggcgagtcccgccaccaccccctccaccccacgacggtttgcatccctcctccgctgtggccgtccctcgacgatcccgccgacgagatctcccccgccttcgacgcggaccacctcgccgccgtcgccgccgcttctagtccgtacgctctgcaggacatcatcgcggcgctgcgccgccaccagtccgacccggactccgacggccccgactcgccggtggacctctacacgtccgatcacttccgcatgtacgagttcaaggtccggcggtgcgcgcgcggcaagtcccacgactggacggagtgcccctacgcccacccgggcgagaaggcgcggcggcgcgacccgcggcgccacgggtactccggcgcggcctgccccgacttccggagcgggcattgccccatgggggacgcctgcgagctcgcccacggcgtcttcgagtgctggctccacccctcgcggtaccggacgcagccctgcaaggacgggctcaactgctcccggcgcgtctgcttcttcgcccacacgcccgagcagctccgcgtcgtgccggggcagcagcagagcccgcggagcgtcgagtcgctgtcctcgtccccgccggtgtcgccgatgtcgctgtcgctgtcccggtcgccgttccgggcggacccgatgggcgagatggtcgcctccctcaggaacctgcagctcgacaaagtgaagtccatgccctgcggcgggtccacttccgggtcgccgagggcctccaggatccgaccggggttctacagcatgcccacgacgccgacacagtccaccccgacggcgcgcgggctggggtgcctggattcctgggagagcccttacgaggaagagccggcgatggagagggtggaatccggcaggggcctgagggtgaagatgtttgagaagctgagcaaggagagctcgttggacacggcacgacctgaatccgatcctgacgtctggtgggtatcggacctggtcaagtaaaagcgatatcttgtctgcgtcttccctctcttccgctgtgaatagcatctgaaaggggagtagagggatgagaaccgggtagaaatgctaatgatttcagactgaagttactgtacatatatggtgtaactgacggacggcatgatgaagcgaacttggcaagatggttccgattccagaggaggaagacgatcggcaacgtttcgagtcgatgaagagctgattccgaatcgcagaggaagtcttgatttacaggtcttcattcctcgtttcgttctcgactgttcttgttctccttggatccgaccgaaggaggaggtcgcaggagccatggttgatggtcgtgtcttgatgcagggtgatgtggaaggaggtttttgttcttagtattcatcgccgtccggtatcgcgacgctcaaaagaactgtccgaggttttcagattcctttgctgattctgggtaatctatgtatattttgtctggcagaaggaggattatggtattgatctattaaaatcctctcttgcttgttcttttgtcctttttatttgtcttaacctaaactcatccaagctttttttaaagttcataaaagtgtgtcgtcacatgatttccatgtatgg

SEQ ID NO: 173 - DNA, 1915 bp, Eucalyptus sp.
cccaaattccccagccgggtgagcgaaattcatgttgtgattgcttactctgatccgttcgccgcaggggttgattccgcgtagcggtgtttttgattccgggaagctcaggcgcaaggccggcctgtggaggagtgtctttgctttctggaacacacgagcggcgagcctgttttttagtggtaggctaggcttcattatggcggactctggtgaggctaagcaggctgaaccaggaaatttggaggagacaggtgataagcaaacatctgaacaggtgtgtagctttttcaggaagccatcaagaaataagaatatcaggaagcggatggttgaagaagacgatgatgaagattccaagacggagagttcagtgttacataatcagaagaaacctcaaaggacaggcaataagctgtatttttcaactggatcctccaagagctctgtgtctgcagaatcaaaggttgattctgataagccgatatttcaatttgagtcttcaaaagaaattcaagttgaacatgatagcagagcaacagctactctggaaactgagactgagttctcaaaagatgcccgagctattcgagagagagttcttaagcaagcaactaatgagataagtgggaaaagtaagggcactggtgatgagaagctgtataaaggggtccatggttacactgattacaaggcggggtttcggagggagcagacaatatccagtgagaaagctggaggggcacatgggcccttgcgagcttcagctcatattagagtctcagcaaggtttgattatcagcctgacatatgcaaggactacaaagaaactggttattgtggatatggagatgcatgtaaatttatgcatgaccgaggagattacaaatctgggtggcagttggagaaggagtgggacgaggcagagaaggcaaggaagagaaatttagccttgggagggaatgatgaagatgaagaggatgttgaccaaacagaagatgaagaagatgatgaattgccctttgcatgcttcatttgcagagagccatttgttgatccggtcgtcaccaaatgcaagcactacttctgtgagcattgtgcactaaagcatcatgcgaggaacaagaagtgctttgtctgcaacaaacccaccatgggtacatttaatgttgctcaggagataaagaagaaaatggctgcagaaggtggaaaatgatggacattgtcaataaaagtggcaaatttagtgaaaagggccggggttgcactggtaatttcccttatcactaatatagattgtgcaatattgtcgctaggacaacatctgaactttgctattgcctctttcctttcagtaagtatttcttcactagagaagaaacttgaacgactcataagaaaaaggaactaggaggggacccgagacaacctagcttctctgtctcagttccttggagtagttgactgactaatgcccctgctaaaaatgccgtcaacatggacggtgtggcagaaaatgcgagttttcagaccaaatggccttgatgtaattgtcccatcgttcaaagtccatagcccagcaatagagtggttttcatccttgcttctaacatgttaatggttaataatagctcactccctaagggttaggctgccccctttttttcagttaagttcggctcggtcagaattatacagatgtacaatcagttgcagggcatgtattatttttatcttcgctgtctcggatgatgttgcctttatattactcttcaaatcatgcccattccgatcagaatgagcaccttcaatgttgttactctttcaaattttacccacttgaaagacatacacagaaaacctgttgagtttgatattgtgaaaataaggagtgtattgaaagttaaaaaaaaaa

SEQ ID NO: 174 - DNA, 1794 bp, Eucalyptus sp.
gccttgcgaaaatctccgaactggactcccatctccggcgagtgaaacgatcgaggaggaggaggaagaagcgacgatgatgatgatgacgatggccgccggcggcggcgaccaccacgcccgctccaccccgaccgtccagatcccccccgtgtgggacccgctcgacgacccggccaccggcggctgcggcgggccgtactcaccgtactccccgtactccccgtactccggcggcggcaatgccggcggggccgcgggaggaggggagtgctgcaacgacctgacggcgttgcggcggttcctgccgtcgaaccaccaccaggacgaggaggacgaggaggacgggcgggcgcccggggaggacggcgtgctgggctgcgacgagttccggatgtacgagttcaaggtgaggaagtgcgcgcgcgggaggtcgcacgactggacagagtgcccgtacgcgcaccccggcgagaaggcgcgacgcagggacccgcgccggttcttctactccggcactgcatgtcctgatttccgcaaaggcgcgtgcaagaagggtgactcgtgcgagttcgctcacggcgtgttcgagtgctggctccacccggagcgataccggacgcaggcgtgcaaggacgggcaaagctgccgccgccgcgtctgcttcttcgcccactcccccgaccagctccgggtcctccccgcccaccagcagcagcagcagcagcagcagcagcagcagcacagtcccaagagcgccaccgactccgagttcgggtccccggtccgcccctccgctgccgcggcggcggccttcgactcctacttcaccaagccgtggtcggcctccttcatatcctcgcccacctcgatcctgaccacctcgtcgcccccgatctcgcccccgaccaactcgcccccgatgtccccgaaccaacgcggcggctgctgcgggtcgcccggatcggtgagcgagctggtggcctgcatgaggaatatgcagatcgccaagatgaagatgagcccccgcgggcagatgggggggtctctcttcgggtccccgctccgacccgggtgccaccttgcggcgccggtgactccgagggccgagtcttcaccgcggtacgggcaactcggcggtggaggcgggctctttgatctgtgggagtctcaccgtcgctgcgaggaggagccttccatggaaagggtcgagtccgggagagatttgagggctaagatgtacgccaagctcagcaaggagaattccctcgatggcgccgacctggtagggaccggagctagtcccgacgtggggtgggtctttgagctggtcatgtgaaggccgaagaagcaccttcgagtcctccccgagtcgacttggagctcgaattttgtttgggtcgaaagaagtgattttttggggctggtgggcggtgttcagcaatcgggtggcctgttgattaatctctgactcggatgtgtgaatatatctcgtgttcatttccgttgatgatgatgattaccttccttcttttcaatgtgtaaatattggctagcgggagagagatttcaagtctctgttttgtggtccgatgactttccagttacctctctttgtaaatgaagtttcagtaagcaattcttaaaatattcgcaatgcaattgcagatttctgtataggaagaaactagaacgtggaagttcgacctggggttttggcttttttggggcttgtattgttgattatcgttttttggtcaagtccttgaaatctctgtttcgtctcattttctc

SEQ ID NO: 175 - DNA, 1820 bp, Eucalyptus sp.
gaagacgcgaagcgctttctctctcttcttcccccctccccctccctctctttctctctctaaaggcagcgccattcctgcagtctctctcctttgcctgcgctgcgaccgaggggagggggaggcggtggtggtggggaagcgtccggggtttcgcgcgtggggacgggcggctgattccggcgtcggcgtcgtcggcggcggccggtggcggaatgcgagctccggcggagcgggccctcctccacttcctccggcggcgattggttttgcgggcgcggcgggcgatggagtgatggcgttcgacgctggaattccgatgccccgggggtccgttgccgacggtccctctctctctccgtcagatgcgatgtggcaaatgactttacgatccaacgaaaccatagaatcggggccctaccctgagcgtccaggggagccagactgttcttattacattagaacaggcctttgtagatttggtgctacatgtcgatttaatcatccatctgacaggaagctggctatagctaatgcaagaatgaagggagagtacccagagagagttgggcagccagaatgtcagtactatctgaagacagggacttgcaaatttggagccacatgcaagtttcatcatcctagagacaaggctgggattgcaggaaaagttgctttaaatatcttaggctacccatttcgtccgaatgagatggagtgtgcatactatttaagaactggacaatgtaagtttggaagcacttgcaagttccaccatcctcagcctactaatatgatggtttcactgcgtggttctcctgtgtacccttctgttcagtctcctactactccgactcaacagtcatatccaggagttacaagttggtctagagcatcttttatccctagtcctcgttggcaaggtccttcaagttacactcccttgattgttcctcagggcatggtatcaattcctggctggaatgcctacagtggtcaattggggtcagtttcatcttcagatagccagcttataatgatgggacaaagtcagatttttggaagttctggccagagtgattcagtcaatactggatctccaggggcattctcatcataccaatctggctctatgcctgttggtttctatgcgttgcagagagataacatatttccagagagacctgggcagcccgagtgccagttttacatgaagacaggagactgcaagtttggtgcagtttgcaggtttcatcaccccagagagagattacttcctgctccagattgtcttttgagccccataggccttccattacgtccgggagaaccgctgtgcatattctattcccgttatggtatctgcaagtttggaccaagttgcaagtttgaccaccctatgggtatcttaaataatctatctgcgtcatctccatctggtgctcctgttcgacgtatgttagcatcttcatctggaactgctgcattggttttatctgaatcaggcccagggaaccctagaagactttcattgtcagaaacaagacagataccttctgatgacaacatcgactcagacgaataaagattccttgaagaagagagcctctgtccatttgtacaatctctcggagatggagagagagttgtctgtaaatcattgcttacggattgagatgtacagggtttatatatgttgcttctgttctcctgaaatgcacttcagtcaaccaaaaactactccgagtatccattttgttgcactctgtaaatctgaaaatatgtcacatttggcaaaaccagtgtgaacaaaaaaaaaa

SEQ ID NO: 176 - DNA, 1864 bp, Eucalyptus sp.
ggccgaattcgatcagatgaaccgccgctgcgaagaagcattcctcccgtagccgtagccgtcgatggccaatcatcagctgtacgggacggcaccgcctcccggggcggcggccaaattcaatctggcaggcctctccacctcaccctcgacaaaccttcttctccgcaagcgcatggaaatgggttcggaccccgacgcgtccttccttgcatcatccgcatttggaggacgctctcggtcccagagcagtgccgatgccctcccttattctcccgcggacgtcgtcggttactcttcctacgccggcggcttgggtgcacgctcctcctggtctcactctcaccttcaccttcaccccgatgatgtgagcccgctcctttccggcaccaagcgcccctctcaagcgctctaccatcagaatgttttggatgcccaaagagagattgggcaaagtgaagcgtggtattccaccaacttgttatccaagcgccctagattggagagtgcaagcaatttgcctatttatccacagaggccaggagagaaggattgtgctcattatatgcttaccagaacttgtaaatttggacttaactgcaagtttgaccatcctatttgggttcctgagggtggaatcccagattggaaagaggcaccacttgtgacaacagttgaatcccttccacagagagcaggagagccagattgtcctttcttcctcaaaacccaaacatgtaaatttggtttgaggtgcaagtttaatcatccacgagataaaattattccttcgggtactttagatgatactttgaacttaccagaaagactgactgagcctccatgtgcgttttacctgaagactgggaactgtaagtttggagcaacctgcaaatttcaccacccaaaggatattaaggtggcacaggtactacaagataccgatgctggagagttgagggactcattagcagagaatgacagaatggtcagagaagtgaagcttgtcaagcctctcatctctctttctcctgcttcatcacataatactaagggacttcctataagaccgggtgaagtggactgtcctttctaccttaaaactggcagctgcaaatatggtgccacttgccgctacaaccatcctgagagaaatgctattgatctccatgttggcattgttccaattgttggggcttcaccagccagaaacccaaattttgctgctggctcagcagcctctatctatcaagctgtcgatcccatattgtcacaattgatgctgggagctggtccaactatatatcctcagcgtcctgggcagattgaatgtgattattatatgaagacgggtgtatgtaagtttggagaacgatgcaaattccatcaccctattgatcggtcagctcctacacaggcaatggcaaatcaaagtcaacagactgttgagcttacactcgcaggattacccagaagaaaggatgctattgtgtgcccatattatctgaagactgggacatgcaagtatggagctacttgtaagtttgaccatccacctcctggtgagctcatagctatggcggcaacacaaggacaatctgcttccgagggagaggaagcaaaagagaagtgaaatctggtgcagagcaactgctgatgtgatgaggtcccatcccactcatggatatcatcagagggaccagatacgtgctgttgtgcatctccctttaactttcatgagctttctagagcaaggctaatttgtgtatcaaatgtgtatggtttagcagtaaacatgcaaattgctccttattggtttctcataggttgagctcttttacaacaaattatcagaaaaaaaaaa

SEQ ID NO: 177 - DNA, 2709 bp, Eucalyptus sp.
cttctgaaagctttttgacttaagacgagagagaaggagagaaggtccccctcctcgtcctcgtccccccgtggattttgaagaagaaaagtcgcaccttccttctcctttcccactcctccctctgctcgaagcttttctcttccgcagaattacataaaaacctcgactttgcgcatcattccgattcacctcacaccttcactttcccactcgaggtctcccccctcttttcctagctctttccctttccctccctctctctcgagaatcgccgcatttggaggagctccaatctgctttgctttgctttgctctcttcttgctcggttccccctcataaggagtcgattatgtgcaacggttcttcgaagggtaaacttttcccctcgagtatgggcatggagggcgaattccacaacaaggatggcgaagcaccccgtaaatgctctgccttgcttgaattggcagcctcggacgatctctcgtcgttcaaaagtgaagtggaagagaagggctgcgacgttgatgaggccagcttttggtatggtaggagaatcgggtcgaagaagatgggttttgaagagaggactccattgatgatctctgctttgtttggaagcaccaaggtcttgaaatacataatcgagaccgccagagctgatgtcaacaggtcttgtgggtccgacaaggtggccgccctccattgcgcagccgcgggtgggtccagttcttcacttgaaattgtgaagctcttgattgaggcctcagcggatattaattctgtagatggcaatggaaataggcccatcgacgtgcttgccccggcagggaagtctcgctgcaattccagaaataagtttgttagatcgttgctgaaaggtgaaaactatgtcgtggaaggtgaccaatcctttgacatagaaggagaggagaagctagtcgctcttccaaaggagggaggcgagaagaaagagtatcctgttgatgtctctctacctgacataaacaatgggttctacagtaccgatgagttccggatgtatgctttcaaggtgaagccttgctcgagggcttactcccacgactggaccgagtgcccgtttgtgcaccctggggagaacgcgaggaggagggacccacgcaagtacccttacagctgtgtcccttgtcctgagtttcgcaagggttcgtgcgtaaggggggatgcttgtgagtatgctcatggagtctttgagtcgtggcttcacccagcgcaataccgaacccggctgtgcaaggatgaaactggttgtactcgcaaagtttgcttctttgctcacaagtccgaagaattgcgtcccgtgtatgcttccacaggttctgctatgccctcacccaagtccttttcagctaatgccctagacatgacaaccctgagccccttatcccttaattcaccatctctgcctttgcctgctacttccacgccccccatgtcacctttggctgcctcatcttcacccaagggcatgaacttgtggcataacaaaattaacctgaccccaccaagcctgcagcttcctggcagccggctgaagacggctatgagtgcgcgggacttcgattttgagttggaatttcttgggctggaaaagcaagcttctcagcggcagcaactgatagaagagatttctcgtctctcatcgccctctcatatgtggaactcggaatttggcagaaccgcagagctgaagcccactaaccttgatgatgcgtttggatctcttgacacttctcttttgtctccgttgcaggggtcgtcgatgaaaacatcgactcctacccagttgcaatcccccacagggcttaaaatttcgaatttgaaccaactccgtgcgagctacccgtctagcagcttgtcgtcctctcctgtgaggaagacctcttcttttgggttcgactcatccagtgcagttgctgcagcagtcatgaactcacggtctgctgctatgacgaagcggagccagagcttcattgaccgtggagcagtgggtcaacggtctggactcattggacctgctaattctgctcctaggatgtccaacctttcggactggggctcgcctgatgggaagttggattggggtgttcaaggggacgagctcaacaagcttaggaagtccgcttccttcggctttagaaacaacagtatggcgaacccaaacaacgtggcgtctcccagtgctgatgagccggacgtgtcgtgggttggttcattggtgaaggatgtggctccgcccgaagggtatccacagtatctgtacatagaacaggagcagatggtggcataactaaagcgaagagcaccacacgaactctctcctgatggcttaagatgacttgtttgacattctttatattcttacaaacagcgcgttcttaggagttagctggaggaaagaaggaaacggtattgagtttgagattcaggctcttagctggacagcgaaaatttggggaaggaagagaatttggtttcttgcccaacttagataatgatgcttttgaaggcttaaaagaaagatgaaggcaaacattcttttgttagtattgtattattgttttaatttttcatcccctctgtcggggtgtggtgggtgtcgatgtttctttcatcagtaaaatatataatgaggtttactcatctattttctactaaaaaaaaaa

SEQ ID NO: 178 - DNA, 2518 bp, Eucalyptus sp.
tctccttcgagtttctttcttcactagaattcgctcccgagtctgttgttgctcgtgtagttttgcttactccgtccttcgtttagctcgctgaccagcgcggagctaggagcggtcgctaaaggattactcgtacaaaacgtaaactcagctctgccaattttcccatggagggggaatcttacttcgagaaagatgaaaaatattctaattgctcaatcttgctcgaattatctgcttcggacgatctcccagcttttgaaaggaaagcgaaagagaagggctgtaacattgatggtgctagcttctggtacggtagaagaattggctcaaggaagatgggtcttgaagagaggactcctctcatggtggcttccttgtttggaagctctagggttgtgaagtacattctcgaatctggcaaagtcgatgtaaatagggcttgtggttcggacaaggtcactgcccttcactgtgctgttgccagtggctctgcttctgcggtggaggttgtcaagctcttgcttcacgcatctgccgatgctaattgcattgatggcaatggaaagaagccaattgatgtgatagcccttccattaaagtcacgcggcgattcaaggaggaagctgatggagctgttgctgaaaggcgataattctgatggggaatttgaatcccacgaggagaagccgattgccgcaccgcaagcatccaaagagggaagcgaaaagaaagagtatcaatttcctgttgatatctctctgcctgacataaatgttgggatttacagtactgatgagttcagaatgtatgctttcaaagtaaagccttgctcgcgggcatactcccatgactggacagagtgcccatttgttcatcctggcgagaatgcgaggaggcgggaccctcgcaagtacccctacagctgcgtcccttgccctgaatttcggaagggatcttgccaaaagggtgactcctgtgagtacgcgcacggcgtatttgagtcgtggcttcatcctgcacagtatagaacaagactgtgcaaggatgagactggatgtgctcgcaaagtttgtttctttgctcacaagcccgaagaattaaggcctgtctatgcttcgacgggatcagctatgccttccccaaaatcctactcatcaagtgggctggacatgtccacattgagtcctctctcaatcagttctccgtcagcatcgttgcctgttacttcaacagcacccatgtctcctcttgcagcctcgtcatctccgatgtctgtgaacatgtggcagagcaaggctaacaagctctccccgccaatgctgcagctctcaggtagtaggctgaagactgctttgagtgctagggacttggacctggagatggaattgcgtggtctagagagtcagatggccactcaacagcatcagttgatggaagagatatctcgtctctcctcaccatcatcctgctttagtagtaggattggggaagtgaaacccactaacctcgatgacgtttttgggtctccggatcctgctttgctgcctcaattgcaggggctgtcaagaccttcaacaccaagccagttgcaatctccaactgggcttcagatgcgccagaatgcaacccagtttcgtggggcgtaccagagcaatgcaaatgcattgtcatctccagcaatgaagcaggcaccttcttatgggtttgactcatctagtgcagttgcagcagcggtgatgaattcgaggtcagccgcttttgcgaagcggagtcagagttttatcgacaggggaatggcgtgccctggaattgccaattcttcccctatgatgtcttcagctatgtcgagctggagctcacctcatgggaaattggattggggcgtccaaggagatgagttgaataggctgaggaaagctgcttcctttaagatgagaagcagcaccggagcaggtgctaatactgtctcggcagcagccatggctgatgagccagatatttcttgggtcagttcattggttaaggacgtgccttctgcggaggacgcgatgttcgctgcagagaaaggacagcgcacttatgggaaagacatccgcgaaaggattaccccatgggtggagcagctgtacagagaagtgccacggatggcgatgtaagattgccactgcaagtcggatgccttagtatgctgactaattgatattctttgcatttgttttgaggcatttggtagccattagatacgagaaaaggccaagcagcaggtggtgtcttggcaaggaataggatgcacatagtctgttatcgagtagaatagacttgggaacaatggttatagccaaatgttaaaagttatgatattcttttccaattctttctcttcctcatagtaggtttctcaccaagtcttttagtgagagcctgcgggatgtactatatgtttcccttatgtaacgtctcttcgttgaaagaaatggctttataatataaagcatcaagttttttaaaaaaaaaa

SEQ ID NO: 179 - DNA, 2683 bp, Eucalyptus sp.
gcaaaggtcgatcacttcctccctagaaagcgagtgtggagttgaagcttgataaccagaggccgcctctcgtctcgtctcgcccgcctgcgcttgctctgctctccgcgtgccaagggagtgttcctaggtgctgaatctttccatgtgtagcggttcaaaagggaagggagagtgaattcgagaagcagaggatgtcggcccgtcagttctcgatcctgctcgagttatctgctgcggatgatctgacgaactttaagaaagcagttgaggaagacggctacgatattgatgagtcgagcttgtggtatggtaggaggatcgggtcgaagaagattgggcttgaagagagaactcccctcatgattgccgcgatgttcggcagtatgtccgtgctggattatattatcaagtctggccgggccaatgtaaacaaggcgtgtggttcagatggtgctaccgcgcttcactgtgctgcggctggtggctcggtacaatctcctgaggtggtcaagctgttgcttgattcttcagcgaatgctaactccattgatgcgaatgggaaacgagcgggagacttgatttctgaggtctctggttcgcccttcaattcgagaaggaagactttggatgtcatgttgactggaggtgggactgttgagtttgttgaggaaacttacaatctgcctgagaatctgggtagtcaaattgaaggaaacgaacaaagagagagtccaacggcccgcgcttccaaggatggttctgaaaagaaagagtatcctgtcgacctttctcttccggacatcaacaatggaatatatagcacagatgagtttaggatgtattctttcaaagtgaagccttgctcgagagcttactctcatgactggactgagtgtccatttgttcaccctggggagaatgcaagacggcgtgacccacggaaatatcactacagctgtgtgccttgccctgagttccgcaaggggtcatgcaggcaaggggatggctgcgagtatgctcatggtatatttgagtgctggcttcacccagctcaatatcgcacccgtctctgtaaggatgagattggatgcaccagaaaagtctgtttctttgcccacaaacatgaagagcttcgtccattgtatgcatcaactggttcggcgcttccttctccaagatcattttcgcccgttgctgcttctctagacatgggatcactgagccctctctctctcggttcttcttcagtccggataccgccaacttcaacaccacctatgactccatcaggggcctcttctccccttggtgggtcgatgtggaaaagccaaattaatagcactccgcctggcttgcagcttccaggtagcaggttgagaagcgcattgagtgctagagacatggatttagatgttgacttgatcgatctagaaaataattatcgtttgcagaagcagttgctcgaacactttcctgatctgtcctctcctcgtggttggaacaactcttcatccaccacgtcggctttccctgagtattcaggtgacatgactggagaaataagtaggttaggagtaaaaccaaataatctcgaggatagtttcaggtcattggacctgaccctcttgtctcagttacaagggctgtcacttgatggtgcaatatcccagctgcaatctcctactggaatgaagattcggcagaacatgacccagcagctctactcaaactatactgacaagctttcctcgtcacctagggcaatgccatcatttggaaccgatccttccagagcttcagcagcagccactctgagttccaggtcattggcatttgcaaaaaggagccacagcttcattgagcggagtacagtgaacagtcagtctggatattcagcaggtgctgcttctccaactgcaaggatgtcttcccagaatgactggggctcgcccgatggcaaactagactggggcattcaaggggaggagctgaacaagctgaggaaatctgcatcattcgggctcaggagcagcagcaaccgcttccatgcgtctgcagattctgcgacagcaactgtaggggacccagacatgccctggattcagtccttggcaaaggaagccccgtcacaaaaccctggcaattttggagcagagcatcagcagcagcagcagcagcagcagcagcagcagtatcatcttaattctggaggtactgagctgcttccagcttgggtggagcagttgtacgcggatcaggagcagatggtcgcctgagatcaacattggcttcttatctaaccactattagtcatttcgttattgctttaattttttttcttctgagtctagtattaatgtctaggattcgaacgaactggaaaattaaatctagagggaagatgggaagaaaagagcaggatggaaggtttctgctcggtccgagatttctcatagtctattatagactatcgtatttctcgttcttttccgtcccaatgttcttgatttggttctcagcatgttttctggatgaggcttacaaactatgtaatcttgtcttgctaaaagaatcagagctgcacctgcaccaaaggttgtgatactaccgcttattgatgatgatgataataataataattcggacatttagtaccaagtccgatgtctcaaaaaaaaaa

SEQ ID NO: 180 - DNA, 3657 bp, Eucalyptus sp.
tttctctctcctctctctatcacttcactcactgccacagtgggcgactccgcctctcctaccagtctttgtttttattgttttcaaaggagagagatagggagagtggctagtgagagaaagagagagagagggtagagaactctaggtgggtagtgagagagagagagagagagagagagggagagctgagcttttcctttccttttcagcttgactgccaccaacttggcctcagtttcccaagaaacaacgctgagcaaatttgagctgatagtttttggtttctgccatggctgaaaccagcctagaaacaagggctttggggttttgctttttgcagctataaagttttgaattttgaccggtggggaaagagggagagagagagagagggagagcattaaagaaggagagagcctgatcttctcgtcagaagtgaaagaagaaagaccagattttgatggtgtatgagaaagatggacactggaatactcaaaagaactcatcacacagcttcacaagctgagttggtagtaggtggggtttgtggttgagaaagaaagttttacttaccgagagagcgagagagagagagagagagagcaacctcgcccgctctctagcaggcacactaaactcaaaagatcatcaccaacaaaaccgggttttaagagggttggtatgaaaaggtgaaggcacacagccaccaaacagaaacactcacttcactccatttatttccatggacgcatatgaagccacaaggattgtcttctcaagaatccaaagtttagaccctgagaatgcctccaagatcatgggtctcctcctcatccaagatcatggtgagaaggagatgatcaggctggctcttggaccggagactctgcttcactcagtggtcctcaaggcaaggaaggacataatccttccgtcaaactctccctcaacgccctccacaccttcttctccctctcctttcatgtctaccaaccccatctccatctcctccaggcctaaaggaagcaacttttcgccatcttctctctcaaatatccccagcccatcttcttgggggggtggtggtggtggtggtggttctttctctgatctctcaagtggagatgatttgatcaattcttcctcttgtttgtatggaaatggaggcagtgacaccatgattgatgagcttcagctccaagaccagctttccttcctcaacgataactccccaccccttggacccaacagcaaccctgatatgttctgcccccagcaggacttgctgtccagtcccaccgccgtatacggcggagcggccgcgggctggggcgccccggtgcaccggaggagctgctcggtcagcgatgtgtgctcgggttcctcagaagacccatcttgtggagtcgggtggaggccatgcttgtattatgctagagggtactgcaagaatgggatcagctgcaggttcttgcacagtggtggacttggcgatgccgcttctgtggtcggcagcccggacggcagtgcgtccgcggtggtcggctccccgagtaaagtggacatgatgggccagtgccatgaagctgttctgaggtccaaatctgctcagcagcagagactagctgctgcttctcagctcataggttctgcaaccttcccttacactcccaaatccatgaatttacttctccatcaccagcaaaatgatgctcatagggctgctgctgctgctgcgctgatgatgggtgatgacttttacaagtatggcagatcaaggctagaaaggagtgatttttcagtgaatggttgtgtgaatcctgcttctaggcagatttacttgactttcccagccgacagtactttcaaggaggaagatgtttccaactatttcagcaactttgggccggtgcaagatgtgagaattccttaccagcagaagaggatgtttggctttgttacatttgtttacccagaaacggtgaagctcattttggccaaagggaaccctcattttgtttgtgatgctagagttctcgtcaagccttacaaagagaagggaaaagtgccagacaagttcaggaagcagtcccagctggtggaaaggggtgatttttcgccttgtggaactccaactgggttggattcgagggggggaccatttgacctcaacctcggagcgaggccgttttacaattctcaggacatgctgtggaggaggagattcgaggagcaagctgatcttcaacaagcccttgaataccagagtcaacggctgatgagtctgcagcttctagatgtcaagaagcatcatcatcagagggctctctcaactggctcccccattccatctcctgctcaatcgcctactttgttcaacaatccaaccttcctcaacattccttcggttcgcagcctgggcgtcacagaagagaatggttctagccctggcttatccgacagtcagcccttgaactaccagtctgtgattgtctctgctgggaaagatttgactggaagtgacaagagtaatgggaatgacaaggaaagctcccatactgaagataaaggcttggctgaaagtttggagcataaccttcctgatagtccctttgcatctcctactaaagcctccgcagagcacttctcttccttaaccaatgtagtcagcgaggctgaaaaggatggtgtaggttcggcctcatcttctcccaacagcaataacccagtctcttcacccttgatcccgggcacctccgccatggacatggcttcattcacgtctttcaactgccagattcctgccataggaatgtatgccggtgctggagggccaacatgcccagtgggtatatagctagctcttccttgactgagggagattaacaacaataaccaaacaaacccgttatcaaagaccagatctgtagagaatccgtaccactaccatcacctccaccactacctcgattatccatactatactactggataccatacaaaaatgcatacgtaaaaaaaatgactaaattaagtgggatagcccaatctcctttgtgctattttcacatgtttttttctagttgcagtttggaccaccaggagaactttacagtctttgtgcagtattttaaaactcacagagctgtaaatttcctcttcttcccgttttcaagtttttactacggcccctcctttgggagggtggcggagtccataattagcaacagtcttctattagtttgtgttgttagggtacaagaaagatcaaatctttgtacagcaagaagaatcgaagaattcaaagagccagggagtggccaaaaaggcaagaagtgacgacaagggctgatttttcatccccgtgaatggtaatttggaagtgaaaggaggggagagatttgaaggggaggaacggatgatgggagaggcagagatgaatagaattttagtcagctcagttttcaggtacaaatttgtgaggtcgattattaaatgtttgatgtttactgtagttgtttattatacaacagtttgtgttcaactactcatgtggatcagagagacagaaaaggaactagtgaaagatcagcacccagaaagaaagaaatcagtttcacaatttatgaaatggctctcctctcaaaaaaaaaa

SEQ ID NO: 181 - DNA, 1063 bp, Eucalyptus sp.
gaatccctcaaaaacttaattttttttttcccagaaaaattcgaaaacctccaccaccaccaccatcgatggacaacgcccagcagcaaccccagcccaactcctacccgccccctcctccgccgcaggcggtggcgtcgggcggccccggagccccgccggcgacgccgttccaccacctgctgcagcagcagcagcagcagctgcagatgttctggtcgatccagcggcaggagatcgagcaggcgaacgacttcaagaaccaccagctccccctggcccggatcaagaagatcatgaaggccgacgaggacgtccgcatgatctccgccgaggcccccgtcctcttcgccaaggcctgcgagctcttcatcctggagctcaccatccgctcctggctccatgccgaggagaacaagcgccgcaccctccagaagaacgacatcgccgccgccatcacccgcaccgacatcttcgacttcctcgtcgacatcgtcccccgcgacgagctcaaggacgaggccgcgggcctcggcgccgccgccgccatggtcgggccgccggcgagcggggtcccctactattaccccccgatggggcagcccgccgcgccggggatgatgatcgggcgccccgccctcgaccccgccggcggagtctacgtgcagcagcctcctccgccgtcgcaggcgtggcagagcgtgtggcagaccgccgcgcccgacgacggcgcctacggcaagccgggggatctcgatggcccagggtattgactctgaatcttctttggtgacgcacaattgaagcaagcagactgatattaaggacttaacattagaattttatctgatgtggcaaagggttaatgagctttgctgatgttaactgaactctttatccgcccctgcaactgttaattatagtgtgtttgggcagtgtttgttagcaaatgtatcgacttccaccaaaaacttgtgagaacacagataactatattttgtgagaacacagataactatattgagtgtagcaacagaattgctactataactcaaaaaaaaaa

SEQ ID NO: 182 - DNA, 1314 bp, Eucalyptus sp.
ccaagatcagatcttgcccgtgtgtacggcaccagatcgctcttgggaaaaagccttcccttttaatctctctgcaacacactttccattcaccacgcaggagaagaacatcgtatcagatccaaaagcttctctgacatatttgccttttcttgctatttttttccggcttccctccccttttccacggactcgagtctgcacgtaaaagaagttgtgcttgaatcaagatggatcagcaaggacacggtcaacccccaccgattggggttgttcctgccgcaggtcaattgccctacggcacgatgccttatcagccaggccagatgatcggcccttcgagtttcccgcatattcagccgactagccagcctcagccgccgggatcccagcttgcacataaccaactggcctatcagcaaattcaccagcagcagcagcagcaactgcagcaacagctccagtctttctgggcaaaccagtatcaagaaatcgacagggtcgcagacttcaagaaccacagcctccctttggccaggatcaagaagatcatgaaggccgacgaggatgtgaggatgatctcggccgaggcgccgatcgtgtttgctagggcgtgcgagatgttcatcctggaactgacactgcgctcctggaaccacaccgaggagaacaagaggcggacgctccagaagaatgatatagcagcagcaatcacccggacagatgtctttgactttctggtggatattgttcctagggaggagctgaaggaggaagggcttgggacagttccaggaggagtgctccctgccagcgggcccgtggatgggctaccttattgctacgttccgccgcagcaggtgtgtcaggctgggcctccggggatgtttgttggtaagggtgtggttgatcctgccatgtatccatatatggctcaacaaatgtgccccgagacatcagagcaacagcaatctccctcagatcatcagtagttataatactgagtagagaatatattctctctccacatattggccagttggtatctgaagaatggaatgagaggccttctgagttgataacctgattctgactggagaagagtgaagatgatgcataacatgattgttaagagtagccgatcttgatttagtctatgttaccttctcagtttccctcgttttagttacctgaagatacaaaattagttgtcattttggcatctgatttgttgaaaaggattgtgtattcattctgcactaagttctacaccttctccttcaagtgacttgatccttatcctcaaaaaaaaaa

SEQ ID NO: 183 - DNA, 1262 bp, Eucalyptus sp.
ctatcacccgcacccgtggccgtcgtcttcgctcctgtgcttcctccggtctagggcttctcaagtctgacttcgcgtcctcctcctgtcttggcgtcccacggcgagtccctctctctaccccccacttccctccgttcgaatttctcgaaggcgagtcgttggaaggagctgagatgttagtgatgccggggagggccgaaaatatagatccacagttagaacaaggaactcaaagcattttgcactcttcgctgtatgtgcaaccttggtggcatggagctagaaacagtatgtcagttacaactgaagatgggagtaataggcaagaggagaaacatgccaagagtgttgtatcctcaatgactctttcgactggtgaacatcttggagtgaattcccccagggaacttgttggtcactcaattgttctgacctcatctctctattcagatccgcaatttggtggtcctctgacttctttctatggacctcaagccatggtaccgcatctttacggggttcatggtagaatgcctttgccccttgaaatggcggaggagccagtttatgtaaatgctaagcaatatcatggtattctgagacggagacgaatacgagcaaaggccgaacttgatagaaaagccgtaaagggcagaaagccatatctccacgagtcacgacaccggcatgcgatgagaagaccaaggggttccggaggccgctttcttaacacaaaaaggctggatagtgatgattccagctttgcagcagaaaaagctgtgaattccagtgttgatctgccaacacaatttgttaagacatcaactgctcaaggctttcaaactaggtccatgagagcagattcaacaggctccaatgggaatgctagtgccaatgggctctcataccaaggtataagctgccttggtgcggagaaggaaaccttgcagctatatgagggccctaatggggcctacaaatagctaaacctctctacgtgggggtcccatggagctccacattgcttgtgctaccgtcttttatttccgtaagaaatagcagatgtgtgcaaggatatgcagctttcccgagtggaggaccctcagtttgctgtgctccggcaactcattcttggctgatacgtgctctttaaatatctatgttcttcaggaagagagttctcactggctggcttatcaagttgccagccgttgtcgtagtggatgtttgaataatctctcttctgttcaaaaaaaaaa

SEQ ID NO: 184 - DNA, 1653 bp, Eucalyptus sp.
aatcgctggagaaatcggattgacttgcctttgaattcctcctcctccggggaaaattccacaccgaacttccgctttgggggggccgccggaaatctagggctccgctccgccgtcctcctccgtcgtccgcaggtccatctcggtttcaaatgctgttatatttttgatccaacatattgtcggagagcaatagaatctggcgttatgcagccaaaatctaaaatttcaaacggggtagatgctcatccacatagcatccagactagtgcagtattcactgaaccctggtggcgtggctataatactatttccccagctgacccaggaagaaacgaaacccatgcgcctttaggatgcataaatggtggttcagagtccaatggtggtcaatcacagtcaaatgaggaaagggttgaggaagatgatgatgacgataatgtcaaaggatcagggaaccctgcatgttcaggagcagttggaaatcaaggacaagggcctcaaaacgggcatggtgctcccactattattacaatgcgtgatgatggccttgcacaacctccccagctagagcttgttggtcacacaatcgcatgtgcatctaatccttatcaagatccatattatggggggttgatggcacaatatgggcatcagtcaatggcttatccttttgtcggtattcctcatgctaggatgcctctgccccttgacctggcacaagagcctgtttatgtaaatgctaaacagtttcaggggattttgagacgaagacaagctcgtgctaaagctgagcttgaaaagaagctgatcaaagttagaaagccgtatcttcatgagtcacggcaccagcatgccatgagaagagccaggggaactggagggcgctttgctaagaaaagtgaaaccgatgcttcgaatgatgcagctgaagagaagggcacaaactctggtccggctctgtcctcccaatctgccagttcatcgggctctgagcctttggcacctgactcctctgaaacctggaattcatctagtaatcacgtggcaggaaggtcgcaagtgcatggaactcacagaggtcatgactacgtgaatgggaacagccagtacaaaaatcacggccacttccaggcctcagcatattcaaatgaaagggagagagatcgctttggccagcaacccagagagcgtcttctctagcggggttcacgaaagcctgcgtgggccccgtggtgcaggtattgggcccaccactaattacgtaagaaggctggtggcatggtttcgatcccgcaattcttggcaatctgtttgcggggcggcaattcattcttggcttttgttctttgtgtttatggtggcttgttggataaaaggaggtgccgaggaggagatgaagaacatgggcatgtgagtttctggatgtccactttttcattttcccccaacctaccttgttcttttagtcgtgtacaggagtaggtctctctgttgtgaactttagaccaaaattttagcttccagtcagacagaacatccttcttaatgcttgaatcttaggtcatcatagctcagaaagaataacgacaatttgatgaactgatttttctatttggaccagatttgcctttctttttagcaaaaaaaaaa

SEQ ID NO: 185 - DNA, 964 bp, Eucalyptus sp.
cctaaatcagctgcgaagtcgtcttatcctcttcgattcctgaagaatcgtgtcgctcttctcctcctcctcgacgattaagaatccgattttgatcgcggcggtcgatcgtcggcggctccgattcggcggcggcggaggcggaagatcggttgctcggcgcagcttcgcgtttttccggctcgaatcgcgctgccgggtgaggtaggtgagtgtcgggatcgtgtttttccggaggtcttcgcggcgtcgcttctgtttgatcggattgtggtctgattagccccccctaacttacgccggcgtgtttgggttagggttcggttcggttgggggtgtttcgaagatggacccgatggatatagtggggaaatcgaaggaggatgcgtcgctccccaaagcaactatgacaaaaattataaaggaaatgctaccgcccgatgttcgtgtggcacgagatgctcaagatctattaatcgagtgttgtgtagagttcataaacctggtgtcatctgaatcgaatgatgttggtaatcgagaggagaaaagaacgattgctcctgagcatgtactcaaggcattagaggttcttgggtttggggagtacattgaagaggtttatgcagcttatgaacaacataagcacgagacgatgcaggattctcttaaaggtggtaaatggagtaatggagccgagatgactgaagaagcattgctagcagaacagcaaaggatgtttgccgaggcacgtgccaggatgaatggtggggcagccgtccccaaacaagcagatgtagactctaatgtagagagctaatttaggaccttgatttccttaaaccataggcaagcatctctaactcttttatatgtgcttctgatctcctcttattttgtacagagccagttgggaggtagtctggcttttgttgatatcattatacgttccgaggtcgacgcggcc

SEQ ID NO: 186 - DNA, 1186 bp, Eucalyptus sp.
gaggagttgcgcggaattgtggagagtttgccgagctgtagctgagtaaccgttgctcttccggccccgtcgcctgagaccacagcttttaagccttttttggtcacgatcagacattgggcttgggaacttacttgtatcatccttgatgacttcctctgtgcatgacatttcagaaaatggggaagctgatgaacagcaaaaacattcagaacagcatgagtcctcccctgcaactggagtgcctcatcctggtgtctctttgcccaatgtccaatatgcaacgcctccacaacttggagcgggacatgccatgacaccacctgcttacccctatccagacccttattatcgaagcatctttgctccctatgatgcgcagtcgtacccgcagcagccctatggtgcacagcctatggtccatctgcaattaatgggaattcaacaagctggagtgcctttgccatcagatgcagttgaggaacctgtatttgtcaatgcaaaacaatatcatggcatcttgcggcgtcgacagtctcgtgcaaaagctgagttagagaacaaagctcttaaatctcgcaagccttacttgcatgaatctcgacatttgcatgcattgagaagagctagaggatgtggggggcggttcctgaacgcaaagaaggatgaaaatcagcagagcgaggtttcttcagcagacaaatcacagggaaatatcaatctcaactctgataaaagcgatcgctcctcctgaggtgcaacttcctgatcaatgcaaagtaatctctttcgtgcatgaatcatgcctgttcatcaatagatttcccctacctagcctagcctcaccaattgccctgctcttctgcttgtaggtcagtctctttagttggtagtgtgaatctgtttgtagttctgagggaaacctgctgcatagatagtagtttcgagtaggtcttgaagatgttattgctcgtacctcttctggcattaagaactagatgttctattcggccattgtgatcgagtatgtcgctagtttgagttcgtagaaagagagtcgtcttgttcttgttacattatgatgctccggtggtgtatcctaggatgtattggtggtggtaatgtatcattagtccctgtacaaatttattgtcaaagagaacgggacaataagctaaaaaaaaaa

SEQ ID NO: 187 - DNA, 1186 bp, Eucalyptus sp.; identical to SEQ ID NO: 186

SEQ ID NO: 188 - DNA, 1016 bp, Eucalyptus sp.
gtcttcttcttcctctctctgcgcgctctgccctttcttctccgtcgtcagatctctccctcccttataaaaaacccccaaaaaaaaaaaaaaaaaaaccgcgacgcgcgcgccaaatacgaatcgaattctcactcctcctctctcccttcctctcccttccaggctgggttattgataagatggcggaagcaccggcgagtccgatgggcggtgggagccacgagagcggcggcgagcagagcccgcagtcgggcggcgtgagggagcaggataggtacctgccgatcgcgaacatcagccgcatcatgaagaaggcgctgccggccaatgggaagatcgccaaggacgccaaggacactgtccaggagtgcgtctccgagtttatcagcttcataaccagcgaggcaagtgacaaatgccaaaaggagaagagaaagacaattaatggtgatgacttgttatgggcgatggcaaccttggggtttgaagagtatattgagccactcaaggtttacctggctaggtatagagagttagagggcgacaccaaaggttctgcaaggggtggagatggttcagctcgaaaggatgtttcaggaggtcagcctggtcagaatgtccagtatgttcagcaggcttcattgaatcagcctgtgggctatatgaatccacagtttggtcaacagggctcagtaaattacgtcaatgcgcatcaatgaatcacattagttctttttcagacatagatgcagcatatgcaagctattacggtgggaggtgaagcatggtgcaaggagctcctcttctatagatattatggtgaatggcgaggtagatataggcgaataatattgaaaaagcatctttaatgtcgttatattacttcacaatatggtgtacttgtaggtctggaatagtgagggattgaaagttgacatctaggatgttttgttcttaattaggaaaacagttacagttgcctgatattctgtaaatttgtttcaaaaaaaaaa

SEQ ID NO: 189 - DNA, 2607 bp, Eucalyptus sp.
gccatctcccgccttcccgcttcgtcttgaatctctctcctcctccttccctccctccctccctccctcgcttccctccttcacttcacttcacttggccgcacacttagcacgcgcgcgcagagagagagagagagagagatgcgcagcggcggttggtgggtctgcggagatggacacgcctgagaagacccagatcgccgctccccccgtctctgcccacgaggactccccagtttttaacttcatcagaagtctctcgcctatcaagcccgtgaaatccacacacatagctcagactttcacctcacttcctttcacagcccttccctcagttttcacttcgcctcatgccaattttcacaaggacccgagttttctgcggaggcatcaaagcttagatccatcaaatcccgattgttcttctgaaaaccacaatatagtctgccgaaatggggattttattaatggcatttctcagagaagcaaaagctctgacaaaaaggtttcagttgaagttcatgctgaaccatgcaaggaacattcagattttgcaactgagtttcctcagacctcgaggtgtggcttctataatccggaaggtaacatgacaacttgttctgctggtgcagaagctgcagtagagactgctggtatgttgacccccattataccggtggctatgaaatcttctgggaaaccacttcctgaaggtgaaggtcaacaacagaaagaatggccaattgatgctagtgacttgttcatttttagctctcctaatgatgttgaggcatttagggagcttgttcatagatcacctgattttggaacagcatgtttaagttctctcatgtcaaggttcacaccagatgatgtcagtggttttgagagatcgcagcaggtggatttaccgtctagggaacaacaacaaatagaacccccatatccaactgatgaagcgtacgggcaaaaggaagcaattaagaatcttgattaccataatctggataaatttttggataagtatatgtcaatccagctggacaagaattcacacaatgatgcaggaacatgtgtgccttttgattacacgcctgtccctaatttccatcggggcttgaggaggcgttgtctggactttgagattgctgagcttcgtaagctctctggtgacgattcggattatagtcacattgcattatctcaacatgatgaaaacactcttgtgaacgatgggcagctgcctgttgaaagtgaaggtgatcccttgaggtgcacgttacctggaattggtctgcacttaaatgctctggcgaccacttcaaacgactaccaaagtgtagaacatggaaatttgttgagtgaaaatcagttgatgaacacgcaaatctcttctagctcattgaatcttcccaattcccatcaatctcttcatgaatctttgacttcagttgcttctgaggacataggttctgccgataatggagtcctagttgtacaagatggttcgcagtcatgtgcatatcctgacagtgaagagcttgaccacaacagtcctcagaaaaagaggcgcaaagcagagcattctgaagatacggcctgcaaacgctgcaactgcaagaaatccaaatgtctgaagctttactgtgaatgctttgctgctggtgtctactgcatcgagccgtgcgcatgcctagactgcctcaataagcctattcacgaagatactgttcttgcaactcgcaaacagatcgagtcacgcaacccacttgcatttgctccaaaagttattagagcttccgactcttttcctgatactggggatgattccaataaaacccctgcttcggcacggcataagaggggatgcaactgcaagaaatctggctgcctgaagaagtattgtgaatgctatcagggcggagttggttgctccttcaactgcagatgtgaaggttgtaaaaattcattcggtagaaaagacggatctactctaaatggtgtggaggccgaaataattgacgaagggaaggaaaatatcggaaaaagcgtggggaaccaacgttctctggaagtcgcaaaacagagggatccaattcaagcaacgccatctgcatattacggaccatcaattcagactacatattcagcgaagaatgaaccgccacgatccacatctttggtcaccaccagctcctcttcagtacttcatgcgggtcaaaatcaggggacacataaacatgttgccccgcagcctgagtttgagaagcattacgacaatgataataataatagtagtaatgctggtggcaagatgccagaggtgctccgaagcaacgacactcccaatgcagtaatcaaaactgcttctcccaatggcaagagggtttcttcaccgcatagcgactttggttcctcccctccactgaggagcgggcggagattgattttgaaatctataccttcttttccttctctcacccagcattgagacggtgagagtgacttggaatagttggcttagtggtcttgtttgtggtagttgtatgctttagaggccctattgttgtatcataaaatgtttttcctttgcccataaaaaaaaaa

SEQ ID NO: 190 - DNA, 2744 bp, Eucalyptus sp.
ctctcgctctccctctcttcctcccgctctcggaggagatacccagaaagggagaggccttagaaagagagtgagagagagggagcggggggtggtttggagagagaaatgtgaagcagcttcttctctggaaatggatactccagagaggaaccagatcgccgctcccatctccaaattcgaggactccccagttttcaattatatcaacagtctctcccccataaagccagtgaagtccatacgaatcactcaggcattcagctcactgacttttggatctcttccgtccattttcacttctccacatgtcagttcttctcacaaggaatcgagatttctgagaagccatcaagactcagatccatcaaatatcggaacttcttgtaaagatgagaataaaattccaacagctgaacgcgatgtttcggatgtggctcagttggctgaaaatgaaagtgagctgcaggaaaactttgatatcttggttcccattggagaatcttctgttgagccgcttgatgagcaccaagaatttgcgcttgacctgccgcaatccttaaagtacgactgtggcagtccaaattccgacccaacgccatgtagcactgctgcagattgtactgtgtccaagtcagatgctcctgttgttgaaaaaaattcccaaatagacttacctgatggtaggtcacatcaggaggggacttctcaacagaaaaatgatacagggtgtggatgggagagtttggctttagagtcaactgaccttttaatatttagttcccctaatgatgctgctgcttttaggggactgatccagagatcaccagatgtagaggtgggatatttcacttctatggtgtcaaattttcctgagaacgaggttagtgaagaactgaaaaagcagttactgtatcaactcacttttaacgaacagcatgaagcagaggagccttcttgtcagcctgtagatcccagcgaacagaaagacacaaatactttgccgaatggtgtcgcgataagcaatctggataatcacactggtacttatttgagtgtaaatatggataatgaggtgggagcgcatattccatttgctaataagcctatctctgatctacctcgtggtatgaggaggcgctgtcttgattttgagatggtgggaactcagcagaagagcttggacagtggttcaggtggtatttcttcaccactacttaaatccgatgagaatgatatcccaaaaaataagcaactggtcgttgtcaaaggtggaggtgattcttcacggtgtattgtacctggaattggcttgcacttgaatgctttgacttcaactacaaaggactccaggattgttaaacatgaaagcttgttatctgatgtccaagcattaaacgtgcacatgtccacaacctcgttgcagtctcccttgaccaatcaggagtcgcttcacaagtctttgactttgagtaatgctgaagagatggaccatgataatgggcttcaggttgctgaagaagtttctcaagcacccactgatctgaactatgaagagaatggccagactagtccccgaaagaaaaggagacgaatggagaatggcggagaaagtgagacctgcaagcgctgtaattgtaaaaaatcaaaatgtttgaagctttactgtgaatgttttgctgctggtgtctactgcatcgagccatgtgcatgtcaagattgcttcaacaagcctattcatgaagacactgttcttgcaactagaaaacagatcgagtcacgtaacccgcttgcatttgctccaaaagtcattaggtcttctgaatctgcttctgaatacggggaagattctagcaaaacgccagcttcagcacgacataaaagaggatgcaattgtaagaagtccagttgcctcaagaaatactgcgagtgctatcagggtggtgttggctgctccattaactgtcgatgcgaagggtgtaaaaatgcattcggtacaaaagatggttctgctttgagaggaccagattgcgaagaagaagaagagactgagaagtgtgaaaagaacaaagcggagaaaattccttggaaaatggaaaatgagaataatgatgaactaaatttagcttctgctcttccaagcacaccatctgggtttcgcagacctttggttcagttggcatttccatcgaagctcaagcagccgcgttcatcattcgtcaccattggatcctcttatgcattgcactctagccagaaaatgggaaaaccggatcttctactaccgccgccaccgaaattcgaaaaacttcctctaactaatatggaggacgaaattcccgagatcctctgcagcagcagcacgccaacggccagcataaagagcacctctcctaacagcaagagggtctctccgccacacagcgactttgggacctccccgaacctgaggagcggtcggaggttgattttacaatcgattccatcctttccttctctcactcctcaacactagaagtgagccgtatcatgattttctgctcgagaatcgccttggtacttccttgaacttcgcctcgttgagaggcttgttgctcaattgcaatttttaagtgtctttttctttccgatggacgcgcagtataataaaagctgtagcatgctcttaagaataccgatgtatattgtaaaatagtcaagtttcagttgattcaagctccacagttccttttgcaaaaaaaaaa

SEQ ID NO: 191 - DNA, 1596 bp, Eucalyptus sp.
ggaagacaagaggcactgggcggaactgggcggcgtctgatgctccccccccttgttctccttcaaacccaactttttcttgagcggtagtgatggtgattgggagcagtagtagcaatcacaatcaccaagaagatgtggagaggaaccctgtggcggcggcaggggcaacggcgggggctgcggtgcccagaagcggcggagggggcggcagcaggtcgtggggcaccacggtctcgggccaatctgtgtcgaccagcggcagcatgggttcgccgtcgagccgcagtgagcaggccatggctactccggcgagcgagagtacttttctccgcatgaaccaccttgacattcaaggggatgatgctggatctcagggagatgttggtggcaagaagaagaagagaggtcagcgggcagctgctggtgataagagtggaagaggacttcgccagtttagcatgaaagtgtgtgaaaaagtggaaagcaagggaagaactacttacaatgaggttgctgacgaacttgttgctgagtttgctgatcctggcaatagtgctgctacccctgatcagcaacagtatgatgagaaaaatataagacggagggtgtatgatgccctgaatgttcttatggcgatggatattatatccaaagacaaaaaagagatacagtggaagggtctgcctcgaactagcctaaatgacattgaggaactaaagacagagcgtcatgggttgagaaatagaattgaaaagaaagcagcctatttacaggaactggaggaacaatatgtaggtctacagaacttgatacagagaaatgagcagctgtttagtacgggaaatgctccaaatggaggcattgcattaccatttattctggttcagacccggccacatgcaactgttgaggttgaaatatcagaagatatgcagcttgtgcattttgatttcaacagcactccttttgagctccacgatgacaactatgtcctcaaggccatgaaattttgcgaaacaccgggaaacgacgagatggtgcccgtgtttccttctgatggaggcgaaggctccagcatgtcgggcatgtaccaaccacagcctccgtatcctccaatgtccagcgcggcgggtaggccggccgcctctcctcctctacccggaatattgaaggcacgcgtcaagcacgagcattgatcatttcatgccatggcaatatatctcaccatagctgtatagtctgtaaagataaatgggcctcgaaattagtcatgtggttgccataaccctctttcattaggaaatcacgattaacatagagatggtaactcgctctgtcaggagatggtcgagaggttttggatctctggcttctgtttttgtgccattgtcaaattatcagtgctgcaatttgttcatggtttcctccgctcgatccggggtttagaaggaatcgtcgttttgttctatttttcttggaaggtgactgtataagatcattgatctctcatgtaatcgcactacaacaacattgtttctgcaatgtcatagtccatggatgtacattttggatattaaccttacaaaaaaaaaa

SEQ ID NO: 192 - skipped

SEQ ID NO: 193 - DNA, 2460 bp, Eucalyptus sp.
gcccacctcccgtttcgcctctcctctttcctctctctcctttctctctctctctctctcgaggataaacagaggacgcgaaaaggaattgactcggggggtgggagtcgcgccaggagcttcttccctgcgctgagatctgatgctctgatttctccagtgtaacgggaacccagcaaatccagcaacctcgtgcgtcggagtcggtgttcaccgcttgttttcggattccgatcttataagtttgtgagggttttgtggttttttcgtggaagatctatatcagaaaatgatgatgttcgaggatatgggaatctgtggcgatctggacttcttctctgcccctctcggggagggacatggggttgctccgcaaactgagccagaggccaccgtggaggatgattattccgatgaagagatcgatgtggatgagctcgagagaaggatgtggagggacaagatgcgtctcaagcggctaaaggagcagaacaaggggaaggagggagttgatatcgcgaaacagcggcagtcccaagagcaggcaaggaggaagaagatgtcgagagctcaggatggaattcttaagtacatgttgaagatgatggaggtctgtaaggctcagggttttgtgtatggaatcatcccagaaaagggaaagccggttaccggggcatcagacaatctaagagaatggtggaaggacaaagtcaggttcgatcgaaacggtccagccgccatagccaagtaccaagccgatcattccgttcctgggaagaatgatggatgcaaccccatcggacctaccccgcacactctgcaagagcttcaggacacgacccttggctcgcttctgtcagcactcatgcagcactgtgacccccctcagaggcggttcccattggagaaaggcgttcctcctccatggtggcccactggaaacgaggactggtggccccagctgggtttgccgaaggatcaaggagccccgccctacaagaaacctcatgatcttaagaaggcatggaaggtaggtgttctcacggcggtgatcaagcacatgtctcctgatatcgccaagatacgcaagctcgtgaggcagtccaaatgcttgcaagataagatgacggccaaggaaagtgctacttggctggctataataaaccaagaggagtctttggcacgagagctttaccctgattcatgcctcccactgtcctcatctggagggagcgggtctttggtcataaatgactgcagtgagtatgatgtcgaagggatggaagacgagcccaactatgatgtacaagagcgcaagcctgagaatctcaacccaccatcccatctggggctggagagaatgagaggtccttttgtccagcaatcgcctttcccaatgaagggagaagttgtcagcaacttagatatggcgcggaagaggaagccgtgcaatgatttgaatatggtgatggatcacaagattttcacctgtgagttcctgcagtgcccttatagtgaactgaggctggggttccgtgacagaacctcaagggacaatcaccagctgagctgcccttacagaagcaattcttcagagtttggcgggtcaaacttccatgttaatgaggtcaagccagtgattttccctcaaggttttgtccagtccaagcccatgacttcaacggtcaattcagcatcaaccccctttgatctatcagggcttggagttcctgaagatgggcagaaagtgatatctgatcttatgtcgatctacgataccagcatccaaggcaacaagaacatgaatcccgcgaatgatgcgatcatagaagaccagagccgtcctcagccaaagcttcaacaacaaaacgagtttgtgggatcattctttcagcaacccaatgcttccgccaatcatcacatgttctcccgagaggacattcagttcgaccggttcaagaccatgaattcttcgttcgaggccaacaaccacaaccacgacaacctacagctcatgttcgggtctccattcgatttgtcgtctttcgattttaaggaggagttgccaggtggggtcatggatcccctgccgaagcaggatgtcactatatggttccagcaatgatttctgcgtgctcagcttctcgggcgttcttgggaactgtatatttctctgaagagagatctatatacttaactgtggtctcttgttagatcgagtttaagttttcttggccaaggtctttgcttagcttatgtattctctcgaactttgttaggtgtagatttagaaagtttaggcaggggtttagatggggaaataagatattagacaaggacccatgactagccctgcttgctgctgaatatataaaaatgttgtctgatcaagtgattattctactagactgtcctataaataagtgaggtgcgttttcttttaaaaaaaaaaaaaaaaaa

SEQ ID NO: 194 - DNA, 2535 bp, Eucalyptus sp.
gctctgtctctgcgtgcgtcactgaggaatctgcgggaggaggaggaggaggagaatgatccggagattgaacggggactgaaccgtatcgttcgcatcctgggatcatgagatgtatcttgagttggatccacaaagatattgaaacgttcgagtgattaagatctgcttgattctaggtcggtttggggagtgaggaactgcgaaattaggtcgaagcaaagtcggttttgccgccttcttgtcatagatgggtatcctcgaagagatgggcttcggcagtagcatcgacttctcatcagctaatccccaggaggctgatgccgaacaggaaaccgaggctgtcgtggaggaagagtacagcgacgaggaggtggaggtggatgtggatgagctagagaagaggatgtggagagacaggatgctcttgaagcgtctcaaggagcagagcaagaacaaagaagttctggatggcgcgaagcagcgccaatcgcaggagcaggcgcggaggaagaagatgtcgagagctcaagatggtatactcaaatacatgctgaagatgatggaagtgtgcaaggcccaaggcttcgtgtacgggatcattcccgagaagggcaagccagtgagcggtgcctccgacaatctccgagcctggtggaaggaaaaagtgaggttcgaccggaacggacccgcggcgatcgccaagtaccgggcggaccactcgatccccgggaacggcgaggacgcggccaccatcggccccattcctcacaccttgcaagaactgcaggacaccactctcgggtcgctcttatcggctctgatgcagcactgcaatccaccgcagcggcgattcccgctggagaagggcgtggctcctccgtggtggcctacaggagaagaggagtggtggccccagcttggcctgcccgccgaccagggacctccgccctacaagaaacctcacgatctcaagaaggcttggaaggtgagcgtcctcacggctgtcatcaagcacatgtcgccggacatctccaagatcaggaagctcgtccgtcagagtaaatgtctgcaggataagatgaccgcaaaggagagtgccacgtggctcgcgataatcaaccaggaagaagctctgtccaggaaattgtaccccaatagcttcccgcccgtgtgttcggacagtggatttgggtcctatgtcatcagcgatgctagtgattatgatgtggaaggagctgatgatgaaccaaagttcgaggcggaggaatgcaagccttttgatccaagtgcttttggcatcgggccaagggtgtctacaggcgagcttttgatccatccactggtttctcaaatcaaaggagaagttcatgaaaccaaaaccaattcgcggctagtttcaaagaggaatcaaccatccgatgagccgaaggcgaagatggatcagaagatatacacatgcgagttttctcaatgccctcacagtgatcacagcttcggttttcttgataggacgttgagaaataatcaccagctgagttgcccttatcggagtaagcctatcccttcccaggccattggaatttcaaacttccaagtgaacaatggccagcaagcagcctttcttcattcctttgctcaacctaatcccagtcctcctcctggaactcatactccgtcttttaatatacgtggaattggacttcctgaagatgggcaaaagacgatatccaatctcatgtccttctacgatgtgaatctccaacagaacagtactagtgcagggaaacttggtgcaccttcaaatgagcagcagttgctgaatgttcagcatagcatgggtgatagcttatttgctcatggagctttcatgggaggcaaaacgcatgaagagataaacttacccttgaaccattcggtctttccatcgatgggcagtcaacatgatcaaagcaaggcatttgattctccgttcgaattttgcctcaatgatggtacggtggactctcgatttggttctccatttagtgtgactgcggctgcggccgactgcaataggatggatttgcttccaaggcaagatggctttgtttggtaccgttgaagccactgcctgtgtctttgcgtcatgattttctcagaactgatgtaagagaaggagcattggacaagcagaaaagtaccaatctgttgtttagtttagtttagttttgctgcaagttggttgaagattttggtgttgaacttagctggatttgcctgtttaaaattggaaaatcgagatgtcgggtgtccctcctgcagcatgctctataggatggatagtaacttacaattgcatttgcagtaactgaagagcagagaatttggtaacaagatggggaagaaacaaaaaccgtactccatggtccctagtgtcctaaaatttcatgctttttgtaattcgttttcttgttggaactctgctgatactgggcttgtaaaaaaaattcttatttggaatatacatacaatagtagcttctgaaaaaaaaaa

SEQ ID NO: 195 - DNA, 925 bp, Eucalyptus sp.
agaagatgttagttaagtgggcagagcatttcccacattataaagcaagtcaattttgtatttatttttttaagaccacatcaagccactgaaaatcactttcagaggttcttctttagcatttatagcttctctgatctgatctgatctagcggtttattctgcccacccctaagatctgccaattcaaaaccacaagctcattggtcaccatccgcaactccagtcttcgagcaggcagggaacaacaggcatggaggtgggtcagatgcagaggaggttggtagagttcaccaaatcattgttcatggaggattctgagaagctgctcaatgatctgacgtcggctctagagcagcaaaatgtggactttaaaaaagtcgatgcccatgttcaccagttgaagggcagcagctccagcataggtgcacagagagttaaaaatgcctgcgttgtgttccgcagcttttgcgaagaacaaaacctcgaagggtgcatgagatgtctgcaacaagtgaagcaagagttctaccttgcgaaaaacaagtttgaaactctgttcaccctggagcagcaaatcgtggcggccggcggttcgatcccggcgatggaaatcacgagtttctaaggatttagaaagaacatcgacgtacccctgctatgccttggagaatccgttaaccgattttgcgaattttcttgggaccataagctcaataagtaaccatgtctctgggtggtctccactgagaaagatgtctctctcttctatgtgtttgtaggtctccttaaacaggaacatatttctgtgtagtctagcgtttttggctatatttgggatttaattctgtactttcttaagctgatgggcagtggaggtggccttattacaccacagattttggtgttcaaaaaaaaaaaaaaa

SEQ ID NO: 196 - DNA, 744 bp, Eucalyptus sp.
ttttgaatgaatgaagaatctctgaaactataacgatggatgtagctcagttgaagcggcagttatttgagtacaccactctactatttcacgagggatttctagatgagcagttcactcagcttcagcaactgcaagatgagaacaacccagactttgttgtggaggtggtgtcactgttctttgatgactctcagaggcttctcaatgagctggccaaagcacttgatcagcagaatatcgatttcaagaaggtggatgctcatgtgcatcagctgaaaggaagcagctccagcatcggcgcacagagagttcaaagagtctgcattgccttccgcaactactgccaggacaaaaatgtcgaagggtgcctgaaatgtctgcaacaagtaaagcaagagtattccctgcttaagaataagcttgagactctgttcaatctggagaagcagattctggcagctggtgggtcagctcctatgtaatgaagtgcgagtggatttagcagattttacaagattgaagaaatgtgactatgagtccatttatttttgcttttatctgaggagagatggtcctttatttgtttttcctctcaacccattttcagcaagagcttgggtggctgcatcagcttttggtcttctctcgtggcaaaatccaaatcaatgaacagtcagaaaagatcaatgtgaataaactcttcatcagcttgtctatgtattgttttggcaataaaaaaaa

SEQ ID NO: 197 - DNA, 889 bp, Eucalyptus sp.
gccaattcaaaaccacaagctcattggtcaccatccgcaactccagtcttcgagcaggcagggaacaacaggcatggaggtgggtcagatgcagaggaggttggtagagttcaccaaatcattgttcatggagggtttcttggacggtcagtttttgcagctccaacagcttcaggacgagagcaaccctgattttgttgtggaagttgtgtccctcttctttcaggattctgagaagctgctcaatgatctgacgtcggctctagagcagcaaaatgtggactttaaaaaagtcgatgcccatgttcaccagttgaagggcagcagctccagcataggtgcacagagagttaaaaatgcctgcgttgtgttccgcagcttttgcgaagaacaaaacctcgaagggtgcatgagatgtctgcaacaagtgaagcaagagttctaccttgcgaaaaacaagtttgaaactctgttcaccctggagcagcaaatcgtggcggccggcggttcgatcccggcgatggaaatcacgagtttctaaggatttagaaagaacatcgacgtacccctgctatgccttggagaatccgttaaccgattttgcgaattttcttgggaccataagctcaataagtaaccatgtctctgggtggtctccactgagaaagatgtctctctcttctatgtgtttgtaggtctccttaaacaggaacatatttctgtgtagtctagcgtttttggctatatttgggatttaattctgtactttcttaagctgatgggcagtggaggtggccttattacaccacagattttggtgttcaaaagaagagcacaagatcttcctaatgcagaacataacattagagaaaaaaaaaaaaaaaaaaaa

SEQ ID NO: 198 - DNA, 864 bp, Eucalyptus sp.
ctaagatctgccaattcaaagccacaggctcattggtcaccatccgcaactccagtcttcgagcaggcagggaacagcaggcatggaggtgggtcagatgcagaggaggttggtagagttcaccaaatcattgttcaggaagggtttcttggacggtcagtttttgcagctccaacagcttcaggacgagagcaaccctgattttgttgtggaagttgtgtccctcttctttcaggattctgagaagctgctcaatgatctgacgtcggctctggagcagcaaaatgtggactttaaaaaagtcgatgcccatgttcaccagttgaagggcagcagctccagcataggtgcacagagagttaaaaatgcctgcgttgtgttccgcagcttttgcgaagaacaaaacctcgaagggtgcatgagatgtctgcaacaagtgaagcaagagttctaccttgcgaaaaacaagtttgaaactctgttcaccctggagcagcaaatcttggcggccggcggttccatcccggcgacggaaatcacgagtttctaaggatttagaaagaacatcgacgtacccctgctatgccttggagaatccgttaaccgattttgcgaattttcttgggaccataagctcaataagtaaccatgtctctgggtggtctccactgagaaagatgtctctctcttctgtgtttgtaggtctccttaaacaggaacatatttctgtgtagtctagcgtttttggctatatttgggatttaattctgtactttcttaagctgatgggcagtggaggtggccttattaccccccagattttggtgttcaaaagaagagcccaagatcttcctaaaaaaaaaa

SEQ ID NO: 199 - DNA, 812 bp, Eucalyptus sp.
tgttctttcaccctttcctcctcctccccgttgttcctcgccgttgttcttggtcgatcgccgatcgaaatgggtgtcaccgccgcgtcgcaatttcatgtcttggcggttgatgacagtctcatcgacaggaagctgattgagaggctcctcaaaacctcctcttatcaagttactgcagttgattctggaagtaaggctctggagtttctgggcctgaatgagcagcagcccagaaatgccaacgctacctctgtctctccaagctatcatcatcaggagatagaagtgaatttgatcatcacagactatttcatgccagaaatgacaggatatgatctcttgagaaagatcaaggaatcgaatagttacaaggacgtaccagttgtgatcatgtcgtctgagaatgttccctcaagaatcagccaatgtttggaagatggggctgaagagttctttctcaagccagttcagctagcagatgtcaacaagcttaaaccccatctgttgagagggagatctaaggaacaccatcccaacagcgaaaacaggaaggacagggaagagatcttatcacctgagaggacaagaacaagatatgatgtccctgaagtgatttagaactagacacagctaatgcagggctcttgtggtgagcactcacggaaagaagaaattcggcatagttttgttgagatgtagtctatgtagatactcttgtcttctcttgcaattataggtcatacagactttattgagacaaagaattctggttagagaggattctctctaaacaaaaaaaaaaaaaaaaa

SEQ ID NO: 200 - DNA, 1406 bp, Eucalyptus sp.
gcggccgcgtcgacttgaaatttactccctcaaatgccccttctttttcttttttgttttttcgtttgatttcgcattgcttgtcctgtaattgaaaatcaagttggaagatttgggatgaaatctggtcagatcttgctttgtggggggtgtggattttggtgggtcttgttttttttcaatacaaagcctcttccctcctccttcctcctccttccctattaagtacacaaaagaaccgaaccaccaaacaaccaccgaaggcaaactaaaccacttctctcctctctctcatctcctcctcctcctcctctctccttctgaatctcatctcattcagatcttacattggtcccgaatgggcatggcagcagcagagtcgcggtttcatgttttagctgtggatgacaacatcatagacaggaagctgattgagaggctccttaagacctcctcatatcaagttactacagttgattccggtagcaaagctctagaatttctgggcttgcacgaggatgatcgaagcaactccggttccccatccattttgacaaacaatcatcatcaggaattggaagtgaatctcatcataacggactactgcatgcctggaatgacgggctacgacttgctcaagaaaatcaaggaatcatcgtctctgagggacatcccagtggtcatcatgtcatctgaaaatgtccctgcaaggatcagcagatgcttagaagaaggagcagaagaatttttcttgaagccagtgaggaaatcagatctgaacaggctcagaccccatgtgatgaaagccgtatctaaggatcagaaacaagagaaacacgaagaagaagaagaagaagaaaaacaggaagaaaaagagattaagtcgcaaaagcatcaagaacagcaacagcaacaacatcaacaacaattatcgccgagaccatcaggcaatagcaagagaaaggccatggaagagaatctttcgcccgatagaacaaggcccagatacagtgacattgctgctgtcgtctgatcaagccctccccaggaatttctttctttttttccccaacaaaaaccgtatatacagaagaagggctttcaatgctggatcatacacacacaaggttaaacagaagatggagagacagttcctttcgtgtacacacattctgcatggagataaaagaggttcctgcccaattttgcttttgaccatatggaggatggatcatcactcatcagaaaaaagaggaaaacataagacagagagagagagagagagagagagagggattagagttgatggttttattttgtttggtggcttctctcttgctcctccattaaaagctttgtgaggtgtagggttaatcgtctcctccttcctcagtccacgcggccgc

SEQ ID NO: 201 - DNA, 915 bp, Eucalyptus sp.
gtggcgagccccctcaacaagaaatcgtgcgttcgtacagtttcatctacatcaggaaaggctctttgctctgatcttttccttgcgagttaatcattatgacgatggccggcgaaattctccggcggcagtcgccggcggaggtcgacttgtgtggtgggtcgggtcaggagctgcatgttcttgcggtggatgatagccttgtggataggaaggtcattgagaagctgcttaagagattgtcttgtaaagttacggctgttgatagtggattgagggctttgcagtttctgggattggatggagagaagagctctgttggacttgatgatttgaaggttaatctgataatgactgattactccatgccgggcatgactggatatgagcttctcaagaagatcaaggaatcatcagctttcagagaaacgccggtggtgatcatgtcctccgaaagaatcctcgcccgtattaaccgatgtctagaggaaggagcagaggaatttcttgcgaagccagtgcagctgtccgatgttcagcgcctgaaaaatttcgtgatgggtgggggagaagtttgcccggacagaagaatcaacaagagaagactcgaagaaaataacgataacgacgacaacgaaaatcatgccccatcgccggtgtcgcccctgtgcagtcgcgattgggcagtgtgctcatcttcatcgtccgattcttcatcgccatctatagccgtgtcttcatcgaagaggcttaagatacatcatcaagcttgaggatattcattcgtatataccagaatttgatttattgttgttttttggccgatgatcggcatattcatggctaggaatggcaccttttgttcagtaaatataatatgatctctttcccctatccaaaaaaaaaaaaaaaaaa

SEQ ID NO: 202 - DNA, 1027 bp, Eucalyptus sp.
gaagaatagagttctgaaaagagaagcggaacagagtctaggcttctgcttggggatcatttcttcctgcgcttcttcagtaaaaactggtatggcgaggaacggcgtggcctcgtggcggaggaggtcgtcggaccagttcgacgacccgtcgccgtgcgggtccgaggatgtccacgtcctcgccgtcgatgacagcatcgtcgaccggaaagtcatcgagcacttgcttaagatctcttcctgcaaagttacggcagtggatagtggaatcagagcccttcaatttcttggcctgggcgaggagaaagcagcaggcgattttaacgggttgaaggtggatttgataataacagactattgtatgcctggaatgactggttacgagctcctcaagaaaatcaaggaatcctctgctctgagggaaattccggtggtgatcatgtcgtccgagaacgtcttggcacgaatcgacaggtgtttggaggaaggtgcggaggacttcatcgtgaagccggtgaagctgtcggacgtgaagcggttgagggatttcatgacgagagacgtcggagatagagtgaggagcgaccgggagggcaccacccacaagaggaagctgccagagagctccgacgtgtcctcatcctcgccgtccgtctcttccgcatcgtcgtcgtcctcctcctcactgcctacaacgccgtctcggtcgccgtcgccgtcgccgtcggtttctttgtccgagccgtcatcgccgtcgccatctacggggtcctcgggaccgtgttcgccgtcatcgctggaatctcccacgagacggctcaaaatgaccagctgctgtgactagcctcgtcccaagttttaactttttctctctgttttcaatttttttcttggtttgggctggaattggcagctcaagtttacagttatatctgttgcgtcttatctgtccactcgatctgtttcgtttttcggggtctcgaccgccctagtctctataatttttttagaaataaaaaaaaaa

SEQ ID NO: 203 - DNA, 1385 bp, Eucalyptus sp.
ccaaaacagagcaaagctcccgtctttcctccttgccaattcgctttcgccttctgggtcgtcctccttggccttgttcatgtactttttcttgctctgctattggatgtacgccccggttttccaggactctgcagatctgcttctggttcaatgaagaatgtatcaacagaaaggtggcgctagttcaagtttagttcctggcaacacaatggttcatggtcaacatttagacagtggtgctaacacaatggactccatcggtggagggaacaatcacagtaacaatgccaatctcgcatccaagcagcggttacggtggacacatgaccttcacgatcgctttgttgatgctgtggcacaacttggggggccagatagggctacacctaaaggtgttcttagagttatgggtgtgcaaggtctaacaatataccatgttaaaagtcatttacagaaatatcgacttgcaaaatatctgcctgactcctcctctgacggtaaaaaagctgagaaaaaagaatcggcggatgtgctctccgacatggatggttcctcaggtgggatgcagatcactgaagctctcaaactgcaaatggaggtgcaaaagcgcttacatgaacagttggaggtgcagagacagctgcagctgcggatagaagcacaaggcaagtacttgaagaagataatcgaagagcaacagagacttagtggagcactcgcagatgggtcagcagatgaatcgggtgataagggccaagaagacagcaagactgatccacctaccccagctcctatctcggagtcacccatccaagataagtctaaggactgtgccgtagcgaagagcctctcacttgatggatcgctctcatctcataatcatgaaccattgacccctgattccggttgcaatgtcagttcgccagccgaaagccctgatggcgagaggtcagccaaaaagccacgggtgactgctggtgcttcgcatgctaaacctgagatcgtgctacacccgatattcgaatcaagcttgggttactcctacacaaactcctcattcaaactacctgaccagggatctgtttgattcccagcaagaagataaaactagactggtcaaactgggattagccttggcagatatactgtaacatcttgtactggttggtgtatcaacttgcgtactagtttgtttcaacttgcatgtgtagcttgtcaggagaaagtgaactatttaacttggtaagtattatataggtagcttagacgtcattgtatatgttgatgcatcctttgatgcttagctcaaacttgtgaggatatggcattttctgggcaggtggtattgaaggagtatgtgtacttgttgcgtaaaaaaaaaa

SEQ ID NO: 204 - DNA, 1207 bp, Eucalyptus sp.
ccccccccccccccctcctcctcctcctcctcctcttccgctctttctgctgctagtccgccgcggttcgccggcggttccgaggtgcttccggcggtccggtccggtccggtccggcggcgggtgggtgggtggggttggctttttttcgctttagggttgatgttcccgaggctgatccagccccacgaggggctcatcggccaccccgacgacttcgtcggcggcggcggcggcggcggcgggcccgggcaccggggggacccgtgcctcgtgctgacctccgatcccaagccccggctccgctggacgaccgatctccacgagcgcttcgtcgacgccgtcacccagctcggcggagccagcaaagctactccaaaggccattatgcggacaatgaatgtgaaagggttgactctcttccatttgaagagtcacctccagaaatacaggctaggcaagcaatcagggaaagagggggctgatgcacccaaagacggttcttaccttttagaaaaccctggtagtggtaattctaccccaagcttaccatcatctgatctgaatgaaaattatgaagtcaaagaggcattaagagcacaaatggaaatgcaaagcaaattacatcttcaagttgaggctgagaagcacttgcaaatacgccaggaggcggagagaagatacatggcaatgcttgagagggcctgcaagatgcttgctgaccaatttatcactagcgcaatcattgataatgaaaaccaaaaatgccaggcatatggggttaggatgccaagaaacccgtccattgatccacttggcttttacacgcatgaggtggctgcagtacatggcacggaggatgatttgccaccgagcctccattcccagaggggtgattgctctactgaaagctgcttgacctcacacgagagtcccagaattttagctttggaagaatctccagctggaggaaagaaacgaccgatgggcattgactcaacaagcgcccctcttatttggagtgaagctaagttgaagatccaggatgtcgctgtgccccaggtaagccctcatggcctcactggctttgggatgtagggctgaatattctgtattcaattcatctggctaattggcctagctcctagcccgccctgcaatttcaagtgtaaaaaaacgccagttctctttttgtcctcttcgtcat

SEQ ID NO: 205 - DNA, 1795 bp, Eucalyptus sp.
ccaaagctttgaaaagaagaaaccaacgagatccacctcgaacacctctccatcccaatctctccgacaccctgaatcctaggaagagaaaaaaggagagagaaagaaggggaaagtctttgccttaaaaatcgtgcctttatgcgctccgatcttccctcccctcccctcgtgcggaatctggtacttgcgagggatcggctcactgtacgggcgatatagcgaactgggttggagccgaatcggcctggcgatgagggaagacgatggtggtaattggttcacgaaatggcaagtggagcttcccccgcctgaggagctcacgcccttgactcagtccctgatcactcctgatctcgctctcgctttcgacatcgggagaggcccttcctccagcaataactcgatctccgtcgtcggcgccaaacagcgccacctgctgccctcgccgccgccgccgccgctgccgctgccgcagcaactgagttcctccagtcgcgattcgaagactggtgccccggcggcgcgccaacctggccccgtggattttgccgattcgggcgatctggggtctgggggaggggcagggggaggcggggacgagccggcccggaccctcaagcggccgcggctggtgtggacgccccagctgcacaagcggtttgtggacgcggtggcgcaccttgggatcaagaacgccgtgcccaagaccataatgcagctgatgagcgttgacgggttgacccgggagaatgtagccagtcacctgcagaagtaccgcctctacctcaggcggatgcagggattatctggcggcggaggtggcagcagcagcgcagatgccgccaccgagcggttgtttgcaagcgcgccagtgccgccccatttcttgcatccaggcaggccgagttcggaccatttcttggcactgcagcaccaccagcatctagcggcagaggctgccgcggcagcagccattccacagtaccacaggcaagtgggccattttgggttaccgccaaatggacagtttgagcatcctctgttgcaaagcaggcaggggcagatcgcgcatagcatggcggcagcaatgtcaatgcacaaccctattcagtcctctgttggagagtcggattcggtcaagggaagtggagagagaaaggtcctcactttgtttcccaccggagatgattgagttttggggtaatcactaattttcttcccccaggacctttctgtcatctccttaaaagttttacttttatggtgagaatgatcatttgtgtctgtgctttcaagcattagttttggctcattcataactactgtgcttttagctttttgctggggtcttttctgttggctgcttgaaatgtgcttccaggaaactactttttatcgaaaggttcctgtcactgaatgtataggaatttgctggagctggactttgatgctggtagattggcacgataaggccatctaaatgttagagtctggctggggtaggtgggcattgaggattgcaagcaaatgttgcccgggatttgttctacttcaggataggatgttgcgcgctgcttggtgattggtagatcatcagatttcaacacagtgatttatcactgcagccttccatcaattggtctgggttcaactgttgatgtaaattacttgtgtctgttgtaaattccgcaactttaatagattttttcatttcattagagtatttatgtcactgtaatgtgccgtgtgatgtagttagcttttcttgatctctcactagacaatacatagt

SEQ ID NO: 206 - DNA, 1255 bp, Eucalyptus sp.
gccgggattctcttcgtcgatctgattccgggtaaagggtaaatgtatcaacagagaagtgtccctagctcgagtctagttcgcaacaactcttttactgaaggtcagcagttggattgtggtgccgatgcaatggtacctatgaatggaggaaacagtctcagcaacaactctaatcttgcatcaaagcagcggcttcgttggactaatgagcttcatgaacaatttgttgatgctgtggcacaacttgggggtcctgacagggccactcctaaaggcgtccttagagtgatgggagttccaggtttaacaatataccatgtcaaaagtcacttgcagaagtatcgactagcaaaatatttgccagactcttcttctgatggaaaaaatgccgagaagaaagattcagcagatattgcttcaaatacagatggttcatctggaatgcaaattacagaagctctcaagcttcagatggaggtgcaaaaaagactgcatgagcaattagaggttcaaagacagctacagttacggatagaagcgcaggggaagtacctgaagaagatcattgaagagcagcaacgcctcagtggggttcttacagatggttctggcttgggtgatgattgcctggaatctgataagaagagtgacccagcaacccctgcaccgacttccgagtgcccacttcaggagaaagcctctgaggaccatgccccaggaaagagccactcaattgatgaatcgctgtcttctcatcatgaaccacagacccccgactccgggtgccatgtgcgacctattgctgagagccctgaaggagagaagcaagcgaagaagcaaaggctaacagaggatgcggcgtatgccgcagaagaactgtttaccccacatccgatacttgactcaggcttgaactcctaccaccaatcgcatccagctttcctgaccagggagcagtttgatccctcgctggggatctcaattgcgaatggtgaacaaccgaggaaagtctccagtggtagtctataattcttttgatgcatggaatatgcatttgtagaccttttctttcagccttgtatgtgtaacttataggaagtcttaaacttcgttgaaataacaagtttagaagcttgtctcgtctgagtagttctggaaggtgtcttaataactgttttggcaatgaatgacttatgcttacattatctagactatttctttgaacccattcgaagataaattaaaaaaaaaa

SEQ ID NO: 207 - DNA, 1437 bp, Eucalyptus sp.
aaaaaggaaaagaagaggtatagcggctatatagtttattgtaaactaataaatatgatatatatttgcaaagggtgtcctagtagcttgctttggaatagagaaacgccaaaggggaaaagggcagcctgatctttcttcaaaaaacgcaccctattccttctctctttcccccatatcgcatttgttcttcagcttagagagaggtagagaatgttccatcccaagaagccctcgggtatgaattcccatgagagggggatgtgcgtgcaaggtgattctggcctcgtcctcaccaccgaccccaagcctcgcctccgatggaccgtcgagcttcatgaacgttttgtcgacgccgtcacccagctcggaggccccgataaggcgacgccgaagaccatcatgagggtgatgggtgtgaagggtctcactctttaccatctcaagagccatctccagaaattcaggctgggaaagcaaccccacaaggaattcaatgatcactccatcaaggatgcttctgcacttgagcttcaaagaagctccgcttcttcttctgccatgataggccgcagtatgaatgagatgcagatggaggtgcagcgtagacttcacgagcaactggaggtgcagagacacctgcagctgaggatagaggcgcaagggaagtacatgcaggccatgttggagaaggcatgccagacgctcgctggtgaaagcatggtccttcacaactcatccggagcagggtaccacaaccacaagacccccagtaatatgccaaacccgatgaatagcattggaggaggagcaccatttgtcaaagactttggatcctcatcccctctcaacttcccttcttttcaagacctcaacatctacggtggtgccgaccaactcgatcttcatcccaacctagacaggccttccctttccctcgattcctaccatctccccagtaataacaacaacagccacgacaacagtggttttggaaagaagagaccaagtccctttgtgaccggtggtagcggtaagaaccctttgctgtggtctgccgatgatctcccggaacatggccatgaccagatccacacgcctgagatggtcgattccatctctgttgacatttacgaagcgaagccacccccggctcttaccggaggaggaggaggggatgagcagaagcctttgaagccccatcgccacgatgaccatctctttcagcaggctggatgatgctgatgatgatgatctctaccctagcttatactatggtaattaatttcagctgatgatgatgtgacacattatttttggactagagtttcttccgggtcttcaaaccttgctcttctatgtatgagcatatgtatcatgaagtcggctttgggaactttgatcatcaaggaatattatttaggtttaaaaaaaaaa

SEQ ID NO: 208 - DNA, 1641 bp, Eucalyptus sp.
cttctctctccctctctctctcttctccatctcaaagttctctgcaactactccttcctcagtctcatattgatctaaccccatctatgaatccaaccctctcctccctcttcccaactttaaattcctccacccaataaccagatcaccccaaaaactctcagcctccgctgttttcttttaagggttttctggacacactttttacctagagcctcttgatacacctcagtatcagggagccaaagaaaggaggatatattatcagagggagaatccgaaaccgacgtgccgtttgttctttcgtggtctaaatggagctcttcccagctcagccagatttgtccctgcaaatcagcccgcctaacgccaaatcggcgtcctggcggcggacggcggaggaagatgtgaacctgggcttctggaagagggccctcgactcgaggagccaccactccttgccgtcctcaatggcggccaagaacgacgcccgcttcgatctatccctgtcgaatccgagggcaggccacaacgccgttggcggcaacaccattccggagggcaacaataacgtctcttacaaccatctccaccaaggcggcaaccatatccactccttccaaaaccaaagccagtactccaacagtaatcaccaccagcatatgcaccagcatcatcactcggtgttgcagcatcagccacaagggctgagccaagagctcggcttcttgagaccgattagaggcatcccggtgtaccaccagaactcttctagtgctttcccattcgccactcaacttcaacatctagacccatcgccaattcatcacccgaatagtagtaactccctaacaaatactgccaattccatcgcttcgaacctttgccattcacacgggctggtgagatcgaggttcttgtcgcggttcccggcaaagcggagcatgcgggcgccacgaatgcggtggacgactacgctgcacgcccggttcgtccatgcggtggagctgctcggcggccacgagagagccacaccaaagtcagtccttgagctgatggatgttaaagatctaaccttggcacatgttaagtctcatttacagatgtatcgaaccgtgaagactaccgatagaacagcagctaattcttcaggacaaacagatgtatttgataatggatcgtcaggagaaacttctgatgatttagtaatcgaagttgcgaacccgaaaaggcctgaacttggaaggcatgattatcaagatacgagtcaacacggtctttggagcaattcctcaagggaagcttggttgcatgggaagccaaaggattctggagggagcactccatctgttgaggtatctataaggaagacctagacacattctttttcttgaagtttccatgataatcggagcttcgccaaacatctataggtgtctacgtcccagatttgatcaagcgaaattatgtactttagaagttggaatgctatgataagacagattgctgaatacaaccaattatagtgtgctacatgtcgaattttttgtttttttgtaaatttctctatcctatatacgttattaaaaaaatgtttaagttcctggactaatgccatccgttgattagctaaaaaaaaaa

SEQ ID NO: 209 - DNA, 1918 bp, Eucalyptus sp.
tgtcaatttctcctctctctccctctcaatcgccctcatctctaatctctctgcaactgctcttcaaattgatcaaaaccccccatttgaactccccacgaggaattgaactctcccaaaatcttcatcgtgttccaatccaataaccatactcacgagttcgcatctttctcatcctagagcaccacaacagccgagaggagagactccgggcacgttttggtcacatgaggatggagctcttcccggcacagcctgacttatcgctgcagataagccctcccaacagcaaacccacctcgacatggaggagatcaacagatcaagaagaggccaacttgagcttctggaagaaggccttggactctagaagctccctctcctccatgtcgaaacccgacactcgccccgaactctctccgtcgtcgaccaccctgttcactgggtccggacccgacactcatcctctcctccagaaacgaagcagcaacagcctcgtccatcgttttcaagaaaagaaccacaaaactgtttatcagcagcatctgcaacataatccgcttggccaagaggtcgaaacgttgagacccatcagaggaatcccgctataccaaaacacttcttttccattttctcatcatcaacagcaacagcctcttgaagttattgccaattcttcactctcttccctggctaataacgctgccatgagccgttcgagttctaatagattccactctcacggcttgatgcggtcgaggctcgcgtcgaggttccccgggcccaaacgcagcacaagggctcctcggatgcggtggaccaccacgcttcatgcccggttcgtccacgccgtcgagctgttaggcggccatgaaagagcaacaccaaagtcggttcttgagttaatggatgtgaaagatctcaccttggcgcatgtgaaatctcatttacagatgtatagaaccgtgaagacaaccgataagacagctgcttcttcaggacaatctgaagtgcttgataatgcatcatctggagatacctcggaagatttggtgttcgagattggcaactcaagagggcctgagacatcgattcaacaaggagaactcaataatcaagaaaaggattactatgccctaaagtggagcaaatcagcaagggaagcctggaagcaagggaaattaccagaggatgatttcataggaaattgcgcaacatacgttgaggaagatcgtaatgcaaagtgtccaagcaacgaaagaatatcagatgtgaactcaccgaatctttcggggacaagcaataacatgaagcccaatctggagttcacattgggaagatcatcttcacattgattgcttttattttatttttttgttttttctctctcctgtgcgctactcattttgaaatcattatacctcttaagggtactgctctgtgtagagaaccaggtgccggctcagaaaatcagagtgaaaaagaaaggagagagagggagagagaaagagaagaaaagtgaaaaggagagaaaggaaaagagaaaaaaagtgaggtgaaaaagagagggaaggagacaaacaatgacagaaagcagaagaaaagcaagaaacgatggagaaaagcaagtcctgcctttctaattcatctagtatgaaaccctcctgtgggagcatccaaatcaaaggcatcatattcctacgtagatatgaaacctaattggtttagtttgtctcccactaagagagagagagagagagagagatctaaccatcaataatgatgagcatagaaagatcctttgtggtaattgtagtatgtcttgatggaccgttgtcacacatgcttggaaaaactttcccggctaaacttttttaccgtggatcaagcagtctaagctatttgaccaaaaaaaaaa

SEQ ID NO: 210 - DNA, 1715 bp, Eucalyptus sp.
gctagagagatcttaggaagttatctctgaatttactccaattcaggacgagacgctgcgtggcgtggaagatagaataagttagttttgtttggagcataaacatattggatcacgagaaaagtgaagcgcaattcagaaaagcaagtatgtaccatcacaaccagcatctgggaaagaacatcagtcctccttcaagaatgccgatcccttcagacaggcatatgtttatacaaggtggtaatggtcctggagattcaggacttgtcctgtcgactgatgcgaagcctagattaaaatggacacccgatctccatgagagattcgtagaagcagtcaaccagcttggtggagcagataaggccacgcccaaaacagtcatgaagcttatgggaattccaggcctcaccctataccacttgaagagtcatctccagaaatacaggctcagtaagaatctgcatggacaagcaaacagcgggaacaacaaaatcggtactgtcgctgttggaggagacagagtacccgagacaaacggatctcacgttcacaatttaaacatcgtaccgcaaacaaacaaaaacttgcctttcagtgaggcgctccagatgcagattgaagtgcagaggagactccatgaacagctggaggtacagagacacttgcagctccggatagaggctcaaggaaagtatctccagtcagtgctcgagaaagcacaagagactctggggaggcaaaacgtgggctcggcaagcctggaagccaccaagcttcagctctccgagctggtgtccaaagtatctacacaaagcctgaactctgcattcccggacttaaaggaacttcagggcttatgtgcacaacaaatacagacgaacccgcctactgattgttccgtcgacagctgcctcacttcctgcgaaggatcacataaagaccaagagattcacaacaatggcatcgggctaagaccttatagcggtggtagtgtgctcttggacccgaaaggaatcacagatgagcccagaacagagaagatcgaatttaagtggggtggggatccgaaagaagacaggatgtttctttcgtatggagtgaaggaaatggagagatctttccctggaggactaggacaaggccacttgtccatgagcataggccttgaaggaggactaggctgttccgaggtgaaaaacaaagccaaagaagtcggaggcagcgtgaatttcctcgaaagactacactccagagcagattcagtgaatatggatagcaatcagagatcctgcgggaaccaattgcattactttgaggcgaaacttgacctcaatgcccgcgaagaaactgatgtcgcctcgagcggcaaacagttcgatttgaatggaaatggattcggctggggctgagaagggtctatctcgagctaaaccagatcaattcaatggacaaacgcttcccaagctagcgttcccctgcagcgaaggatcagtagctgggaagatggccagccaccggccattgagccaggaaataatttgcgtcgcccaaatgtgtacactatttataagtagataagcaatgggggctttctaaagcatacaaaactatattgtcgtaggtaatttttcaataatgtcaagttatataattggagcacaattggtgcttaattaatctgaatagaaatggttgatgcatcctcaaaaaaaaaa

SEQ ID NO: 211 - DNA, 2018 bp, Eucalyptus sp.
tgcaacaccccagagacttaaaaagcattcatcaaacacccacttttcaacagcaatctttctactaaaagtttgctgtttacacactttcatgcattagaacgcaattgcaccagctatatagtgcctctatatagcgggctcatatagtttttgacctaactaggttgagcttacacaatttttgttgcttcgagaggagtcttgagtttgggattaatgcttgttgtgtcacctctgaggaacccgaacgatggcagcaacaacaaccaaggagagatggagagcttttcaatcggaggcggcgttggcggcagcgacgacttccctgacttctccgacgggagcctgcttgacagcattgacttcgacgacctcttcatggtgatcaacgatggggacgtgttgcccgacctggagatggacccagagctgcttgctgagttctctgccagctgcggcgaggagtcgggaacagggtgctcgtcgatatctgtcgagaaggccgaggtcaacaacggctccaagagagaagtcgacgaggacaaggcctcggagctggataacatctctagcgtgagccgaggggaagaaattgtgagcaagagggatgattctgtggtggtcaatccagtccccaataataatgaagagactgacaacaagagaaagaaatcatcagctcaatcatctaagagtaaccatcaagctcaagggaagcgaaaagtgaaggtggattggacgccagagttgcacaggaggtttgtacaagcagtggagcagcttgggttggacaaggcggtgccttcaagaatcctggagctcatgggcatcgattgtctcactcgccacaacatcgccagccacctccaaaagtatagatcgcatagaaagcacatgctggcccgtgaggcggaggctgcgaactggagtcagaggcgacacatgcacggcaatggaggtcaaaagatgaggcctgacacgatgctggtgatgagccactccaccacccccaccaacgggagtccttggctcgcaccggccaccctcggattcccacccgtgacccccatgcccccccacttccgacccctccacgtgtggggccaccctcccgcggaccattccctcatgcacgtgtggcccaagcactcaccttccctgctcccgcccccgctgccgtccgcctgggcctccccaccgcaaggcgctgctccctacggccaccaacgggtaccaaatccgccaatgccgggaacgccgtgctttgtcaacccacccctgccagcgacgaggttcggagctccaccggtgccgggcatcccaccccacgccatgtacaaagtcgagagaaagcacaataataataataacaacgacaacaataatcggggctatggtgtgccgccacctggaccattagcctcccatcctcctttcgattttcatccggattatgcgttcgatgaacactcgaaggagacattagatgcagctatcggagatgttttagcgaagccgtggctgccgcttccactcggtctgaagcctccttccacggacagtgtcgtgggagagcttcaacgccaaggagtacccaaaatccccccttcttgtgcttgaaaaaaaaaccttaggacatccttcggttgcaaaggttgttccccaacagcgctttcaagcctaaaattcgacgacatttcctgcgttagacgcaaacatctaatcggcaagtacccaccttttcccgacccttttggtgctcatttgtagctcgattggttgccggagatgaaaccatttccagataacatgccctcgtctgtttccccgtctttttgtagtggttgtcgtggatgtgagactgatctcatggccatgagaactatctaatctaaagagttaccctgttttgcttctcaagaagttattgaccgaataattcaggtttgtagagtttgtaactgttgacgacttggccaatttgtcatttagctccttgccattgaaaaaaaaaa

SEQ ID NO: 212 - DNA, 2589 bp, Eucalyptus sp.
tttacgtgtgcgttggttcggtgatgctatggtttgtgtgtcgcttcaagttttgggatttcatacctgttcatctcccttcctagtcacctggaagatttcacaacggtctatagacccatcaagcaggaagaatctttgcttttgaacgaagatcttcctcttctgctgagcttgttatacatgcttatgtggtgatcactcacaatttggtcagtctcagctgaattatcacatgcttgtatgagttcatcctgctataggaacctttatcttggaaagttgcattagcaatgagatcggagtgatctggtggaatctttttggtggagcgtgactcgagagacatgttggtggcctgagaaacaatgccaaaccagctatggtttgcactgccagtgatctacaagaatggaaggacttcccaaagggactcaaggtccttcttcttgaccaggactctgattctgcttcagagataagatcaaagctggagttaatggactatgttgtttttacattctgcaatgaggacgaggctctatcggcaatagctagcaaacctgatagcttccacatagctatggtcgaggtgagtacaagcagtaatgggagtttcgagttcctcgaagctgctagagacttgcctaccatcatgatgtcaaataaccattgtctcagcaccatcatgaagtgtatagctcttggtgcggtcgagttcctccacaaaccgctctgcgaggacaaactcaggaatatttggcagcatgtcgcccacaaggcatttaatgcaggggtcagcgaggtctcggagtctttgaaacttgtcaaagaaacttcggtctccatgttgcagcaccaattgaaaaatgaggagcagaacaatgacgagtcaagagaaatgagaaaactgtctgttcatgaaactgatcaagagatgtccgctgcgagtgataagtatcctgcaccatcgactccacagttgaagggaggtgcacggctcctagatgatggggattgccaagatcaaacgaatggaacggtcgagaaggagagtggggagcaagatggagagtcaaaatttgtcgaaacaacttgtgatgattcaatgtctgagaatatccaggaagctcaaggccagagagatagggatgttctggtaaaagaagaggatgattcagccaacaattccaagtgcgagagcatgatatctccgctgtccgaaaacaaagataggtcccacgatgtacatggttgcaatgataatcaaagcaaagcatccagtcttcataattctgccagaacacgggttaacaggaagaagatgaaggttgactggaccccagaactgcacaagaaatttgtgcaggcggtggagcagctaggcgtggaccaagccataccttcttgcatactcgaccttatgaaagtcgaaggcctgacgaggcacaatgtggcgagtcatctccagaaataccgaatgcataggagacacatcttgcccaaggaagatgaacgcagatggccacattctcgcgatggtgtcaccaggagttactatccgcatcgacctatcatggcctatccgactcaccatcctggtcacccccttccaccaggagcagcctatcctgtgtggggggcaccgcccagtaatcatccagccggcatgcagatgtgggggccgcctggctatccgccatggccatctccagaaaactggcattggaagactgcctatcctgcgatgcaagccgacgtgtggggttgcccagtgatgccatcttctcatcacggtcccagctttgcctttcctcagaatgcacccgtttgccatccccccgacggattggaaaacagcttcgctggaaattcgttcgactatcatccggacgaggaagtgattgacaacatcgtgaaagaggcgataagcaagccgtggctgcccttgccgctggggctcaagccgccttccaccgactgcgtcctcgccgagctctccaggcaaggcatccccagcattcctccccatgccgaccagctcggcccatgctgacgcagcatggcgtcgcgccggctccatccccccgacgaaacctagcggcccccctcgattccggcgaggagaggaccgaccggatccatcggctcatatttccggcccgcccaaatttggccgttcaacgttcaataaaaaaaaagtgggcgcgtgagaatgacgcgccgtttttgggtaggatgtgacgcgacgacgacgcgcgcgatcttatccgacggcagagaataaaggcgggcaaccagaagcttcaaggaggcgggccgatgtgggcggctgaggagtggccacgtaggtcgacgcctcgccacatgttggtgggccctcttttgtggtggtacaacgacaggagtcatgtcgtgtttagcaagaaaagagggacaggactgtgttccaattggagccgcttcagctggagcctctttttgttggatttgggtcgtgtcgatgtttgcatgttttcccatgttggtccctttctgaggattgaggggtatggcccttgcttctgtcaggtgtgtctagtctctcga

SEQ ID NO: 213 - DNA, 2946 bp, Eucalyptus sp.
aaaccctgtctcttctgtttttttttttttcaatcccgcaacgaattctcctgaaatttctttcccgcatcaacgccctcccaagaatttctctccctttgttttctgttttgctgagtgggttttgaactcgccaatcagttcgtaggtgctttgggcttcgttcttggaacagaaatctgttaccttggcctcgaacaatcgacacccaccaagcgatttctcgaatttcttccttatctataagtttcctcaactgggtttttcagataatgaagtgggtactgctttcttgattgcccccagctcgaggatgtgaggatttcttggtttgggggtcgaaagagagaaaccaactctccagttcttgatcctgctctgcccccaatctgagaagggacagcgggagaggatccatgtcaacgttgacttcgagctgctcttggaaggccggggacggggtctccgatcaattcccggcgggtctgcgggtcctcgtggtggatgacgatccgacttgtctgaggatcttggagaaaatgctcaagacatgccagtatcaagtgacaacatgcagtaggtcagatgttgcattatccacgcttcgagataacaaaaatggatttgacattgtgttgagtgatgttcacatgccggacatggatggcttcaaacttcttgaacacatcgggctcgaaatggatctacctgtaatcatgatgtctgccgacgacggaaagcaggtcgtaatgaagggcgtgacccatggtgcttgtgattatctgataaaaccgataaggatcgaggcattgaagaacatatggcagcacgtggttaggaagaggaagaacgaatggaaggaattggagcaatgtggaagtgtggaagatggagatcggccgcagaaacacttggaagatgtggattactcatctacagcaaatgaaggaagctggaaaagtggaaagagaaggaaggaagaggaggatgatgcagaagaaagggatgattcatcgacgctgaagaagccacgagtagtttggtccgttgagcttcaccaacagtttgtgtcggctgttaatcagctcggaatcgacaaggctgttccgaagaaaatacttgagttgatgaatgttcctgggctgacaagagaaaatgttgctagccaccttcagaaataccgcctgtatcttagaagactgagcggtgtgccgcagcatcaggccggagtaaatagctccttcattggaacacaagacgcgggttttggggcaatctcctcacttaacgggtatgagatccaagcacttgctgctacaggccagcttgcaccccaaagccttgctacactccaagcagctgggttgggtcggtctgccggaaaatctggcatatccattcccatgttggatcaaagaaacctcttcagctttgacaatccaaaattaagattcggagagggacagtcgcaacaaaatctcggaaccaatagtaaacaggcgaacctgctccacggaatcccaaccacaatggagcctaaacaactcgtgaatcttcaacagtctgctcaatcttttggaagcatgagcatgccagtccatacacatggagcccagagtagctctctgctgatgccaatgggccaaccgcaggctagaagacacgtcatcagtgaaagtgggagcagtcgtcctcctgtgcttcaggccaatatggggcagtctattatgtcaactggccttgttggccaggccttaggcaggagcggtactgctgaaaatgggcgaggtctggggcacaatacgattttgcagacatcatctgctatgaattttcccatgaaccaagtatcagatgcaccggttagtagttttcccatccaaagtacttttcctacatccaaaggtggatacccagaggatgtgaactctagtattattaaagggcctggagggggtatgccgagctacgatatactccatgacttgcagcaaattagatccaatgattgggagtttcagaatgtgggtgtgacgtttgatacatcgcaaccaggaaattctgtccaaggaaatattgacacatccggattgcttttagttcatcagggtttatcttctgggcagagcagcaatggacacaatagaaacatctctgctgctggcaagtccttgctttctgctgatggaaatcggcaggtgaccactcctaatgttggtcagcctccaacctcccttgttgacaatccagtgcaaattaagactgaaggtttccctgatatgagctatcaggccgtgctctatccagaacactacagccaggaggatatcatgagtgcatttctcaaacagcaacaaggcattgggccacctgatagtgagtttgagtttgatggattttccgtgaataatattcccgtttaggatatgttccatggtcagctgcagtacagtgcaaacctgcgcgtacatagtttcttccagttggttattttcccctcctgtgattgggctgcaaattcaagaggattcttgatttgaagtggtggtgctggaccgtgatgattattgaatggaccaattgtggagcacggcaacaggattgtcgagcacggcaggcactgctgcgtgatatgcaaaggcgtacatgctagttctttttgactgcttttgatagaataataccttagccagaagaagcaactaatttagtcttgtcaagttattggtagaatttcttaggcactttgttcagctggacaaggttttgtgatactggcagtactttaggtctaggagccttttctaactccaataacacagccaatgcggttctggtcctgtattctatttcccccttgtttattgaggtaactcaatgttattgtaagtatttgctatttcattgctttggacaaggatttgtgcattctttacttggtgcttc

SEQ ID NO: 214 - DNA, 1698 bp, Eucalyptus sp.
ctcgtgccgctgggtttgtggctcatcaacattcccagctcagtgacgtatatctgctgctccgctggagcacggattcaagaagcaagcatccatcggcatttgatccggtgaggtcacatcacttcaaggttcatcaatgactggtatgcttcacgacgagggatcatcacccgtaacttcatccccacttcaaatattttcgatgatgtcactttctcccggcataggatcaccatacccattgctcagggaagttagtcctgaagacaggggtttgtggttgattcattatcttattggctgcgctaaccatgtcgctgctggtagtgtagataatgccaatatttgccttgagcaaatctcccatcatgcttctccagatggcgataccatgcagcgaatcgctgcttacttcactgaagcacttgctgaccggatactcaaaggttggccaggccttcataaagcccttaattccacaaaaatatccccagtgtccgaggaaatccttgtcaaacgatggttttttgagctttgccccttcttgaagctcgcatatgtaatcactaatcaggccatactagaagcgatggatggggagaagatggttcacattatcgacctcaactcatttgagcctgcccagtgggtcaatcttcttcagtcactaagtactaggctagaaggcccacctcacttgaggattacaggtatccatgaacagaaagaagttttagatcaaatggctcttcaattgaatgaagaagctgaaaaattggatatcccgtttcagttcaatcctgttgtctgcaaactggaaaatcttgatctagaaagtttgcgcgttaagactggtgaagcacttgcaattagctctgttctccagctgcataccatcttggcagctgatgatgagacgcagcggaggacctcgccttctgcatccaacagttcaaattctagtcatcaacagagagctttgcatatgaggcagcgcactctaggagagtggcttgagaaagatgtggtcaatctatattgcgctagtcctgactcagccttggtatcttcaccaaagatggggggctttttaacttccctttggggattgtcgcctaagctaatggtgattactgagcaagagtcaaaccataatggcaccttaatggagagatatgtggaagcattgtatttctatggttccctgtttgattgtctggagtctactgttccaagagcatcggtagagcgacaaaaggttgagaagatgctgttcggagaggaaattaaaaatatcattgcttgcgagggcattcagaggaaggagagacatgagaagcttgaaaagtggattttgaggcttgagttagctgggttcggaaaggtgtccttaagttacaatggtttgttgcaggcagggaggttactgcagaactatggttatgatgggtacaccctaaaagaagagaatgggtgcctcctcttatgttggcacgaccggcccctgttttcagtttcagcctggagatttaggaggtagaaagtagtattgtgtatcatgtgggagttgtgttcttctcttttctcctattttccaattttctttcatattttgtataaagaaactgaagctcttctttctcagcacgtgcatagtgaactgacggagagaatccaatttactcaaaaaaaaaa

SEQ ID NO: 215 - DNA, 1982 bp, Eucalyptus sp.
tcaagatcctcctctctttttttttccaaagtgttatgctcttcccatcccacttctcttctttaacaacacaatcgcccatgccttgtgtttcagaacttggcactaaaagctcagagggagagcggtttgatattacacgtacaaaagtttcttcttttctttaagagaaaaagttgaatattttgatgtggtcatttggaagaggcttgaatggataccttgtttagactagtgagccttcaatcctccgatcagtccttcaactcaagcaggacctcaagcagctccagatcctcccgacaaaaccatcactaccatcaccagccagaagcggacgaagaatgcctcaacatcttcatggatgaagaagacttctcctcgtcttcttccaagcactacagttatccttatcaccccgccaccaccagcaccacccctaccaccactagtagtactcacactccccacacttatgaccctgccgatgtatccgtctcgcccgcccgcgacctcaacttcgacttctctagcaagtgggcctctgacatcctcctcgagacggcccgtgccatcgtcgacaagaacagcacccgtgtccagcaccttatgtggatgctcaatgagctctgctccccttatggcgacatcgagcagaagctggcctcctacttcctccaggccctgtttagtcgcatgacggactcgggcgagcggagctacagtgcctggttggccgcgtcggacaagacctgctccttcgagtccacccggaagatggtgctcaagttccaggaggtgagcccctggaccaccttcgggcacgtcgcgtgcaacggcgcaatcatggaggcccttgagggggagagcaagttgcacatagttgacatcagcaacacgtactgcacccagtggccaaccctgctcgaggctctggccacccggacggatgagacgccacacctgcggctcaccaccgtggtggtgagcaaggcgaacggcggggcagagactagtggcgtcgtcgccgtgcagaaggtcatgaaagaaattgggagccggatggagaaatttgcgaggctcatgggtgtgcccttcaagttcagcgtcctgtaccacagtggcgacctgtcagagttgaatttggacgagttggatatcaaggaggacgaggcgctggccatcaactgcgttggcgcgctgcactcgacaacgacagtcagcaaccgccgggactttgtggtctcatctttccgaaggttgcaaccgaggataatcacggttgttgaggaggaagccgacctcgacgtgggcgtggatgggatcgaatttgtcaggggtttccaagaaagcctgagatattttagggtttacttcgagtcgttggacgagagcttccctagaacgagcaacgagcgcttgatgctcgagcgaggggctgggcgagcggtcatggacctggtggcatgcccaccacaccactcggtggagaggcgggagccagcaagccggtggtcgaggcgcctgcgaggaggcgggtttaatccttgtttgttcagcgacgaggtatgcgacgacgtgcgtgccttgttgaggaggtacaaggaagggtggtcgatgacgccgtgctctgacgccggaatattcttgacgtggaaggaccagccggtggtttgggctagtgcatggagggcttgaggatgatgaagctctctcatgaacaaaaaacagccagggggagtgtttcacacgtgtgatgtgtgtgtgtgttttttttttttttgcttttggctcgtgcaaggaatatgggagatttgtgggtttctgggcaggggggagggggttagagagtaggggaatatctgcttgtttttggatagaattaatggagtgatcaattttctttgattagtcttgtcatatttgtgataatattttattctgtggaaagataaactggttttgatcattcaaaaaaaaaa

SEQ ID NO: 216 - DNA, 1939 bp, Eucalyptus sp.
ctctcctctccctaagaaagaagaaaggcccatggaaccagttccgccgggagctcactgaaaacattaatttcctcgctcaagggtttggctgctcggttggataagatctcactaccattgagttttgagctcatcaatatgcaagttaactggcaaactgagaaccgaacttgatagttttaccctgccatatagtgagcaggtggtcctccaaagtgaatcattggtgagatgcaaacatcacagaagaagagtcatttgagcatgtcgaacaaaatttgttatcagtctgctcttgagatcggcacctattgcttgcctcagtttcatacattagattgttacccttcctactgcacccttgagtcatcctccgctagtggaggttatgctatatacaacccaccatcaaccatcagcttctcatccgatgggagtcccgtatccttgcaagattctgtgtcttatccacctgatgcgctacactccccagataatacctacgcctcctccataagtggatcttgtgtcactgacgatgcaaatgattttttgcacaagctgagagaattggagaacgtaatgcttggacctgattcggatatttccattaacaatgacaggagtttccagaaggggatccatgtagcttcaccagggagcaaactaaaagatgcaatagaacggaaggatttgaaacgagttctcattgcctctgcgaaggcagtttcagaaaatgatctatggacagcgaactggttgatggatgagttgcgtggaatggtctcagtttctggggaaccgatccagcggctgggagcatatatgttggaaggtctcgttgcacgtttggcctcctcaggaagctccatctataaagctctgcgatgcaaagaacctgaaagctcagagctcctctcctacatgcacattttatatgaggtctgtccatacttcaaatttggatacatgtcagcaaatggggcgatagccgacgcaatgaagaatgagaatagagtccacatcattgacttccaaattggtcagggcagccagtggatcactttaatccaggcatttgcagcaaggcctggcgggccaccccacataagaataactggttttgatgattccacgtcagcttatgcccgtggaggaggattggaaatagtggggaagaggcttactaagcttgctcagttgtacaaagtcccattcgagttccatgctgcattgataccaggttcggatttactgcttcaccatcttgatgttaggcgcggggaggctttggccgtaaatttcgcgtttatgcttcaccacatgcctgatgagagtgtgagcattcagaaccatcgggaccggctcctgaggctggtcaagagcctgtcaccgaaggtggtgaccctagtggagcaagaatctaacacgaatactgctgcctttttgccacggttcattgaggcgatggactattatgcagccatgtttgagtcgattgatgtgactcttcacagagagcacaaggagaggattaatgtagagcagcactgcctggcaagagatgttgtcaatataatcgcatgcgagggggctgagagagtcgaaaggcacgagcttctggggaagtggaggttgcggtttgcgatggcaggatttacaccattccctttgagttccctagtgaacggcaccatcaagacgctgttggagaattactctcacagatataggcttgaggagagagatggagctctttatttgggatggatgaaccgggacttggtagcgtcctgtgcatggaagtgaattaatctgagaaaggataagacggcatgatggagcagctggaattgttcctcttcttttcatgtttcgttcctttgtaatcatttagcttgctacctttgatgaggtgtttgaagcaaaaaaaaaa

SEQ ID NO: 217 - DNA, 2170 bp, Eucalyptus sp.
gagagatagagagagagagagagagagagaggggggaagttggtggtttcttgttcttgaagagttgggaagctgagctgagctgaggtgaagctgagagttctgtgacccagtggtttcagatattactacttttacgcaattggtctgaggaagcacttggctgctgttgctgctgagtatcgtattgaggaattctatggcgcggtgaaagcagatcatttgttttgagattgccatgtttgttcttatggcctgagtgatgttctggattacataaaacattctgctcgaaagcttccagtattatctgcaagtcaatcacctggaatcctcctaaatgcaaacatctcacaaccgccagaattcagccggcatccatgggttgtaccatcaacccgtgcaagacatcgacccttattgttcatccaattttcagatcatggaaaacaatgttagtccagacattggcagccaagggactaatttctccattcagggttatgatgggcagtacttcaccctcgactctgctccagccgtttccagttttggttcgtacgattccccttcggctgtgagcgttgcgtctaataggagtcccttttcaactcaaggttcacactcttatgtgtctgatgcacaacattcttctgactatctttatgggtcgcccatcagcggttcttcagtggctaatggtggccctcagatgtgggacaagctgagggagttagaaaattcattgcttggacctgaatctgatatcagtgatagctgcaattgttgcctaaatagtgggagccaccaattcccgtcaactgggcagtggaatgtaaaccagatgatagagatgatccctaaattggatttgaaggacatgctgattttctgtgcacaagcagttgccgaagctgacatgcctaagacagctgctttgatggaggtgttagagaggatggtgtctgtctcaggagatccaatccaacggttgggtgcttacttattagaagggcttagagcgaggttggaatcatctgggagcataatctacagaaagctcaagtgcaaagagcccactggctcggaattgatgtcttacatgtccatcctctatcagatttgtccatactggaagtttgcctacgagtcggcaaatgttgtaattggggaagctataaagtacgagtcaagaatccacataattgacttccagatcgctcaaggaagccagtggatccctattatccagggtcttgcaggacgaacgggtgggccccctctcattcgcatcactggtgttgatgactcccagtcagctcacgcgcgtggaggggggcttgacattgtcgggaagaggctagagaaggttgccgagttgtgtggagtgccatttgagttccacgctgccgccatgtgtggaagtcaggttgaacgagaggacctcagagtgcgacctggcgaagctatagccgtgaattttccctttgttttgcatcacatgccagatgaaagcgtcagtaccgataatcaccgcgatcggctgctgcgattggttaagagtctatccccaaaggtggtcaccctcgtggagcaagagtctaaaaccaacacgtccccattctatacaaggttcatagagactttggactattataccgcaatgtttgagtcaattgatgtagcgtgccgacgggatgacaagcaaaggatcagtgcggagcagcattgtgtcgccagggacatagtcaacatgatagcttgtgaggagacggaaagggttgaaaggcatgaacttttggggaaatggaggtcaaggtttaggatggccgggtttcaacagttcccattgagttctgcagttactgatgctgtcagaaatctattaagggaatataacgagaattatagaatcgaagagaaggatggagctctttatctctggtggaggaatcgagctatggcaacttcttctgcgtggtggtgaaacttgtgggttttgacgagtctgtaaagttttgtactagttgtagttcatgtttagcttgatgattagctttaattctacttccataggatcaagggagcaatgtctagaacttccactacactgtcataaaattcccaacttgaatttgaaaaaaaaaaaaaaatctttgtaaaaaaaaaa

SEQ ID NO: 218 - DNA, 3174 bp, Eucalyptus sp.
gctcccttgttccttatctcttccatttcctcagcctctgctgttcctccactggacctcccaccacccccctccctcctccctcctcccccctaaccccccaagaaaatcaagaaaatcaagaaaagagacgctgccagcaaaagcagcagcatgctagtcataaaacctcctccactccctgctgccatgaacgaaatttgatcctcagctccccactcacagccctccgaaatctctgaaatcaaagcaaggaaagagagagagaagagagagaagagagaggggaaagagagatgaagagggatcatcgagacgcttgcagtggcggctatggcggcggcggtggcggggaggcgagcggcgcctcgaagggcgagcccccgtcgtcctcctccacccactcattgcccggctctggcaaggccaagatggtgatgtggggcgaggacgaccaagatccgagcggcggtggcgggggcggcatggacgagctcctcgcggtgctcgggtacaaggtgaggtcgtcggacatggccgaggtggcgcagaagctggagcagctcgagatggtgatgggctctgctcaggaggacggcatctcgcacctgtcctacgacgccgtccactacaacccttccgatctctcctcgtgggtccagagcatgctcttcgagctcaacccccctccgccgccgcagcaggtggccgacgcggtcctcgctgcggccgagtcgtcttccaccatcgcgcagcaccaccgttcgcatctcgggtctcggtctcagacgcagactcggactctgagtcagacttcggctcccactcagacgcagtcccaggtaatcttcaacgacgactccgagtacgacttgagggcgattcccggcgtcgccgctttcccacagggcgactcggacttcgagagcgccgcccggaagaagatgaagaccctgaacggcgggtcgaattcgttgtcgtcctcgtcctcttcgtcggccgccggagcggcgccctccgagtcgacccggccggtcgtcctggtggacacgcaggagactggggtgcggctcgtccacacgctcatggcctgcgccgaggcggtccagcaggagaacctgaagctggccgatgcgctcgtcaagcacattggcctgctcgccgcttcgcagaacggcgcgatgcgcaaggtagcgacctacttcgccgaggcgctcgcccgccggatttaccgaatctaccccaacgacggcagcctcgactcctcgtgcaacgacatcctccagatgcacttctacgagacctgcccgtacctcaaattcgcccacttcactgccaatcaggcgattcttgaagccttcgccaccgccagccgcgtccacgtcatcgatttcggcctcaagcagggtatgcagtggccggccctcatgcaggctctggccctgaggcccggcggtccgcccgccttccggctcaccgggattggcccgccgcagccgaacaacaccgacgccttgcagcaggtcggctggaagctggctcaattggccgacactatcggggtcgagttcgaattccggggtttcgtggcgaattcgctggctgatctcgagcccgccatgctggacatccgccctcccgaggtcgagacggtggccgtcaactcggtgtttgagctccaccccctgctcgcccgaccgggggcgattgacaaggttctctcatcgatcaaggccatgagacctaagatagtgacgatggtggaacaggaggcgaatcacaatggcccggggttcgtggaccggttcacggaagctttgcattactactccagcctgttcgattcgctggaagggtctggggtggctcccccgaaccaggatctggtcatgtccgaggtctacttgggtcggcagatttgcaatgttgtggcctgcgaggggccggatcgagtggagcggcacgagacgttggtgcagtggcaggcgcggatgggatcggctgggttcgacccggtccatctcgggtccaacgcgttcaagcaggcgagcatgctgctggccctgttcgcaggtggagaaggttaccgggtcgaggaaaacgatggttgtctcatgctcggttggcacacgaggcctctgatcgccacttcggcgtggcaactcgctgctgcaactcagtgaatcaactgtcgttcggttgagtttggtcgaaatcgagatagaccctgttgtcggttggaccccttagatgatcagtgaatggaagtgctttgcctgagttgggaaggtactaagagaagagaggctacgaaacaacctcagagcgtgtagttccacttcttgttttttgcctctgtgtagtcttctgcaagatcttccaaatcttccttattgatttatttcatgaattttgattttggttagacctttgggctctactcaaggttggatgaatgcgaatgtgtatcctctgcatttagcttctggaataaaatgatgacgacgacgattctcgctgccaaaaaaaaacggatgcaatcgtttacgattcatcacatctctatggaactccaagttactgggtgcaacagtttttcgccgagtcaagtggagcaactcttcttgatacaacaattccagcgaattactccagctcacttctcgcctcagcaatcacgtggacaaattcagatgatgataaaagttatataaagattaagatcgtgaacttcggtagcagtccagttaatctaacaatttccattagcggactggatcaaaattcgatacaaaagtctggatcctcaaagacggtattgacatctgctaacttgaaggatgagaactccttttctgagccgaacaaggtggtgccaacccaaagtctactcgaaaatgcaggcaaagagatggatgttgttatcttgccctattccttcacttcctttgatctgttaaaagaatcgactagcatccggatgaagggagatgattattcgtctaaatcttctatctaatttatatatctgattgagtgtaattatatggaataatctcatgactcagatgttatgatactcaaaagttatgtagatctttgtggctgtaacatgtacttcttgcttacctgttcgatgctatataatataaattatattacataaaaaaaaaa

SEQ ID NO: 219 - DNA, 2452 bp, Eucalyptus sp.
aagaaagaagacaggagggtggatcgaagctgaaaatcacagaaatattggaaggtgatacaagaggatgttggctgggtgctcaagttctaccttgttgtcaccgaggcatcgattgaggagtgaaccatctgcagttgcacagttccaagcttgccatttccagttgccttcaatgagcacccagagactggacttgccatgtagtttctccaggaaagagaactcaagacctcagtccctcaggccagtctcactctctgtggagaaaacatccattgaagcaaccaccaccacttgttctctcaagcagcacatcaggctgcctccattggcaaccacttctcagggatcaatcgaaggtaggagagaggtcaagggggagttctgggagagagggaagagcttgaagaggttcgcagatcgcagttctgtcgatgagtcctatgtcagcagggctaagaggaaaaggcatggcaattcgaatgagaaacctgattatgttggggaagggggtgagaacctgagcttaggccaattgagcggaggcagcttttggttccagccaagtttcagtgcctctccaatccctttctccatcacatgttcccaggatgatgaggaaagagtttgtttcgttccgagcgaggttgtctcctcccctatgccgctgtcgaacaatccttgggtggaatccatcgtgaccaagatcacagacctaggcgagaaagatgtcgagatcagccacgggccggtgaaagaggattcgggatcaagcgcttcatcagacagtcagagcttggcgcttaggcttaacgaaaacatgtcggagcatgaagcagggaatggttcagggaacccatatccacatgaaggttttagtttggaagccagcgaggagaatcaccacggagagcaccatgaatttgagctcgttagcctacttacagcatgcgtagaggcgattgggtccaagaatattccggtgattaaccacttcattgctaagttgggggatcatgcctccccgaggggatccactataagtcgtgtgatcgcttactatactgaggctttagcgctgcgagtcacaaggctgtggcctcatgtttttcacatcaccacccctcgggaagttgatcgggtggatgaggactcggggatggcattgcggcttttgaaccaggttagccctatccccaagttcatccatttcacatcgaatgagatactgttaagagcgtttgaagggaaagacagggttcacatcatagatttcgacatcaagcaaggacttcagtggcctagtttgtttcagagtctagcctctcggtccaatcctcctagccatgtaaggattaccggcataggtgagtctaagcaggaactagttgaaacaggggaccgactggcggtattcgctggctcgttcaaccttccttttgagtttcacccagttgtggatcggctggaagacgtgaggctgtggatgcttcatgtaaaggagggagagagtgtcgccgtgaactgtgtttgccaattgcacaagacgctttatgatggcagtggaggagcactcagggactttctcagattgatacgaagcacgaacccagttgttctcctgatggcagagcaagaagcccatcataatacaagcagcttggaagtgagggtcatcaattcgttgagatactattcggcattgtttgactcaattcattcgagccttccgctagagagcgcagccagggttaagatagaggagttgttcgcccgggaaatcagaaatattgtcgcttgtgaaggaagcgacagattggaaaggcaccagagtttcgacgagtggaggaaattgatggagcagggagcattccgttgcttggaaactactgaaagagagagaattcaaagccagatgctgttgaagatgtacgacgttgatgaggattttattgtcagtgagcgcgggcaagatcaagcagcacttactctgagttggcaggatcagcctctttatacagtctcagcatgggtacctgctgatgttgcaggcagctcttcctccttttctcagccgaattgatatccatgtcttatcaccatgcaaaccattaacttccattctttccgcacatagatgactgtgaaattctttgtaggtagaggaagactcgtcattctttcattcttttgctgcagataagatttgtcttcgggataggagcattatatgagtagctcaatactgatcaaagttattcgttgtagaaattatgggtttacattgttagttgtttggggtcattttgtgttgattatttcgattctttatgtacgatgaaattcttttgcattgtgtcaatcaatttgctctggtcaagagtcaagagtctgtaattttcgaagtactgttttcagtggaattattcttttgtgcttaaaaaaaaaa

SEQ ID NO: 220 - DNA, 833 bp, Eucalyptus sp.
gctttattatttccgccttccggcctctcctccaagcccattcccatttcccccattctctctctattctctccgcgaggaaaccctaaagggtcgtcgtcgtcgtcgaggttttcagccatgaagggaggcaactcgaagtcgcagtcgaggaacgctgcgctttcggtgaacaagaggaaagtgactaagaaggagaagaaggtgaaggatcctaacaagcctaagaggcctgccagtgccttcttcgtcttcatggaagagttcaggaagcagtacaaggagaaacaccctaataataaatccgttgctgctgttggcaaagctgggggagacaagtggaagtcgttgtctgatgatgagaaagctccttacatcgccaaggccgagaaaaggaaggttgagtatgagaagaccatgaaagcttacaacaaaagacaagctgaaggtaccaaagcagatgaagaggagtctgagaaatctatgtccgaggtgaacaatgaggaggaagatgaagatggcagcgaggaggatgaggacgatgattagacttctgggaagggaagatagtttttatctaggtcatcaaaaagcggtttagctatcttttgtcaaggcatctgtagttcgatgctcatttatttttttggtgccctctgattttgttccctttgaggaatgaagacaagtacttgtggaagggggagagcacagcgacttgtattgtgccttgatgacttttagatgggggcttttatattgtgtagagctatcattaagtaaattcgatttgtgattttatccaggtggtactttccttcttaaaaaaaaaa

SEQ ID NO: 221 - DNA, 742 bp, Eucalyptus sp.
ccgcgaggaaaccctaaagggtcgtcgtcgtcgtcgaggttttcagccatgaagggaggcaactcgaagtcgcagtcgaggaacgctgcgctttcggtgaacaagaggaaagtgactaagaaggagaagaaggtgaaggatcctaacaagcctaagaggcctgccagtgccttcttcgtcttcatggaagagttcaggaagcagtacaaggagaaacaccctaataataaatccgttgctgctgttggcaaagctgggggagacaagtggaagtcgttgtctgatgatgagaaagctccttacatcgccaaggccgagaaaaggaaggttgagtatgagaagaccatgaaagcttacaacaaaagacaagctgaaggtaccaaagcagatgaagaggagtctgagaaatctatgtccgaggtgaacaatgaggaggaagatgaagatggcagcgaggaggatgaggacgatgattagacttctgggaagggaagatagtttttatctaggtcatcaaaaagcggtttagctatcttttgtcaaggcatctgtagttcgatgctcatttatttttttggtgccctctgattttgttccctttgaggaatgaagacaagtacttgtggaagggggagagcacagcgacttgtattgtgccttgatgacttttagatgggggcttttatattgtgtagagctatcattaagtaaattcgatttgtgattttatccaaaaaaaaaa

SEQ ID NO: 222 - DNA, 871 bp, Eucalyptus sp.
ggcaccagaaacactctctctctctctctctctctccctctcacacacacacaaatacacaaagcacatctagaactcgcacacgcacgctctctcgctccttctctctctctctctctctctctctctccctcgcaggccctaagcttacaggttccgtcatgaaaggaggcaaggcgaaggcggagacgaccagagtcgacgccagtttgaagaggaaaggcgccgggacgcagcgagctgggaagaagacggcgaagaaggagaaggctgtgaaggatcctaacaagccgaagaggcctgccagtgcattcttcatcttcatggaagatttcagggtgcagtataagcagaagcatcctaacaacaagtccgttgctgcggttggtaaagctggtggagacaagtggaaatccatgtcagaagctgagaaagctccttttgcagcaaaggcagagaaaaggaaggatgagtacaacaagaagatgaatgcttataacaaaaaatcagctgaaggaaccaatggtgccgatgatgaagagtctgacaagtcaaaatctgaagtcaatgatgaggatgatgaggatggagatgacagtgcggaggaggacgaggatgacgactaagtcactattaccctcgaggagtatgtgtaaactgttacgccaacaagcaacaaaaaatttctgtcattttggacatgtagttgtttgccttgatgataattaggtgaacagtgattggcttgagtatcttctgaaacttaaatagcgatgtagttagttgtttatgctgattttagctgaagcttgtttctctgatctcatatatttaagcttctttgcactcaaaaaaaaaaaaaaaaaaaaaa

SEQ ID NO: 223 - DNA, 680 bp, Eucalyptus sp.
gctcacttatctttcccctctctctctttctctctctccctcaaccctaaccctacctcaccaaccaggattcaacatgaagggaggtaaatccaagtcagatactaagagtgccaggctctccgtgaacaagaaatcaaccgcgaaagctggaaagaaatcggggaaggcagctaaggatccaaacaagccaaagaggcctgctagtgccttcttcgttttcatggaggagttccgtgagctatacaagaaggatcaccctaaaaacaaatccgttgctgctgttggcaaagctggtggagataaatggaagagcttgtctgaagctgaaaaagcaccttatatagctaaggcagataagcgaaaggctgagtatgaaaagaatatgaaagcctacaataagagacaggctgagggtcccaaagaagaagatttggagtctgagaagtcggtgtctgaggtgaatgatgatgatgatgatgaagaagaagaagaagaaggcagcggagaggaagaagatgatgagtacgaagattcagcagggaggatagcataatgaatgtaggcttgtgatagttgtttaatcaaaatcttattatgttaatgcttttgatgtttccacgtttgttattcttttagatggacatgccatctaaagggaaaatgtacctctgaatcat

SEQ ID NO: 224 - DNA, 637 bp, Eucalyptus sp.
gatttttcttccattaaagaggaagctttcttgtaagaatgaagccaacaagaagcagagcggctgcaaggaagggcaacaaggaagcagttaagcctgttgacgacaggatcattggaaagcgaaaggcagctatccgagctgataagagtaacaacaaacgcgcaaagaatgtgacatcggccaagaaagaccccaacaaacccaagaaacctcccactgctttctttgttttcctagaggagttcagaataatttacaaacaagagcatccaaaagtgaaggctgtctcagctgtgggcaaagcggggggagagaagtggaagtcaatgtctcatgcagagaaagctccatatgaagcaaaagcagcaaaaaggaaatcagattatgagaaggtcatggcagcctacaagaagaaacaggaaagtactgatgatgatgaagaagcagagtctgaaacatcgaaatctcaagtcaatgacaaagatgatgaagaaagtgaggaggatgatgaagaagaagaggacgatgactgaatctcgcatggtttctgatttagtcctggcaatgaaccttgttaaaagttgtgtcttagttggctttgtatgatagtatatttgctttatgtcatgtgtgc

SEQ ID NO: 225 - DNA, 1018 bp, Eucalyptus sp.
ttccatcaacttcaacgacatctacgagaagaagatctcctcctcttcctccggccagcaaccctctctctctctctctctctctctcctcccctgttttttttttcactctttctcgttcccctgttcacgttcgatccccatcaaaagatgatattccccgcttgattcctctcgttcacgccccgatttctctccccttgaaagttgtcgcctccccggctccgtttcttgaagttttggacgaggaagaacttgtaacttggtaatgaagactacgaagggcaagggcccggccaggagctcaagggaagccttgaagcctgctgatgacagaatggttggaaagagaaaggcagcagctaggcctgaaagcaagcggaaagtcaagaaggataaacaggccaagaaagaccctaataaaccaaagaggcctcccagtgctttctttgtgtttctagaggagtttaggaaaactttcaagaaggagaatcctaacataaaggctgtatcagctgttgggaaagctggaggagagaagtggaaatccatgtctcaggcggaaaaagccccatatgaagccaaggctgcaaagaagaagaccgagtatgaaaagctgatgaatgcctacaacaagaagcaggagagcgtggatgaagatggtgatgaggaatcagagaggtccaaatccgaagtcaatgatgaagatgaagctagtgcagaggaggctcaggaggatgaggaagaagaggaggaagacgatgatgacgacgacgatgaggactgaagaaggatgttgtggaactccctggtcgaataggtcatcttgtggacaattctggaccgtaggtatacgatgcgttgagctcgcatatggcacttctggttcctgagtctaaattctgttttttgtttttttggctttggccagattcctatggcttgttgtataacatgttctggtccacagaaagtgcttgttgttgttacccaagtaaaaaaaaaaaaaaaaaaaaaa

SEQ ID NO: 226 - DNA, 957 bp, Eucalyptus sp.
gcgaaacacattctctctcttccttctctctctctctctctctctctaaaaccactttccatcttctctgcgactcgtcggagcggcgatggccggaggaggatcgtcgaagtcgaacgcgccgaaggcgaggaagagagtggaggtcgacgcggcggcggcggcggcggcggcggcttcttcttcgctcgtccgcggcaaggacggcagcgctttcgcccgatgtgaagagtgcaacaaggatgtgccagtggcgctcattagcatgcacagttgcggccttgatgccaaaattaagatgaatttggaggctcaagtcatggaaagacctgctgaggcgaagaagaaaccagcagtggatagaaagaggtcatcagaacccaaggctaagaaagctaaaacagaaaagaagtctaagaagggcaaggatgcaaatgcgcctaagcgccctgccacggcattcttcgtcttcatggatgatttcagaaaggcttacaaggaagcgaacccagattctaagggtgttaaggaggttgcaaaacagggtggtgagaaatggaagtcaatgtcggatgaagagaaaaaaccttacttggacaaagcttctgagctcaaagcagagttcaataaggccatggaggctcataatgctggtgatggagaaaatgaagagggttcggataaggaggaagctgcggatgaggaagctgcaaatgaggaaactgcaggtgaggaagctgcaaatgaggaaactgcaggcgaggaagctgcaaatgaggcaaatgaggaaaatgaggaagttttagaggatgagtagtcaatgctttgataatttttcatgttaatgtaggatggttttagtgtctggcttctagttgttgtaaatggaagctctagccagtgctctttttgggaaaccattgatttctttaccaaagtttctctccaaaaaaaaaa

SEQ ID NO: 227 - DNA, 1719 bp, Eucalyptus sp.
gagagagagagagagagttcagaaaaccaaaaaacccacctgcattcacgctgcccatttccctctcttcgcttcccaacaataaaaatctcacctttagccacccgagaaacccaccttcctgcaaacacccccgccccaaaccggaagactgaaaaaggggccaactttccgcagatcaaagaggggaattctcgaagcgggagcacctgatggactcaagggacgcgccaccgccacccgggatggtgggggtcgtggggtccaccggctcctaccccaccggcggcccccaacaggcaccgacccagcagcagcagcagcagcagcagccgccgcagcacctgatcaaccccaattcgtcggcggtcatgatgcagcaccgcttccccttcaactccatggtggcctccgggccgcaccccccgccgccgccccagcagcagcagcagcagcagcagcagcatcagcagcatcagcaggcggcgcagcaggagggggggatggatgccctcggtaatgccggcggcatttacgacggatcgtcgcagtcggggctgaggcccggcggtttctccatcgagccggccaagaagaagcgtgggaggcccaggaagtacactcccgagggcaacattgccctagggctcgggcccgcctcggtgcactcctcctccggcggggatcatcatcatcaccaccaccatggcggcggcggtggcggaggaaccagcggcggcggaggtgatgggaacctcacgggctcgtccgagccgcagtctaagaagcacagagggaggccacctgggatggggaagaagcaaatggatgctttaggagctggtggagttggtttcactccgcatgtgatccatgtcgacgctggtgaggacgtagcctctaaaattatggccttttcattgcaaggaccccgtacaatttgtattctctcagcaagtggagctatctgcaatgtaaccctcaagcagccagcaatgaatggtggaactgtgacatatgagggccgatttgagataatctgtctatctggatccttcctgtgtccagaaaatgaaagtggtcgcagcagagctggtgcattaagtgtgtcattagcaggtccagatggtcgagtgctcggtggaggggttgcgggattgctaattgccgctacacctgtacaggttattgttggaagcttccttgcaaattcaaagaaagcatcttcaagtgctctcaagtccgacgcttctccaacgccacagggtccacaatcccatatgttgaactttggtacagctggaacagcagtgagccccccctctgacggagcatcggccgattcatctgatgaaaatggcaatagcccaattaatcaccgacctaccggaatctacaacaacactagccagccgatccacaatatgcagatgtaccaccatctgtgggctggccaaactcctcactgaagaagttaactgagatataactggctttctgggtactactcaacttgagatcattgttcatcgtagccgcagatatatatacattaggccaacttggcaggcatcacccaaatgacatcttaatgaggcatcctctcgtcgactccattttatttcttgtttagtctttattctctttctgaacttggttactgggggtttgttaatttgaatcttatcggaacatggtgctgttgttgatagttgatag

SEQ ID NO: 228 - DNA, 2269 bp, Eucalyptus sp.
cctcgtcctctcccccccccaccggagcttcgaaatcgagcggcggcgacgcgatgacggacggccacctcttcaataacatctccctcggcggccgcggcggctccaaccctggacagataaagattttctcaggagggatttcatggaggagacaaggaggcggcaaagcagttgaagttgataaatctgacattgtcggggtgacctggatgaaggtgccgaggacaaatcaattaggtgtccgcaccaaagatggtttacattataagttcactggattccgagacccggatgttattagtttgaccaactttttccaaaatacctgcgggttaactccggaggagaaacagctttctgtgagtggtcggaactggggagaagttgatttgagtggtaatatgctgacatttcttgtgggctcaaaacaagcatttgaggtatctctggcagatgtctcgcaaacacagcttcaaggaaagaatgatgttattttggagtttcatgtagacgatacaactggggctaatgagaaagattctgtgatggaaattacatttcacgtgcccaactccaacacccaatttgttggtgatgaaaatcgtcctcctgctcaggttttccgtgacagaatcatgtcagtggcagatgttggggctggaggtgaagatgctgttgttacatttgagggaattgccattcttactccaagggggcgctacagtgttgaacttcatctgtcattcttgcgacttcaaggacaggcaaatgactttaaaattcagtacagcagtgttgttcgcttatttttgctgccaaagtctaaccaaccacatacatttgttatcatcactcttgatccaccaattcgcaaagggcaaactttgtatccgcacattgtgatgcagtttgaaaccgactatgtggttcaaagcacattgtctatgaatgatgatttatttagcaccaagtacaaggacaagctggaaccatcttataagggactcattcatgaagtgttcaccaccatcttgcggggtttatccggtgccaaagtcacaaaaccaggaaaatttcgtagttctcaagatggttatgcagttaaatcatcactgaaagctgaagatggagtcctgtacccactcgagaaaagcttcttctttttacccaagcctcctaccctgatccttcatgaggagattgactacgtggaatttgagaggcatgctgctgggggctcgaatatgcactattttgatcttttagtgagattgaaaactgaacaagaacatctctttcggaatatccagaggaatgagtaccataatctttttaacttcatcagtgggaaggggttgaagatcatgaacttgggagagcagggcgctgatggagtaccaggcgttcttgatgtggatgacgacgatgctgtcgatccccatcttgagcgcatcaggattgaagccggtgtagatgaaagtgatgaagaggatgaagattttgtcattgataaggatgatggaggatctcctactgatgattctggagatgacgagtccgatgtcagtgaaagtggagatgagaaggagaaagagaagtatgggaaaaaggaatctcgaaaagaagtcaaagcatcatcaagcaagaagaaagcaaaagctggagatgaagaggggtcgaagaagaagaaacagaagaagaaagcccccaatgcaccaaaaaaggctatgtctggttataactttttcttgcagacggaaagcgagaaaatgaagagaactaatcccggtctttcctttggggatgtatcaagagaaattgcagacaagtggaggggtttgtcagcggcagagaaagcgccatatacagcaaaagccgaggaagataaaaaacgttaccaagaacagttaagcggttataagaatacttctcaagctatgaatgtagattcagactgatgagggaaaactcgagcactcacgagttcacgatgctatcacgagttcacgatgctagcatttcttttcacatgtaacttgtagcccttgtgcgatgaacaaattgtaccagctgttaggatggatgtgttccgtcatagcctgctatagtgaatttctactggaaatgagatccatatgttgtaatgtttatgcggcactggtagccagtaattctgccgaacgatcattgggtgctcaagggttgccacatatggcttattcattaatcttatctcaggcaggagcccctttttccaaaaaaaaaa

SEQ ID NO: 229 - DNA, 2298 bp, Eucalyptus sp.
tctctccccttcttttctcccttctctcgcacctcgtcctctcccccccccaccggagcttcgaaatcgagcggcggcgacgcgatgacggacggccacctcttcaataacatctccctcggcggccgcggcggctccaaccctggacagataaagattttctcaggagggatttcatggaggagacaaggaggcggcaaagcagttgaagttgataaatctgacattgtcggggtgacctggatgaaggtgccgaggacaaatcaattaggtgtccgcaccaaagatggtttacattataagttcactggattccgagacccggatgttattagtttgaccaactttttccaaaatacctgcgggttaactccggaggagaaacagctttctgtgagtggtcggaactggggagaagttgatttgagtggtaatatgctgacatttcttgtgggctcaaaacaagcatttgaggtatctctggcagatgtctcgcaaacacagcttcaaggaaagaatgatgttattttggagtttcatgtagacgatacaactggggctaatgagaaagattctgtgatggaaattacatttcacgtgcccaactccaacacccaatttgttggtgatgaaaatcgtcctcctgctcaggttttccgtgacagaatcatgtcagtggcagatgttggggctggaggtgaagatgctgttgttacatttgagggaattgccattcttactccaagggggcgctacagtgttgaacttcatctgtcattcttgcgacttcaaggacaggcaaatgactttaaaattcagtacagcagtgttgttcgcttatttttgctgccaaagtctaaccaaccacatacatttgttatcatcactcttgatccaccaattcgcaaagggcaaactttgtatccgcacattgtgatgcagtttgaaaccgactatgtggttcaaagcacattgtctatgaatgatgatttatttagcaccaagtacaaggacaagctggaaccatcttataagggactcattcatgaagtgttcaccaccatcttgcggggtttatccggtgccaaagtcacaaaaccaggaaaatttcgtagttctcaagatggttatgcagttaaatcatcactgaaagctgaagatggagtcctgtacccactcgagaaaagcttcttctttttacccaagcctcctaccctgatccttcatgaggagattgactacgtggaatttgagaggcatgctgctgggggctcgaatatgcactattttgatcttttagtgagattgaaaactgaacaagaacatctctttcggaatatccagaggaatgagtaccataatctttttaacttcatcagtgggaaggggttgaagatcatgaacttgggagagcagggcgctgatggagtaccaggcgttcttgatgtggatgacgacgatgctgtcgatccccatcttgagcgcatcaggattgaagccggtgtagatgaaagtgatgaagaggatgaagattttgtcattgataaggatgatggaggatctcctactgatgattctggagatgacgagtccgatgtcagtgaaagtggagatgagaaggagaaagagaagtatgggaaaaaggaatctcgaaaagaagtcaaagcatcatcaagcaagaagaaagcaaaagctggagatgaagaggggtcgaagaagaagaaacagaagaagaaagaccccaatgcaccaaaaaaggctatgtctggttataactttttcttgcagacggaaagcgagaaaatgaagagaactaatcccggtctttcctttggggatgtatcaagagaaattgcagacaagtggaggggtttgtcagcggcagagaaagcgccatatacagcaaaagccgaggaagataaaaaacgttaccaagaacagttaagcggttataagaatacttctcaagctatgaatgtagattcagactgatgagggaaaactcgagcactcacgagttcacgatgctatcacgagttcacgatgctagcatttcttttcacatgtaacttgtagcccttgtgcgatgaacaaattgtaccagctgttaggatggatgtgttccgtcatagcctgctatagtgaatttctactggaaatgagatccatatgttgtaatgtttatgcggcactggtagccagtaattctgccgaacgatcattgggtgctcaagggttgccacatatggcttattcattaatcttatctcaggcaggagcccctttttaaaaaaaaaa

SEQ ID NO: 230 - DNA, 846 bp, Eucalyptus sp.
gccttttccctgccaggcaaaacagcaacttcgtctctgatcattcagaagaaagagagaggatcgccatgaacgacctgagcgaagatgacatggcgctcatctctgagctttaccctggagtgtacatgcgaccatctcctcctccacaagaggcaaagccgccgcggcggaggcggaagaagagcagaggactcgagaacccgggggaagaaggaggaggtacaggaggcgaggggcgggggaagcggaagctgaccgcggagcaggtggagctgctggagcagaacttcggggacgagcacaagcttgagtcggagcggaaggaccggctagcggcggagctcgggctcgacccgcggcaggtggcggtgtggttccagaaccggcgggcccggtggaagagcaagaagctggaggtggagtacgccaagctgaagtccgtccacgagaccgtcgtggtggagaaatgccgttttgagtccgaggtgctgaagctcaaggagcagctttcggaggcagagatggagatcaagaggctgtcggagaaagctgatctcgggctctccggcaacagcccatgctcctccgtcacggccgatgctgctacagacgatcccgtgtggggagattttggagttgctggagaatgtgatgaccaagatgtgctgtactacatgccccagaatgcttatttacagggcttggagtggtacaatcaatatgtgtagttagagggttaattttctagcgaatgattgctcttaggatatgtgtagatactgacccgtgcgctgtaaaattcatcttctaatatatgacttctagctgttgttaaaaaaaaaa

SEQ ID NO: 231 - DNA, 1051 bp, Eucalyptus sp.
gcagaagcatctcgtttcaggcaaagcatgaaggttcatcagttcgcacgtggattctttgagctcgaacccaccaccctcacgctcgggtgcaaacgcctccgccccctcgttccaaagctcccccaccagaccgacgtggtctcgactgccgcatttgtcgacatcaagagcttcatccgcccggagagcggcccgcggaggctcggctcctcctctgacgacaagagagaccctcctcaggtggaaacacatccaggagggacacgttggaacccgacacaagagcaaatcggaatactcgagatgctgtacagagggggaatgagaactcccaacgcgcagcagatcgagcagatcacggcacagctcagcaagtacgggaagattgaaggcaagaacgtgttctattggttccagaaccacaaagcccgcgagaggcagaagcagaagcgcaacagcctcggcctctctcactgctcgagaacccccaccacagccgccaccatcgccactgtaactttgaacactactaagggatcagaaggagagattagaggggaggaggacagtccatacaagaggaagtgtagaagctgggcatttgacttctcggaagtagaagaggatgtgagcaggtcatcatcatcttcattcagagatgaggatgaagcagttcactgtagaactctggagctcttcccgttacacccggaaggcagatgaaggtgttcggttcggaagaaaaatataacctggcaaaatcttcctctcgttctcgttctctctctctcgctctctctcgctctctcaccctttcactttatttcaaatactttgtgaggccaaattgtgatgtgatcatcgtctaagcatgatcttcccttcttctttctttttctttcccttcttttgaattagatgatgtactgctttttctttctcttttctttccttttgttccgggaaagaagaaagaaagacaagatgtgtcgtctcttgtctgacctctgtactctaatttaacctttgttctctctcaaaaaaaaaa

SEQ ID NO: 232 - DNA, 1593 bp, Eucalyptus sp.
ctaccgtaccgcctcacttaaatatcatcgccgtttgtcttcttgctcaactgttccaaatcccaggatcacagcaaagattcccttcaccatagcacgagcctccggctcctgccgagccgtccaagccgaaatagccacgctagggaaccaggtccatgtaacgcttcgtaatcaattgaatgaaggaagcacagagggcgagccagcgagcgagtgaaggaatagcgcctcccgacacccgtatataacagcaattcaagaactgcgcttccccacaatcttcccagtacaagctctagacggtctcgactcaaaggcatggataaagtaagtgcttcgtgtaattagactcaaccaccttctctgattccccatatatacccaccagaacgtcaatcaagcagagcagcagcaccgttggcttttaagatgtttagtacgggagaatattctgctgctgccttcgaaggcatggactcgctcccgagcccaaggaagaagaagaaccagctggtgaacagaagaaggttcagtgatgaacagatcaggtcactggagtctatctttgaatccgagtcgaggctagagcctcggaagaagctgcagctcgctagggaattggggctgcagccccgccaggtggccatttggttccagaacaagagagcccgatggaagtccaagcagctggagcgtgacttcgccattcttcgcgccaactacaacgccctctattcccggttcgagtctctcaagaaagagaagcaatccttggtcactcagattgagaaactaaaccaactcgtcgagaagccgcaaggagagggccagagctgcgggcatgatttggcaacgaacagcaccgatcgcgaatccgacaatggggttcccaagtatgaagacagtcagcctgtatttccggataaactaacgcgtttgatgggaatcccatgtgaggatgactactttggcctagaagaggagcagagcctcctaaacatggccgaacccgatcctgaacctgcccctgcggatagttccttgacatcacctgagccgtggggcagcctggagactgatgatcttctcaatcaatcgtccggcagttcgcagtggtgggacttctggtcttgagctgatggccctttagaacagattacccgacgatatcccccaaggatgagctgctctcttcagtgcctcagactccagagtgccagtagcgtggtcataagggcttcattagaaggaactgttgctcctaatgcacgcactttccttgaataagcatcccaagaaagaggacatgaaatcaatcgacaatccctgagggggagttgctgctgcagctagtggtaatttaaagatacagagcactgacgcatacccggtgccacgagtcagcacaagggagaacgtcccaccgacatgtaaataacaatgtccaagactcgtctagtgaggaggatttttgtgcatgttacttcagtagggtagcaaaccattttctttcattttacccctctttgctccaatgactgtgtttatggaagagagaatgacgcatacgaaattcagtcaaaaaaaaaa

SEQ ID NO: 233 - DNA, 1063 bp, Eucalyptus sp.
ctctcttttctctcaagctctctccttcatcttcaagaacacaagaccaaatcaatctcccaccatctcctcaaatgggcatagatgatctgtgcaacacaggccttgttctgagtcttggcctcgagacgcccttcaagatcgaagcccagaggcaagccaaacagcgccttaacttcgagccctctcttacgctgtgcctctccggcacgaccaaagctacccgcgacgagcagcctccggcggaccacttgtatcgccaggcttcgccgcacagccacaacagcctcagcgcggtgtcgtcgttctcgagtccgcgggtgaagagggagagggacctcagcagcgaggaggccgaggtcgagacgcgggtgtcatcgaaggcgagcgacgaggacgacgacggcgcgaatgcgaggaagaagctccggctcactaaggaacagtctgctcttctggaagagagcttcaaacagcatagcactctcaacctgacgaagctcaagcagaccgaagtggactgtgagttcctcaaaaagtgctgtgagacgctgaccgacgagaaccggcgattgcagaaggagctccaagagcttaaggccctgaaactggcccaacccttttacatgcacatgcccgcggcgaccctcaccatgtgcccctcgtgcgagcggattggtgcgggcccgagcgtcgacggcgcggcgccgacgaagggccctttttcgatgacgacaaaatcacacttatacagtcatcactttaccaatccatctgctgcttgctgattagaagttattagggttttagagatattacagagagagagagagagagagagacatatatagaccccaaatcacaaccccctataatttttgcttgagggcttgtagctagttaaagatccaatgtaattatttgttagggacatatagtaaactcctgatggatcatcatctccttgttttctttcttcttttttgggcttaatctgtaaatgttttaacaatatatttgagattatcaatggaggaattactttaatttattaaaaaaaaaa

SEQ ID NO: 234 - DNA, 1168 bp, Eucalyptus sp.
cgcctctcttctttctctcttttctctcaagctctctccttcatcttcaagaacacaagaccaaatcaatctcccaccatctcctcaaatgggcatagatgatctgtgcaacacaggccttgttctgagtcttggcctcgagacgcccttcaagatcgaagcccagaggcaagccaaacagcgccttaacttcgagccctctcttacgctgtgcctctccggcacgaccaaagctacccgcgacgagcagcctccggcggaccacttgtatcgccaggcttcgccgcacagccacaacagcctcagcgcggtgtcgtcgttctcgagtccgcgggtgaagagggagagggacctcagcagcgaggaggccgaggtcgagacgcgggtgtcatcgaaggcgagcgacgaggacgacgacggcgcgaatgcgaggaagaagctccggctcactaaggaacagtctgctcttctggaagagagcttcaaacagcatagcactctcaaccctaagcaaaagcaagctctagcgaggcagttgaatctacggccccgccaagtcgaagtgtggtttcaaaacaggagagccaggacgaagctcaagcagaccgaagtggactgtgagttcctcaagaagtgctgtgagacgctgaccgacgagaaccggcgattgcagaaggagctccaggagcttaaggccctgaaactggcccaacccttttacatgcacatgcccgcggcgaccctcaccatgtgcccctcgtgcgagcggattggtgcgggcccgagcgtcgacggcgcagcgccgacgaagggccctttttcgatgacgacaaaatcacacttatacagtcatcactttaccaatccatctgctgcttgctgattagaagttattagggttttagagatattacagagagagagagagagagagagagagacatatatagaccccaaatcacaaccccctataatttttgcttgagggcttgtagctagttaaagatccaatgtaattatttgttagggacatatagtaaactcctgatggatcatcatctccttgttttctttcttcttttttgggcttaatctgtaaatgttttaacaatatatctgagattatcaatggaggaattactttaatttattattttcaaaaaaaaaa

SEQ ID NO: 235 - DNA, 1063 bp, Eucalyptus sp.; identical to SEQ ID NO: 233

SEQ ID NO: 236 - DNA, 1491 bp, Eucalyptus sp.
cccaacgcctccccaaacgcaacgcaaagattccatttttccctctcgccgtcgcgtgaaactccggccgccggcggcctcagatcaccccgcttcagcagcagcagcagcaagcgctgagcaaaggggagaaggtggctgctttcatggaggcccactgagtcttcagtccggagcttccgacccaagaaagggagagcagacgaagcagagggggagaggcaaagagagagatttgaggagctggaaagtgttttgggaaggagtggcatgatggggttttgcatatgtccgctggagacgccggcgaggctgctgtggacgaccagcttcttccgtcacaagctcatgctcttctaactcgcggcctccctgtgtagacatagtgtaaactcgtttgtacgtatatctacgtgttaagtgctttttttccagtgcctcgccggagtttcggtcaggctgggatacaggttgccggagatccacctcgggctgagaagggtatggaggcagggcgttttctgtttgatccccccgcgcttcaggggaacatcctcttccttgataaaggatcaagatccatgatgggcatggaggaatccccgaagaggcgccggtttttctgctcgccggacgaacttttcgatgaggaatattacgatgagcagatgccagaaaagaaacgtcgcctcactcctgagcaggtgcttctgctggagaagagctttgaggaagagaacaaactggaaccggagcggaagacccagctggctaagaagctggggttgcagccaaggcaggttgccgtgtggttccagaatcgccgggctcggtggaagacaaagcaactggaaagggattatgattacctcaaatcttcgtacgattcccttctttcggactatgattccatcttgaaggaaaacgagaagctcaaactggaggtctattccttgacagaaaaacttcagggcaaggaagtcgatggagcaccaatgacaggcccctcggagccagctccgctggaggaggctgatgtccaggccgtccaattcagtgcgaaggtggaggataggctgagcacaaggagcgggggaagcgcagtgatcgacgaggaaggtccacagcttgtggacagtggcaactcgtacctcctgtgcgaaaattaccccggatgcgtagcccaatcggaggatgatggaagtgatgacggccagagttacttcccgggcgtttttgccgccgcgactgagcagccacaccacgaagaagaggaggagccaatggactggtgggtgtggtcttgagattggggcctccttgaagacctctctttttagctatggatagtctaatctctccctttgtttatgtgtgccttgtcataagaaggttcggttatgttcctccttctgtatacgatgtcaaataaatcgtagggatactgaacatggccgtctaatgaataagattacaggtctaaaaaaaaaa

SEQ ID NO: 237 - DNA, 1491 bp, Eucalyptus sp.; identical to SEQ ID NO: 236

SEQ ID NO: 238 - DNA, 1403 bp, Eucalyptus sp.
ggggaatttttatcctatttcagcttccctcctcgaaactcgctcgaccccatttcatgatctcttccccttgcctttaagcatacgttgtctcttttaacgatggagcgcgtgtgcttctcctgttgcaacagcagagtcattgaggagaagagcaagttgtgacagctgaaacgcttgctttttctgttctctttttttcctgtttccctcctctctccacttggtgactcgactctgcataaggagccgcaattagccgtgttgattatagccatgaagcggctcagtagctcggattcgtcggatgtctggatctccatgtgctcgggtaaagaggaaaaagtcctaaagaagagccaaggctacagcatagaatttcaggcaatgctagacagtctagaccaagaggatcattccggggaagaggccggcctgatcaccgagaagaagcggcggctcagcgcaaaccaagtgaaggccctggagaagaacttcgagatcgagaacaagttggagccggagcggaaggcgagattggctgaagaattgagcctccaaccgcggcaagtcgcgatatggttccagaaccggcgcgctcgctggaagaccaagcaattggagagggacttcggccatctcaaggccagctacgactctctgaagctcgacttcgatagcctcgagcaagaaaaggagtccctagcggcagagctaacggagctgaaggtgaagctccgtcgagaaacgtcagagagcagcaatcactgcgcagtcaagcatgaatcccccctctccgaatcctccgaagacggcaagcccgggtcgtgcagcggatccgtcaaggaagacccgaacccgaccccggagctgcccccctcgtcggctgctcccccgctccctctccgatacggcagttgctctacgtccccgccgccgccgccgccgccgccgcctccttcctcgtcaagagggaccacggcgggaagagggtactaccatcaggtgaggatggaagagaatcatccgagcgggttcatttcggaggagtcctgcaacttcttctcggtcgaccaacctcccacgctgcactggtacttcccatgaagattacagcattaagataaagcctagtcaataattcccgggttcttctccttttcccgggggggaccatgtcctgctctggaaatccgaatgccgtgccgtggtcgagagctggagttggcaagtattggagtcttcttcttccctcaaagatggggaagtggaactagatttggatctctcagcataatccctgacgagaacagggtctctctctctctctctctctctctctctctctatatgcagcgttgttaagtaatgaagagttagtaataaaatgtttaaaaaaaaaa

SEQ ID NO: 239 - DNA, 1152 bp, Eucalyptus sp.
cccccctctctctctctctctctctcaacttttgcacgcacccaccaagaaaaaggactaaatcttcaatctttcagcctcaaaggaagcgaaatcccctaggaaggaacgggttcttgttggttccggctgctcttgcgggcgttctctgttttgcctggagaagaggcgaagagggaaatcgagggagcatgatggtggagagggaagatctgggcttgtctctgagcttgagcttctctgacagcagccggccttcccagctcagcgcctctcctttcgggttcaacctctacaagccatctcaccgcgactgcgagaccttcgcttcattagatcggatctcggaggcggatgcgcggccgtccctgcggggcatcgacgtgaaccggccgccgccgtcggcggcggactgcgaggagcaggaggaggcgggggtgtcgtcgccgaacagcactatctcgagcgtcagcgggaagaggggcgagagggagatggtcagcggcggggaggacaacgaggcggagagggactgcagccgcggaggcagcgacgaggaggacggcgagaactcgaggaagaagctgaggctgtccaaggatcagtcggccgtcttggaggagagcttccgagagcacaacactctgaatcccaagcaaaagctggcgttggctaagcagctaggcctgcgacctagacaagtagaagtctggtttcagaaccgcagagcacggaccaagttgaagcagacggagatagactgcgagttcctgaagaggtgctgcgagaacctgacggaggagaaccggcggctgcagaaggaggtccaggagctgcgcgctctcaagctctcccctcagttctacatgcacatgccccctcccaccacccttaccgtctgccccaactgcgagcgcgtcggggcggccgcaccgccgctcccatccgccggcggcggcggcaggcccgcccaccatcgagagccggtgcccatgatcccatgggccgcgcggcccggcccggtctcgcacggggctctccggcccaggacgtgacttcggggaggacattttggtcaactcgaggatgtcttcatagcctttttaggatgctgtaccggtggggatgtacctaagtatgtgaaaaaaaaaa

SEQ ID NO: 240 - DNA, 1336 bp, Eucalyptus sp.
gcctcaagagaatttattccctctcaattttagcttctagcgttctttttcccccattttatcaaatatagtcatcatcacgatcgccctcccttttcctctctctatttctctctctctctctctctttctctctctctctctcggagcttcagcaagactgtcaggctaaactgtggagtctcaaagattccaacaggaggagtgcgtgcataaggctcaggacatgacttgcaactagcgagggattggactgatggccttcttttcaccaaatttcatgcttcaaagcccgcacgatcaagatcatgaacaccctcatcaccagcatcagcaccagatcctctcctcttgcacgcctcaggacttccatggtgttgcctccctactgggcaagagatccatgtccttcacgggcattgacgtgggcgacgaccccaacatcaacaacggcaacgttaatggggaggaagatctgtccgaagatgatgggtcgcagccagggggagagaagaagaggaggctcaacatggaacaggtgaagacattggagaagaactttgagcttggcaacaagcttgagcccgaaaggaaaatgcagctcgcgagagcacttaatctgcaacccagacagatcgccatttggttccagaacaggagggcgaggtggaagacgaagcagctggagaaggactatgatctgctcaagagacagttcgatgccgtgaaggctgacaacgaaaccctccaagctcagaaccagaagcttcagactgagatactggcactcaagaataccagagaaccagccgaatccatcaacctcaacaaagaaaccgaccagggctcttgcagcaaccggagcgagaacagctccgagatcaggctcgacatgacgcggacgccgccggttgagagcccggtctcaggccacgcgctgccggcagctggccggcagctgttccctgcctcgatgaggcctgccgcctccggaggatcggtggcgcagctgttccaaaacccttcgaggcctgatcttccgatgatagtcaaggaagaaagcagcatcaccaacatgttctgtggcatcgaggatcactctgggttttggccatggttggagcaacagcattattgaaaggaaatcaaggagccaaatcgaaatcaattcctacttggagccaagctgtgggaagtacattaatatgttattctccacgagataacttataagaaggaagggaagaggaagatccccatttttcttgcttaaattttggtgtaaaaaaatagcaacgcatatgataatttgggaattttgaggtcaaaaaaaaaa

SEQ ID NO: 241 - DNA, 1471 bp, Eucalyptus sp.
ctctctctgcctctcttaccccatcggccacaccttcttcctcgcttgcgaacctcttcctttgtcgatacactctccctcctttggccctccaaaaattctgctcttctgagtgatgggtgtgacctgccggtgctcgcacacgttccacataaccgagatcatcatgaccagcttcttccgccataagtcttaagtccttcatctctcccggttccagacccccttcttttcatttcggtcgatggtgtcgagctagagaccagaatccgacccagaagagcacgcgtggggggggatcgtccatggcgggcggtggtggttgcgagggttcggcgatcgcatctttgcttcagaaccagcgagtctctccctcttccgatgcctttttcttttacgggtcttctttttctgtaggatcgagatccatggtgagctttgaggatgctagcggggcaaacgtgtcgaaaaatcccttcttccaagcgtttgatccccatgaaatcggggaggaagagctggacgagtatctccatcaacccgagaagaagaggaggctgacgaccgagcaggtccatttcctcgagaagaacttcgagctggagaacaagctcgagccggagaggaagatccagctcgccaaggacctcggtttgcagccccggcaagtcgcgatatggttccagaaccgccgggcccgatggaagaccaagcacttggagaaggaatacgaagatctgcaagccagctataacagcctcaaggccgactgcgacggccttctcaaggaaaacgataagctcaaaaccgaggttcttgtccttacggacaagcttcttatcaaagcaagaggaacgcaaaattccaaattgtccaacgcatcatctcctggaccaccggagaatcccgtcgcctgctccaagggcgaagaagagagaatttcgacggtacccgaagatgtctgtcccggcaagagcgagatatcggattccgacagtccaaatggtggctattctccgctgagagagcacggtgattcttcctacgccttcgagcccgacctctcggattcgtcccaagacgaggactacacgcggaatgagaacctgcagcatctgtgcgtcttcccgaagctagaagagactcgagacgattaccccatcctatccacaagctcgtgccatttcggattccctcccgaagatcaagcctcctggccctggccgtactaaggaactatcggcatcttaaggcttgtttcttccatgaaactggactcttgtgaattatgaccataaataagcaatcaacttcatcgttagcgctcaacgcagatctgatcctgtactccgcagtagttttttacccttttccgagccgaaagtcatgttagtagttgtcgaccccgtcttctgccacgcaattatacttgtattgaaagcaaagtttgtttgcaagctcaaaaaaaaaa

SEQ ID NO: 242 - DNA, 1850 bp, Eucalyptus sp.
ctcctcttccccctcataggccctccttcccttcttaaactgcacacctcaaccttctttctctctctctccctcctgctctgtgtggcatattctctctctctctctctcttcccttgtggaagcgaaatctgtgcaaaaacgcaggagggttgcagcagaaagtcttgcatccatctctgatcccaatattgcctttgcccctctcttcccttccctcatgcacacacctttaacgagaaaactgtcttctcgttcttttcgtcgtcataatattcacagtccattatcaagatagttccccaagacaaccctctctctctctctcttactctctttctctctctctgtggtcctatctctttctttcttgaaaaccctcgtcactcctcttccttgccacaaataaaaagcacccgactttctccacgataccctttaaggcctttaatttcccctccccatctttcttttcactggtgacttacacatcctcctaaggcttcgacagattctcttgtacgacgcgcagtagacgaagtaacatagcccaccatatgcaagagccgaacttggccatgatgggcggcggtggtggcggcggcggcgggggcggggggatcgtcggtggcggcggcggggggctgggcagcgaggcgtcgttctcgggcgatcacccgcagcgccagctcaagggggagatcgccagccacccgatgtacgagcagctgctgtcggcccacgtggcgtgcctccgcgtcgcgaccccgatcgaccagctgccgctgatcgacgcgcagctggcgcagtcgcaccacctcctgcgctcctacgcctcctcggtgcagcacggccacagcagcctctctcctcacgacaggcaggagctcgaccatttcttggcacaatatctggtggtactatgcagcttcaaagagcagctgcagcagcacgttcgagtccatgccgttgaagccgtcatggcctgtcgtgaaatcgaaaacaccctccaagctctcactggaatgagtttgggcgaaggaaccggcgcgacaatgtcggacgatgaggatgagttgcaaatggatttctcattggatcaatccggtgctgatgttcatgacctgatgggattcggtccactccttccaactgaatccgaaaggactttgatggagagagtccgccacgaattgaagatcgaactcaagcagggtttcaggtcaaaaatagaggatgttagggaggagatactacggaaaaggagagccggaaaattacccggcgatactacttctgtgttaaaaaattggtggcagcaacactcaaagtggccatatccaactgaagatgacaaggcgaaacttgtggaggagacaggattgcagctgaagcaaataaataactggttcatcaaccaacggaagcgaaactggcacaacaattcccaatcggtcacctccttgaagtccaagcgcaagaggtaggcgcaacggaccatcatgcttgtctttgtgccgctaactgaaacacgaaacttatcaatcggtattgactctgatataaccttctgatcgactgggggtatactttatagctagagctgaacacttgtggtggtggatcaagcagtgatggtaagtagatgattcattatggaattagggcctgtaacaaatgatgcaaattccagtagattacatacacaaaacccagaaaattgatgtctttttgtttggttagaagtgcttctgttgcctaatctctcttgtatttaggcccaaaacaaacaacatgttgatttgttttctgtttttataaaattgttgtttttggcagtaaaaaaaaaa

SEQ ID NO: 243 - DNA, 1364 bp, Eucalyptus sp.
tctctctccgttcccctctctctctctctctctctctctctctagacaataagtgggcattcaaagctctgtgctttccaccgaaaggactccagcagaaaggactcgtcgtcatgggcgagagagatgatctgggcttgagcttgagcctgagcttccctcagggtcacctgcatcagcagcagcagcagcagcagcggcagtccctgcagctgaacctcatgccctccttggtcccgtcctctgcttcgtctgctcaatctgggttcaatcttcagaagcgctcctgcaacgacgccttcccttcttcttcagatcggaactccgaggcgcgatcgttcctccgggggatcgacgtgaacagagagccgtcggcgggggcggcggcggactacggcgaggacgaggccggggtgtcgtcgccgaacagcatggcgtcgacggtgagcgggaagcggagcgagagggatcaccagagccagaccaacggcgacgacctcgacaacgagagggcgtcctcccgcggcggcggcagcgacgaggaggacggcgacatgtcgaggaagaagctccggctgtcgaaggaccagtccgccgtcctcgaggagagcttcaaagagcacaacaccctcaatcctaagcaaaagctggcactggcgaagcagctggggctgcggcccagacaagtggaggtctggttccagaacaggcgagccaggacgaagctgaagcagacggaggtggattgcgagtacctgaagcggtgctgcgagagcctgacggaggagaaccggcggctgcagaaggaggtgcaggagctgcgggcgctcaagctctccccgcagttctacatgcacctctcccctcccaccaccctcaccatgtgcccctcctgtgagcgcgtcgccgccccgtctcccccctccgccgtcggccgccccctcgccgccgtcccggcccacccccgccccgtgcccctcatcaacccatgggcccctgcggccgccccattggcccacgccccgttagacgccctccgctcctgttcgtgagcgtggaggggccgtcggggttgggttccgggtcatgggcattttggtcattttacgcgggacggtgtccggatcgaaggagttggagaaattgtacaaattctggagtagcgttttggtctctaaggatatggtttgtcggaaaatgagattttggagggtctacaatgttttgtaccgtgacccatcatcttttccctgaaagtttaggatttgggacaaagacgtcaaaaaatttgtaaaatccgatgttccattaatttttactaacctatgattggtggccaaaaaaaaaaaaaaaaaaaaaaaaaa

SEQ ID NO: 244 - DNA, 1631 bp, Eucalyptus sp.
tcttcttcctgtaaagagagagagaaagagaggagctttctctgctcttctcccaccaccctgcactgaaagattcatcaccctttgagatccccaaaccccctttcagaacccacaccccaaagctctctccccaacctctccaacctgagattgttcaaatcccctgtttccctctgtggccccctgcgtgatgggtgtttgcagccggtgttcccacacttctcacatcacagagatcatcatcaccagcttctttcgccacaagccttaggttcttcacctcgacagagacgcggagggaagacgagacagtttgatcgtctgaagaaaccgctgtcatggaagtagcctgagtgaagagactttgaccaagatcacccacccttttttctctttttttgttcgcgacctctgctgatggcgggcggtgcttcggcttcggcttcggctatcacgactctgcttcagaaccaaagggtccctcctcctcctccttctgatgcctttttcctttctgggtcttctccttttctgggttcaagagccatggtgagcttcgaagatgctcacaggggaaacagattgaacagaccgtttttccggtcaatcgaccctgatgaaaacggggaagacgacctggaggattacttccatcagcctgaaaagaagaggcgcctgactgttgagcaggtacagtttcttgaaaagagttttgaagtagagaacaagctcgagccagatcgcaaaatccagttggcaaaagacctcggattgcagccacgacaggtagcgatatggtttcagaatcgtcgtgcacggtggaagacgaagcagctagagaaggattatgaaactttgcaagcttcttttaacaccctgaagtcagactacgacactctcatcaaggagcggaatgatctgaaagccgaggttcttaacctcacggacaagctgcttcacaagggaaatgagaaggagagttccgagtcgtccagcaaatctcaagggctattccagaaccccattgctgattctgtttctgaggacgaagtgtccagagtccccattcctacatggccagaggatatttgctcggtcaagagcgacatgttcgattctgaaagtccgcattacactgacgctgcccactcttcgctcttagagcccggcgattcttcctatgctttcgaacctgaccattcggacctatctcaagatgaagaagataatttgagcaagagccttttgtccactcgcaattacccaaagctcgaaaactctgactacgccatcctgcctccaaattcgtgtaactttggattccatgctgaggatcctgccttttggccttggtcatactgaaggcgtccttgatgccgttcactccctttgttttcttgtatcatatatgaggggatacgctataagtatgcaataagctccatcaatagctagcatctgtccaaatgctgtagtgagctttctcaaggaagttggaacctgtgttgatttccttttctttaggttttgtccttcaatgggatcgtctgttttctatgtaaactaaataaagaaaccttgtttatcaatacagtctcgagcatgttacctctttgctaaaaaaaaaa

SEQ ID NO: 245 - DNA, 1631 bp, Eucalyptus sp.; identical to SEQ ID NO: 244

SEQ ID NO: 246 - DNA, 1264 bp, Eucalyptus sp.
ctcctctctcataagtcataattcacaggcgcggcacaaggcacgaaaagataaaaaaaaaaacgatggccggtgaggagccctattctgccgacacgaactcggacactttcgctgatgaagaaacgctgattccgagttcttccgaggctcttgagtccgcctgggttcctacttcctcgaccgctcatcatggttcaaaatcagtggtcaattttgaggacgtttgtggaggaggagacaccaatactgcgccgaggccatacctccgacagattgatctgaaggaagaagccgtcgaagaggactacggcgacgggaactttcagcctcctggtaagaagcggcggctatcggccgaccaagtccatttcctcgagaggcactttgaggtcgagaacaagctcgagcccgagaggaagatccagctcgccaaggacctcggcctgcagccgaggcaggtcgcgatctggttccaaaatcggcgagcccggtacaagaccaagcagctggagaaggattatgattcgctcaaagctcgcttcgagagcctcaaggccgatcacgacaagcttatcaaagaaaaggagaatttgaaaggggaggtcctgtctcttagagacaagctgaggagcagagcaaaaggaagcgaggagggatcgctcgaagctgatgattccttgcgtggagcgactccgaaaccaaccacaccctcaactctcgatgccgtttcgtacgtggatgccacgatcttaaagcaggaggacgtgagttcggccaagagcgatgtgttcgattcggactcgctgctggaacctgcgaattcttcccacgtgttcgaaccagactgctcggacttctcgcaggacgaggatgacagtttcggcaagagcctcttgcccctggatttcctccccagatttgatgatggatacgccttccaacagaacccacctgcaatttcttgcaattttgctttcccagctgaagaaaatcccttctggtcctggtcttactgagtaaaaacaaaatgttacaggataaacgccatggcagcttaagggtagagtctccgctacgatgcatttagctataagtagaacaagaagtaaattctggtggtttcttgaattggcatcttttgtgggtcgatgcgaaagccgaggcacaacacgcatcccaatctcgggctgctaaatctgcggccacggtttcacccaaaaaccaattctgaatctgaaggtgtctatctagaaaaaaaaaa

SEQ ID NO: 247 - DNA, 1245 bp, Eucalyptus sp.
ctgaagacccaaatcctccctcacttctaggtgcatagtttgatccctctcattctcatggatgaaatgtacgggctctgcggcggcggcggcggaggaggaggaggaggaggagaggagtactccgagagggcgctgatgtcgccggaaaacctggtgctgccgtcagagtaccaggcctggctgtgctcggccgggtttagggataatcgaatccccatgtacgggttcgggtcggaggagttcgtgtcgtcggcgtcgggcatgtccgagaccgcctcggtcacacccgaccaagaggatgcggcggagacagcgatcaagtccaagattaagtcccacccttcgtaccctcgtttgctccacgcctacatcgattgccagaaggtgggagcaccaccggaagtggtggggctgttggacgaaatccggccagagaacggcgtgtgcaagcgagacgccgccgtttctacatgccttggtgccgatcctgagctcgacgagtttatggagacgtacacagatatattggtgaagtacaaagccgaccttgcgaggcctttcgacgaagccaccaccttcctcaacgcaatcgagatgcagctcactagtctctccacttccactcgcaccggtgcttctgcaaatgaaggtgatgcgtcatcggatgaggacttcagtggcggggaagtggaggcacccgagacacaaccgaggggtgaggacagagatctcaaggatagactcctgcgcaagtttgggaatcatattagcacgttgaagctggaattctcgaaaaagaagaagaaagggaagttaccaaaggaggcaaggcaaacactgcttgagtggtggagtgtccacaataagtggccttacccaacggaagccgacaagattgcgctggccaaatccactggcctcgaccagaagcaaataaataattggttcatcaatcagaggaagcgtcattggaaaccctcagagaacatgcaattcgctctcatggacagtatccccgggcaatattagtggctgattgaggtgaactggatgtcgtgcttgctgcgacattaggtgatcgcttcctgctgcgctcatgttgtttctttgtgtacatcgcatccttggtgactccttaattcccccaaaaaagggggaaggcattgtgattctacatgctctgtaattgaactcatgcaagaatggttaacaaaatgtctaaatgactttataaaaaaaaaa

SEQ ID NO: 248 - DNA, 1334 bp, Eucalyptus sp.
gcgaagatcgaggctgtatttatcagcaggcctgggcaagatttgatggaactgggagaccaagaacaggaaagagagatgccgagttctttggggtacacccctccacataaagattcttcctccaaattctctgctgcaaatagaagagatcaaaccctagatcagccaaatcatctatatcctcaaaaccaccacccaccaaatccacaccaattagctaacaagcctagaagagaatatcaagaaaccgaccaagatccatttgcagtcgcgtctccatctccaattgcggtagctaccggcggcacttcggtcagcattaaaccacacacggaaccaccatcgccgccgcaagggcaactcacgcagtcccccacgccacagccacagtcagtgacggctcttatctccacctcctccatccgatatagagaatgccttaggaatcatgcggcgagcatgggcggccatatcatcgatggttgtggagaattcatgcccagcggggaggaagggacgccggggtatttcagatgtgctgcgtgtgagtgccaccgcaatttccatcggaaggaggtcgatggtgaaccgcagtacacacctagtctgtactatagcagcaacaagaccaatggccaaagagctgctttacctcctccccaacatcatgcaattccccagccgaacccaatcaatctgcatcacaggttctcttattgcatatcaagcgctgctaccaccaccacgacgatggccctaaatcaaccagtgatgatggccttcggcgggggcgtcccagaagagtcttctagtgaagaccttactatgattcaacatagcgatgctatgctgcgttcaacacagctggcgtcgtctaagaaaaggtttcggacaaagttcacgcagcaacagaaagacaagatgatggaatgcgccgagaagttggggtggaggattcagaagcaagatgagcaagaagtgacccaattctgcgctgaggccggtgtgacgagaaaagctttcaaagtgtggatgcacaacaacaaacaagccatgaagaagcaacaaaggtaaaaagatcaagtgactcttgttcaggaataagattgtaattgttgaaactgtctgtttataattagaggagatagatcggagcaggcaattttggccgattttccctcatttccaaggctttgttgtagcgtgatctgccctttttagatgcttctgaatcatcagcaactcagagctgcttattaattcatggcgacacctgtctgccatgccttgaattatacagaaaagataatagctagagtggaaaaaaaaaa

SEQ ID NO: 249 - DNA, 2274 bp, Eucalyptus sp.
gccgagctggtttatttaaagagagagaaagcgcatgaccaccagctggccagtgatattgcttctccgatctctcccaatcccctcctctcactctcccccaaaaaccagtctctggttttcctctctcccctgcgcacacacacattctctctcctccttcccaccattattacagaaacagcagactgcgtagtgttgaaaaacttgatccacaattgattgggtaatgatgatgatctagagggagagagagagagagagagagagagagagcataaattcagtgcaagcttttgattggtgattggtgattggtgacatctcttctgggttgggtttgggtttgggtttgtgggtttgggtttgggtgggtcttttgcttgtgagagtattattctttcttcaccctctgtgcatgaattttcttgggccatgctcatgcattctcctcctctttcttcatcaccatcgtcatcgtctctggctttgatgggttggcgagggggggagctgagggagagggagaggagaggagagaggagcggctgtgcgttcgcgtgcagggctgcacgaggtggtctcgtttcgggcgcgggcgctctgcttccatggctgcttttaagtaagacgccaaaagaaaacctttttgctctctcgagtgtcatgaactcgcactgaaagtgcgcgccgaaccgagaagaagaagaagaagaagaagaagaaagagaaaccacccccttagaaaacgcgaaaaagagtaaatagtaaaaagagcaagcttgatcttacttgatctaaaacattaagatccttctctgttcgagagaagtcacagtcccgctttttccagacatgaagagacttggcagctcagattcgttgggtgctttgatgtccatctgcccaccttcagaggaattgcagcacagtccgagaaacggcaaccccatctaccacagcagggacctgcagtccatgctggagctgggcctcgacgaggaaggctgcgtggaggaccagtccgccggcggcggggggcacgtcggcggcgagaagaagcggcggctgagcatcgaccaggtcaaggccctggagaagaacttcgaggtggagaacaagctcgagccggagcggaaggtgaagctggcccaggagctggggctgcagccgcgccaggtggccgtgtggttccagaaccgccgcgcgcggtggaagacgaagcagctggagcgggactacggcgtgctcaagtccagctacgaggcgctcaagctcagctacgacgccctcaagcacgacaacgaggcccttcacaaggagataaaagagctgaaatcgaaactccgggaagaagacgacaaccccgagagcaatctctccgtcaaagaagaggtcatcatccccggccacgacgtgtcggacaagatccgggccgcggacgacggcgacgacgacaccaaacgctctcctccccctccgatcaccgccccgcctcgcgagctgagcttcaacaatggcgggctgaaggacgggtcgtccgacagcgactcgagtgcaattgtgaacgaagagaacgcggcgaccagcagcagcagcccgaaccccgccgtccagagccacggcggcttcttgaaattcatggggtcatcgtcctcttcggcctccccaccgccaccgccaccggcttccttcggcgggtgcttcagcttccagttccagcgagcgtaccagcctcagcctcagcctcctcaccaccaccaccaccacagtccgtacgtgaagatggaggagcacaatttcctcggcggcgaggaggactgcaacttcttctccgacgagcaggctccgacgctgcattggtactgccccgatcagtggaactgatggatacgaacttctctcgttggatgggactgcagattagagatcgataaaaaaaatgtagggcgacaactccctagctttacgtgcttgtgaagtgaaacaaactctcgggcacatgattgcacgaatcacttcaacccggcatgacatgactcgacacgacgaaaataagatcgagctagtgagagagaggggtttgggcacggagcgaaaattcgagtagtatgcagttccttattgcacgcggcattccggttataggatgcaaattagaattgaatatgatgcgatatggtaatgtttttgtttccctcttgtgatggatcatgagaattcagcatggacaaggggtgaataagaagagtttctcaaaaaaaaaaaaaaaaa

SEQ ID NO: 250 - DNA, 2274 bp, Eucalyptus sp.; identical to SEQ ID NO: 249

SEQ ID NO: 251 - DNA, 1777 bp, Eucalyptus sp.
gctcagccccaccttgatcgcctcgtctctctcctctctctctctctctctcttcctccctcctctgcaatttgcacggagccctcccgctctcgcttctttaacatgcccaccacctcctggtgcaacttcacctcgaggcctccgtgagctactgtgtgggcgtgcttctcttctcgtaataattctaatcctaacatggtgtggtatgcgagacaaaaccagaccagaccctccatggctcgtctagtccctttcctatccgtttcgtgacccacctgggcatctccaattactctctctctctttctctctctctctagggttttcgaagacagctcctccccctcgaagctcgctagggttttggatcgtcgtctcatctcgggtcgtgtttggaatggaggaatatggccagatgaacgagaacagtagcactgggtccagagggaacaacagcttcttgtacgcatcgccggttcttgggccgagctcctccggcaatagcaattacgggaggggaaatagcagcggtggccacttctattcccagtccggcgatcactgcttccaatccgaagcgccgccgcacccggtggtgaagactgaagcaaccacctctcaccacggccatgctcagaagtttcatcactattctctggtgagagaccatcatgacccatcagcttctcaccaccaccaccaccaacaccaccagcatcagcagctacaaacagcgagcgagagctcgcgcgaggtcgatgccatgaaggccaagatcatcgctcaccctcagtattccaacctcttggaagcttacatggactgccaaaaggtcggagcgccgcctgaagtggtggcgaagctgtcggtggcgcgacaggagttcgagtcgcggcagcggtcgtcggtggcttcggcggacgggtcgaaggacccggagctggatcaattcatggaagcgtattacgacatgctggtgaagtaccgggacgagctgacgcggccgttgcaggaggccatggacttcatgcgcaggatcgaaactcagctcaatttgctcagcaacaatggcccagttcgcgtcttcaactctggggttggttcatcggaagaggatcaggataacagtggcggtgaaacagaattacctgagattgatccgcgtgctgaggatagagaactgaagaaccatctgttaaggaagtatagcgggtatttaagtagcttgaaacaagaactctccaagaagaagaagaaaggaaaactacctaaggaagcccggcagaagctgcttagctggtgggagttacactacaaatggccatatccatcggagacagaaaaggtggcattggctgaatccactggtttagaccagaaacagataaacaattggttcataaatcaaaggaaacgccattggaaaccttccgaagatatgcagttcatggtgatggacggtcttcatcctcaaggtgccgctttatacatggatggtcactacattggtgatggtccctaccgtttgggcccgtaggctgtcaatccatgcaccataatcggatatataggtttgatgttcttgcagggtcctctggtggttgcttcgcctttacattatgtgtcctagtgtatgaattgttagttgtgccacctgatcaaatcatgttatagagtgttgggtaaagtccatggcaacccaatgcaagaaatatttttgatgactaaggtcattcttaggtcatatctatgtatcctctctataaaaaaaaaa

SEQ ID NO: 252 - DNA, 1743 bp, Eucalyptus sp.
ggagagagagacagagggaaaagggttttgcattaggccatacactgtggaatggagggcggttcaaacagcactaattcgccttcctgtttgatggcttttggagagaacggtcaccacagtggtggtggtgatgggctatgcccaatgatgatgacgatgatgcccatcaacaccatcacctcatcatcccatccccatccccatccccatcatcaacatcatcatcatcaccatcaccatcatcaaaacctaaacacaagcacccaccagtactttcttgaccaaacagctcgtaatagcagcagcggttcttctccgattcttgacgaccgcaacaacaatagcaacaacaacgcgggtggttcaggttcaggctcaggctcaggttgtttcttcatggacaacgatgtcaaggccaagatcatggctcatcctcactaccaccgccttctctcagcttatgtcaattgtcagaaggtgggagctccgcctggcgtggtggcaaagctagaggaagcgtgtgcatcggctgcgataatggccgggaacagcggcatgagcaacacaggttgcattggtgaagacccagctcttgaccagttcatggaggcctactgtgagatgctgactaagtacgagcaagaactctccaaacccttcaaagaggccatgctcttcctccagaggatcgagtgccaattcaaagcccttactcttggtgttccttctgattctgtggctttgagtgaggcttttgataggaatggctcgtccgaagaagatgatgtgaacaacttcattgacccccaagcagaggacagagagctcaagactcagctcttgcggaagtacagcggatatcttggtagcctcaagcaggagttcatgaaaaagaggaagaaggggaagctcccgaaagaggcccggcaacaattgcttgattggtggagtcgacactacaaatggccttacccatcagaatcacagaaactagctctagcagaatcaactggactagatcagaagcaaatcaacaactggttcatcaaccaaaggaagaggcactggaagccatcggaggacatgcaattcgtggttatggatgccactcaccctcattactacatggacacatgctcggcaatccctttcccatggacatctctccgaccttgctttgaagtctatggttgatattgctaatattattcgaccctagtgtcattatgagctctaaatgtgctctttccgagtgctgtagacccacctaatcatttgatggcaagttgtgaagcttatgagtacactatgtattgtgccggcttgtggcacatggaaatacatgataacatccgataagattatgacctgttagctatatttggggttcatgtatgactatggttagtttcgcggctatggcaaggataaatttggaaattatgtcgtaggtaattttggtgaggattagcatatcataaagcttcaaatttcgtatgtaccatttagctagcttaggccttaagtgaaaaatagacaagatcgtgtgcggtgattcaattagtgatgcgagtgtaaattatgcttctatggtattgcagtttgtgaactcaaaacatgtaagaagtgcatctaacaaaagcagcgtatgatgattttctaacgtctgtcatacgacattatgtaaattatgagtgcacaatcagacttggtaagtgtgaatatttagcaaaaaaaaaa

SEQ ID NO: 253 - DNA, 2024 bp, Eucalyptus sp.
gctctctctctattttctctctctatctctgttctcgaacctctgcggcgaattccttctctctataaccgaagagtatgaacgcgccataagcgtcgtcgtcttcgtcgtcgtcatcgtcatcatcaacgggattcctcccatcgcccctcctcctctcccaccgcatggccttccacaaccacctctcccaccaggacctctcctccctccaccacttcgccgccgaccagcagccgccgccgccgcagcaccagcagcagcagcagcacctgccggactcctcctcctccgtccaccaccagctccaccacgccgccggccccaactggctcaacaccgccctcctccgctccgacgccgcggcggcggcggcggcggcggcgggcggcaacagcttcctcaacctgcacacctcgtccgactccgccgcgtcgccgcaggcgcagcagcagccgccggcgacgtccgcgtcggccgcggcggggcaccaccagtggctgtcgcggcagcactcgtcgctgctgcagcggaaccacagcgaggtcatcgacgcggactcgatcatcgactcggcggatttgaaggagagcgtgagcaagggggacggcgggggcggcggggccgcggagagtaattgggagaatgccaagtacaaggcggagatattggcgcacccgctgtacgagcagctgctgtcggctcacgtggcttgcctgaggattgccacgccggtcgaccagttgccgaggatcgacgctcagctggctcagtcgcagcatgtggtggccaagtactcggcgatgagtcaaggattggtcgctgatgataaagagcttgatcagttcatgacacattatgtcctcttgctttgctcttttaaagaacaactgcagcaacatgtccgtgtccatgccatggaagctgtaatggcatgctgggagattgagcaatccctgcaaagcttaacaggtgtttctcctggtgaaggtactggggcaacaatgtctgatgacgaagatgatcaagttgatagtgacgccaacttgtttgatggaagtttagatggtacagatagtttgggatttggtcctctcattccaactgagactgagagatcattaatggagcgtgttaggcaagagttgaagcatgaactgaaacaggggtataaggaaaagattattgatatacgagaagagattcttcgtaagcgaagagcaggaaaacttcctggtgacaccacctcggttttgaagcaatggtggcaaacacactccaagtggccatatccaacggaggaggacaaggcaaggttggtgcaggaaactggcttgcaattaaagcagataaacaactggtttatcaaccagaggaagagaaactggcacagtaacccgtccacctctactgtcctgaagagcaagcgcaaaaggtaattatattaagctagtgagtgaattaacttgattcttctagagcttctcaccaactaaaaattcaaaatgaagtaatgcaggtgaaaatagcagtgaccgcttcatgtagattaaggaaaattgtaaactaaactccttccgagtcgtgcatgtgctcatgatcggcacatatggttggtggcaaatgaagcgcgaatttcttttgattctgtagaggaagagcctaacatagatgagaaaaatctgcccactttctgctgctgtaaaggaaccacaaactaaattcggagggcagatccaaaacttatacccgcatcacgtggaagtcctggaataaagattgctgtctcgtaaattatgcgaaacgattctgctgcatcggctgatgggtgtaatttttgtttaccatattcatatatgtgaataagtacagagaagggttgtgggtgtatagtacaatagctctcgcttagttccatacacgtatagtagatagagattatagcatgttaggtgttgtcatttctactgtagtgtacgcttgtgaagcaaatgtagcttggtcttgattacacaaaaaaaaaa

SEQ ID NO: 254 - DNA, 2965 bp, Eucalyptus sp.
ggccatcgcatatggtcaacaatgtaactcgatatcccagtgcccttcccaccactcccatcgaagtagagattaaggagaaattacatacaagaattgaggaggttagaactcaaaagctttgtgtcatggactatttgattctcccactttgcttcctctgccaggcaagttggtcggagtccgcgggcacgcatagggatgtgtgtgtacagatgaaagatgagatttgtagaaaatgccttttcagttcaaaaaagtgtgtacttgagaattaaaaggaccaacataacgaagcaccctcgtgccgaattcggcacgagggctccctctctctctctctctctctaaaagcctgtgggcttatagggtccgttgaatggtctctctctctctctctctctatcaatcgctctctacagagagcagagggaaattctcgagattggcgtctggggataaaagaccagcacagggaccatcttcttcattccctctctctcttcctcgactggaacaagaaaagctctgtttgtagcggaggaagtgcgtccagagagagctctcttgctgcgggacattattctcatgaaggagataggaggctctcttcggcagagagagcccgcctccggagagagcctgcccgactgacccccgcgcagacattggcattcctccttcttcttccttccccctctcgagaacgttcggagaaaaaagcgacagagcggaacccgggactgcggatggcgctggcgatgcacagggagtgctcgagcaagcagatggacgcgagcaagtacgtgcggtacacccccgagcaggtggaggcgctggagcgggtctacaacgagtgccccaagcccagctcgctgaggcggcagcagctgatccgggagtgccccatcctctgcaacatcgagcccaagcagatcaaagtctggttccagaatcgcagatgtcgggaaaagcagaggaaggaagcataccgtctccaaacagttaacagaaagctgaatgccatgaacaaactgttaatggaagagaatgatcgcctccagaaacaagtttcacagttggtttatgagaacggctacatgcggcagcagctgcatagtgcatcaacagcgaccacagacaatagctgtgagtctgtggtcatgagcggtcagcaccaacagcagcataacccaacaccccagcatccagaaaaggatgccagcagcccagctggccttcttgcgattgctgcggagaccctcacacagttcctggccaaggctactggaactgctgttgactgggtacagatgattgggatgaagcctggtccggattctattggaatcgttgctgtttcccgcaattgtaatggggtagcagcacgagtcttcggtcttgtgagtctagagcccatgaaggtcgctgaaattctcaaagatcgtccatcttggtttcgcgactgtcgatgccttgaggttcttaatgtgatccctgcagggaatggggggacgatagagcttgtatacatgcagacctatgcacctacaactctggcagcagcacgtgatttttggacagttcgatataccactactctggaagatggcagtcttgtgatatgtgagaggtcattgactacaagtactggtggcccatcagggccgtcgtcttcaagttttgtgagagctgaagttcttccaagtggttatctcatccgaccttgtgagggaggtggtgcaatcattcatattgtggatcatgttgatctagatgcttggagtgttcctgaagttctcagaccactttatgaatcgtccaaaattcttgcacagaagatgactgttgctgctttgcgccatattagacaaatagcccaagaaagtagtggggagattcagtatggaggtagccgacaacctgcagtcttgaggacgtttagtcagaaattgtgcagggggtttaatgatgctgtgaatggctttgtggatgacggttggtctgttctaagtagcgatggggtagaagatgtcaccattgctgtcaactcatctccaaataaatttcttggttcccaatacaatgcaaccatatttccaaattttggaagaggagtgctctgtgccaaggcgtccatgcttcttcagaatgttccgcctgctgtgcttgtacgctttctgagggaacaccgctctgagtgggctgaccatggaattgatgcatactcagctgcatctttgaaaactagttcttatgccattccatgtgtgagacctggtggtttccctagtagccatgtcattttgcctcttgcccacactgttgaacaggaggagttcttggaggtggttcggctagagggtcatgcattctcacctgaagatatacctttggcacatgacatgtatttacttcagttatgcagtggggtggatgaaaatgcagttggtgcctgtgctcagcttgtctttgctcctattgatgaatctttcgcagatgatgctcctttgttgccatctggctttcgtgtcatacaattggatcctaaaacagttaagcatccttgatactgccgtctttcatagagtcctattctcggggtatcatcggctgagacttagcctgacgatgctaccaatctacttcttgtttgctcctgtaccacttaccatacaatacaatctaggaagtaatctttactgcgcaaacaattttatgtcactgggtatctgtttgttacgctaatgcatctttcagagactttaaatattgtgaaatggaagggctctgaagattgaatggctgccaagaagcttgtttgagcagtttcctaagattacttgaaactcctagcatgccatttttctgatctttgcttgaagaccttacatgtgaatgtactcatggcaccagatcactgttatcattatcattatcattatcattattattaaaaaaaaaa

SEQ ID NO: 255 - DNA, 2796 bp, Eucalyptus sp.
ggagagagtcatggtttttttggaggaagaagagtctgcgagcgtgtggaattcacacgtggggatgggtgaaatgatgggtaggggaatacagatgagtaagaaataggaggaaaagaaaaaagaaaagaaattgtgggggtgtttgatctgttgtccctttgaaattatctccccatctcttcttccatcattagaagtgaagctgcagaagttttccttctctctctccctccccttttttcctcttcttcttcttcttctttttatctgtctttgtcttttcttcttcttctgcgtttgttgacaagtgctgtgatattttggacgagaggatcaacatcttgggatcagcaagtgtttttggtctccagagaggattttctatcaaattgatctctctttctctctctctctctcaagagctctttctgttccccactaatcccacatccgttgcttgtctcaagagtgaggatgcgattattgtcccagtaaccgagagtgcggatccttagattgtggaattaatatggcgacttactatacaaattcgaatcaaagggatgctgcacctgccctctacttaagagaatctatgcacagttcgttccccgagacgcctgttctgtccggcaacatgatgctgtatatgaatcctgggccttacgcggataatccattgggggggaattctcagcagcaaagcaacggcatggaggtgccctcggtggggggtattgattcagtgcagcagcagcagcagcagcagcaagaaatcctttccaattttggtgggtcacgaagtggagatcaagatttctcgttgtggagagacgggagaaacgagatgctactaatgccaccattacagagcccacacggccagggattgtccctcagccttggcacgcagattccatcgggaatccatatgccttctgcgaatcttagttccatatcgttcttgggtcctattcccatggtatcgggggatggtggtgggaggaccggttctgagcggtcaagaaacgctgattgtgctccggcaggttttcctggaggtgatgaagatgtgaataagggaggggacattccttatggaatgtcaaccatcgtgagagtcattcccaattctaggtacttgagggtggcgcagcaactgcttgatgaaatagtgaatgtgcgaaaggctttgaagcgccctgatgacgcgaatgaccaatctagacatgagaaccaaaggagccccaaagatgcggatgggggttccaagaacgaagcatcctcaaatccccaagaatccgccagtaactctagcgagctttctgctgctgaaaaacaagatttgcagaacaagctcacgaagctcttgtccatgttggacgaggttgataaaaggtacaagcagtactatcaccaaatgcagatcgtggtacagtcttttgatacaatagcaggaagcggtgcagccaagccctacacggcgcttgcgctccagaggatatcccgccacttccggtgcctgcatgacgcgatcacgggtcaaattcaagcaacccgtaaaagtctcggagagcaagacacctctaacagcaacggaatatcacgattacggtatgtggatcagcatctgaggcagcagaggtcgatgcagcatcttggtataatgcaacagcacgcttggaggccacaaaggggtttgcctgaaaactcggtttcaattcttcgtgcgtggctgtttgaacatttccttcacccatacccgaaagattcggacaagatcatgctagcaaggcagacgggattgactagaagtcaggtctcgaactggttcatcaatgctcgagtgcgcctatggaagcctatggtcgaagaaatgtacaaagaggagatcggcgaccccgagatggattctaactcctcctctgaaactgcagccaaggcgacgggaggtgatggccggtcttcagaggacaagggtgaagatttgcagcagagtgcgagctcaacggccactaagagatgcggaacggggaacttcatggacttaaaaccacctgtagtcaaccctgagatggagatctctggaccgactttcaatagcgggacacatggtgaagttgacgccgagtatggttttaagctacgaggagggcacattcctggtgggaacgatggaattctcttctcggatagcatcgttcagtcggacgggggaaacaacaggttcatggctgcagccacggctgcttataatgtgtccaatttcggacaatttgggggtggcaccggggtttctctgactctcggcttgcagcactgtgacggtgggaccttacccttgtccaactccatggatcacggtattgcatccatgagaggagatggcttctacaacgcggcagcctcttccgtgggggcagagacgatggaatttgagggctcaagtccaggtgagcagcagcaccggcttgcttcaaaccagctgttccacgattttgtcgcataaaacaaaggaggtcaatgcagatgacgcgggtccacgtcgattggaattccaagatcctcattaaatagataaaaaggagaataggccgtgctcgccaaatgcccttctgctctctctcagaaccggcctgaaggtgaaaaatagacaatgtaggggggaacgtgtaaagaacagctgtatatgaagatattgtttggaggagttagctttatttgtaaagatgtatatccgatacttcggttacatatgtggaaggagaaaaatatatacaggtaaaaaaaaaa

SEQ ID NO: 256 - DNA, 2614 bp, Eucalyptus sp.
ggttcatcgccaccaccattggcgtctaacatgttgcctcctccataaaacaaaaccagcccccccccacaacctatcccttccctcaagactgccatgggagtcgtcgacatgtcgaataacaatcctcccacctctcgcaccaaggacttcttcgcctctcccgctctctccctcagcctcgccgggatttttcgggatgccggggcggcggcggcggcctcggccagcatggacgtggaggagggggacgaggggagcggcggaggaggagggaggagggaggatacggtcgagatcagcagcgagaactcgggccccgcaaggtcgagatcggatgacgagttcgatccggacggggacaacgacgaggacggcggcgacggcgacaagagcaagaagaagaagcggaagaagtaccaccgccacacggccgagcagatccgcgaaatggaagcgttgttcaaggagtcgccccatcccgatgagaagcaaaggcagcaactgagcaaacagctgggcctcgctcctaggcaagtgaagttctggttccagaatcgcagaacgcagctcaaggcaattcaggagcgccatgagaattctctgttgaaaacagaaatggagaagctcagagatgaaaacaaagccatgagagacaccatacagaaatcttgctgccccaattgtggctcagccaccacaagcagagataccgccttgacaactcaggagcagcaactccgaattgaaaatgctcgactgaaagccgaggtcgagaagctccgaacagctctaggaaagtacactccagggacggcatcgccttcttgctcagccgggaacgaccaagagaacaggagctccttggatttctacaccggaatctttgggctcgacaagtcgaagatcatggaattggtgaaccaagcgatggaagagctcaagaagatggctactgctggagagccactttggatcaggagcgttgagaccggccgtgagatacttaactatgacgagtacgtgaaggagttcaaggtcgaagcccctagtgagggccggcccaagagatctatcgaagcctcgagagagactggggtcgtgttcgtcgacctcccccgcctcgtgcaaagtttcatggacgtgaatcaatggaaggaaatgtttccttgcatgatctcaaaggcagcaactgtggatgtggtttgcagcggtgaaggtcccaacagaaacggcgccgtgcaattgatgttcgcagagctgcaaatgctaacgccaatggtgcccacgagggaggtgtacttcatcagatactgcaagcagctcagcgcagagcagtgggccttagttgatgtctccatcgaaaaagtcgaagataacatcgacgcctctcttgtgaaatgcaggaaacgcccctccggctgcatcatcgaggataaatccaacggccattgtaaggtaatctgggtagaacacttggagtgccagaaaaccaccgttcatcccatgtaccgtaccatcgttaacagcggcctagcctttggcgcaagacactggatgacgacactgcaagtccagtgcgagcggctcgttttctttatggcgactaatgttccaaccaaagattcgaatggtgtcgccacacttgcaggaaggaagagcattttgaggctggcacagaggctgacacaaagcttttgtcaggccattggagcatcgagctatcacagctggaccaaggtcccaactaaaactggagaggacattagggtggcttctaggaaaaatctgaatgatcctggagagcctcttggggtgatcctatgcgcagtttcctctgtactattgccagtctcacctcacttactgttcgacttcctcagagacgaatctcgccgtagtgagtgggatatcatggcgagtggaagcccggtacagtccattgctaacttagcaaaagggcaagatcgcggcaatgcagtcaacatccaaacaatgaaaaataaagacaacagcatgtgggtactccaggattgctgtacaaatgcttacgaatctatggtggtctatgctccagtggatatcacaggaatgcaggcggtgatgaccggctgtgactctagcaacatagccgcactgccatccggtttctcgatcctgcccgatgggatcgagtcgaggcctctagtcatcagctcaaggcacgaggagaagagctcagaaggaggatcactgctcacaatagcttttcaaatcctaacaaatacctctcccacagccaagttaactgtggaatctgtggagtctgtcaacactctcatatcctgtacattgcggaatattagaacgagcttgcaatgtgaggatggatgacaactttaagttttatttaaagtagatagggataattaactgtacaactaatagggtggagaaaaattagcagtttcaaaagcaatggctttttttcatttgttctttggttggattggaaggcttggcttggttttaagcatgtttttatgcagaaagtggtgactggcgggcaagagagaaagaagaatttttgttatttgggatctgttaaatcaacagtgcaacattaaaaaaaaaa

SEQ ID NO: 257 - DNA, 2931 bp, Eucalyptus sp.
gggtctttctagcttctgggtcttgaggaggagggccattttcttcttgccgattcgataggttggcagcccggtaaggcctcggcaccgagtcatccttttgcggttcttggtcagttggaacttgatcggaacggtgggaagaaaaaatgaatctttgatggaaacatcatagcacacatgtgcctgtagagctgtgtttctctcggtcttgggatgatggcggtgacttcggcctgtaaggacaagatggggatcgacaacgggaagtatgtgcggtacacgcccgagcaggtcgaagctctcgagaggctgtatcacgagtgcccgaagccgagttcactgcggcgacagcagctgatcgagaaatgcccgattctctccaatatcgagccgaagcagatcaaagtttggtttcagaatcgaaggtgtagagagaagcagagaaaagaagcatctcgccttcaggcagtgaataggaagctgactgcaatgaacaaacttttaatggaggagaacgataggctgcaaaagcaagtgtcacagctggtgtatgagaacagttatttccgccagcagacacaaaacgcaaccctcgccaccactgacacgagttgtgaatcggtggtgaccagtggtcagcaccatttgactcctcagcatccaccaagggatgccagccctgcaggacttttgtccattgcagaggaaactttaacagagtttctttcgaaggccactggaactgctgtggagtgggtccaattgcctgggatgaagcctggtccggattccattggaatcattgctatttctcacggatgcactggtgtggcagcacgtgcatgcggccttgtgggtctagaaccttcaagagttgctgaaatcctcaaagatcggccgtcgtggtatcgtgattgccgagctgtggatgtcgcaaatgtgctgtcgtctggaaacggtgggactgtcgaattgctgtacatgcagctctatgcgcctaccactctggcaccggcccgtgacttctggttgctgcgctacacatctgtaatggaggacgggagtcttgtggtatgtgaaagatcaattaacaacacccaaaatggtcctagtatgcctcctgtgcagcattttgtgagagctgaaatgttgcctagtggatatttgatccggccctgtgaagggggtgggtcgataattcatatcgttgatcacatggatttagagccatggagcgtgcctgaagtattgcgcccactttacgagtcgtcaactttgctcgcacaaaggacaacgatggcggctttacgcaatctgaggcagatctctcaagaagtttcccagccaaatgtcactggttggggaagaagacctgcggcactgcgtgctttaggtcagagattgagcaagggttttaacgaagctgtcaatggatttatggacgatggttggtctatgttggaaagtgatggcgtcgatgatgttactcttctcattaactcatcgccggccaagatggcaggcgtgaacatttcttacgcaagtggttttccttcaatgactagtgcggtcttgtgtgcaaaagcatccatgctgctgcaaaatgtgcctccagcaatactcttacggtttttgcgagagcatcgatcagagtgggcagacagcagtattgacgcatactctgctgcggcaatcaaagccagtccatgtaacatgccagggacacgaattggagggttcgggagtcaggttattcttccgctcgctcacacaattgagcatgaagagtttatggaagttgttaaacttgaaaatatgggccattatcgagacgacatgattatgccaagtgacatcttcctcttgcaactttgcaatggagtggatgaaaatgctgttggcacttgtgctgaactacttttcgctccaattgacgcatccttttctgatgatgcacccattattccttcgggattccgcatcattcctcttgatccaggatcggatgcctccagcccaaaccggacacttgatcttgcctcagctcttgatgttggtcccacaggcaacaaagcggtcggtgataattctggtcatagtggaaacaccaaatctgtgatgactatagccttccaattcgcatttgaattacatcttcaagagaatgtggcgtccatggctcgtcaatacctcagaagtattatagcatctgttcagagagtggcattagcgctctcacccacaaatttgggctgtcatgcgagtcttcgccccccacctggctctcctgaagcgcacacgcttgcccgttggatctgccaaagctacaggtcctttcttggtgtggcattgctcaagaacgaggccgctgattctttgctaaaaaatctgtggcatcactcagatgcaatcctatgctgctctctcagggcagcgccggttttcacatttgctaaccaagcaggacttgacatgttggaaacaacgttgattgcactgcaagacattaccctggaaaagatttttgacgacaatggaagaaagactctctgctcagaattcccccagataatgcagcagggtttcatgtgtctccaaggtggcatttgcttgtcaagcatggggaggccgatttcgtacgaaagagcagtagcttggaaggtgttgaatgaagaagagactgctcactgcatctgcttcatgtttgtcaattggtcttttgtctgagactaagctatgtcaatgatctagtgagaatcgcactcttcttttgtcctctttttaggcgatagtgaaatcacgaacacgatttagtattatggtgttagaagcaacactggtcgagaaatttttgtcctcctttcttataccttgttcgagtgcccctgtctatgaattattatgcctgtggttaattaaaaaaaaaaa

SEQ ID NO: 258 - DNA, 2921 bp, Eucalyptus sp.
ctcacttgggtcgcctctcgttctctcgtttctcgcctccttcttcgaagcagcagccagcacagccgcgcaacgtgaagaagataaaaagaagagtgtggtcctgacgggaggggggcgtctctctagaaagactacgttttttcctttcgttaagaaatgagacaggggtctttctagcttctgggtcttgaggaggagggccattttcttcttgccgattcgataggttggcagcccgggatgatggcggtgacttcggcctgtaaggacaagatggggatcgacaacgggaagtatgtgcggtacacgcccgagcaggtcgaagctctcgagaggctgtatcacgagtgcccgaagccgagttcactgcggcgacagcagctgatcagagaatgcccgattctctccaatatcgagccgaagcagatcaaagtttggtttcagaatcgaaggtgtagagagaagcagagaaaagaagcatctcgccttcaggcagtgaataggaagctgactgcaatgaacaaacttttaatggaggagaacgataggctgcaaaagcaagtgtcacagctggtgtatgagaacagttatttccgccagcagacacaaaacgcaaccctcgccaccactgacacgagttgtgaatcggtggtgaccagtggtcagcaccatttgactcctcagcatccaccaagggatgccagccctgcaggactcttgtccattgcagaggaaactttaacagagtttctttcgaaggccactggaactgctgtggagtgggtccaattgcctgggatgaagcctggtccggattccattggaatcattgctatttctcacggatgcactggtgtggcagcacgtgcatgcggccttgtgggtctagaaccttcaagagttgctgaaatcctcaaagatcggccgtcgtggtatcgtgattgccgagctgtggatgtcgcaaatgtgctgtcgtctggaaacggtgggactgtcgaattgctgtacatgcagctctacgcgcctaccactctggcaccggcccgtgacttctggttgctgcgctacacatctgtaatggaggatgggagtcttgtggtatgtgaaagatcaattaacaacacccaaaatggtcctagtatgcctcctgtgcagcattttgtgagagctgaaatgttgcctagtggatatctgatccggccctgtgaagggggtgggtcgataattcatatcgttgatcacatggatttagagccatggagcgtgcctgaagtattgcgcccactttacgagtcgtcaactttgctcgcacaaaggacaacgatggcggctttacgcaatctgaggcagatctctcaagaagtttcccagccaaatgtcactggttggggaagaagacctgcggcactgcgtgctttacgtcacagattgagcaagggttttaacgaagctgtcaatggatttatggacgatggttggtctatgttggaaagtgatggcgtcgatgatgttactcttctcattaactcatcgccggccaagatggcaggcgtgaacatttcttacgcaagtggttttccttcaatgactagtgcggtcttgtgtgcaaaagcatccatgctgctgcaaaatgtgcctccagcaatactcttacggtttttgcgagagcatcgatcagagtgggcggacagcagtattgacgcatactctgctgcggcaatcaaagccagtccatgtaacatgccagggacacgaattggagggttcgggagtcaggttattcttccgctcgctcacacaattgagcatgaagagtttatggaagttgttaaacttgaaaacatgggccattatcgagacgacatgattatgccaagtgacatcttcctcttgcaactttgcaatggagtggatgaaaatgctgttggcacttgtgctgaactaattttcgctccaattgacgcatccttttctgatgatgcacccattattccttcgggattccgcatcattcctcttgatccaggatcggatgcctccagcccaaaccggacacttgatcttgcctcagctcttgatgttggtcccacaggcaacaaagcggtcggtgataattctggtcatagtggaaacaccaaatctgtgatgactatagccttccaattcgcatttgaattacatcttcaagagaatgtggcgtccatggctcgtcaatacctcagaagtattatagcatctgttcagagagtggcattagcgctttcacccacaaatttgggctgtcatgcgagtcttcgccccccacctggctctcctgaagcgcacacgcttgcccgttggatctgccaaagctacaggtcttttcttggtgtggcattgctcaagaacgaggccgctgattctttgctaaaaaatctgtggcatcactcagatgcaatcctatgctgctctctcagggcagcgccggttttcacatttgctaaccaagcaggacttgacatgttggaaacgacgttgattgcactgcaagacattaccctggaaaagatttttgacgacaatggaagaaagactctctgctcagaattcccccagataatgcagcagggtttcatgtgtctccaaggtggcatttgcttgtcaagcatggggaggccgatttcgtacgaaagagcagtagcttggaaggtgttgaatgaagaagagactgctcactgcatatgcttcatgtttgtcaattggtcttttgtctgagactaagctatgtcaatgatgtagtgagaatggcactcttcttttgtcctctttttaggcaatagtgaaatcacgacacgcgatttagtattatggtgttagaagcaacactggtcgagaaatttgtgtcctcctttcttacacctaaaaaagaaaaaaaaaaa

SEQ ID NO: 259 - DNA, 2855 bp, Eucalyptus sp.
tgaagaagaagagtccaacaagctttctttcacaaagagaggggcctttcgggagacaagcttcgacggagaagagtctttaacttagcaccaatatagagagcgtcttcaagctcgggtttggtcgagggagaaagaaatggcgatgacgatggtgcctcacagggagagcagcagtggaagcatcaacaagcacttgaccgactcgggcaagtacgtgaggtacacagcggagcaagtggaagctctcgagagggtctattcagaatgccctaagcccagctctctgcgcagacaacagctgattcgggagtgtcccattttgtccaacatcgagcctaagcagatcaaagtctggtttcagaatcgcaggtgtcgagagaagcagagaaaagaggcctcaagactccagacggtgaacaggaaactgacggccatgaacaagctcttgatggaggagaatgatcggctgcagaagcaggtttcgcaattggtatgcgaaaatggctacatgcgtcagcaactccatactacatcggctactactaccgatgcaagctgcgactctgtggttactactcctcagcactctctcagagatgcaaataaccctgctgggctcctctccattgcggaggagacattggcggagttcctctccaaggctacaggaactgctgtcgattgggttcaaatgcctgggatgaagcctggtccggattcggttggaatcttcgccatttcacaaagttgcagtggagtggccgctcgagcctgtggtcttgttagtttagaaccaaccaagattgtagagatcctcaaagatcgtacttcatggttccgggactgtcggagccttgaagtcttcaccatgtttcctgccggaaatggtggaacaatcgaacttgtttacacgcagatttatgctccaactactctggctcctgcacgagatttatggactctcagatataccacgactctagaaaatggcagtcttgtggtatgtgagagatctctgtccggatctggtgccggccccaacccagcttcagcagctcaatttgtgagagctgaaattcttcctagtggctatttgattcgcccatgcgagggtggaggatcaatcattcacattgttgaccacctcaatctcgaggcctggagtgttcctgaggttcttcggccactttatgaatcatccaaagttgtggcccagagaattactattgcggctcttcgatacatccggcaaattgctcaggagacgagtggggaggtggtttatggtttgggaaggcagccggcagttttgagaactttcagccaaagattgagcagaggctttaatgatgcagtaaatggattcaatgacggtgggtggtcattgatgaatggtgacggagccgaagatgtcatgattgctgtcactttctctaaaaaattgaacactacatcaaatcctgctaatcccctttcatttgtgggaggaattctatgtgccaaagcttccatgttactacaaaatgtccctcctgctgtgttggttcggtttctgagggagcaccgctcagaatgggctgatttcaatgtggatgcttattctgcggcatcattaaaagctagtccatttggctatcctggtatgaggcccacaagattcaccgggagtcaaatcatcatgccccttggtcacacaattgagcacgaagagatgcttgaagttatccgtcttgaaggccattctcttgctcaagaagatgcttttgtatcaagagatattcatcttttgcagatatgcagcgggatagacgagaatgcagttggagtctgttccgaacttatttttgcgccaattgatgaaatgtttcctgatgatgctccactgctaccctctggtttccgtatcataccactggattcaaaatcatctgatgtacaggattctctaacgacaaatcggacccttgatctgacatcgagtcttgaggtggggcctgcatcaacaaattgcgttggagatgttgcgccaagccatggtgcacgatctgttctgactatcgccttccagttcccatttgatgccaacacacaggataatgtggcagtcatggccaggcaatatgtccgtagcgttatttcgtctgtgcagcgggttgcgatggtcatatctccatcaggattgggcccttccattaaccccaagctttcacagggatctccagaagctctaacacttgctaactggatctgccagagctacagcttatatctaggaacagaattgctgggatctgatttgcttggtgctgattctatgttgaagactctttggagtcatcaggatgccatattgtgttgttcattgaagtctattccagttttcatctttgcaaaccaggcaggacttgacatgttagagaccactttggtggctttacaagatatcactttggataagatatttgacgagtcagtccgcaaagaattgtcccccgagtttgccaagttaatgcaagaggggtctgcctacttgccctctggaatttgcatgtcgacgatggggcgacatgtctcatatgaacaagcgatcgcgtggaaggtcctttctgcggaggagaacactgtccactgcctcgctttctctttcgtgaattggtctttcgtgtgagcatagcctaatatattctttttttgaacgccctcttgctgctgttgaatagatgtgaaaaaactaagaggggttaggagttttgtcatactgaaaaagaaaagaaagaacacatccaattccccaattttttatttaatgaaaatttccatgtgaaaaaaaaaaaaaaaaaaaaaaaaaaaaa

SEQ ID NO: 260 - DNA, 1946 bp, Eucalyptus sp.
gttcttgaggaaagcaagaaaatgcgtgttgcctctctctctctcttcctctctctcctttgaaagatgaccaaagtgggggtgatactttaaaaatattttctgcttctcaacacttctagaactatacccaaacacccatcatcatcatgaccaagaagaagcctccttctctataagtttccaaagagccccaatctcaagaaaaaaaagaattctcttctcttctcttccccttttctctcctcttttttcccatctttgtctttccattgatgaggggagttatgttcagccatggaagcagctgatacacgaaggaagagagcttgccacagcctggtccacatctctgggttctactgctggggctgggagttcctcaccgctctccttctctttagttgctccatctgatcaccaccaaacccttcaatctcctctctctctctctctctctctctctctctctctctctctctctctcgctctgtgttttattccctcctgaaactgcaattcttgctgccggggaggggcaaatcgggaacagacgataaggggatggcacagcgctcggctccggcgcccttcctgacgaagacgtaccagttggtggacgatccggccaccgacgacgtcatctcgtggggggagagcggccggacgttcgtggtgtggaagacggcggagttcgccaaggacctgctccccagctctttcaagcacaacaacttctccagcttcgtccgccagctcaacacctacggcttcagaaagatcgtgccggacaaatgggagttcgccaacgaccgcttccagcggggccagaaagaactcctctccgagatccgccgccgcaagtcggcggcgacgcccccgaaccccccggcctccggcgccgcgaaatcggctgccggcgccgcgggggggcaggcctcgccggagagctcgggcgaggacatggggtccacgtccacgtcgtccccggcggactcgaagaacgcgggctcggtggagacggcggccgtcgcggccgcggccgcggcgacggcgacggcgacggcggcccagttcgcggacctgacgggcgagaacgagaagctgaggagggacaacgaggccctgaactcggagctggcgcaggcgaagaagcactgcgacgagctggtggcgttcctgacggagtgcctgaaggtggcccccgaccagatcgaccgcatcgtgcggcgagggtgccggggggcggcggcgtttgcggccgccggggacggcgccgacggcgtcgaccgcgacgatgacgacgacgacgaaaaagctgcggcggaagtcgacggtgagaagagcacgaagctgttcggggtgtggctgaacgggaaggggaaggaggcgaggaagagggcccgcgaggacaaagtggggcccgtggggatggagttccgtcagcccttgatgaagaccagcaaggtctgcaactgatcgtgcggtcggaaaagcgatgcggggccggggtgcactgcaagctcgatgcacctcgggcgcaccggaatgcgaagttttagggacttgatttgatcggtcggtcgttggtttagtaatgcagaaagagactcaccaaccttcaaggtttcaatttctcgtgtactttttaaaacttttattttttgtacttcagaatttattttttatttttgggtttggtaatagggactctgatggaatagatagatagggttcctaagtcagttgtaaatttgttggtggtggagcaagtggggatcgagaaaatgaagaagggtctccacactcctagtcaatcaatgctattggaacttgcttcaactagcttttcgaatatcatgtcaccaccgcggtagcttgcctagtgatgtaatatttaatattgaatggttatgatcatagattttaattcttcaaaaaaaaaa

SEQ ID NO: 261 - DNA, 1179 bp, Eucalyptus sp.
cagcttttgccaattctctctcaaccccaagaaaagcactctctcctcaaaccccattttcacgagaagagctatcgtccagagagagagagagagagagagagagagcgtgacagggtctctgagaaatgtataccagcgtgcatgggatggaggcggcggcggcggccgccaacggcgacgccatcgcgccgttcgtcatgaagacctaccagatggtgagcgacccggcgacggacaacctcatcgcctggggcaaggccaacaacagcttcatcgtcgtccaacccctggacttctcccagcgcctgctgcccgcctacttcaagcacaacaacttctccagcttcgtccgccagctcaacacctatggtttcaggaaggtcgatccggaccgatgggagttcgcgaaccagtggttcctccgcggccagaagcatctgctgaggaacatcgtgcggaggaagcacagcaagggcgcctactcgcagtcgaagggcggcggcgacgccgacatggacgaggaggagctggctagcgagatagcgaggctgaggcaagagcagagggccctcgaggaggagattcggggcatgagcaagcgcctggaggcgaccgagcggcgccctcagcagatgatggccttcctctacaaggtcatcgaagacccggagctgctgcctcggatgatgggggagagggacaggaacaagcggttggcggtggcgagcggcgacaagaggcagcggctcatgatctcgtccgccgcggtgtcgtcctcctcctcgtcgggcatgggggtctcgagctcgatcaagagcgaggacgacgaggagggcaccaacttcggggtcatgtcctcgcccgaggtcgaggggaatctggacatcagccgcttttgcgacttcgctgcggttccggcctcgtcgtcttcggcttctatcgatggcgggatcggcagaaacatggccttctcgccaccctacaacgacgtgggtggatacggcggcgtggcgaacaatcaattcgggtactttacggaaatggcggtggccggaggggaggccagtccgccgacgccgccttatcctttttccctcttgggaggtggtttttagttgccttatcacgaatatatctttcatcttatcccttgtattaattccttctattttcttt

SEQ ID NO: 262 - DNA, 1959 bp, Eucalyptus sp.
ccctttctctctctaacccatcatcattttctctcccccacttccgcacgaaacttctagaaacaaaaaaaaaaaaaaaaacctaactcctctctctcgctctctctctctctccttctctgcctccgcgcgcattcgttccggcgagatttcctccgatcggcgtcgcggcgtgggtggtcggtcgacggtggcttcccgtgccgtcggctagctgcctccggcgtgatttccccttgcctgtccggtggttggtgagagagagagaactcgtcggaggtctcggcggctcgctgctttcccggtgtggtgtctataggcttcggatctgagaggggggcgcggccgcggcggggggctgggagggaccgatgccgggggagcagaccggggattcgccggtggccggagactcgcagcggtcgcttccgacgccgttcctcaccaagacgtaccagctagtggacgatccgggggtggacgatttgatctcgtggaacgaggacggggcgacgttcatcgtctggcggccagcggaattcgccagggatttgctccccaagtatttcaagcacaacaatttctccagcttcgttcgccagctaaacacttacggattcagaaaggtggtgccggatcggtgggagttcgccaatgattgcttccggaaaggcgagaaggccctcctccgcgacatacaacgcaggaagatctccccgacggccgcggccgccggggccgcggcggtgacggtcgccgccgtgggggtggcggggctgaccgtgtctccggcgaactccggcgacgagcaagtgatctcgtcgagctccccgccggtggccctcgcgaccgctgcggtcgccgccgcctcgccgtccgtggtgcaccgctcgccgagctgcacgaccgcgccggagctcctggaggagaacgagcggctgaagaaggagaacatgcagatgagccaggagctgtctcagctgagagggctgtgcaacaacatactgtcgctgatggcgaactacgtctcccgccagtccgactcctcctccgccgccccggaggggcaggccctggagctgatgccggcgaggcaggcggaggcggcggaggactgcgccggcccgccgtcggcggcggcgctggaggaggacgacgacgaggaggccgcgacggtcgctccgcggttgttcggggtctccatcggggggaaacggcagaggatcgaggagaacagcagcaacggcggagacgaagagatgcgggaggcggatcaggcggcgccggtgccacccgacgagcgtgagcccgggggggaggtgaaatcagagccgttggatgggagcagagatcatcacgggggagaagacccgtcgtggctcgagctcggaaaatgacaaacctcctcggctgcgacggacgtgacggcggagacgagggggcgtcgctgctttggtcacgcgcgtggcgcgtgggggtggcgcgtggagggggggggggcatatggggaaaaggagagcgaaaaaactcgaaactgaaccccagcgaattttgcaagaaagtcaaaatcaaaatccgcgggcgagcgagaatgttgtaaaggtaactaataatgctcgcatcgccgaggaagacaagaggcgggggggggggggggaaagctgcacgtgcgagcgagcgattttgtccccaaattagaatccggaagttgtgatgtttaacgcttttcgggagaaaattagaggttgaatcgaagccgggcacgaaacggtgtctttggttggggattatctattgatgtttgattttttttttttttttggttgacttgatgtaagccgttacgcacctgatttaactagaaatttagctgtaactggaagtggaagcgggttgccatcgaatctggccggcttgataaggatctaagggattcaatccttttgaccaaaaaaaaaa

SEQ ID NO: 263 - DNA, 1537 bp, Eucalyptus sp.
gctctcatcctccctcctctcctgcacttcccccgaacaaaatcctctcccctctctatctccgttcccccattttcgatcttccgaagtcactctctcagtatcatcaccctccctccttctcttccacctccccggaccaaagcaaccacttctctctctctctctctctctcaaaggagaagaaagaagaagggttggtgatagaggagatagaataagaagggatggcgcagcttatggtggacaagtgcggggagggcttgctggtggcggtggaggcacagaaggcggtgccggcgccgttcctgacgaagacgtaccagctggtggatgacccctccaccgaccacatcgtctcgtggggagacgacgactccaccttcgtcgtgtggcgtccccccgagttcgcccgcgacctccttccgaactactttaagcacaataacttctccagcttcgtccgccagctcaacacctatggttttaggaagatagtaccagacaggtgggaattcgccaacgagttcttcaggaagggggagaagcatttactctgcgagattcaccgccgcaagaccgcccaaccacaactcacccaccaccacccgcactccgcctccccgcttagcggccccactccggccttcttccctttcccaagccgcctcagcatctctccctccgactccgacgaccagcattcctcccactggtgcgactcgccgccccctccccctccaccaccgctctcttctccccgaagcgggtgtggaggccacaacaacagtgtggggcctgttgcgagcgccgccaattacaacagctccgcagtcactgccctatccgaggacaacgagaggctgcggaggagcaacaacatgctcatgtccgagctcgcgcacatgaagaagctctacaatgacatcatctacttcgtccagaaccacgtgaagcctgtcgctcccagcacttactcgtggtcgccgccttcgatggtgcaaaaaccctcgaaccaactccttggttacaataattacgccaatgccattgcggctcccaacaacaatagttgtgtcgttaccaatcacgtcaagccggtcgtccgtagtaacagcaacgtaacacagagctctctaacgattcttgaagatccgccggtcatgaacaagatgaagctcttcggtgtgccccttctgtcgaagaagcggctgcacccagagtataactcgagtccagtgggttacatggagaccaacaaggctcgtttggtgttggagaaggacgacttagggttgaatcttatgcctccttcgacttgttaaggttcttggcgatgattatgatatgatgatcagtttttcctgcattatttgaagaagctgaggctgaggtttcttgtcttttctttttcctttttgttatttttgaagaggttttcttttctctatttcccccccctttttttttttgctttaattatcttcttgccctcagagtcagatatatatcgatgagagttatgtgaaaaaaaaaa

SEQ ID NO: 264 - DNA, 1774 bp, Eucalyptus sp.
gaacggactccctcgatgtaagaaacgagctgcacgaggaatttgccggtagagagataaagaggagcgatggagatgaagggaggggtcgtcccgaaagaggaggaggcgtcgtcggacgtggggcagccgccgccgccgccgccgccgccgccgcagcccatggaggggctgggcgaggcggggccgccgccgttcctgacgaagacgttcgagatcgtggaggacccggcgacggacccgatcgtgtcgtggagcgaggggaggaacagcttcatcgtctgggacgcccaccagttcgccgccaccctgctccccaagcacttcaagcacggcaacttctccagcttcatccggcagctcaacacctacggtttcaggaaggtggatccggatcggtgggagtttgccaacgaagggttcttaggagggcagagacacctcctgaagaccatcaagaggaggcggaacgtcttgcatagcccacgccagccaggaggagcatgcgtcgaactgggtcattatgggctcgacagcgagctggagaggttgaggagagacaggggcttgctggtggccgaggttgcaagattgaggcagcagcaggagcagtcgagggaccatatctttgcgatggagcaacggatacagcgtactgagaggaagcaacagcagatgttggctttcctcgctaaagcgtgcaataacccgtccttcattcggcaactcatgcagagaaatgctcgtggaagggatatcagaggagttgaaattggacacaagcgccggctgactgctacaccaagcctggagaatctgcaagatgaggacacggtggctgctctaggccgtggtggagcaggagatagtgcgatccccatgcaagaggaaatggtcaccttggagtcagaaatgcagacaatgttttcggctgccttggatgacgaatcaagcagcgacgtgaacgaactgagtgcagctccagttcttgctacaagaggtggcaacacggatgctgtcaatcagacgatcctggaagaattgctgagtgaagatctgatgactgggaatccggaggaagaaatattggttggcgaccggcctgaaatcgacatggaggccgaggatctcgtgcccgggcgaaggaatgccagcgaggaatcacaagacttatctcaacttgaagccgtgactccgtccagctcattacggcaggataaattcatggaagagtggtgagaggctgtgtcaaacagattagataacagggtctacttagttcatcatggctaggtacttcagccggctaaggttttgtaatagcagttggcacaggtagttgtatgtatcgtacagagtgctgatgtaaaggagtatgtaaagattataacttgggaataccaatttgggagttgaagatagaagacaggaggatcgattcacttgtgttgtaaaagatacgccaaactgatgaaggccaaagctgagagagaatcatcaaaagggagaaatgtaaaatgcccccgctttcagcgatcgtcggttaacgtcgttccaaactgcatccgatgctgtggagcatcgttttgtggaaggagacgaaacaggcaatgaaggaatatttatccttggattgctttcccgaacgagatgattcccacgcatgaagacacattagggaatctcttctggaagtattgctgaacaacagtagggatccaatgtactgcagaggagctaagaagtgtccaaaacctgcttcctaaaaaaaaaa

SEQ ID NO: 265 - DNA, 1807 bp, Eucalyptus sp.
gagaaagtagagagagagagagagacaagtattccctctcagtcaccccagccgacgatcctcccgccgaccgcctcctcccccggccgttccgatcctcccggcgacgcgacgacaatggtgaagccgagcggcggcggcggcgatcgggcccccccgctggcgccgttcctcagcaagtgctacgagatggtggaggacgaggcgaccgaccccatcatcgcgtgggggagcgccggcgacaccttcgtcatctgggacatcactcaattcaccctccagttgctcccccactacttcaagcactccaacttctccagcttcatgcgccagctcaacatctacggtttcagaaaagttgattcagatcgttgggaattcgcaaatgatggattcatcaaagatcaaaagcatatgttgaagaatatacgcaggaggaagaatgttcaggttgtggatcagaaaaaatcattgcagaagcaggataattccgttgaagaagtcgataaaattaaaatagatgggctttggaaagaagttgaaaatttgaagattgataagacagtcctttcgctggagttaggtaaagttagacagctccaggaaacttcagataataaattggtcctcctgagagaccgtgttcagggaatggaaaataatcagcagcagatgttgtcattcttagtaatggcaatgcaaaacccagggttcttggttcagctggtcaagctgaaagacaatcactgtcgcgtgactgaaatgggtaacatgctggaaccacaaggagcagaaaatggatcatggatttctgagggaacaatagtgaagtaccagcctccaactgatggaaaaacaaaccctgaattatccccgttatcaggcttgggggaaacgccaaaatctggtccttcttttgatgggacaagagatgttttaatgaacaacgatcttatgtcgatgctcatgaatgaaaaattctctttggatactccactgatatttccagactctcctgatgacaatgcatgggaaaaactgcttttagcttgtccttttattgagagcgccagtgagaaaaggcaagacaatgaaggacccaattatttgggcatggagacagaaccagcattttctggagcgagctcagtctctactgattttgaagctttaatgagaatgatggggaaccctcaggaagctgagactgagtcagatgttgatggagatgattgggaggatgctccaaatgttgattttctagcggagcaactggaatacttggcttccaaggcttgatctcaagcttcaggcaacataagagcatttggcttttggaagggtagctgcagcttaagttttatagggggctactctggtttcttctgcatactataacatatttggaaatgcttgatggagctttcctgcaaagacataagttagtttctaactgccgacttttaagcaatcagatacagcaatgcacgcaatgctgggaaactagtgcagttaaggatgattgcaatacggagtggagattacataatctgattgaatcttaagaaaaagaaaagtcaatagtatcgtgttttctaccctgaatatgatgcaggaaattttcccgatgaagttcccttattgatggtgacattcctcttggctgttggttattgacaggattcatgtgggtgggcaactcgacatgatctttttcttgcagcccctgtggtgaaccacaaaatgttggacttacctttccaaatgactttgtaaattacttgcagagaatcataatatggacgcc

SEQ ID NO: 266 - DNA, 1710 bp, Eucalyptus sp.
cccccctctccccttctgcctccgccctcgatccccaaaaccctcctccgaatcgattccggcagccccctccggccaccgccccctcccgccgcaatggacgcagcgccgccgggcggcggcggaggcggaggcggcccggcgccgttcctcctgaagacctacgagatggtggacgacgcggggacggacgagatcgtggcgtggagctccggcaagacgagcttcgtcgtctggaacccgcccgagttcgcccgcctcctgctccccacctatttcaagcacaacaacttctccagcttcatccggcagctcaacacctacggattccgaaaaattgatcctgagcgatgggagtttgctaatgaagaatttgtgaaggacaaaaaacatcttctcaaaaacatccaccgtagaaagcccatccatagccatagtcagcctcaaggttcaatggtggactctgaaagagcagcatatgaagaagaactagagaagctcaaccgtgataaaagtgcccttgaagcaaagattgtgaggctcaagcagcagcagtctattgggaagcttcatatgggggaactttttcagcgagtgggaggaatggagcggaggcaggaggatttgcttgcattcctagagaaaaatctccagaatcctaattttgttgaacatctgactcgaaaagtcaagtctctggatctatcagcatataaaaaaaagagaaggcttccccacactgatcatggaaggccaggggcggagaacagtctggatactcatagtagctctagactggagcttggaaatattttccagcaagatttctcaaataagctcaggctcgagttatcacctgcagtttcggatattaatttggtttccaatagcacacatagttcatacgaagatgggggaagcccacggagaattacatcagaaagtgaccctaaagatgctccaatgggaactgagagccttttaagtgcacccgaagcagtagagctttcagatacagggacttccttcacgttcaagatggattcgtctatgcaaaggaaaccaccagtagatgaaagcccaaggatgcatccgttgcccatgaatctaactactgaagagggagataacaatgtttcgtgccaactaaatctatctcttgcatcttctctactgcaagttgaccacagtcaacaattcaatcgtttgaatgtgctaggttcagaaactagcaagtctccagatgcaaggtcaaatgccagcatcacagaatctggttttggggttctccagaagaataagaattcagatgaagagcgtacaaattcctcgttgcctgaggctcaaaacaacaatcaacctatagctcctgcttcgggtagaataaacgatgtgttttgggagcagtttttgacagaaaggcccggagcattggagaatgaggaggcttgttctagttacagggaaaactcgtacgacgtgcatggcgatcaaagaccaggccctggaatgtccagaaattctaaaagcatggagcggctcacgctgtgagagtaaagccggaggtggagatcaatgacagctttctttgggtttcgtattgaccatctttgtccattgtacaacatgctcataatatgattgtatctctggattttgacaaatcactcatttaataaggccatagaaaatgaagttacaaaaaaaaaa

SEQ ID NO: 267 - DNA, 2048 bp, Eucalyptus sp.
gcttttcaattcaagctccctctctctctcgaaaccctaccatgtatattcactcgcttgaaaatttcttatgctatctccacctttgaacctgaactcgagcttctgacgggaaaaaaaaaaaagaaaagaaaaaagcttgaactcgagctcaagttaacgacggcgttccgccggccgtaccaatggctcttgcgtgtcgttttccaaaaccctcttccaagaatcaagtcttgagctggaaaaggcaaaaacctttcgcaaaatcacgggaagaaatcgcgtccgttgctgttcttgacggtggcgaccatggcgagatagggtcccagtcgcccttgtacttgaacctaacccgaaccgattctcctcggtcacaatcaaagccccgtgcaggcgagctaggatgctgtgggtcgctttcccattcgggtcacttgccagaagtagccattggcgatggcaaaattggagctgggtcgtgcttgcattcgtgcctgacccggcccgaaccctgttcagctctggccgtgaaggcggcgaagatcaaagaggaagtggaagaggaggaggtcccgaccattgctgatcccagggatgcgaccattttattgccgtcatgctcgtggcaggcagtagcggacggtgtggcgaagccgatggaggggctgggagaggcggggccaacgccgttcctgaggaagacgtatgagatggtgtcggacccggggacagacccgttggtgtcgtggggtttgaggcgggacagcttcgtggtgtgggacgagcaggagttctccaagcaggtcctgcctcgatacttcaagcactccaacttctccagcttcatcaggcagctcaacacttacggttttaggaagatcgatccagatcgatgggagtttgcgaaccgaggttttcacaaagggaagaagcacttgctgaagaatataaagaggagacgcagatccaacgagcatagagaaacatcgagtagtactgtcacctctgattaccagaaagctgaaaatgaagtggaactcaaaacgcttaagaaggaccaggaagcgttgaagaccaggatccttaaactaagagaagagcgggagaactttcagcgtgagattgagcacgtcaccgagcgggttcgccatgccgagtgcaggaaccagcagatattcctcttcctcacaaaagcagccaaaaggcccaactttgtccagcatttaatccagaagaagaggcagaagagagatttagagacttgtgaatccagcaagaaaagcaaattgcttggtcccgatgctgaagccaccaaatgcttgaatgaagcaatggatcacatgattcaaagcccaaacgttgattgcctgagaatcagtgatgatttggcacagatggagcattggccaaatagggtcatgccggaggattttgacaccattcagatgcccaacccgtggccttcaatggatgttgaagatttcagagtttcgctgggtcagacgcccgatcagatggccagagctggtccctctgatttgtcttcagtattccatgagatgtccgagaaactcctcagggaagacgtggttgctggcgatgacgcagacaacatagaagtagaagaccacctgacagtgaatgacatgggaatctatcttgaactggagggtctgactgatggattgggtacacgagtgaactgatggagcaagcagtgagactgatgccctaaatttccatatcacatattgcagcttttgcatagttggagagagagtggagtgaagccaccattcgcttcacggcatgaaggtatatgtgccggacacaggaaagaagaagaatccaaccactgaactaggttttggtgggtcaatggaatatgctcgtgtacatttgttgtagtttcttactttttcatcgttgtatcaaagacctcccaatgttcttttctcaagtttgcactaactttttatttctttctgcgcttgtgttgttaccagttatgtataaataaaagcgtttatagtgcaaaaaaaaaa

SEQ ID NO: 268 - DNA, 3343 bp, Eucalyptus sp.
ctcgagagcgcataacccacctcccggtctgctgattttcccacccgagatcgcgagattttcccggcaaagtccccttttttccgggaaaattcgatcggacggggtccggccatgaaggcggacgatgccctgccggaccatttgcggtgcaaccggacggacggccgccaatggcggtgcaatcgcccggtcatggaggacaagaagctctgcgaaattcactacctgcaggggaagcaccgccagcacaaggagaaagtgcccgagtcgctcaagatccagaggaggaccgggaaatcggaaggtaaggtccccgccctccacaatctcaaaattagggctcagaagatcgagaagcccggcaggcgggcggtgcggatgaggaggaagaatttggcgagggagctggtgaggatcgtggtgaagagggaggcggagaagcggcgcgaggtggaggggagcggcggcgaggatatgatgcggcgtctgcccaatggggtcatggtgatttcgcagtccgccgcacggcggcagcagcagcagagcggcggtgcgaatgacaatgtgggttcgcagtgcgatgtcaaggtgggagtcgatgctaatgtcgctccgaggaggcggttccggtcgaagaatcttgagcccctgccaattggggcagttcaggttatgccatacaagaggaatgtggagaaggtcgggaggaagaaatgtcactggtgtaagagcagcggtgccacgagtttgatcaagtgttcgagttgtagaaagcatcacttttgcttggagtgcatcgaagggcggtacttcgacacacaagaagaagttaagatggaatgtccagtttgtcgcaaaacttgcaggtgtaaggcatgcttggcttacaaatataaggacagtgcttgtcaggaactttcaagtgaccacagtagagctgacaaaattttacattctcatcatttgatttctgttcttcttcctgtactgaaagaaataaatgaagaacgaagcattgagcttgaggttgaggcaaaagtaaaaggaacagaagtttctcaacttcaagtccatcaagctgaatgtggctttaacaagcaatattgctgcaataattgcagaacatcaatcctggatctgcataggagctgttcaagttgttcttataatctttgcttaagttgttattgggatttctatcgaggaattctaccaaaaggagtgaagttacccaacaataaatacgatagaaagaggaaagcctctgttcagggtcataaacaactttctgcaaagtcaataagcaaacttgagcaaaaatatggtggtaaatctctcactgtttcaatgccgttagccacttcaaaagcttgtaacggtgatgacgtatcatgcccaccatgggagtttggctgttgtgataatgcccgattcaacctgcaatcctttttccccataaactggagtaaagagttagagaaaaaggcggaagaagttgtttgcagctatgatttacgagaaaactcagatggtagtttgtgttgccccttgtgtcatggggataatcatgaagctgtaaatacgcagttgcaacaagcagcaacaaggagaacttcaaatgataacttcttgtactacccaactgcattggaagttcatgctgataagtgtgagcacttccagaagcactgggttagaggtcatccggttattgttcgtgacatactttggaggacatcagatcttaattgggacccggttgctatgttctgtacccaccttgacggtagcattgctaaatgtgaaaatgaaaaggaagcatcaaaagccagtccttgcctggaatggtctgaggtagaaatcagcatgagacaatcgtttattggctcttttagagggaaagcacgtgaaagtattcgacatgagaaactggagataaagagttggctttcatcccgatattttcgtgaacaattccctgctcattatgctgaaattctctctgcattaccacttcaggattacatgaacccagatttaggccgcttaaatctggccacaatgctgcccctggaaaatatgtcagctgaaattggtccttatgtttatatctcctattgcagtcctaatgaacatccctctgaacattttgggtcaaaactatgctatgatttgtgtgatgtgatgatgtttcgccggacaaaattaatagaatcaaagctgatgaggaagcgccaggctcaggataaaaaggaatcaactggtgctccaaatggtgaactcttgggatctgacattgaaaattcaagtgaggtccttgatgtgagtatagaagagatgcaaatacggaagaaaatggcaaaagtgacttggctggcaacagcctcggaagaatcgccttgtctaattgcccaagataacaaacagaaacaagatcacaatagcacatcaatggaggatatccaacagaacctttatgagaatcagacagaaagccatagccattacatgaagaaagtgggaaaatcatgtggtgcccagtgggatgtgttccgcagagaagatgtaccgaagcttgaagaatactttaggcgatactctgctgaattcatgcagccgtgtggatctcagaagcatgttgtccatccaattctggatcagtgctactttcttgatgaatatcacaagttgaggctcaaggaggagtttgaaattgaaccctggacttttgagcaacatgttggtgaggctgtccttattcctgccgggtgcccctatcaaatcagaaatcccaagtctagtgtaaatgtgattctgcacttcatttcacctgagagtgctgccgaatgcatccatttgattgatgaactccgcctgcttccagaaggtcatgaggccagactagacaagctcgaggtgaagaaaatggccgtaagtagtttaaccagagcaattgatgaaatacgcgagcttacatcagtaaaggataatgctgaggcttagcagcgtctagaggaagtcatgggaaatgccaggctttactcagatggcttcatcaagatattcggcattgctagatttctgatttgggcagaaaggagggcacatttcatctatagaaattttgacacctctctctctctctctctctctctctctctctctctctctgtacagaagttcaaatcatgaactgcatctgtacagaagttcaaatcatgaactgcatccagcatgtatatgttggagaatcattagttgcaggtcgattggttcggaatgtaaatatattgagttgattgaccattctataaatagattctcaggtacaaaaaaaaaa

SEQ ID NO: 269 - DNA, 918 bp, Eucalyptus sp.
ggtttttactctaaatttcataattttaaattaatattttagtatttattttttttaaataacgaattttcgatttttttttatagaaccaagaacaagtgaaacagaaactagacacactaacaatgcctttcgtacctgcagaaaacccaaaatgcccagcatgcggcaaatcagtatatgccgctgaagagaaagtagctggaggatacaaattccacaaaatgtgtttcaaatgcagcatgtgcaataaattattggactccaccaactgcgctgaacacgaaaaagaattattctgtaaacaatgccacggtagaaagtacggaccaaaaggatacggtttcggtggtggtgctggatgtttaagcatggatgctggtgaacatcttggtaaataatttccaataaatcaaaccaatccaacaactcaactttatgtaaaagattaatctcaaaccaaatggaaattctcatattatacctacctacctatagctacatatataccaaccaaaaattaaattcaacaatctctgaataacagaattttaaaatccaagaaaaaccaaatgtttatttttctattacctatatatttatattattgtaaaacaagaattaaaatcaaacaattaataaagaagacgtgttctcgtttacgatctttttttaccgttttatcacaaccaactttttttctttttgcttattccactcgtttttttcttctttttttatgttcttttttttttaaaaagaaaatttattaaaatacccgactacacacttgcatagtataaacatatgttaagtttatttatatataagtttatttattcattcaattgtaaatttgtattaggtatttaattaaattaatcaaataaaaaataattttaagttttaaaaaaaaaa

SEQ ID NO: 270 - DNA, 389 bp, Eucalyptus sp.
gcagtctcggcatcaacgccttcgactgtacacgcgttcgggaggtcgactctcgtagcgaatcgacgaacaggataagttaagcgagcacaatgcctttcaaacccgcagacaaccccaagtgcccgaaatgcggcaagtccgtatacgcggctgaagagcgagtcgctggaggactcaaatggcacaaaatgtgcttcaagtgcggtctgtgccagaagctgttggactccaccaactgcactgagcacgatggtgagatctactgcaaaaactgccacggacgcaagttcggacccaagggctacggtttcggcggtggcgccggatgcctgtccatggactccggagaccatttcaaggaggcgaattgagcgagcgccccccca

SEQ ID NO: 271 - DNA, 1038 bp, Eucalyptus sp.
caatcacagagagagagagagagagagagagagagagagagagaatggcatttgcaggaacaacccagaagtgcatggcctgtgagaagacagtctatctggtggacaagctcacagctgacaatagaatctaccacaaggcctgcttcagatgccaccattgcaaagggactctcaagcttgggaactataattcatttgaaggagtcttgtactgccggccgcatttcgatcagctcttcaagagaactggcagcctcgaaaaaagctttgaaggaacccccaagattgcaaagccagagaaacccgtcgatggagagagacctgcagcgaccaaagcctccagtatgttcgggggaacgcgagacaaatgtgtaggctgtaagagcaccgtctacccgaccgaaaaggtgacggttaatgggactccataccacaagagctgcttcaaatgcacccacggggggtgcgtgatcagcccatccaactacgtcgcgcacgaggggaaactctactgcaggcaccaccacactcagctcataaaggagaagggcaatctcagccaactcgagggcgatcatgagagggaaacaatggctcctgaatcataaaacgctttgatcttgcactaccttgttcgttgagctgtcaccacactttgtggccagcggatttcaggctggtccaaaaacctgttatgctattagagaatctatgtccatctactaaatttgagatgtgtgagccttgaccggtttgatttggcttctgttttgcgattgcggatgatttctcgggttggttgtaagcgtagaataagtggtgcttgcttcttgactttgtgaaacctctgagcttgctttcttttcagtcttgtccagcgagtgtgtctagcatcatccctatttttcattcattcgactcacttttgtcagtgtccttgaagagtcttcatttactatggttgtgaattcgaagtgaaacttctcgacgaaaaatagcatgatttagttctaggtttgaagaacaaaaaaaaaa

SEQ ID NO: 272 - DNA, 1052 bp, Eucalyptus sp.
ggaattcattgacgacgacgaggtaacgtcgacctttaatcatcaactttccaaccaacacttgtttttttggcttccctttcttatcctccattctcctctctccttctccttacactcacagacacaatcacagagagagagagagagagagagagagagagagagagagaatggcatttgcaggaacaacccagaagtgcatggcctgtgagaagacagtctatctggtggacaagctcacagctgacaatagaatctaccacaaggcctgcttcagatgccaccattgcaaagggactctcaagcttgggaactataattcatttgaaggagtcttgtactgccggccgcatttcgatcagctcttcaagagaactggcagcctcgaaaaaagctttgaaggaacccccaagattgcaaagccagagaaacccgtcgatggagagagacctgcagcgaccaaagcctccagtatgttcgggggaacgcgagacaaatgtgtaggctgtaagagcaccgtctacccgaccgaaaaggtgacggttaatgggactccataccacaagagctgcttcaaatgcacccacggggggtgcgtgatcagcccatccaactacgtcgcgcacgaggggaaactctactgcaggcaccaccacactcagctcataaaggagaagggcaatctcagccaactcgagggcgatcatgagagggaaacaatggctcctgaatcataaaacgctttgatcttgcactaccttgttcgttgagctgtcaccacactttgtggccagcggatttcaggctggtccaaaaacctgttatgctattagagaatctatgtccatctactaaatttgagatgtgtgagccttgaccggtttgatttggcttctgttttgcgattgcggatgatttctcgggttggttgtaagcgtagaataagtggtgcttgcttcttgactttgtgaaacctctgagcttgctttcttttcagtcttgtccagcgagtgtgtctagcatcatccctatttttcaaaaaaaaaaaa

SEQ ID NO: 273 - skipped

SEQ ID NO: 274 - DNA, 968 bp, Eucalyptus sp.
gctctcttgccttatcgtccgcaccctcatttgctttctgcttcgcacaactgattttgaggcacacacagacacaagagaggctcactcctgcagtgttggggcgagagcaatagagggggtcatggctttcgcggggacgacccagaagtgcatggcgtgcgacaagacggtgtacctggtcgacaagttgaccgccgacaaccgcatttaccacaaggcctgcttccggtgtcaccactgcaagggcaccctcaagctttcgaactacaattcctttgaaggagttctctactgcaggccacacttcgatcaacttttcaagagaactggcagccttgagaaaagctttgaaggtatcccgaaaattgtcaaaccagaaagacctttgggcagcgagctgctcaaacagaaacctgctgcggctaaagtctcgggcatgtttgccggaacgagagagaaatgcttcggttgcaagaataccgtatacccaactgagaaggtgagtgtgaatggaactccgtaccacaaaagctgcttcaaatgcacccacggtggttgcacaataagcccgtcgaactacattgcgcatgaaggcaaactcttctgcaaacaccaccatgcacaactcatcagagagaagggcaacctcagccagcttgagggagaccatgcaggaaacgagaaagttgcaactagagaaattgctgtgtgagacgtaataagcagcatctgctatactatgttattttctccctcttgcactctccttccttaccggtcgagactgtagtttctgtggtctgaaaggcttcatgtatccattttgttcaactcgaaaggtgttggtcaccgtttcttgtaatttcggcttccttttttaccactggacactcgttagaacatgcccgcttacacttatagttgcataatcagatctcagatgactcttgcaaaaaaaaaaaaaa

SEQ ID NO: 275 - DNA, 871 bp, Eucalyptus sp.
ctcaatctgacttgtcaggggtgggatagcaagaaaagggtctgaaagtttttcttgctgaatcttctttgaccctcggacaatcagacacagcatagatttaatctgcccgaggaaacacaaaagatggctttcactggaaccgtggataaatgtaaggtttgtgacaagaccgttcatgtcgtcgacatgatgactcttgaaggcattccctatcacaaaacctgcttcagatgcagccattgcaatgggacgcttgtgatgagcaactattcctcgatggatggtgttctctactgtaagacgcatttcgagcaactcttcaaggaatccggtgatttcaggaagaatttccattcagccaagtccgacaagccgaatgagatgacaagaacccccagcaagctttcttccatgtttagtggaaccctagacaagtgttcctcttgcaacaaaaccgtttaccccttggaaaaggtgacaatggagggagagtgttaccacaagacatgcttcagatgcgcgcatggaggatgccctctgacacactcctcttatgctgccctcgatggagttctctactgcagacaccatttcgcgcggctgttcatggagaagggtgacttcaagcacgtgcttgactcagccacgcacaggagaaacgcctcctctggtaccccaccacccgagcctgctgagctggtgacagaaaccgacactgagatgatgcaagaagtctcgccatctgcttagcgctccttgatagttttctgcaacttggttagctgatcatctattttcggttttgtggggggtgaatgattgaaattcttgtttgattgttccaaaatttgattcctcctgtgtttgc

SEQ ID NO: 276 - DNA, 1260 bp, Eucalyptus sp.
aagacatccacttctcctcctcctctctcccctctcctctctcccctaccttttagggttcatatagactctctcttccaagcttaagctcaagcgcaagctcgcaggcatgacctctccctccctccatctctcttgctcaattttcctcttccgaatcgcctagggtttcctggatttctttctctctctagaaccctccgtttctctctcaacaagcgcctccaccccgcgccgtctccgatttcctgctttccgggacctgatccgcgcgacgccctccgttccgcggccactccgattcggagctcgaagtccgtactctcgcttcgatcgagcgttcgtcgccgtcgctcagttcccgctcttcttcttcttccgatctctttcttgttttttgtggcttgagagagagagagagagagagagggaggggggaaatggtgagggggaagacgcagatgaagaggatagagaacgacacgagcaggcaggtgacgttctcgaagcgcaggaacgggctgctgaagaaggccttcgagctctccgtcctctgcgacgccgaggttgcactcatcatcttctccccgagaggcaagctctacgagttctcgagctcgagcttgagcaagacaatagaaaagtatcagaagagagccaaggacatggaagccaaaactgctgaaatttctatgcagccttccaagggaaacactcttgacatggaaaagaagatcgagcatttcgaaatatctagaagaagactcctgggagagggtctggattcctgttcggtcgaggagctccaacaaacagaaaaccagttggaaagaagtctaaccaagatcagggcaagaaagaaccatttaattagggagcatattgagcggctaaaagcagaggagcggaaactactggaagaaaagagaaagctacttcaagagattgaatgcggcaaaggattgaccccggtctccagcaaaccgcctcgtgaagaaatccgcgcagagactatggatgtcgtgaccgagttgtttataggaccaccaaaaagatgaaccgatcagttgttctgttccgcgattgctcaaaataatgactatagcaccggaaacgcttcttctgttgctcttttcttcttcaatcgtgaggcaaaataaattgagagtgaacatgttcattaaaattttaattcacgatgagtgtatactttgttgttgctcgattgcctgaaaatctgtatattaattaaaaaaaaaa

SEQ ID NO: 277 - DNA, 976 bp, Eucalyptus sp.
caaggaagcaacagtcttgctgcaaccagaagctagttcaaactagtggaaggttgtgggcgcttccagtgctttgtaaagccaccccaagaaagcaaaaaccatcgttgccctaccacaaagttcgcagcgttcgtcgacgagaggagtctgttgatttatccaagtgttgtttaaagtagatctcctttttcggtgaacatggctcgtggaaaagttcagatgaagcggatcgagaacccggtgcaccggcaggtcaccttctgcaagcgccgcgcggggctcctcaaaaaggccaaggagctctccgttctctgtgacgctgacatcggcctcttcattttctccccccacggcaagctctatgagctggccaccaaaggaaccatgaaggggctgatcgagaggtacatgaagaccacccaaagccaagctgctctgaccgaggaagccacaccgagccaaccactggatgccaaagaagagattaacatattgaagcaagagattgaagcacttcgaaagggtctcgggtacatgtttggaggaggagctggtaatatgacactggacgagctagatgttcttgagaaacaactcgagacttggatttatcacactcgctcaacaaagatggatatcatgtttcaagagatccagctgttgaggaacaaggaagggatactgaaagctgcaaatcagtatcttcaggaaaagatagaagagaacaccgccattactaacactgcgccaatgaccactaactatacttacccactaactatacagaatgaattatttcaagatctgctattggtttagcagctcctctagtggagtggcactagcgtttctagcagtgaaaagaagcgtctgaccgtgcttgccctaagtgtttttgagcaaataagtattgttcaagtgctgtgtaagtccttgaattggctactactcttttgttgggtcaaaaaaaaaa

SEQ ID NO: 278 - DNA, 1065 bp, Eucalyptus sp.
gctctctctctctctctctctctctgtggtggctttcttctgtttttggctgtgatcagacaaacaaaaaccatctggttcggcgtctgaacaagaaaaaatttgagaagggattcaaggaagatggcgaaagagaagataaagataaagaagatagacaacttgacggcgaggcaggtgacattctcgaagaggagaagagggctgatcaagaaggccgaggagctctccgttctgtgtgatgctgacgtgtccctcatcgtcttctcagccactggcaagctctatgatttctccagctccagaatggaggatacgctaacgaggtattatggtttccactccaataaagttgagaaatcggttcaaccatgtcttgcgctcgagatagagaacaccaatcgggaaatgttgcatgaggaagtgtatgatcgggctcataaactgaggcagatgaagggagaggatctggaggggttaaacgtggaggaattggaccaattagagaagaaactcgaggcgggactgagcctcgtgatcaagaataaggaagagaaaacatggaacgagatcaacaaactgcagagaaaggaagcacagttgattaaacagaacaagcaactgaaacatgaaatgaagatgattttacatcaagagaaatcagtgaccgtgaactcggagtcggttaaagacgtttacatcagccgcaatagcatgcctcctctggatggcgatagtcctaatccctcaagttagggcttcctttccgaagctgaagtctcggacaggagacagccaactggtgcattttcctgcaagcaatcaataaagtatcgaagcatgtgacttcaataataacaataaaggattgaagccggcgattgcgaataactattctatagctagttggtgatgcaacttcttatattgatgaaactgcagtaacgattttccatttaaaaaatttgtactatattttcttgctcagttgctctagacaatatcgatacaataatgtaccgttgaatccaggagaaaagtttcactaattaaataaaaaaaaaa

SEQ ID NO: 279 - DNA, 1065 bp, Eucalyptus sp.; identical to SEQ ID NO: 278

SEQ ID NO: 280 - DNA, 1068 bp, Eucalyptus sp.
ggtttttgccctcttatccttctctagggtttctgaattcatggtcatttctgtgacatagagaagagaagtttcgccctttaatatgctgtgcaaatctatgatgctccgaccattgattctgtgaaatctttatcttctggtttttgcttgtgttcgaatggtatatcgtccatttctgtttgggaaaaaaaaaagcgtgattaattttgcagtgttctaaagcttttccggtgcttcatcctaaagtctacagaataggaggaggaagaaaagaaaactactcagctgattgaagctgcacaaagtacttgggagtatttaatcatggtgagaggaaaaattcagttgaggcgaattgagaatacgacaagccggcaagtcaccttctcgaagcgccggaacgggttgcttaagaaagcttacgagctctcggtcctctgtgacgccgaagtggctgtgatcatcttttcgcagaaaggaaggctttacgagttctcgagcaattccgaaatccaaaagacaattgatcgatatcgtagatctacatatgatatggatacatacaagactaatttggaccaatgtattctgcatttgaagcaagaaaccacagatatggagaggaagattgagcttcttgaagtgtctctacggaagctatcaggagaatgtcttggatcttgttccattgacgaaatccaaatgataggggatcagctcgagcgaagtttgagcagcattagggcaagaaaggcacaattattcgacgatcagatacagcacttacaagcaaaggagaggtctctgaaagaagagaatgcaaagcttcttgcaaagtgtcttgcaaatcctgggcagtcaacagctcatccgagagcagcagcactacatagccggagcagccggagtacagatgttgagaccgggttgtttattggattgccagagttaaactgatttgccatcacctgacacaagtctaataatacctgttcaataggatataatacgaatcactgcaatatcactcggtaatatctttattcagctggattaaaaaaaaaa

SEQ ID NO: 281 - DNA, 1110 bp, Eucalyptus sp.
ggccagcgagtcctttcctgaaactatatctttttctggtttttttgttctccttttccctctgaaacgcaatatgtgatgtgcatgattttggccctgtacgcagtttggggtttctgggtaacttccatttccgtgtatagcgagagaggaactctcgtcttggcctcaggagcaagacttttcctcagcagcagcaaattttcgcgtatcttaggagcatggcgagaggcaaaattcagatgaagcgaatagagaatgcaacgagcaggcaagccaccttctcgaagcgccggaacgggctgatgaagaaggctttcgagctgtcggttttatgcgatgctgaagtcgcagtcatcatcttctctcaaagaggaagactttatgagttctcaagctccaacatgcaaaaaacgatagagcgatatcatcaatatgcaaaagaagatacgggaaaaaaggccagcatggagcaatatatgctgcatctgaagcatgaggccgccgacatgtcaaggaaaattgaactccttgaagcctcaaaacggaagtttttgggacaaggtttggaatcctgctcagttgatgaacttcaggagatcagtgttcagttggagcgaagcttgagcactatcagagtgaaaaaggaccaattattcaaggagcaaatcgaacaacttaaagcaaaggaggtgtttctaatagaagaaaattcaagattgtgcgagaagtacggtgagaagggaatgccatggcagtctacatcatcagtccaaccaaaagaagcacgaattcacagtctaagcagcggaagtacagatgttgagaccgagttgttcattgggctgcctgaaatgcgctgctgattttttatacaaaggaataattgaagagcaagcagttagattattcatcttgctgacttcgcaaggccaggcgctccaataaaccatgcaggataaccttttgtcttcccttttcaagctttgagtaccgtccccctcagtcaagatcgttgcgtgtaatattctttcttttaggccctgtaaacgtacttgatctcataagaagcgaagagagtgtcgatcgctttcagaggtaaaaaaaaaa

SEQ ID NO: 282 - DNA, 1409 bp, Eucalyptus sp.
ggtaatgtccctctctctctctctctctttctctctccccccgtctttactctgcctttcttaggctttgccaaaacgagacaagtctctcctgtcttgattctccttgctccttctgtttcactatattcgcggtttagagggcctatttcccattttgtcatattttttttttgcctttcccccctcgtggatttattatgctttttcccatttttgtgggtgggagcttgaaggagataagagaggatagggagcagttgaatgttgctaaaacataacatttcagtagtgtttgtggtctccgagcaaagagattgatacatcaagcatccaaagaaaaaaaaaatcatcccttctctctctctttttgtgtgatgtgcatgattttggccctgtacgcagtttggggtttctgggtaacttccatttccgtgtatagcgagagaggaactctcgtcttggcctcaggagcaagacttttcttcagcagcagcaaattttcgcgtatcttaggagcatggcgagaggcaaaattcagatgaagcgaatagagaatgcaacgagcaggcaagccaccttctcgaagcgccggaacgggctgatgaagaaggctttcgagctgtcggttttatgcgatgctgaagtcgcagtcatcatcttctctcaaagaggaagactttatgagttctcaagctccaacatgcaaaaaacgatagagcgatatcatcaatatgcaaaagaagatacgggaaaaaaggccagcatggagcaatatatgctgcatctgaagcatgaggctgccgacatgtcaaggaaaattgaactccttgaagcctcaaaacggaagtttttgggacaaggtttggaatcctgctcagttgatgaacttcaggagatcagtgttcagttggagcgaagcttgagcactatcagagtgaaaaaggaccaattattcaaggagcaaatcgaacaacttaaagcaaaggaggtgtttctaatagaagaaaattcaagattgtgcgagaagtacggtgagaagggaatgccatggcagtctacatcatcagtccaaccaaaagaagcacgaattcacagtctaagcagcggaagtacagatgttgagaccgagttgttcattgggctgcctgaaatgcgctgctgattttttatacaaaggaataattgaagagcaagcagttagattattcatcttgctgacttcgcaaggccaggcgctccaataaaccatgcaggataaccttttgtcttcccttttcaagctttgagtaccgtccccctcagtcaagatcgttgcgtgtaatattctttcttttaggccctgtaaacgtacttgatctcataagaagcgaagagagtgtcgatcgctttcagaggtaaaaaaaaaa

SEQ ID NO: 283 - DNA, 1513 bp, Eucalyptus sp.
acaggggcaatatgaaaatggaaaggtgggtgcgtgagactgtgtgtgcttccccatttggtgactgtcaatgaattgagagaatccatcaatcgcccacccaacaaccccccccccccccccattccaaaaaaatcttttttttttctcccataaattagctccctcttttatccttaattatcctgggggctccttcatcgtttctttgggtgatactgatcacacaatcctcaggactttcccccatacttttccttcttcttcctccctctcctttctttcgctttcccatttccggcctctttccgtgcccttcatgttcgtccgaaagcattcttggtttttgcctctttggtgaaatcgagtttggggtcgattcttctcagacttttatccgcttctgggttacccttttgtcttgttcttctttcgaggagcatttcagctggagaaaagcttcttcttgaatcgaatcgaatcaaagcccacacctcgagctcacctgggtctgttgctcgcctcttgaacccttctttgtccctcgatctctgttgggaaatccttaattcgctgcatcaaatatcagtgagggcgattgttgagtaaagatggtgagagggaagaccctgatgaggcgcatagagaatgcgacgagccggcaagtgaccttctcgaagaggcggaatgggctgctcaagaaggcctttgagctctccgtgctttgcgacgccgaggtcgcgctgatcatcttttcccctcgaggcaagctctatgagttcgcaagttccagcatgaacgaaaccatagagcggtaccacaggcacacaaaggacacaagaacaggcaacaaatcagtggaagaaaatatgcagcatttgaaggacgaagctgcgaacatgatgaagaagatcgagctcctggaagattcaagaaggaagctccttggtgaaggtctaggatcatgctcgatagaggaactgcaacagatagaacagcagctagaacggagtgttatcagcattcgtgctagaaagactcaggtcttcaaggagcagattgacaagcttaaagagaaggagaagatgttgacagctgagaatgcaatcttaactgagaagtgtggaatcaagcccccacaaagagcaaatgagtgcagggatagtccacttctcagagagagcagcccgagttcggaggtggagaccggtctcttcatcggaccaccagagaccagatcgaggcgcctgccgtttcagaattaaaaatatagccctagcctctcaaagtatcaaaatgtcacaaggcagacgggctttctctcttctctccatccctccctcccatcattttctcaaaaaatttcaactgccactgaagcgctatcctagtgcaagcaataaattagagcaatatcaatatgaccatgtatcgattctgtttcatcaacctgtgatgaaaggatgacagagaattcgatgtttaaagtattcagatatcacgaaaaaaaaaa

SEQ ID NO: 284 - DNA, 1513 bp, Eucalyptus sp.; identical to SEQ ID NO: 283

SEQ ID NO: 285 - DNA, 849 bp, Eucalyptus sp.
cctctcctggctctcgctctctctctctctctcagttctttctcggacgggtgtctgtgcgtggcttttgatcggtcatcacctgaggccgcgtctgcaagcaagtgaagaaggaggacaaggaatatggcgagagagaagatcaagatcaagaagatagacaatgtgacggcgaggcaggtgacgttttctaagaggagacgagggcttttcaagaaagccggagagctgtcggtcctgtgcgatgccgaggtcgctgtcgtcattttctcggctaccggcaagctctttgagtactccagctccagcatgaaggacactcttgagaggtacaccctccaccacaataatcttgagaatatggaccaaccttctctcgagctgcagctggagcatagcaataacatgaggttaagcaaggaagtggcagaaaagagccatcgactcaggcagttgaggggtgaggatcttcaaggactgaatatagaggagctgcagcaattggagaagatgcttgaagctggacttaaccgtgtgctggtgaccaaggaagaacgaattaggactgagatcactgatctagagacaaagggagcagagttgattgaagaaaacaagatgttaaagcagacaatgactacattgaccaaaggaaagcggcatattgtcacggagccagatgttgcacttccggaggaaggggtgtcatccgagtctgctaccaatgtgtgcagctgcaattccggccctcctttggaagatgatggctctgatacatccctcaaacttgggtagaacgctgctctccttgcttcctttctgaaagcttaacttggagagtaactgatg

SEQ ID NO: 286 - DNA, 1636 bp, Eucalyptus sp.
accgaccgaccgctcatcttcttcttctgcgcaattttttctgctggatcatcatcattaccatcatcgccatccccaccatcatcatcatgatggtatctctatctctccctggcaatcgattgtagaggaaaggaagagggaaggggcatatgtattgatcaacctacccgaaaaaacaatctgatcagccctgctaatcttgcttataaatctcttatccactgttcaatcattcaggtttcttcccactttcaagcaaaggctcccggattggccgtgttcttagattttcagaactcgggctgcgtccaactgtaggaacgaaccagcacaaggggttgcagcttttgctgttgctgttgcgcccattgcttttggactggtattagtagttgcagctttgttttgcatacgctgtgaggatctgtgcgcggaaattttgtgtacaaatcatgggtcgtgggaagattgagataaagaggattgaaaatactacgaaccgacaggtcactttctgcaagcgccgaaatggtttattaaagaaggcgtatgaattatcagttctttgtgatgcagaagtggccctcatcgtcttctccagcagagggagactttatgaatttgccaaccacagcgtgaagaggacgattgagaggtacaagaagacttgcgttgacaacaaccacggaggggcgatatcagagtccaattctcagtattggcaacaggaggctggtaaactcagacaacagattgaaattttgcaaaatgcaaataggcatttgatgggtgacgggcttacagctttgaacattaaggaactcaagcaacttgaggttcgacttgaaaaaggaatcagccgagtgcgatccaaaaagaacgagatgttgcttgaagagatcgacatcatgcagagaagggaacacatacttatccaggagaatgagattcttcgcagcaagatagccgagtgtcagaatagccacaacacgaacatgttatcagctccggaatatgatgcactgcccgcattcgactctcgaaatttcctacatgcaaatctaatcgatgcggcccatcactatgcacatcaggaacaaacaacgcttcagcttggctgaacgttgaagcggtggacgcttaaaactcaatcaaggcacccgaaaaatatgctagtaaccttgaatgagattcagagtcgaaatattgcgaggcaagagcacaatggaagagatagctcctagtatgaatatggatttatgatattaacatatggtttgtcagctttaaatatagctgtttgaaacaaagaatacaacatattagctagtatttttttggcgcatgttatctttctgttgaacataatcgacgaagctttacttctacatagttccttctttatgcctatgctggggtcaatttaatctttgtctctccttatttcgaaacaccagtagtatttgatattccaagaacattgaaatcagtacccactggcagagaaaggcaagggaattaagagtccgttcctgcaaaaaaattgtacacgtatgtttcgattgttagcttgttgtaaccatgtaaatttgcacacttatgtctcaattgatagcttggtgtaaaaaaaaaa

SEQ ID NO: 287 - DNA, 1149 bp, Eucalyptus sp.
ggtcttctccaggatctttaccaaaacaagaaagatgatttagaaaaggagatatctgatttctttccccttcaaccaacaagcacttttctttcttcttgacttggtttcatccggttcagattcccgtccctccttttgctatttctggaaaacctaatccgggtcttgcagatccggtagcctcctcaaggaagctgtctctcgatacaccatttctcaactccccattttcttggcatcgcagaatcgtttcttggactttcttgagctgctcctttcgcctcatttctcaagtgcgtgaaaaccaaaaaaatggtgagggggaagactcagatgaggaggatagagaacaagacgagcaggcaagtgaccttctcgaagcgtcggaacgggctgctcaagaaggccttcgagctctcggttctttgcgatgctgaagtcgccgccatcattttctctcctactggaaaactttatgagttctctacctcaagcatgagcagcataatagaacgatatcaaaggaaaacaaaggacccggggtgcagcgagaaaactaccgaaatcgatttgcagaatatgaagggaagctctctagacatggcaaagatgatcgaacttctcaacgtttccaacagtcggctctcaggagaactttcagatacgtgttcagttgaggagctacaatcaacacagaacctgttagagagaagcttatccaaaattagggcaagaaagaatctactctttaaggagcaaattatgctgctaaagcaggaggagaagaagttgttggatgaaaacaaaaagttgcgtagtaagaacgaagtgcgaggcccgctgaaatttgtgaccgagcatccagaagttcctcgaggacagggactggacgtggaaactgaattatccataggatgccctcaaagacaccgattaaacatccatccacatgaagaaggtttgagcatacactggctataatagctgtcatttgtccaaagctggtacgagcttgaccataactcagaatctgtgtctcattgtcatttttttcgtgatcgacttcataatatctgtccgaaggggttttcttaccctaatgatggaagaggtaggcttttaattcgttgcctccttgtacttgga

SEQ ID NO: 288 - DNA, 1149 bp, Eucalyptus sp.; identical to SEQ ID NO: 287

SEQ ID NO: 289 - DNA, 1051 bp, Eucalyptus sp.
ctcccctctcctggctctcgctctctctctctctctcagttctttctcggacgggtgtctgtgcgtggcttttgatcggtcatcacctgaggccgcgtctgcaagcaagtgaagaaggaggacaaggaatatggcgagagagaagatcaagatcaagaagatagacaatgtgacggcgaggcaggtgacgttttctaagaggagacgagggcttttcaagaaagccggagagctgtcggtcctgtgcgatgccgaggtcgctgtcgtcattttctcggctaccggcaagctctttgagtactccagctccagcatgaaggacactcttgagaggtacaccctccaccacaataatcttgagaatatggaccaaccttctctcgagctgcagctggagcatagcaataacatgaggttaagcaaggaagtggcagaaaagagccatcgactcaggcagttgaggggtgaggatcttcaaggactgaatatagaggagctgcagcaattggagaagatgcttgaagctggacttaaccgtgtgctggtgaccaaggaagaacgaattaggactgagatcactgatctagagacaaagggagcagagttgattgaagaaaacaagatgttaaagcagacaatgactacattgaccaaaggaaagcggcatattgtcacggagccagatgttgcacttccggaggaaggggtgtcatccgagtctgctaccaatgtgtgcagctgcaattccggccctcctttggaagatgatggctctgatacatccctcaaacttgggcttcctttctgaaagcttaacttggagagtaactgatgattcaaagggatctcagtttcttataattacaagaaccttcaatgtgtagtcgttaatggttatctcgacggatgtataatagtgcctgtaactatttttccattcccagaagctttgatatgttgtatgtatgctttaacatgagtgataaatgtttagtgaatatatattactatatagttggctccaccttttggagaaatttaaaaaaaaaaa

SEQ ID NO: 290 - DNA, 1051 bp, Eucalyptus sp.
ccaccaccagcagaaggaggagaagggggagaaggaggagaaggaggaggagatgggtagagggaagatagagatacagaagatagagaacgacacgaacaggcaagtgacctactcgaagcggaggaatggcatcttcaagaaagcccacgagctcaccgtcctctgcgacgctagggtttccatcctcatgctctccggcaacaagaagctccacgagtacatcagccccaccaccacgacaaaaaggatgattgatgattaccagaaggctcttgggatcgatctgtggactacacactacgatagaatgcaagaggagttgaggaaactgaaggaggttaataacaattttcggaaggaaataaggcagatattgggccacgatttgaacgagctgagctacgcagaactgcacagtctcgagcagacgatcgagtcttctgtcaattcagtgcggcaaagaaagtaccatgtcctcaagactcaaactgatactcacaagaaaaaggtgaaagccttagagcacagatatacagaacttcttctagaatctggagcgacatatgaggatctacaatatggactaagtgaagatattgagggtgattatgaatctgccgtcaccaacttgtccaaccacaccggagcatcggccatgtatgctctccggcttcatccgagcgaccatgatctctccagtgaaggacatttcgtgcctgacttgagcctcaactgaagtcggtcgcagtttcgtggtgctaccttggatggtttatgtttccttttcttatgaacactttcgatgttctatttaatctcgtgtgggtatcctcttctggggatgttacgaaattagacaagaaaagagacaaggactagggagtccgagacttaatcgaagtgtgttccttcttgcaattactgttggtgtgttgatttgagatcagaataatggacaaagctgttgtgtaatcttctgcctgcgataagtagactttattagcacgtgtgaaaacaatactatgagctcatttatgcaaaaaaaaaa

SEQ ID NO: 291 - DNA, 1043 bp, Eucalyptus sp.
gcttctgcgtagtttcaacattttagagttgaagaaaaggagaaaaaactaggcaaacttgcgaccatggtttttccaacccaagccacgcccgaggagtccccgcagaggaaaatggggaggggaaagatcgagatcaagcggatcgagaacacgacgaatcggcaagtgactttctgcaagcggcggaatggcctcctcaagaaggcatatgaactctccgttctttgcgaagccgaggtcgccctcatcgtcttctccagccgcggccgcctctatgagtatgccaacgatagtgtcaaagcaaccatcgagaggtacaagaaggcttgctcagattcctccagtagcggatccgtttctgaagctaatgttcagttttatcagcaagaatccgccaagttgcaacaacagattaataacatgcagaacaataacaggcaactggtgggtgactcaattgctgggatgaatatgaaggatatgaagactacggagcaaaaactagaaaaagcaatcgctaaaattcgcgccaaaaagaatgagcttctatttgcggagattgagtatatgcaaaaaagggaaattgacctacacaacaacaatcaagttctgcgagcgaagatcgcggagagcgagaggacccaacatgcggatatgaatttgatgccgggaggtaccaactatgacttcatgcagccatcttcttctcagcctttcgattccagaaactacttccaagtgaacgtgctgtagcacccaaccactgtgagtctgcacaactagtattgattgaagggaatataactagtatatggagcttctaagtgcttattatgaggttatgatggacttcatcagatgttaattaagtagaagcagttggcagatgcatctattaggtgaagggcgtcctcatccttttgttgattagcatccttagatgtcttaaaatttcaaccatctttgttaaggtgtgtatttgggtccctatgtactaaactgaatatgaactatcgaactctagccgtgttaaactaata

SEQ ID NO: 292 - DNA, 1073 bp, Eucalyptus sp.
ggtcgcaggagagagagagagagaaaagagagagagagagaggtagggagatggcgagggggaagatccagatcaagctgatagagaacacgacgaaccggcaggtgacctactcgaagcgacggaacgggctcttcaagaaggcgaacgagctcaccgtcctctgcgacgccaaggtctccatcatcatgatctccagcaccggcaagctccacgagtacatcagcccctccacctcaacgaagaagatgtacgatcagtatcagcaggcgctcgaggttgatctctggagctctcactatgagaagatgcaagagaacctgaggaagctgaaggaggtgaacaagaagcttcagctggaggtcaggaggaggttcggggaaggactgaatggtatgagcttatcggaattgtgcggtcttgagcaagatatggacaacgccgttagcctgatccgtgaacggaagtacaagacgctcggcaatcaaatcgacaccgccaggaagaagaaaaagaatgctgaggaaataaacaaaagtctcctgcaagactggaccaatctgatcaagcatctgagggaggacgacccgcacttcggaatggtcgacaacggcagggattacgaggctgtgatcgggtatacagacgccgccgccgccgctcgcttgtacaccctgcgcctgcaaccggaccagcccaatcttactagcggaggaggatcggagatcacgacctaccctttgctcgagtgagacgaaggcgtcggaaacccttccgacgtcctcatattgtctattcattctgtctaagggccgattccatctggaatcctgacttcattggtatgtcgaagtttaggactttgttatgtcatcctattcagcagctaagtttgttcttatcagaagctgttcctattatggaccgagggcgatttcctctagggcatcatgtgttttaagacaagtctatatataagactactttaaaacaatcgaatgagttggtgcaagatagtattgcacgctaatatatgtgatctaaagggctttgccatgggttcaaaaaaaaaa

SEQ ID NO: 293 - skipped

SEQ ID NO: 294 - DNA, 1037 bp, Eucalyptus sp.
cgacggccgcgaaaccgctgttgaagctcccgccgtcgcgcctctcggtcgcaagcttgacggggatggggagggggaagatagtgatacggaggatcgacaacacgacgagcaggcaggtgacgttctcgaagcggaggaatggattgctgaagaaggcgagggagctcgccatcctgtgcgacgccgaggtcggggtcgtcatcttctccagcaccggcaagctctacgacttcgccagctccagcatgagcaaggtaattgagcggtacgacaaattaaaagaagagactgatcaatctgcgagcccaatggctgaacttaagtattggcagagggaagcagcaatattaaggcaacaactgcagcatctccaagaaaaccaccggcaaatgatgggagaagaactctcaggcttgagcatcaaagaattgcggaatttggagaaccaattggaaatgagtctccgcggtgtccgcacaaaaaaggaccaagttttaatggaagaagtacgggagctgaacagaaagggaaacctccttcaccaggaaaacttggaactgcataagaaagaaaatctatttaaacaagagaacatggaattgtacaagaaggtctatggcacaagagatgcaaataacataaatggagcacacgcgagtcttctaccaaataaaccaagcaatgatgaagatgctcaagtacctatccatctccaactaagccagccgcatcatcagaactgtgagacgtcatctagaactacaaacttaggattgcagctgcattagcaaactgggtgcaacaactgcagaagtacattattgagtctctatcaagggaccatgcaaacaaagtaatgtttctttgactgagatattgtataagagccaaagctattcagccagacatgttcataggggttgattagattagctttgagcaaccatctgttaatgatataagccgatgagatcatattaactgtcacaaataaagacgaattcaaaagccgaaaaaaaaaaaaaaaaaaaaaa

SEQ ID NO: 295 - DNA, 1002 bp, Eucalyptus sp.
gagaaagagagacagagatatgggaagagggaaagtagagctgaagaggatagagaacaaaatcaacaggcaagtaacatttgcgaagagaagaaatgggcttctcaagaaagcttatgagctctctgttctctgtgatgctgaggttgcgctcatcattttctccaaccgtggcaagctctatgaattctgcagcagttctagcatgatgaaaacaattgagaagtaccagaagtgcagctatggttcacttgagaccaactgctccatcaatgagatgcagaacagctaccaggattatttgaagctaaaaacaagagtggaggtcctccaacgatctcagagaaacctccttggggaagagttgggtcccctaaactcgaaggagctggagcaacttgagcaccagttggagaattctctgaagcaaattcggtctgcaaagacccaattcatgtttgatcaactggctcatcttcagcacaaggaacaaatgctggttgaagctaacagagaattaaggaagaagctggaagagagcaatacaagaatccctctccgccttggatgggaagctgaggatcacaataacatttcatacagccgccttcccatgcagtcgcaaggattgatcttccagcccttaggcggcaacccgacattgcagatcgggtacaatcctgcaggctcgaatgaattgaatgtttcggctgccgaccaacatcccaacggattcattcccggatggatgctctgaatcgttccgcaagtgaactgcttgctggaagttccatatcaagtacattttccagtttttgctatgatatatgactcttcttcttctggatgacctatacgaagatccatcattcgtggatattgtccatggacgtaccctaaaaggaaggacagtatgaatccaatctagcttactattttgtataagaataaacatctgtgctgctgatatttggaattcatctatgttatttaaaaaaaaaa

SEQ ID NO: 296 - DNA, 1002 bp, Eucalyptus sp.; identical to SEQ ID NO: 295

SEQ ID NO: 297 - DNA, 1258 bp, Eucalyptus sp.
attaattcatgtctccgctcatctcaactggaacagttcagaaagacagatagatacatacacagagacatcgattgcatcatcttctctacctcattgtgcgtgcggtgcgtgcggtgcgtgctttttatagacgctcgctcttacgttgttctcgtccgcccggtggtgtggtggttggagagagagagagagagagagagagagagagagggagaaggagtagagagagaaaatggggagggggagggtgcagctgaagaggatagagaacaagataaacaggcaagtgacgttctcgaagcggagatgcgggctgctgaagaaggcccacgagatctccgtcctctgcgacgccgacgtcgccctcatcgtcttctccaccaagggcaagctcttcgagtacgccaccgactgttgcatggagaggatcctcgagcgttatgagagatattcatatgcagagagccaggttctcacaaacaatgccgaaaccaatgggaactggactttggaacatgcaaaactcaaggccaggatggagattctgcagaaaaatcaaaagaatctgatgggagaagaactcgattctctaagcctcaaagagcttcagaatttggagcatcagcttgacactgctcttaagcacattcggtctagaaagaatcaactcatgtatgaatccatctctgagcttcagagaaaggataaggcgctgcaagaacaaaacaacatgctggcaaagaaggtgaaagagaaggagaaggcactggcacagcaaactcaatgggacaacccgcaagatgatggcctcacctcttcctcggttattctctctcaatctttgcagcctgtcaacattgggggtccttaccatccgagtggaattgaggagggagcggccctcggtccacctcaacatcgtaatgccacccttcttccttcatggatgcttagccacctccaagaataatgatccaatttatttgcatgggaaccatatattaccaatattatctaatgcttcttatcgtatatatccagtcgattatgtaaccataatgtaacatgtcttagtacatgcattgtggggatacttgcaaaaaccttgtttacatgatatctatcaaaagagagatttgctgtggacattatgctacggtacgaactggatgagattgtaaataagatcctgagttagggtcgtaattgctaattatgatgtaatctatgtgattgttattttctaaaaaaaaaa

SEQ ID NO: 298 - DNA, 998 bp, Eucalyptus sp.
agagagagagagtaatggggagagggagagtggagctgaagaggatagagaacaagatcaacaggcaggtgaccttctcaaagaggaggaatgggctgttgaagaaggcctatgagctctctgtgctgtgtgatgttgaggtcgcgctcctcatcttctccagccgtggcaagctctatgagtttggcagcgctggcccttctggcataaataagacgcttgaacgataccaacgtgacaacttcactcctcaagacaacgttgctgaacatgagacacaaaactggtttcaagagatatcaaaattgaaggcaaaatatgaatctcttcaacaaactcagaggcatttgcttggagaagaccttggacagctgaatgtgaaagagttgcaaaatcttgagaagcagcttgaacaagctcttgcacaagctaggcgaaggaagacacaacttatgttggaacaaatggatgacctccgcaaaaaggagcggcagctcggagatcttaacaagaaactcaagtctcagctggaggcagaaggactaaatctgaaggccattcaagcgctttggacctccacatctgatgctgctggaactagcagcttccatgtccaccattctcaacggatacccttggattgcgaaccccagccggtcttgcaaatcgggtaccagtatgctcaagcagaaggatcatctgttacaaagagcggtactggtgaaaccaacttcattcaaggatgggtcctctaaacaacatatggaacagaaaaatgcatcttctatgaatatgatcgcatgcttgatttcttgtcctaaacatactttttaagcatggtttttttttttttttttgccaagtggttggccatcctgataaaggtgatcagagtgagatgggtttgtccatcaaatttactgtgttcgtggcgcaattagagtgcgtgccatgtaaatatatatatctatgttgtgatgcattccagaaaaaaaaaa

SEQ ID NO: 299 - DNA, 1087 bp, Eucalyptus sp.
ctttttgagcaagacgaggatcaaagaagaataaggaagaggccgagagagggagattatcgtcgagcaggagggggaaagaaagaaagaaagaaggaaagaatggggcgagggcgcgtcgagctgaagcggatcgagaataagattaaccgtcaggtcacgttttcgaaacgccggaatggtctgctgaaaaaggcgtatgaactttcagtgttatgtgatgcagaggtagcactgataatattctcaagcagaggaaaactctatgagttcggaagcgccgggatgctcaagactctggagcgatatcaaaaatgttcatacgtattgcaagacgcgactgtatcggaccgggaggcgcagaattggcatcaagaggttggcaaattaaaagccagagttgaacttttacaacgatcacaaaggcacttattaggtgaagacctgagccccttgagtattaaggagctgcaacaactggaacgtcaacttgaggttgcactgacacatgttaggtcaagaaagactcaagtcatgttggaaatgatggatgaactacgcagaaaggagcgaattttacaagaagtaaacaaatctctgcgcaagaagttgcaggaggccgagggacaggcattcaatgccatgcaacctccccctcatgcatgggattcgcatgcagtagcaaataatgcatatgctatgcaacatccatcaaatgctgtggattgtgagcccacattgcagattggataccaatatgcccctcctgagtcaagcatgcctaggcatgaacaagcacaaaacaattacatgcaaggctggatggtataatgtaccaccaatttctaatgacaagcagaagtattaatatttataaatattaaaatgtctgtatatatagctatgaatttacagttgtattgtacttccattttaattcatgtttttcagtagtttgattgtagtaacttaacattttatttttcccaaaccctaacaactttgacttttaaaaagtcacaattttatgcaacaatatttgtgtttatatatataattgcttttctgttttccaataaaaaaaaaa

SEQ ID NO: 300 - DNA, 1145 bp, Eucalyptus sp.
ctctctctctcgctggttcaagaacacaccaaagaagagagacccatgttaagctgttagtatctggagtcttattcttttcatatttttctccaaagcatcctcgtccccaaggtttttttgcggcagtatggagttcccgagtgaattttcagaggcctcttcacagaagagaatcggggggagagggaaaatagagatcaaacggatcgagaacacgacgaaccggcaggtcaccttttgtaaacgccggaacgggttgttgaagaaggcttatgagctatcggtgttgtgcgatgctgaagtggcgcttattgtcttctcgagccgtggcaggctctatgaatatgctaacaacagtgtcagaggaacaattgagaggtacaagaaagcaagcagtgattcctcacatccacagtccgtttctgaagtgaacactcagttttatcagcaagaagcatccaagcttcggagacagataagagaaatccaggtctcaaataggcatattctaggtgagggtataagtgatttgagcttcaaggatctcaagaatctcgagagcaaattagagaaatcgatcagccgagttagatcaaagaagaatgagatgctttttgccgagattgagtacatgcagaagaggggccttgtgcaggaaattgagctgcaaaatgataacatgtatctgagagcaaagatagctgagaacgagggagcacaacagcagcagcagcaagggagtgatcatcacttcaacatgccgggatcgtcgtcagtgaagcctgcatacgatcgcaacttcctgcaagtcaatgtcctggaaccaaatcaccaatcttattctcgatccgaccacactgccctccaactcgtctaattaaagctcagttaatatgtagcactagcaactggacgtattggcactctagactatgctttttaatatgctagagttagttgaaagaggaatcaatgaactggggagagacccgcatgatgagtttcgcctaaacagtggaagaactctctgatatttctcttcatcactcttcaaactcttctgatgaatcgtgttgtacaagggttattgcaatttttatatagtacttaagatctctctctcaaaaaaaaaaaaaaaaaaa

SEQ ID NO: 301 - DNA, 1270 bp, Eucalyptus sp.
agaaaaagaaggggagaaaaggagaggccaccttattataattccacttgcacataaatagaaagataccgattaatcagtacactccctcctcctctctcgctcgttcctccacttccactccctctctctccctctccctctccctctccctctccttctccctcgctctcttcgatgacacggggctagataagtttagggtttcttgagttcttgctctctctctctctccctgtagagattttttattggagcttttttttttttttgttcctggtgttcttgtcgttggtcatagcaagaaaagagagatggggagagggagggttcagctgaagaggatcgagaacaagatcagtaggcaagtgactttctcgaagcgacggactgggttgctcaagaaagcccacgagatctccgttttgtgcgacgccgacgtcgctctcatcgtcttctccaccaaagggaagcttttcgagttttcgactgactcttgcatggaaagcattttagagaggtacgagagatacacttatgcggagcgacagcaagtggccactgattcccctcaagtgcagggaagttggtcgcttgaatatcccaagctcgtggctaggatcgaagtcttgcagaggaacataagaaacttgagcggagaagagcttgatcccttgagtctgagagagctgcagtatttggagcagcagcttgatacagctcttaagcgcatcaggaccaggaagaaccaactcatgcacgagtcgatttctcagctgcaaaagaaggaaaaatctctacaggagcagaataacgtgctctctaaaaagatcaaagaaaatgagaaggtaatgagagagagtggacaatgggagcagcaaaccccagcaccgaccacatcctccttcatgctacaacccactttgcctcttccttccctcaccattggcaacacgttccagacaccgcatgtacttggaggagcagaacaagaggagagatctcaagcccgaccagccaacacgctcatgccgccttggatgatacgccgttcaaatgaatagagagatagagaccaacaacattctcctccacatcagcttttgattacggccaaaagccattttcacttcactgtaaggttatgttacagcgcgagtctttaactcagctgcttcctatctatgaccctctataatcggtgtaaagttattgatgtccgaactactccatcataagaaagtaattgggtatccaatcaaaaaaaaaa

SEQ ID NO: 302 - DNA, 1145 bp, Eucalyptus sp.; identical to SEQ ID NO: 300

SEQ ID NO: 303 - DNA, 1253 bp, Eucalyptus sp.
caaaccttcccagggtttccatttccatttccttcatagaatgctccgttcctttcttatccctttttgggtactctctgttctcatggtcctttcataaagttttctcatctcttaaccaagactggtaagagagagagagatagagagtttattagtgggtgagggtgttaaaaaatgggaagagggagggttcagctgaagaggatagagaacaaaattaacaggcaagtgaccttttccaagagaaggaatgggctcctcaagaaggcttatgagctctcgctcctctgtgatgctgaggtcgctctcatcatcttctccagccggggcaagctttacgagtactgtagcagctctagcatgatgaaaacacttgaaaggtaccaaaagtgcagctatggtgctcagctcaacccaagccgctcaatcgatgagacacagagcagctaccaagaatacttgaggctgaaagcaagagctgaggtcctccagcaatctcaaaggaacctgcttggggaagatttgggttcactcgacagtaaagagcttgagcatctggagagtcaactggagagttcattgaagaacattcggtcgacaaagacccagtccatgctcgatcaactctttaatcttcaaaacagggtgctactggagaccaacaaaatccttagcaggaagctggaagaagtaagtccgcaaattccctttcaacttgcctgggaagtcggaggtcaaggcggcggcggcggcaatgggggcggcggcgggggcgggggcattccatttagcctctttcctcctcaatcggaagggttcttcaacccaatggacggcaacctctcattgcaaatcggatacaatccgacatgtctggacgagatgaatgcttcggtttcgagccaaaatgttgccggattcattccgggatggatgctttgaacttactacatcgacttggagtgtgaatcgagctggtgaaatttgtgcgcgtgtcccttgtaaaattgcgatccgcaagacaataagtacataatattttggagctgtgatgacataaaaagaggaaggccaccctttcctctctcatgatcagaacttttgataatgtctgtatggccctgcagtgcaattggaacgagctcagctttgcagttcttttcgaagcctgaaatattgagctgcatagcttgctgtcataatgtatggtcgaacgtagcgctcgctttagagtttctttaaaaaaaaaa

SEQ ID NO: 304 - DNA, 1261 bp, Eucalyptus sp.
gtctttcttttgtttcttgccgttttggggtgtgtgttgggtcgtgtgaattggagcgaggatggggagggggaggctgcagctgaagaggatagagaacaagatcaaccggcaagtcaccttctccaagaggagggcgggtctgctcaagaaggcccacgagatctccgtactctgcgacgccgaggtcgccctcatcatcttctccgccaagggcaagctcttcgagtactccaccgattcctggttttatcaatactgaaaacaaagattcagccgtgaaaagatagggccgggaaggattaaaaacatgaagagcagctcgaatccttaatttttttgcatggagagaattctcgaacgctatgaaagatactcatattcggagcaccaagttcttgcaagtgagacagaatcgattggtagctggactttggagcatgctaagctcaaggccagacttgaagttttacacagaaattataggcatttcatgggagaagatcttgattctttgagtctcaaggacctccaaaatttgaagcaacaactggagtctgctcttaaacacataagatcgagaaagaatcagctcatgcatgaatcaatctcagtgcttcagaaaaaggatagggcattgcaggagcaaaacaacctgcttacaaggaaagtaaaggagaaggagagggcactagcgcagcaagctcagtgggagcagcaagaccatgcccttgactcacctgttgttctaccccactacttgccatctctcgacatcaatggctcttatcaagcgagacacaacggacacgatgacggagagaacctgactcagcctcgggctggtacacttcttcctccgtggatgctcccccgtctcaattaaggcttcgacataaagggaaacttctgctgctatatctttgatatgcaattttgaagtccagttgatgaattgcatggcataatctggggctctcccccaccttgttctagcgaaataaacatacctctgctttttgctgcattcagtactcctaagtgtggtcctccgtgtatgtatagccccattgcaaatatgcataccaatgtacatgtatgcaaaattatatatggtagttaacccacccataaagcagatggagaagtatattgtttgctagcaaaagagattgtcaaactgtatcaagatattctgatatattgtcctggactcctggttgaataggacggaattctatcgttctgtgctaaaaaaaaa

SEQ ID NO: 305 - DNA, 1624 bp, Eucalyptus sp.
ccaacaagtcatatatcctcgacttgctcccagtggaacgccttccattacttaatcgctgctagcgctaaacccccctcactcttcaccagcaaaaacgccttttctcgcacacaaatgggtcgtcgtaaaattgaaatacagccaataacgcacgagcgaaaccgatctgtcacattcctcaagcgcaagaacgggctgttcaagaaagcgtatgagctcggtgtgctctgctctgtcgacgtcgctgttatcatctttgaggatcgcccagggcacagccccaagctctaccagtactcgtctcgcggtatccaggatattgtgcagaggcatcttcatcacgatggcgagactgataaccgtggccctggggacttttcgggcgctggcgggggaaagttggacgaagtcgatgaagacgatgaagaggaagaggttcctgtgcgtaccaagaggaagaaagacgtcggaaagctcaagccaccgagcgacatgaacattaccaatgatcgcgaataccctcgcaatccggctcctatgaacagcagccacagcgcagggaacaactggcgcactctccccgcatccgcgcagatgcctcccccacaacctccccaaccctcatcccacaagcgtcctagagcagagctcgacgacgacggatacggcggatacacccactctacacgccctggaggccccccgcagccgcaccacggataccaccaaggccaccaatacacacccatgttcggcacccaacaccaccataccccaccgcccccgccgtctttcatcccgctccacgaatcggattttcccccacagcacgatttccacccagcccaccggttgatgggcggttctcaccggcatcatgataacgaataccccggtggttctggtggtgctagtggagggggggcaggccgaggagagatattccccttcgtggagggggatgcgcgttcccatcaacaaccctcgggaagaggccccggactcgcgttagattggccagtacacagtcccgcaccgccggcagcggtacagcacggtcatcgaaatggcccacagcagcaaaaccagaatggtaatcccagctggttcgactttttatcaaacacggcctcgactcccaacacggctttatcctgggagcgtggtggtggtggtagtgggggagcaggagggggaagcaatcgaggtctcaacgacagaggcaacgatatcgcagctgtccttggtgtaggtggcaacactagtgaagagcgatatctcaggacgatggcgttgccagttggtgatgctggcggcagtagaacaccgtctctgccacctggtgatgaccacgatgggcccaagagcaggcagatggagagcatcggtcgtggctctgggaccccgaatcctgggccggggacgaatggaagtccctctgtgtcaggtacccccactatcgcacccaaagcgttgcgtgaaggggaagacagtgaagaggatcagggaaatgggaagaagatggacgtttcatgatacgattttctcgtcgattcggactggcctcgttatgtatacaattttgtgttaatttgatccgtgactctcagtaaaaaaaaaa

SEQ ID NO: 306 - DNA, 482 bp, Eucalyptus sp.
gtttctctttagcgttttgagagatccgtttttccccaaatggcatcgaattctctgacttcttcatcctggacgccgaagcagaacaagatgttcgagaaggcattggctcaatatgacaaggacactcccgacaggtggcagaagattgccaaggccgtgggtgggaaatctgcagatgaagtgaaaagacactatgaaattttaatcgaggacgtcaagcacatcgagtctggcagagttccttttcctaattacaggtcgagcaacaatagcggctgaaggttcggtgaagtctatggagttttcctgaatctttaagatgaagggtagcagtttctgatctgcatattatgtccaagaaagcaggaggctcaagaagtagacgacatagtcttgatgttctctacttgtaacgtctttgtgatttaagtaattttcgacttgaaattgagtggcccattacaagtgaatggatgaag

SEQ ID NO: 307 - DNA, 566 bp, Eucalyptus sp.
gaacagttttgacccctctttaacccctactccaagaaaatacccaacaagaaaattcctcgcgcttcaccggaatttcaatggctgactcgggtctctcttcttctcacgctgcaacgacatcagcggactttagaggggatggtagtcgagactcaaagctgccgcatttctccgaagatgaggagacccttatagccaggatgtacactctggttggtcgaaggtggtcgctgatcgccgggcggattccggggaggtcggcggaggagatcgagaagtactggacttcgagatacattcgaatggtgaacgaacagcgaaactagaagttgcgggaggaaagaattttccctccccttccaagagaaggaaattttccgggaaagtttctgggattttctgttttgtttttctctttgtggagggaaaatttttctaatgccttcgccgagcaggagggggggcggaaaccggcggttccagtactcgggtagtattttctttagttgaaagaaaaaggaaatatctcgaatgagaaggaaattttagtgtaccgtattgta

SEQ ID NO: 308 - skipped

SEQ ID NO: 309 - DNA, 1098 bp, Eucalyptus sp.
gcttgaaaggaaggatgagaaaaccttgttgtgacaagcaagacacaaacaaaggagcatggtcgaagcaagaagaccagaagctcatcgactacattcgcaagcacggcgaaggatgttggcgaactcttcctaaggctgcccgatggtcgctaattgctgggagattgcccggacggacagacaatgaagtgaagaactattggaactcacatttgaggaggaaactaattaacatgggcattgatcctaacaatcaccggctcaaccagactccacctcgccttgagagctcaaacaatgtctctgttagtgcaaattcttctggattgaagactcgtcaaagtccgcgaccaaaatcctgcggtggcgacaaagaccaggtttcagacgctggtagttgtctggaagatgagcctagcaggttgcccgacctgaatcttgacctaacaattaacattccgtctccttcgcctgcaaagattgagaaagagcaaaaaccttgttcttataagcatgacatgttaagggactcggatattgctacatcacccgctttggttctcttcagatgaccaattgggcaaaccaattaattactaggcagattagattgagcaggcccctgatgaatatttgaaaattagggcaacctagctgaggtgattcaacgacaatatatgggatggtgtctcccgatacatatcgatatctgaggtctaaatcaattagcaaggattgatatgatacatcaagcttaaattgatgaactatatacagaagcaatgggctcgagcctgtcaagagttgaatcttattgacccgctcctgtagagagttgttcaatataatctctggagtggaacgggctttgatgatgtattagaaaaggctcaggtattaagagtagattggtcggagcctgccggttgtaaatttaatcagctaaataggaaggtagatttaattctgttaacatacttgtactcgagatctgccatagacatatatatatatatgtatttatgattgaaatgtatcatgagctaatacctgaatttatatggcccttaaagtttctatctctgaaaaaaaaaa

SEQ ID NO: 310 - skipped

SEQ ID NO: 311 - DNA, 1015 bp, Eucalyptus sp.
gcagatacaggggaccccatttccctccactctgcaacatgcacaacaaatacacacatccattcttcttctaactcataatctaaatctctctctctctctctctctctctctctctctcagacagacacaaggcttcatattcagtgcttgagttggggttgccggcgcacactaagcatgccgacgacaccaacgagaagtcggtgctcgaagagagatgctaacagaggagcatggactgcagaagaagaccaaaagctagctcaagttatagaaacccatggcccgagaaggtggaagctagttgcagctaaagcaggcctcaacagatgtgggaagagttgcagattaagatggctgaattatctgagacccaatatcaagagaggcaatatctcagaccaagaagaggacttaattctcaggcttcacaaactcctaggaaacaggtggtctttaatagctggaaggctaccgggtcgtacagataatgagatcaagaactactggaactctcgtctgagcaaaaagataaagcagaaggagagtcaaagcaaattcctcgagccagatcaatctcaggacccgaggaataatccgtcggcgatgcatagcgtggcggacaacgatgggggaacatcgaagagagaggaagagatgaaaagcgacgtctctagggatgacttccttgacaacttcaacgagggtcctctcaacttggagtggatgagcaaattcttggaagtggacgagagctggttttgatttgctttaaaatgtagattttcttcttttcctcctgatttatgatgagcaatgattgggaagtccagcatttagatcctaccaccccataatggtatagtacttttcaggcagggaatgatagtttttggagggaattctggggaaattgccaggaatgtcactcttttgctgatgtaccttggcaaatcttgcatatttactcaaacttggtgtttaaaagcgtgaggttggatcaaaaaaaaaa

SEQ ID NO: 312 - DNA, 1031 bp, Eucalyptus sp.
ggaaaagagaaggcagctttcccgtataaaacccaaacccctccaaattctccccccaatttctccagccagggaagggcgagggcggcgacggcgacggcgacgatcatcccatctccgaccagctgatccttccgctccatcgtcgtcatgtacggacgggcggcggagtggagccgctacgaggacaaggtcttcgagcacgcgctggtggcggtggcggaggactcgcccgaccggtggcagctgatcgggaaccgcctgaaccggtccgcgtcgcaggtgttcgagcactaccagaggctggtggaggacattgacgcgatcgagtcggggcgggtcgagccgccgagctaccgcgacgaccacccggcgagctgcggccagattgccttcgagacgaagccccggatcaaggaggcggagaagaagaagggcaacccgtggaccgaggaggagcacaggttatttttgctcgggctgcagacctatggcaagggcgactggaggagcatctcgaggcactttgtcctcacaagaacaccgactcaggtggctagccatgctcagaagttctacatgcggcagatgagtttggggaagaaagagaggaagaggaatagcattcacgacatcaccacggtcgacacccccccagtcccggcatctgttaatgacagtttcaaccctcctcaagcgggcaatgcccaagatgatccgagttatgattatccaaaagccaacaactttcagcagatgcaaccttgtcaaccggcgcctttcatgaatcaattacttgatcaagggggagggtcgataggatacgaaaacttaagctatttcctgtgaagtgccgggatggaagttttgtatatagatgaaagccagtataaaggagtaattcattatagatttagtggaaaaggggtatatgtacattaggttttcactctttctttatctcagttcatgttgaaccatgttctgaatcactttttgagatgcagtaaatttaaaaaaaaaaaaaaaaa

SEQ ID NO: 313 - DNA, 841 bp, Eucalyptus sp.
gagatggcgaggacaccatgctgtgagaagatggggatgaagaaagggccgtggactccagaggaagaccagatcctgatctcccacatccaccagtttggtcactcaaactggcgtgcacttcctagacaagcaggtctgttaagatgtgggaagagttgcagactccggtggataaactacttgcgacccgacgtgaagcgagggaacttcaccgacgacgaaagagacaccatcattgaacttcatcaagttcttggcaacagatggtcggccatagcctcgagattgccggggcgaacggacaatgaaataaagaacttctggcacacccacctgaagaaacgggtgccacacagcctccccaactcaactcccttcaccataaaccctactcgttgcaccaccctcgatccctcattccagaagccgacctccgcgccgccgacgcagaagtttcaagaaccactgacaacgtcggagtcggagtcgggcccctcgatagcagttcgagcgaacatcgaaagcagctcacaagccgtgccgtcttctcgtgcttcccagaagctcgagaagacaaaaaaggatctcatcgcgggttcagccccggcttttccgatagcggcgggctcacagtgcggcgggcagggagttctgagcacgaagggagacaaggacatggagttctggtacagccttctggtgagagcaggagatggacatcatcaggtggggaacgccgccgggacgctatagaaaagaagcgatgggagttcaagaatgaccagcaccttatctttttttatggtcatgtgggagaagtgttttggactgtggtgtg

SEQ ID NO: 314 - DNA, 1247 bp, Eucalyptus sp.
caaagtacactccttgctatcctctctctctcacatctatatataagccagtacaatcaagaaagctagcagatatatcgttcttcagattctgtggtttctgaagagatctaaccacaccctcttcttgtgctgtggaggaaagaaaagctattgcgagttttggaacagtggtttcgagattagggtttctgatcttgttccgctgtttctaggtttttcttgtttggatcatcctcactcatctcgtgtaagagctttagctagagaggactttgatcagatgtgcaccagaggccactggaggcccaccgaagatgagaagctccgcgagctggtggaacggtacggaccccataactggaacgccatcgctgagaagctacaaggaagatcagggaagagttgtaggttgaggtggttcaatcagctggatccaagaatcaatcgaagccctttcaccgaagaggaagaagaaaagcttctggcttcccatcgtatccacggcaacaggtggtctgtcatcgcaaggctattccccggtcggaccgataatgcggtcaagaaccactggcacgtgatcatggcgaggcggagtcgagagaggtcgaggctctacgccaagagagcagcccagaccctgatggaggaaaggacgagatattcttcgccttcattggctaacaaacaacaagacgtgcagatgatgaacatgatgatgagcgctagtgctaccgcaaattaccagctcgcttcatcgtttgtcgacaacttctctggtttaggccagtgcgcttttgctcatgccggtcttccattgaccaaacaattccacactgaccatcagatttctcccgacattcctgttcgtgaagataaacttcagcctactgagttttatgattttctccaagtaaataccgactctaacaaaagtgaggtcatcgacgtcgtccatgcaagaagagacgatgaagaggtcgatcaagaagcggctaatgacagtgcagataatcaagccaagggtggtagcgttccattctttgatttcttatcggtcagaagctcttgttagcctgggtatttcgcaaaagacagcacgcgcaaattgcccgttgattaattcagaatggcttcgtagagcctcaatatcacgtagatcgcgccggccactttgatattgacagagatacggacttttaattattcaaagagatatatgaatatatagctctagctagaaaaaa

SEQ ID NO: 315 - DNA, 1072 bp, Eucalyptus sp.
caagccttcttcatcgcctcgacggcggcacacgcgcactcgctctccgccgctgctcccgcaaccagcgcccggcgagagagatggggaatccgaagcagaagtggacccaagaggaggaggaggcgctgcgcgccggcgtcgcgaagcacggcaccggcaagtggaaggacatccagcgcgaccccgagttcaacaagttcctcttctcccgctccaacatcgatctcaaggataaatggcggaatatgattggtggtgccagtggccaaggtcaaagggataaatcacgggcaaaagctaaagcgagctcagatgctccttctaccttgcccagtttgccaaatgcccctaatgttcccgtttcagatgaagcaactgcagaaccagctactgacggtgctcaaagaatcgcagatgatggaaagaatacacccaggtacaatgcaatgatatttgaagcacttcaaacattgaaagaccccaatggatcagacaccgctgcaattttcaactatatcgagaaaagacaggaggtcccacaaaattttaggaggctgttgagttcaagattaagaaggctggttgcgcaagaaaaacttgagaaggttcagaattgcttcaagataaaagagatcgcctcttttgagaccaaaacgccagcccctaaggagcaagatgtccgacctaagcagctgcagcctgttgtcaatgcaaatttccttgaaacagtagatgaggcagctgtagctgctgcatacaagatcgcggatgcagagaacaaatcctttgacgcagctgaatcagttaaggaagcagagaggatctcaaagatggctgaagatgcagatgcaatgcttcagatggctctagggatattagaaaaatgttctagggacgaaatggtgctcgtcgcataagatgatacataactcatcaaataaaccgatgacttgactttgtatgtgtagatatatagcttgctctcattctgactttgttacgaagaatcaaaccaatgttgtacccatatgctttcttaataataacattgccattgtcaaaaaaaaaa

SEQ ID NO: 316 - DNA, 1116 bp, Eucalyptus sp.
aattacacccaaccaaaccaaaagagtcataattcaggatccaccttgtttagttaagcaagaataattttcccttcccttttctctttttgagccctttagagttacatgtcttgggtagcaatgacggggaactttgggtggggctcaaactccatggaagaggcgtggaggaaaggtccctggactgctgaggaagacaagttactcattgagtatgtgaagttgcatggggaaggaagatggaactctgtagctaggctcacagggctcaagaggaatgggaagagctgtagattgaggtgggtgaattacttgaggcctgacctgaagagaggtcagataacccctcaagaagagagcgtcatcctagagctccacgctaggtggggaaacagatggtcaacaattgcaagaagcttgccagggaggacagacaatgagatcaagaactactggaggacacatttcaagaacaaggccaaggcctctcccaccaaccctgagagatcgaaagcggcgcgtctcctgcgtcgccaacaatttcatcatcatcagcaacagcagcagcagcaacatcagcaaatgcaacagcagcaacaacagcagctgccccaactgcagcagcatccgcaactgactcaggtcgacatgaagagcatctggtccctgctcgaagaaaacgaccaccacagagtcccgtatacaccccaaatccgacccgagattgcaggggcctaccctaatagctctggctatgaccagtgtttgttctactctgttttcaatgccaataatgcttcccttcctgaggcctcatcatcaacatctacagatgaggatgtgttgtgggatggcctgtggaccatggaagatgtgcatgggatcaactgcggtgctccgtatgcaacgagcaaagcctctatgcacaatctggtcgctcccttctgttaagaacctttcttgttttgctgggtcatcaattaaattactattgcagaagctctaaagctggagctttatgtctgtttttccaaactgttataaagatctgagcataactttgtgacctgtcgaaaaaatagcatcagatttttgcaaggagcaaaaaaaaaa

SEQ ID NO: 317 - DNA, 1672 bp, Eucalyptus sp.
cttctctctaaagcaaaggagcgagagaggagggggaaggggaacaataaaaatcccatcttttttcccgcgccttttgcttttcctcgtgtctgattcttcaggaatctctctctatctctctcccctcggcctccccttttttttttttttctcaactggggtctctctctctctctctctctccatcctcgtccaccaccatctccctttaatcttctggttgtgatttttcttttgggccgttttgtcctttttctctcttgggttcctgtttgttttgttttttatgctctgaggagttgcaatttgagcgtttgcttttgctgaaagggtgggcgagatcctaccttcacccctcctcactatttaactttccctgccccggcctccctcttgatcatatctctctcccttcctttctagattctgcttgattcagaaaaatttgatcttccctattagaatttgaatttgaattctcaagatcgagaataaaggggagattcttgtttccagtaagcaaccctgtggtcgtttctttataagtcgtggaaattctccgcattctctcggtggaatcccaagtctttattttggagacgaatttcgaagagtattacgaccagtggcaatggagactctgtattcaccttcctgtatgtccaattccgcttggctcagcaccagctggactaaggaagagaacaagaggttcgagagcgcgctcgcgatacacgatacggacacgccggatcggtgggataagatcgccgcgatcgttgggaagtcggttcgggacgtggcgaacaagtacagggaattggaagaggatgtgtgcgaaatcgaggccggtcgggacccgattcacgggtacttgtgctcgagtttcgcgctggagtccttcgatgaaagggatttcgatgcatgcaggaagaaatcttcggctggccgcggagccgatcacgaaagaaagaagggagtgccttggacgcaggaggagcacaggcggttcctgatggggctcctcaagtacggcaaaggggactggagaaacatctcgcggaactttgtggtgtcaaagacacccactcaagtcgcaagccatgctcagaagtacttcatgagacaggtttctggtgtgaaagacaagaggagaccaagtatacacgacataactacagttaatctcacagacccggcttcatcttccgagaataatagggtttcctctttggatcaactcaatgcactttcctcacagcagaagctcatcggtgcaccagagctggcccttgaccatagtctccctaactatggaggatttatgttttttgactcgagccatgggcatctattgatgccagatgcgtatgggtttggtctgaatggaaagagatggcaggaaaaggataatccggacggtgtttatccaggtgcagggttccgcagttcattgattggaattcactcttcaagacaccaaattcagggatgacaggatcaaatgttatgactagtgatcttgtgtacatttagagcttgttgcttatgtgatatttaagtactcatgaatgaaaagaacaaaaaaatgttgatgtatgtctctctgggtttgtaactgtggaataaaaggagagatttgacttaaaaaaaaaaaaaaaaaaaaaaa

SEQ ID NO: 318 - DNA, 1262 bp, Eucalyptus sp.
ctccgccctctccccccgcgacgacccggacggccagtccagattccctcgccgtcgccgccgtgaaacgccggagcgcacggcgcacggacccgacggacgccgtcctccgccaccgtcgccgaggttgagagccatgtcgagcgacgcgcgcgccgcctccggcgccaccgccgccggcgccggggagttcatgctgttcggggtcagggtggtggtggtggaccccatgaggaagagcgtgagcctgaacaacctgtcggagtacgagcagccccaggacgcggcccccggcggcggcggcgtcggcaaggacgacgcgggagcggccgcctccggctacgcgtccgccgacgaagccgtcgcgcacggctcgaaaggcggggccggccgcgagcgcaagcgaggagtcccgtggacggaggatgaacaccggctgttcctgctcggactgcagaaagtaggaaagggcgattggagaggcatttcgaagaactttgtgaagactcggacgccgacccaggtcgcgagtcatgcccagaaatactttctccgccggagcaacctcaatcgccgtcgccgccggactagcctgttcgatatcaccaccgatacggtcactgctggtacaatgatggaggagcaagctcctccagtggatgttgcgactgagtcataccctgcaccaccaacaccaacagtgcccttggaatccagcaacatctcgggtttctcaatgatgccaccgacagtacacgttgtgctaccagttccagcagagaatcctgtggaaaatctgagctttggaccagggggccaattcgacaactctccagcgaagctagtgcgcccggtccccattcttccagctccagctgtccacgatctcaacttgtctctggcctcgccttcggaccaaagcgagccatcgagaagaccctcggctttccagatgaccccgagcttcggcaagggggacaacatgatcagcgtcgcatgagagcttccggggggggcctcacaaaaggttaatctatatagcctcgtgaagaaaacttaggttaggggaaagatagggtcgtcgctgatctgtacagacaacggaaaagatgggatgatcgtgtcttttgtcgtgccgtcgatgctattcttctgtgcctcattagattcttgggtcattttgtccgtcttgtcctttgtatctgtgagctcaaaaactgaactaacgaaacctctctctccgtttcaaaaaaaaaaaaaaa

SEQ ID NO: 319 - DNA, 1431 bp, Eucalyptus sp.
tttcagagtcatgtttttgttatatcaactccacctacagttgttactggctcgttaaaccaaatacatacccgtctgaatcctacaggctgttttcgactaactgtagtccgtcaatcaacgatctgttctggtagctgacgcagcttaagctatatgaccgtggacgaaacgactagcgactgctcctggagtagagagcaggataaagcgtttgagaatgcactcgcaacttacccagaagattcagctgatcgatgggagaagatagccgccgatgtgccggggaaaactgtagaagagattaaaagtcactatgaaattctggtcgatgatgtcaatagcatcgagtcgggttgtgtggaactgcctccttacagttgttctccagagggttcaacaagccatggcggcgatgagatgaatagtaagaagggcagtcatgttgggaatctccatggcaatttgaatcacgaggggaaggcatcgaggtcggaccaagaacgtcggaagggaattgcctggacggaagaagaacacagattattcctacttggcttggaaaaatatggaaagggagattggcgaagcatctcccgaaactttgtagtgacaaggacacctacacaagtggctagccacgcccagaagtacttcatccggttgaactcaatgaacaaagataggaggcgttctagcattcacgatattaccagtgttgacaacggagaagtctcgacaccccaaggaccaatcactggtcaaacaagcagttctgtggcaggtgtttcgtccagcaaacctagtaaacagccctttcaaccaccaactgggcccgccagtatcggtgtttatggtgctccaatgatcgggcaaccgataggtgggccgcttgtttctgctgtggggactccagtgaacctccccggtccatcacatatggcatacggtgtagccccggtgccaggggccatggttcctggtgcacccatgagcgtaggtcacgtaacatatccgatgccgcatgcatcagctcagaggtgattgtataggagatgtaaatgaaagactgaaaggcatattggttgtgctttgtgatgtaccaaggatcactccgtagagtcctctgtgggtctattgtctcgattctttggtggccttcttttggccttgcgtctattttctgatagtctcttctatgcttaagagtagtgcttgtaagatgagagtatattatgcttagaaattcaaaccaattagaattttacgattgttagcggatcttcagagtgctgatgattcttacttgaaattctagtgtcaatgtcatgtaattccgatatgaccaatttgctatgtcagtctgcaaccatgagaaaactttcctatggaagctagttgggaacgttagcccctaaaacaaaaaaaaaa

SEQ ID NO: 320 - DNA, 1239 bp, Eucalyptus sp.
atcgcccccgttctctccctctctctccctctcccccctaacgtttctggccctcttctttgtctggacaaaaagatgggaagaaagtgctctcgctgtgggaacataggccataactcaaggacttgcacaactttcatgggggcagcaagtgcttgtgggctcaagctcttcggtgttcaacttgacctatcttcttcttctcctccttcatcatcagcatctagtggttctgctcatccttattcacttgtcataaagaagagcctcagcatggatcgtctgtcttcttcctcggcctcctcctcgtctccatcttcatccctctcctcgccaagagttcttgctgatgaacactgcaataagacctccctcggatatctctctgatggcctcgccgctagatcccaggagaaaaggaaaggagttccgtggacggaagaagagcatcggacattcttaatggggctagagaagatggggaaaggcgattggagaggcatctccaggaactatgtgaccacgagaaccccaacccaagttgcgagtcatgcgcaaaaattctttctccggcaggccagtcttaataagaagaagcggcggtccagcctcttcgacatgatgggaagatgttctacttttcgcgagcaaagcgaaccaccacgcttgatcagaacagagagctctcttcgatatgaagtggtgcctcttcttgcaatgagcaccttcaagcctggtgatgaagagagtgatcgtgagccacatgattcaatttcaagacctccttcgctctgtgatttggccaatcccttggagctgaaaccatcaccagtaaaccccataaagaatccatcactgtctcatgcagcacctgacctagagctcacactggctgctccaatgccattggaccaaaatgaaacctcaccttcctctcttttcgttggatccattagtgtgacctaacctaacaaacaacatgcataaattattcctggaaatatgcatgtgctgtctctgatctctcatctctctcgagtctcattggatcaagaatatcagatgtgcaaatgtttctcatgctacgaatacttcgtttttgctcttttcttgatgatagaggatgttattagtggagaagcagagatctagagggtgatcagcactgtctttgaacgtttgattggatcttgcgtccatgactttccaagacatgagttttgtagtccaaaaaaaaaa

SEQ ID NO: 321 - DNA, 1389 bp, Eucalyptus sp.
gcagggggtgaagaggagtagagagaagagaggggaaatctgcatcgtcatcttcttcctttttatcctccatctgcttcgctccgagaagcgcgcacactctgcacaggccctcacctggaaatacagacgggcaggcaggcgacccaaatgaggaatccgtcgtcgtcgtcgggagggacgaagaccccgtgctgcagcaaggtggggctgaagagggggccctggacgccggaggaggacgagctcctcgccggctacatcaaccgcgagggcgagggccggtggcggaccctccccaagcgggccggcctcctccgctgcggcaagagctgccgcctccgctggatgaactacctccgcccctccgtcaagcgcggccagatcgcccccgacgaggaggacctcatcctccgcctccaccgcctcctcggcaaccggtggtctttgatagctgggagaatcccaggacggactgacaatgagatcaagaactactggaacactcaccttagcaagaagctcatcagtcaaggaattgatccgaggacgcacaagccgctcaatccagaaacccagaactccagcagcaatcctccagcgaaacctcctccttccaaagcggcacctcgccctcgaagccctaaccctagccccatctcttctggcctcgaggaaaccagcagtggcagcccagccatcctcaaagaaaatgatcagatccaaagtgccgataatacggaggctgtgtatcaaaatgggactgcgacagctcacggtggtgaagccagttatttgccgggtacccagcattaccatgtgatgggcttgagaagcagccacggactgtctaatgaggaggaggaggacctcaactgctgcggggacgacgtcttctcatcgttcctgaactccctgatcaacgaggaagcattcccaatccagcaccagctacaacaacaggccgtcggctcctcgccggattcggattctctgattcccatggctgcagcacctgcattcgggatagccgctggctgggactcttagcaagcatccacacttgtgcaaggtttgcccaattgaactccatcttcaagagcgtagagttgaaccgtttagcttcccctcggtgtctcgcccattcgtatggaccctgcgtgagaaagccgcattcgagcaaaaccatgcagaaatccgccatcattggagctcccctctttccgcaggcggcgaggcattcgggggggttcgggaaaaacatgatgacgcaatgatcaccgccgagatggggtccggagcaaaagcgaaaagaggaaaaggaacagaaagatttgcagggccaagaaatgatcgagcgaagagaacagagagaagatagatatcttc

SEQ ID NO: 322 - DNA, 2067 bp, Eucalyptus sp.
ccgattttccctccattgtcggttcatccttggacgctcgttcactctctctcttctcccgctgtgaatttttttttttaactctcagtcaaaatctttccacaggagctttaattgatggcggaggtcgcgcctttactgcgtcacggatatttatgggttgcagagatattttttttgggccacgccaacgccatcgactgaaagccgaccttccttcttcttcctgctcttctgcgctttttgccttttcaattcgtcaataggtcggccgaaagcccaacgacgaaggaaaaagggcgaggagcttttgccgtcgactcggctcgactcgcgcaagcgtccaatttcccgaatttcggagcggatccctatgattccagcagattcagcgggaattcagaaaatcccttcgcctcgctaattgggttttcttcattcacgctaaagaggaaaaggggaggaaaaaaatcgagtcttttgtccgggcttgcttgtcggcttctccccccacttcctgctcataatttcgcggcgtccctgcaacttgcggaccgcagcggtagttgggcatttagcggattcgaatcccgagggggtttcggggataaagacgctgtcttggagtttgatattgggggggaatcaaattggggttggttcgatagctccgtagatctgctgtcgagtttcatttggtcgcgctgctgagtcgcgtgaagtcgttcggagttgggaagggtgtgtgggttttgctttgatgactgtcgatgaagcagtgagccctagttgttcctcgtggagtaaggaacaggacaaggcgttcgagaatgccctggctacccacttcgaggtttccccggattggtgggagaaggtagcgtccgacgtgcccggcaaaaccctagaggagattaagctccactacgaggacctggtggaagatgtcaataggatagaggctggccgcgtgcctctgccgtcctacagttcggcttgctcggatggctccgccagtaacttaggggaggaggagagcaggaagaagggcggcggcggtagcggcgagtcaaaccagggagggaaaggctcgaggtcggatcaggagagaaggaaggggattgcttggaccgaggaagaacacaggttatttcttctaggcctagataaatatgggaaaggcgattggcgaagtatttcccggaactttgtcgtcacaaggacgcctacgcaagttgcgagccatgcacagaagtattttatccgtctgagctctgttaacaaagataggaggcgatctagcattcatgatatcactaccgtaggcagtggagacctttcagcacctcaaggccctattacaggtcaaaatcaaacagatggctctgcgggaggagtgtcttctggcaaatctaacaaacaatctcctcaatctccagcagtgacgtcaggtgttgcagtttcaggtcctcctccatcaattggacaaccggtgggtggcccttttgtctctgctgttggtactccagtaaatctctctactgcgccacacatggcatatggtgttagaggtcaagtacaaggcacagtggttcctggtgcgccaatcaatatgggctccgtgacttatccaatgccacatgcatcggcacacaggtgatgcagcttaagctggacaatatcagactggctgaggttctctgctttcgctcctgttggatgatggaatgtgatctgataataggatggtttggtgcaaagacaactattatttctgttgctttcaaataagttgtggtgggaggaataacatcaatctctagcggcatggcaaagatgtggcatttcagggcgtcaaagtgtactgtcgttcgtttgtttagacccacactgtggtactagaagtagttcatgaaaggttcttttcagcagtgtcatttgtaaagaagtgtttgggttgtagcgattagcattatcaagcgaattcatggcaatgcattttgaattatgatctgcttgctcttgccttgggaaatttgatgtactgtggtggatttcgcctcaaag

SEQ ID NO: 323 - DNA, 1000 bp, Eucalyptus sp.
cagagagagagagagaggagagagagagagagaagagagagagagagagagagacgggggagagggagaggaaggatgggcaggagtccatgttgctccaaggaagggatgaacagaggagcgtggactgtcatggaagacaagatccttacttcctacatcaaagcccatggcgaaggcaaatggaggaacctccccaaacgagctggtttgaagaggtgtggcaagagttgtagactgagatggctcaattatctcagaccagacatcaagagaggtaacatctctcttgatgaagaagaactcatcatcaggctccataagcttcttggtaacaggtggtctttaatagccggaaggctcccggggcgaacagacaatgaaatcaagaactactggaacacaaccctcggcaagaaactcgccaaaactgatcgctcatcttcctccccaccatcattaaaagacatcaatcatccctcatccaaatccagatccaagagaccagtctccaagtcgagctgcttgttccccacgaaagcgactcggccccgagtcaccagatacaagcccctggagggcaccaaggtccacgcctcaccaggctcctcacttccaagcaaaaaccaatccctctactcaataacccaagaatatccaccgtatcttcaagccaattaccgcccaagtgggagcacatgtcaacaggggctagactcagaaagtccgagatctcatcgtgttcactgtggcgctcatgatgaccgccttcagaagaactttgttggagactttgggcttatcaactttggctatggtgatgagtttaacgcggccaatgttatgtgcgctgaccagcccttgaccgtggaacaagaaatgttggagaactggacagcaagtttttgtgtagaagaaaaagacaccttggatcttgattccttggcatatctgctgaattccgaggaatggccgtgaagaggagcattgaaaaaaaaaa

SEQ ID NO: 324 - DNA, 1496 bp, Eucalyptus sp.
cgagagctttaaatctccgcagcagcagcggcggcgacccccaaatcgcatgtggcggaaccctaatttgcgagacgatcttttgggtaaatttgtaattgctccttctgatgggggcaccgaagcaaaaatggacggcagaagaggaagcggcattgaaagctggggttataaagcatggggctggaaaatggcgtacaattctcaaggaccctgagtttagcagcgtcttgtatctgcgctcgaatgtcgacctgaaggacaagtggagaaacatgagcgtgatggctaatggttggggttcacgagacaaggctaagctgactgttaaaagagtgcaccatgtgcctagacaggaagagagctctgcagctgctaggaacgctgtccaaagtgatgaggaaatggtggatatgaaagatctttcaatttctggtgatgctctgcacattgatggtccaaagcgatctattgttaggttggaaaacctcatcattgatgccataaacagtctgaaggagcccagtggttctaataaaacagcaattgctacattcattgaggagcaatattgggcacctccaaatttcaagaggctgctgtcagcaaaactaaagtacttgatgtcaattggcaaattggttaaggtgaaacgcaagtataggattgctcctggacctggctctcttgctagaagaaggacctcttcgatgtttctgtctgatggatggaagcttccaccaaaagtggatagaaatgatgacgatgatgatgtgcttactgcggcccaggttgacttggagttggccaagatgaggactatgactccagaggaagctgctgcagcagctgctcgagcagttgctgaggcagaagctgccattgccgctgctgaggaggcagctaaggaggctgaagctgctgaagctgatgcagaagcagcacaagcttttgcagaagcagcgatgaaaacaatgaaaggaagaaatgtgccaaaagtgatgattcgagtatgacagcatctctgtcaagtgcagataggagctaggtgttttgagttttcctagacgagagctcatgttttgatagtctgctggtatctcgtatcatttgtaaatatgtcagagacaattctctcccctgttgatgctgttgacaagtcttcttcatgcgttgctgtattgagccgctgcatattgcactgttggaggttcggactgattggatgatagatctcatggtgcagaagtttagacagctgatatctgcagaaagttttcgactgttcttttcatttgcagtttagtcgaaagggatagattgattggagtgctctaatttatttttgagagcagcagggtgtacattttcttaactctaggcgcagttacattcgacggatttttgtgccttctcattttgaacgtgctcttttcagattcttttaaatggtgtatcccagactttaggctgtagtttttcagctaaaaaaaaaa

SEQ ID NO: 325 - skipped

SEQ ID NO: 326 - DNA, 2106 bp, Eucalyptus sp.
gccaatcacgactcaccaccttcagcttcagcattaccctctctccttctccctctccccttctcccccacagatattggcagagctttcagattcaacccctgaagcttagcggaagcctctggtttttcagctcggtgttggagttttgacatccatccctggtctctttcttctcttttccttgttgctcagtcctcaagggaaaggaagaaagaaacccatcatttcccccccctccttctctctctctctctctctctctctctctctctctctatcgtgttatcttctcgtttcgcatgaattcagaggaccctcgccgcgaggctctctggctttcgctctccgagctttcccttttgctgcaagtgagttcgtgagttcgttgacgtctgatagggccgctctgcatagttttttctcggtttcgttttcgtttcagggtctctgcttctcgcttcttctttttttgatacgttgcattcttgtttctagttgcgttgggtggtttgttgggtttagatctcgagggtcgtcgcaattcatgttggtgttttcggatcatactgtgatttgttgcttatgttttgtgaggcttgcctttgttatattgggataaaaagtcggttctttatgggattcctaaggctatggttgcacagaggaaaaggagtattctgattcctttcaagatgcttggcgatttaacacggacatctttgtggtgaacccaaagctctccgcatttcccattcgagcgccccctttactttgttctctctctccccctctctctctcgccatcgaaatcgaagagccgcctctctctctctctctctctcttttccaagaagatcgagaatttggtcacccttcagcatctgacttaagtttagtctgaaggaggggtcgcgtgattcccatgtgatgaagtgggaaacgggagttcccttaccaccatgtgcatcgagtgcgaattggtttttcaacgaggagggaaggaccgcgaaatggacccctgccgagaacaaaatgttcgaaaaagcgctggcggtgcacgatcaggacacgccggatcggtgggatagggtcgcctcgatgatccctgggaagacggtggaggatgtggttaagcactatcaggatttggaagttgatgtgagcaatatagaagcagggctcatcccgatccctggctatagcactacagcgcccttcacattggagtgggcgaatggccatggatatgatgggttcaaacagtcttatgggcttggtgggaagagatcatcatcgattcggcctcccgaacaagagagaaagaaaggggttccttggaccgaggaagagcacaagctctttttgatgggtctaaaaaaatatgggaaaggtgattggagaaacatctccaggaacttcgtgatcacgagaacaccgacgcaagtagctagccacgcacagaaatacttcatcagacaactttcaggtggaaaagataagagaagggccagcatccacgatatcacaactgtgaatctcacagagactagaactccttcaccagatgataaaaggccgccttcgccagatccttcatccatggtggctcggcatccaactcccgtcacagcacccaggactccttttctctggaatcagcctagcaatggagggtccatgaccttccatgcgacacaaggggatatgtccatgtgcccacatttcggtgtgaactcttttgggcttaaattccaagggcagaatactcacagagggactttcattcagaacccggtttttcatatgcaagctggacagagttatcctcatggatgaggctgcttcatccctgttttccttagctccaagcatcttttgtttctatcttttgaagtttagtggagtagctatggttgtgcttttgtcatggcttctgtgaatatgtctactagaagaatttgagttagttcagcagtatctaaacccaggacacaggagaacaagatcgtgtttcttttggaagccataaatctagtgtatagattctcagagctggatttttttcctttagtgagaatctccaccttcgtttgaaaaaaaaaa

SEQ ID NO: 327 - DNA, 1674 bp, Eucalyptus sp.
agcacacccaacttcaagattcataagagtcctagagtttctctctgtgtgtgtgagagagagagagagagagagagagagagactaagtgcactagcacacccaacttcaagattcataagagtcctagagtttctctctgtgtgtgtgagagagagagagagagagagagagagagagagagggagagagggaatggggaggagcccatgctgtgcgaaggaaggaatgaacagaggagcgtggacggcgatggaggacaagatcctgaccgattacatcaaagcgaacggcgacggcaaatggagaaaccttcccaagaaagcaggtctgaggagatgcgggaagagttgcaggctgaggtggttgaattatctgaggcccgacataaagagagggaacatcactcttgacgaagaagagctcataatccggcttcacaatctcctaggaaacagatggtcgttgatcgcggggaggcttccgggacggacggacaacgaaatcaagaattactggaacaccaccatcggaaggaaactccaatccagctcgagcaactcgggcttcgtttccagtcgcccgtcgttgtcttcattccaaggaagccccaagtcggccctcgaaaaactgaccattgacgacactctcatgcccgttgagccgcgcgtatctcacgccaaggcaccggcatgcccgaaagcgcttctctctcccgcatcctgtcaagatagagaagcacaagcacccgacatggtggacgacaaagatcaaagctctgaccgctatgaagatcaagtcacgacagttcgggcatctgacggaaattcaaatgtttcatgcaatttcatggcggatttcgagctggacgccaatttcctggaagctttcttggagtctgaactcgccaccgatactcagcagtcgtgtttcgttaatagcggattagatgatagtcacaagagagagttgccgccattgaaatcgtcacgggactctcaagaaaccttagcattcattgatcctggagagacgatcctgagcgaaccagatttgcaatgcatggcatctttactcgaggacgagattgatggcttcaacacgactagctaaagagctctaggagttgactacgtaaacatcctgacctactgtgcgaataatgtatgattagcactcttcttccagttcttgtctggtgaatgaatatcgggaagttcttaatgaagctcggcgaggggaaaaactcgatgagcatccatcgtgcattgcgctagcgcaaccgctagacccgatcgatcgacaacgagtccggctgagctcgatcaaaccggggggcgactggaaaacactaggacggacgaccgggccgggctcgacgtcggacctcaatcattaatgcatggttggacccgttgggtctgggttgaagagggaggggaccgtcgtttgcctggtgtcagccatcttgcggtggtgatgacgaaatttctcaatcgggtcccactcgattgtccacgtctgcacgacaaagtcaatcaatggcaacgtaccacgccattgcggggactgccacactttcatacgaggtcattttgatcgtgggtcccatgtcattaaaaaaagtacgaattcttactatttatcgattttctttttctctcaaaaaaaaaa

SEQ ID NO: 328 - DNA, 1307 bp, Eucalyptus sp.
gcttcagagagagggagagagaaagagggagtgcgaaagcttttaacaaaattaaagttagcaagtatatttaacatgggtcaccactcatgctgcaaccagcaaaaggtgaagagagggctttggtctcctgaggaagacgagaagctcatcagatacatcaccactcatggctatggctgttggagcgaagtccctgagaaagctgggcttcaaagatgtgggaagagttgtaggttgaggtggataaattatttgaggcccgacatcaggagaggcaggttcactcctgaggaggagaagttgatcatcagcctccatggggtcgtaggcaacagatgggctcatattgcgagccacttgcctgggagaacagacaacgagataaaaaattactggaattcatggatcaagaagaaaattcgaaagccttccccagcttctctgacaaatgttcctcccagtacgtcttccgagcactcccttttgagcaacagctcaaatcaactcagctgcgcaatgccggatttaatggcagcgaagatgcccgtacaggaaaccctattttcttccccttgccctttatttatgttcgatactgcctcgctcgaagggcttgcagagagtaacgaacaacaagagcttttcactgaagcagtcacggtgaattccgccggcacctggaacttaaatcaccagcaattccacaccacacttctgccacctcccccgccttatacaagtggaagcgcggatgctaattatttgccaccattgatagaaaatgtagagaacatgttgaatatcggagcacaatctagtaacatcgatgaggaaggagatcgaatagccctagaatgctttcagaggcaggagttgaacgaatgggtcgaatcccaccagtgcccaaattttctcttgtgggataatgtggaagggcctttcggcggagaagacattgtgccggcttcatcaactgcaggagcttctactatgtcttccttcccttcatctctctaatctctctctctctctctctctctctctctctctctctctctctctctctctctgacgaagagttcccgaaaatgatgcttgaggcttgaattgagtttggcttttgacttttggttattcattttcttcatttctttcatgtttgttcaactgaactgaagacgaatgtttatgtaacttgtgattgatgaggaaggcatgccacaaatgcatgcgatgttttggacaatgaaaacagagaagaataaaagcaacgcaacagcggcggtttgacctaaaaaaaaaaa

SEQ ID NO: 329 - DNA, 2038 bp, Eucalyptus sp.
ctcaattctgttctctcctttaggcaccctcgcaggagcttgctcaattgagaggttgatagctagatcctcctcaagggaggtcgcattcttgtgttcacctctggggggtttagctctctcagttcttggcttttgcttttgagtctcaataagcttcaaaaagaaagaaaagagagaaaaaaaaaaagtgagggagcacaatacttttctcactttacttcaatccctacataatcacacccttttcctcgctgtttctttctctctgctgggtcctctctgttttcttgattttctctccactggtttttttctcagaacttttgagttttctgtccagaaggacgtcgtctgctgaactttgctttggaagcttcaagttttgaaattggcatcacattttgaatccacctcgcgaaatctgatatgggtttcgctttcttgcatgattctcgtgcctactgcgctctttggatctgatagggaagtctagggttgatatcaatagtcaaaacagaggcgtcgctttttcttttttttccttttgtttctggaatttcccttgggttttggaaagttggctcttttctagattctcaaatttatgcttaacagcgaaaggggaccttagattccctttcaaaatgctcctttgatttcccatcttccttttcctcttaaaagcttcccctgtgcttctctccttgcattaaccaatatctgtttctccctctttgaactttctaaatgagggaatcggtattggtctgcgacattgagtagccttgtgcacctcaatttcctgctttcccgatgcttttggcttcacgcgagatgaatcggggaatcgaaatactatcaccgtacctccagaattcgaactggttgttccaggagagcaaggggacgaaatggacccccgaggagaacaagcggttcgagaacttgttggcggtgtacgataaagacacaccggataggtgggcgaaagtggcggcttcgatccccgggaagacggtgggcgacgtgatgaagcagtatagggaattggaggaagatgtgagcgatatcgaagccgggcttattccgattccgggatatggaggcaactccttcacattggagtggatcaatagtaacaatggttctgatgggttgaagcaattgtacagtaccgttggaaagagaggcacttcaacaaaaccctctgatcaggagagaaagaaaggtgttccgtggactgaagaagagcacaggcaatttttgatgggtcttaagaagtacgggaaaggggattggagaaatatctcgcgctacttcgtgactagtaggactccgacgcaggtcgccagtcatgcccaaaaatacttcatcagacagggtacaggaggcaaggacaagcggagatccagcattcatgacatcacaacggttcatctcccagatagtgacccgccttcaccagtcaaaaggcaatccgcctcacctgacaattcttccacgatcacgaagctaccagtgcaagcacagccacatgatcatcatccaaagattgaagagatgagcacagatatcttgtgctggaacaaccagtcgaacggagggttagcgacggcatatgaccaagtaggcgttgatgctgccttaggaccatttcgtgggatttcttcctacgggaacaagttgcacgagcagagattcctcatgagtggacttcacggtgcccagttcgatccttatttccagatgcagcctatgcactatcagtgaaagtgcctcagtggtatttttgcaaaaatttgtggaggttaatggatgtatggggatcattcagcaacacctggtctctaatccaagagtgctgtgtctttaaggggtttatgtgtgaatacatttgatgagaaggtcttaagttctaggtcatagtgaggggagaatgtccgaaaaaagcatttagttcccattgccatctgatgatgtccagattctgaacccacttgaatataactggatgcttatttcctcaaaaaaaaaa

SEQ ID NO: 330 - DNA, 1219 bp, Eucalyptus sp.
ggtcacacctgacccttcgacccctcctctcctctcctccctcactctccctcttatctcctccctcctctcctccgggtacatgcaagaattcgagggggagagagggagagagcgtgctttgaacatggggaggagcccgaggtgcgacaaggacgggctcaacaaaggagcgtggacggccgcggaggaccagatcctgatggactacgtcaagctccacggcgagggcaaatggagccggctctccagggaaaccggtctaagaagatgcggcaagagctgcaggctgcgttggatgaattacctgaggcccgacatcaagagagggaacatctcgcccgacgaagaagaactaatcatccggcttcacaagctattgggcaacaggtggtcgttgattgctggaaggcttccggggcgtacggacaatgagataaagaactattggaacaccaacttggccaagaagcccgaagcattgaggtcgatccaattccaccatttgcacagagagccgatggtcgaacctcccgcgacgtcgcagcaagagctggaacagcagagggtgccggaaagcaacattcgtggagttgccaatccagagccacaagttgctcaacggaatgctgctaatggggaaatgcgatcatccccagatggcaattacttgctgaagcaaatgctttcagactcggatatgagcgacgggtcgttgtcattcaactcggaggaggaatcgccggacttcatgatcgatttcaacgtggacgacattagccagttcctcgactcggatttctacaagctcggtccggaccaaaacggctattcccatgacggggagcgaggcagcaagtgcccgccctatttgaaccagcaactcgtgccgccggaggaagccgggaaggatctggacaacagcctacgcatccgagatgattcggtctcggcgttccagtcactggcgtcgttattcgaatccgacgacgagaagtggacggggggcggtgataaggccgactttgcattgcctggaaagaacggttgattttgcctatagcagagagagctgcgtgtagtcttggagaagttggtcacgacaataatcaatcgatcgtgatcttgaagattcatttcatccctagggtttaagaagttccgtgtcactctcttgagataaaataattctgtaatcatcattgctgcaaaaaaaaaa

SEQ ID NO: 331 - DNA, 1234 bp, Eucalyptus sp.
ccggtccgggcggtggagagcatcagccttggagttacagaccaggaaaatacaagatgggtagatctccttgctgctccaaagaggggctcaaccgcggggcctggaccaaaagggaggatatgattctctccgaatacgttcgaattcatggcgatggtggatggagaaatcttccggaaaaagcaggtcttaagagatgtggaaagagttgcagactacgctggttgaactatcttcgtcccgatattaaacgcggaaacatttgccccgccgaggaggagcttattattcggctgcatcgccttcttggcaatcggtggtcactgatagcaggacgactgcctggtcgaacagacaacgaaatcaagaactactggaacactcatctgagcaagaagctgtcaagccaggaatctcaagacaagacttcgaaaaatctcagtacaagctcaaaatctcccgttcctgtccaaaatcgcgtgttcaaggccactgcagtgaaaataacaactgcggtgagacactgtgaaataataagaccaaacgcctgtaacggtgatggctgcagtaattttataccaggtgaagccttgcaattgtgtaatgttgaaaacacgacaaaatcctcatcgtgcggcctacttgtgaacgattccactacaagcaaacaaccagagcgcaatgcttttgcaacgaccgataacctcgtgcagacagaagctacaaactgtacctcctctatgttaaattttggggaccagcaatctccttattctgattattttgaaggagatgcagctaatttagccgagagtttattgtttttgaccgacctatcttctccagactgcaatctgctcgcttccgcgtctgactgttcaacagactttgcatcggaagatctctacaggggacccgctgcattgcctgaagagacaaatgggtttgaagatatgtgttctgatcaaaacaatatgcagcgcgttaatagttctagtatggatcaagaactggaagaattttacaataacgcacaggacgaagactggatccatgagcttgactgcttagagaactcaggcgcacagccactgagctctctactgttggaatccgaaaatgaatgggaggaaaggtctataggcaaacttgccctggaagaccatgtacaaatataattggtacttcttcattaggaaggtaataaaagaatgttcaaataaaaaaaaaa

SEQ ID NO: 332 - DNA, 1287 bp, Eucalyptus sp.
gaaagaaagaaaagaacgatatagctggaatcaacaatgaggaagccaagtgagacaatgggaatggcaatggggattaaagagaaagcaagcagcaaccctcataatcacaagctgaggaaagggttgtggtcaccagaagaagatgagaagctgatgaggtacatgttgaccaatgggcaagggtgttggagcgacattgctcggaatgccggcttacagagatgtggcaagagttgtcgtctccgatggattaattacttgaggcccgacctcaagcgtggtgccttctctccgcaagaggaagagctcattgtccatttgcacaacattctcggcaacagatggtcccagattgcagcacgtcttcctggaagaactgataacgaaataaagaatttttggaactctactctgaagaagagattaaagatgaactctgctacatcttcgtcaaacgagagcgatttatccaatccacaagacatagctgcaggtattatgcccagttttcatgcacaatatgacgtcttagctacatgcatggactcgtctcccgcaccgttccccccgatggacaatatatctgcgccaaaccagttcgatccattccccacactcaacaaccgctgtgacacatgggaaggagtcgggtttttcaccttcccctcaggcattgcaccggtcagtatgggagatgattcaagttatttgaatttggagcatgcaaaagtgggacttttaggaagcgagttttctgttcccccactagctagtagcacaaccaccaccgaggagaataattacagatccataggttgcggcatggatgggaaaggggagaacagcttctccaataacaatgatagttgcttcagcaatactactactgccagttttaaagcggaggacgacatgtctgggtttgggaataatttgcaagcggctaacttgagaatcggggaatgggacctggagggtctgatggatgatttgccctccttcccttttcttgatttctaactcccattttccatttttttcccaccccggaagctaaaaccgcccccctctctctctttctctctctatctctatctctatctcgacctacccatcaattttccttttacagaataatgtaagaacaacacacacatactagagaagtttctgtttatactgcatgtttcataaaataagtctctcagcggatggagattctgtacaatgatctctcggatattggagataacagcaacggaagcttgaattgcaaaaaaaaaa

SEQ ID NO: 333 - DNA, 1382 bp, Eucalyptus sp.
ccaaacatccatccgtccatcagctctaaactttaattgtaatcacatcgtcctttctcgacaccaactgggtcaaatgcttaaaaaaaggaaaaggaaaagagaaagatgacgtttccttccttcctctccaccaccgctctcttctatttatctcctctctctctttcttcctccatgagcggtgctcttcaggttggatgcgccacttcaactcaacctcaatacataaacgtcgtgttgggaaaaggataaaggcagggagaaggagatggggaggtcaccgtgttgcgagagcgagcacatgaacaaaggggcatggagcaaggaggaggacgagcgcctcatcgcctacatcaagcgccacggcgaaggctgctggcgatcccttccaaaagcagccggcctgctgcgctgcggcaagagctgtcgcttgaggtggatcaactacttgaggccagatttgaagcgcggtaacttctccgacgaagaagacgagctcattatcaccctccacagcctcctcggcaacaagtggtcgctgatagcggcacggttgccgggaaggacagacaacgagattaagaactactggaacacccacatcaagagaaagcttcacgcacgcgggatcgatccccaaacccaccgtcctctcgactacaccagcactgctggtgctggtgctgctgccgctcacactatctgttctaacgctaacaacagcggcgacaaggccacgcctcactcgacgacttgtgaagaattatcatcatcatcaacaccaccgccgctccgtgcagccaagaaaagattgaattcattagccagcgcggtggttacagtgcgagaagaagaagaatcaacgaacaacagcatgagcagtgacgtaacgaccaccaccaccaccgcggaggaagtgcaagtgcaactcatcaataacaagaacggcataaatatggatgaagacggagatgccaatgcagacctcgacctttcactttgcctctccgttcaccgccccaagactatcatcagaaacaacagcactagcagcacggcaagtactgaattactaaggagtcctccgcctcaaccagctcatgggcatcgtgaggttttcctgagtctagggtttcatcccgacgcccgacatgcctgcagcggcaccagctgcagtgcacccacagctacaacacttgacttgttaagcgacccctcttcgcaccccatctctggagcctcttcttactggttttgatgttaatgtattctagtcttagactatggctaattatggctaattacggtccccctctcttcaaaccctcgaaaccactttttatgggagagataccacagcttagttctcaaaaaaaaaa

SEQ ID NO: 334 - DNA, 1404 bp, Eucalyptus sp.
ccccattttcccgtttctcccatattcctcaagcactctcatttagggaatgagtgcttagaagccacctcaagtttcaaatttttttcctgcgcagttctcaattcaaatggcacgtagctcatgtaatcagaaactgaggaaaggtttatggtcgcctgaagaagacgagaaactgttcaattatataagtagacatgggttgggatgctggagttcggttccgaagctagctggtttgcagagatgtggaaagagttgcagattgaggtggatcaactatttaaggcctgacctcaagagaggcatgttttcacagcaagaggaggatctcatcatcacgcttcatgcagcactaggaaacaggtgggcacaaattgccacgcaattgcccggacgaactgataatgagataaagaacttctggaactcgtatgtgaggaagaagttgacgaaacaaggtattgaccccgttacccacaagccacttagagaattaaacagcatgtctgagaattgcgtagagattgaggcagcacaagcgctgcaggagttcaagggaagtcgagatatatcgagcctaagagcgaaagagccagcatttcctatagatggtatgcatggtggaccaatggaatcaccagttggagaggtcttcctgaacagggcactgtttgatccttcatcctccttagaattccataatgctatcaaccctgttctccatggtgccaaatcgagactggtcgatccaggatattttgagatgaacgctgctccattctcatcagtgtcgagctcaatggaaattgatcatgagaacaagaatacatctggcaacctggtctctagaatgagctgcttattctttcacgaagcgaagaaatattgcagcaacagctcaaacaacatcagcaacaacaccgagtttcagctgaactctgcagcggaaaacaaagatttaccctgggccgatgatgaggagctggaccctctgcatcagtttcaggtgaacgtgacagggtctgaagacctcaagtcaatttcatggcaagaggaacaccttcttgctcatgccgcagtagatttccatggcaatcacccctcaatgtcactgtcagatgatcaaattctacaggcacatttcaacatcttctgagagcaggcatgaacaagttaattcattgtctgttatagggtactcttcctatattgtaagacacaagataatgtgttatttttccaggcattgtgagatgataggttttgcccctagatcgcgatggagtggcaatagtagttttttgttcccttcctctctagccttttcatgattgtaactttcagggtcttcttcgccattctgctttttacgtgagtcatctcacggttagaaaaaaaaaa

SEQ ID NO: 335 - skipped

SEQ ID NO: 336 - DNA, 1369 bp, Eucalyptus sp.
cggacacgaagcgacgatcgggtcgggtcggttcgggcgtcgccatgacgcggcggtgctcccactgcagccacaacggccacaactcccggacctgccccgcccgcggcggcggcggcggcggcgggggaggcggcgtgaggctcttcggggtgaggctgacggacggctcgatcatcaagaagagcgccagcaccagcagcctctcgtcccaccacctcctccccccctcctcctcgccgtcgccttcgccttcgccgtcgccgtcgccggccgcgggctcgccgccgtcgggcgaccaccactacgaccaccaccaccaccagcagcgcgacccggacgggtacttgtccgacgatcccgcgcagggggcctgcgcgtccgatcgccgcggggagaggaagaaaggtgtcccttggacagaggaggaacaccgactttttttgattggtctgcagaaactgggaaaaggtgactggcgtgggatagcgcgcaattatgttacgtcgagaactcctactcaagtggctagccatgcccagaagtacttcattcggcagactactgctggccgtaaaaagagacgctccagcctctttgacatggctccagagatggccaccgatcgtccactaataccaaaggaaacaaccttgcctccttttgcaagagattctgatcaaccagattcaatgccttcgctggatctctcactggcctcagaatctaagccaatggaaacctcttctcatgaaacagtcaaagatgttgccaaaactgcaatggtatctgatgtgtttccgtgtaccattcctggacatttcccaacttattatgaacaagtacctctttcaatctggccatccactataacctctgtggaaaataagactgcagagatatctcgtcatcaggtcctgaagccaattcccttgcttcataaggaacccgtcaatgtagatgaactatgtggtatgtctcagttgagtctcttagagagtgagaatggctttaaggatcgtccagttctctctttgaatttgcttggtgagcccttgcgccaatcggcttttcatgctaatgctgctccagttgcttcaccagatataagcaatagcaagaacagtccaatcaaagcagtttaattttcagaaagggtatggtacataggcgtctcatcttttccctccttgaaacatcttgttttcctcaatattatgcttctatggtaggcccagttagataggcatagatagatagtaaatcatatttattttattcatctgtaatcatgtatgctattattttgactgatttacatccagactcttatttggatccaatatatgtgtgcttgttaaaaaaaaaa

SEQ ID NO: 337 - DNA, 1382 bp, Eucalyptus sp.
cacaaacaagaaaaggtttcagtgcttttcctccgcagatacatgaacatgaattagcagccttaaattttctttttcttttttgtcgtgtaaaaccaacaaaagtgactgctcatccacaaccctaaaccaaaccccactttcttattttgctggctctacttctgatgataatacacatattccatttcctatatatacttctcatcacgaagccaggcatttactttgatctcgcatcggatgtggaagaatttccctttggccacgccatcatggattcgtcaggacgagcgaactccggctctggcgacgatgggaagagtgctgctgcttgtccccgtggccactggagacccgcggaggatgagaagctccggcagctcgttgagcaatatggtgcgcagaactggaattctattgcagagaagcttcaaggaagatcaggaaagagttgcagattaaggtggtttaaccaactcgatccaagaattaacaggaggccatttaccgaagaagaagaggagaggcttcttgcagcacatcgcgtgcacggaaacaagtgggcgctcatagcgagattatttcccggtcggacggacaacgccgtgaagaaccattggcacgttataatggcgagaaagcaaagagagcaatcgaagctctgtgggaaaagaatccatcaagagtactctctcggcgaccccactggtttgcaaggaagaaagactcattttcaagatgaattgcttggttcgcaattcaggttcgatcagggaaagggatttttcatttttcaaagtcccagtaaagagaggaatttcgctctaccgtcatcttcgtcggcttcttggacttttggcagccagtcgcttgcaaagtccgcacacaactcttcttcagttgatgatttaaatagaatagaaagaagggattactacaatcgagcttccaataattattccggtagagagggggcgagaagtttgagccaacccttccattcccatccatattcatccctttccagtgcttactcgattagccaataccagagggtcgttccaagtccattcgggtatgtttgcctcggcgatggctgcaacgacagtaacacgatgaagaaacaggagattgtgagcttccacgatgaaatgccgaggttagagaagaccagattgcacgttaattcgacgcatcaagaacaagcagacaagtctctcaagcacaaagacgttcctttcatagatttccttggtgtggggatttcttcttgatatgactattgataacgagagaaattttcccagatatttatccgtgtcgtttttctttcctgagtatctaatcaactaattagtggttttgagggaaaaaaaaaa

SEQ ID NO: 338 - DNA, 1531 bp, Eucalyptus sp.
cgatttacccccctccctctctcggcatataaaacccgcaggtgaaacccgctctctctcccccacgccttccgcccgactcggactcggactcggccgagtcaacccacgccccccgcgagtcccgaccccccggcgccatgacgcggcgatgctcccactgctgcaacaagggccacaactccaggacctgccccgtccgcggcggcggcggcggcggcggggacggcgggggcgcggcggccgccccctcctcctcctccccctccacctcctcctctggcgccgcggcggcggcggcggcctcggcctccggcggcggggtgaagctgttcggggttaggttaacggacgggtcgatcatgaagaagagcgccagcgtggggtgcctgtccgccgcccactaccactcctcgtcctccgccgcggcatccccgaaccccggctcgtccccgatcgacgggagcgacggctacctgtccgacgatcccgcgcccggctcccgctcgtccaatcggcgcgtcgagaggaagaaaggtaacccatggacggaggaagagcatcgaaggtttttaattggtctccagaaattgggtaaaggagactggcgagggatagctcgtgactttgtgactacaaggactcctactcaagtggcaagccatgcccagaagtattatatccggcagagtaatgctggccgaagaaagaggcgctccagcctttttgacatggctccagatatggctactgctgaccaaccctcacatccagaagaaacatttctgcctcctttggtcagacttaacgatgatactaactcaacaacttcaaccagtatgggactcgatttggaaagaacgcctatggagacctcgcacccagaaacatctgaagggggcggtgatgttgcgatggaatcaattgatcaagtacctcttgtaccctgttacttcccatactatttaccactaccctttcccatgtggccgcccaacatggcgcctcctgaagatggaagggtggtggagacatctcatcaccgtgtgctaaagccaatcccagtaattccaaaagaacccctaaatatcgaccaaatagttggaatgtctcagctaagtcttgctgagaatgaacctgcaccactctctttgaagtttctcggggaaacatctcgacagtcagcatttatcaaggcgccttcttcagtcaatgaatcggatctcgacaactgcaaggatggcgccactcaagcagcttgactcgtgcctaagatcagcgacggtttagttcttgtgaatctttctgtaaaaccatctgtattggtgtcctccttttcctgttgtatctgctttctttaggctttcttctccacacagccctagctagatcatacttctctaagtatttattctttttgcactatgtggatggaatccaaaataaacttagtcccaagattcgggcattgttgcaagcttctcacttggtaatacagcaggattgcccaaaaaaaaaaaaaaaaaaaaaa

SEQ ID NO: 339 - DNA, 1728 bp, Eucalyptus sp.
acctacaatattcctttcacacattctccatttcatttgcctcacagattagagcgattcttccggaaatctaggcacttttgcatgggaagacactcttgctgtcacaaacagaagctgaggaaaggtctgtggtctcccgaggaagatgagaaacttttgaactacatcgccaaatttggactcgggtgttggagctcagtcccaaagctcgcaggcttgcaaagatgtgggaagagttgccggttaaggtggataaactatctaaggcccgacttgaagagaggtgcattctcccagcaggaagagagtttgataattgaactccatgcagttctaggcaacagatggtcacagattgcagcgcatttgcctggaaggaccgacaacgagataaagaacttgtggaactccggattaaagaagaagctcaggcaaaatgggattgaccccaatacccacaagcccctttccttgtttgaaaacagtgaccaacaaaagtttcatgcaatatatgaagcctctgttgcatccactaaaccgaacctttcccaggccagttccacaagtagcagccagaatctgagagtgactccatctcctgagctctcatttaagaggcccggtatagtcgatgatggaagcttcatcacctgttttccacctgctggtatggtgggcgagctatgctttcagcacttaaaatgttcaggtaccatgggtctattggcaagttcagatactgctctacatcacgattggaattggagctcctcagatatcagtccaacagaggtccattcagctccaaagccaaatagaccctctgacagctattattgcaatattgatggcggtaatagtagccactggagcggcattgctccattgcagaatgttcatacctttgaaaactccccaaattcatggttattggctgactgcggtagagtcgacaaagaaactgagactcacccatcggtgtttgatgcagaggttgcgaaatggttcgaatatctccaccgcactccatttgtgtttaacctctcaccaagtggagcttctcaactggagcacagtgacgtgacgccatcagcaggcacatgctcagtgactggtggtggcttggtcagcaattgcccacatgatcagattctgcaagcttcaccaggctctgacatgtatggcaagactcttcaagttattgccgtttcttcagggcaaaattctccgtcttctttggagcctgtgaagaacaagtttcaagacaagaaagtatgaacaagagatctctcaaaaacctcctcctccttcctttttcccttttttgcaggtgtgcattgtaaatggtaacgattcagttcttaccctctgcatattttttttctttcccttctgttttaccgaacgtatgagattgatccctagagcttatatgtgttcacccatatatgcctcagatatgtgtaaagttgcatcatggttataaacaccattcttgtgcaactctgtctcttggtgtctcgttaaggactcattttttattttttattttttttaattctcggttgttgaagacacatgacacaacagtttaagagggtattgatatttataaggtttagtcagtaccatgacctgcatgtgctgagatagtgactttatttgtagaaattccctttctcgttttggttttcctgggacaactttttctccgtaaaaaaaaaa

SEQ ID NO: 340 - DNA, 3044 bp, Eucalyptus sp.
ctgggacgaggaggagctgctggctgtttgcttcttcttccgcttccgcttctgcttctgcttcggctgcttcctcctcctccacttcttcttcttcccaccgaaatattatattgtccggtgatggcttgatcagaatcgtttccacgcacacacacacacttgttcctctctccccacagcggcctcgcgtcgatcgtcagcttcggtggagcggcgttgctgctggtgctgctggtggtgctgctgctggcctgacgacatggtctgatctccgatcctttcgcgcactccccccctctacgaactaagacacgtctacttgcggtgtagaaaagcgtagacggatctctatcggttgctgtcgttttctctcttttgcagtactagctcttcttcccccccgcgccttcctcgccgcggcggcggcggcggcggcggcggcttcgtttcgcctctcgttcgatctccgttgtcgccatgtccgaagaaccgagagaaggtccctattttgcccgttgctgctgatcagtgaggatttgaagcggcgctagcgtttgaggtccggtcatggacacctactcctccggagaagacttaattgttaagacgaggaagccttatactatcaccaagcagagagaacgatggacagaggatgagcataacagattcctagaagccttgaagctccatggacgagcttggcagcgcatcgaagaacatattggaacaaagactgcggtgcagatccggagtcatgcacagaaattcttttcaaagttggagaaggaggcaattgttaaaggagttcctgtggggcagacattggatataaaaattccacctccacggcccaaaaggaaaccaagtaatccttatcctcgaaagactggtgctagtactcctacactgtcggtaggagcaaaggatggtggaattttatctgtgtcaccatcaaattgtgagaaattggactcagagacagcatcatttcttgagagagctagcggtggagagaagctcgcaaattccaaagagaatcaggatgacaattgctcagaagtttttaatctgcctcaggaagctcactgttcttctatatcttcaaccaacagaagtgttgttccaacaccagtgggtatccagaattcatgcaccttcaggatgtttgttccttcgttgaaagagggagttcaggataatgggccaagaaaagtttctaattcggagaactctgatcgttcgcatgagaaatcagttcaatgcagaatggatggatatgatggcccgccagcagatgagatgcaaactgctcataatttcccgaggcatgttccagtgcatgttttagatgcaaaccatacaaagtgtactcaggcccccttgcaggatgtgtcattccaggactctgcatttgacccaactggagaagtgaaagcacgccttaacctattcccaaatcaaactccatctgcagctggtgaaaatcaaaaggaagccccaagaatggatcatcaatcatttccggcttttcatcctccctttactccagttcaccataatgaagatgactatagatcattcctccacctctcatccacattttcgagtctcattgtatctacactgctacaaaaccctgctgcacatgtggcagctagctttgctgcctcactttggccgtaccctaatgtggaaaattctgtagtagattctgccgtatgtactcagggaacttttccatgtcggccgtcgagctcccctccaagcatggctgcactagctgctgctacagtggctgctgcaaccgcatggtgggcagcccatggtttgcttcctctctgtgctcctcttcacactggattcacgtgcaatcctacatctgctacagcagttcactccctgaatactagtcaaactccaggagtggaaaaagagagaagagagtgtacctttgaaaacccatgctcacaagagcatttggacccagaacattctgaagctctgcaagctcaaaactcagcttccaaatcacctttaggagcattgtcagactctgaggatagtggaggggcaaggttagatacaagatcaaaagctgctgatcatgagaaggctgcagtagagactgattcccaacaaaaccaatcaaagggaggaaaaccagttgatcgttcctcatgtggttcaaatacaccttctagcagtgaagttgagacagatgcattagaaaaacaagagaagggcaatgaaacactgaaagatcctgatccaaaccaatccattttggaatacttcaatcgtcgctgtagaagcaccagcaatgtgactgactcttggaaggaggtgtctgaagagggtcggctggcttttcaggcacttttctcaagaaatgttctgccacaaagcttttctcctcctcgtgatatgaagaacaaagggcagcagaaggaaaatgtggaagaaggtgagcaaaataatggggaggtagataaagatgtatcaacattagacctcaacaggaacatgtgtatctcgtgttcttttcatcaaggtcctgagaggtctggagttattaacggtggcgaggaagggcttctgacaattgggctgggtcaagggaagcttaggactcatcgaactggatttaagccttacaagaggtgctcagtagaggccaaggaaacccgggcggcaaatgttggcagccaaagtgaagagcaagggcccaagaggatacgcttggaaggggagccttcaatgtgacattccataatgcatgcattcaatgaaggaaagctttgttattgcatgcttattttcggtggtatctattctcgtttctctgttaatttgcagctcacgaaacttgtcgtattacgtgtgtgtactgatgtctatttccacgtagttcctatattgaacttgaactcacgcaactgcattcgaaactttttctgcacagaacttcataaggatcactctgtacgactctctgaactctttgctgcaatgatgttcttcctatgtcaaaaaaaaaa

SEQ ID NO: 341 - skipped

SEQ ID NO: 342 - DNA, 1214 bp, Eucalyptus sp.
ctcttgaaacttctccgctcttctcttctctctcttgaaaggaaggatgagaaaaccttgttgtgacaagcaagacacaaacaaaggagcatggtcgaagcaagaagaccagaagctcatcgactacattcgcaagcacggcgaaggatgttggcgaactcttcctaaggctgccggtctcctccgttgcgggaagagttgtaggctaagatggataaactatttgcggcctgacctcaaaagaggcaactttgctgaggatgaagaggatcttatcatcaagcttcatgctctcctaggcaaccgatggtcgctaattgctgggagattgcccggacggacagacaatgaagtgaagaactattggaactcacatttgaggaggaaactaattaacatgggcattgatcctaacaatcaccggctcaaccagactccacctcgccttgagagctcaaacaatgtctctgttagtgcaaattcttctggattgaagactcgtcaaagtccgcgaccaaaatcctgcggtggcgacaaagaccaggtttcagacgctggtagttgtctggaagatgagcctagcaggttgcccgacctgaatcttgacctaacaattagcattccgtctccttcgcctgcaaagattgagaaagagcaaaaaccttgttcttataagcatgacatgttaagggactcggatattgctacatcacccgctttggttctcttcagatgaccaattgggcaaaccaattaattactaggcagattagattgagcaggcccctgatgaatatttgaaaattagggcaacctagctgaggtgattcaacgacaatatatgggatggtgtctcccgatacatatcgatatctgaggtctaaatcaattagcaaggattgatatgatacatcaagcttaaattgatgaactatatacagaagcaatgggctcgagcctgtcaagagttgaatcttattgacccgctcctgtagagagttgttcaatataatctctggagtggaacgggctttgatgatgtattagaaaaggctcaggtattaagagtagattggtcggagcctccggttgtaaatttaatcagctaaataggaaggtagatttaattctgttaacatacttgtactcgagatctgccatagacatatatatatgtatttatgattaaaatgtaaaaaaaaaaaaaaaaaaaa

SEQ ID NO: 343 - DNA, 1264 bp, Eucalyptus sp.
ctctttctccccctccttctactgcgaatatcatatccgaagctttggcttcgacgacgaggctcacggaaattagagaaccatgaggaagccttgctgcgacaagcgggacaccaacaagggggcgtggtccaagcaagaggaccagaagctcatcgattacattcaaaagcacggcgagggtagctggcgaactcttcctcaagccgccggtctgctccgttgcggcaagagttgccggctgagatggataaactatctgaggccggacctcaagagaggcaacttcgcagaggatgaggaagatctcatcatcaaacttcatgcactcctcggcaaccggtggtcgcttatagctggaaggttgccgggacgtacagataacgaagtcaagaactattggaattctcacctaaggaggaaactcctaaagatggggattgaccccaacaatcaccggttgaaccaaaatctccctcgctctcaaaccccggatgcctccggcagcacttcctcatccagtatgaagaccaacatgaccctggccgataaatcctccaggagtgctggtgatcatcctgaggtatttgatgcggagaatgtttcgggagatatcccgcgtgacttgccggatttgaatcttgatctcacgattagcgtcccgtcttcatcacttactaaagttgaggaggaggagcaaaatccgtatgcttccaaggtagcaaccaaggtagcaagggacatcgaaaatgccgaatcccccactttgcttctctttgcgtgatgactcattggtcgcccaccaatttttagaaaatcatgaaagaggtaaaaagtacaaaggaatacgcatgatgcgtgactgcagttagtacgcacggacgattaatcgcgtgacgctcaatgccttttcccaagagctagaaagtcaaatttgtcggagagttaaagcgacgatgtatgaagagggatcgaggaagcacgggctcgaccggccaagataacccatggcttatgcaatttgagagggggaaaacggcacatttgttgctcaattatcattgcaagcggagcctcgtgaatgtcaccctgcgtaacgggcggagatcgagcgtcaccattcaaaaattgcttcccctcaatcctagtaaagttgaggaccggatttccgagctggagaaattctatttcttgtaaatgtattgtttcaccacagaaatatagttgagaaactgtaatcatcagcatttttgtaaaaaaaaaa

SEQ ID NO: 344 - DNA, 995 bp, Eucalyptus sp.
aaaaagcataagctccctgacccataatccctagtatcgatggccaggtttcccagggttgacaagagcaacagcaagaagacagtgaagaagggcgcttggagtgcggaagaagaccagaaactggtggcttatatcaagagatatggcatttggaactggactcacatggccgaacccgccggtttagcgagaacaggaaagagttgccggcttcgatggatgaactatctgaggcccaacatcaagcatggaaacatcacccaagaagaggaagaaatcattattaacttgcaccgagttcttggtaaccgttgggccagcatagcgagcagactttcaggaaggacggacaatgagataaagaactattggaatactcgcttgaagaaacgttttctcatggaaaatttgcaaatgccaaccgcatgggatgtgaaagtcaactccagtcacaatgatcctttatcttgccaagattcatcaattgcccttattgatgctacaaaagcacaaaaccttggatctgcttgtggaattgatcgggttgatgaaaccctagtcaatggcttggtctcaccgggcaataaaattgacaaagtagaagaaaacatttgggaacaattggttgcactgaaggatctttgcatattagaagattttgaaggtacatgctcaaactcaggagctaaatctcctgcttctgagtgtatgtactctgagccaatgtattttggtgaatcctacgaggactttctcatagatttatggggaaattgataatgataatttcctcaaaattttgtcgcaatatatgatccttgtggttttcctttgtaaggtcagtcatcagatttgtaagactagcttgttcctgctatggagttaagttcgtctaaaaatgtaggtttgtgaattatagcatgtatcccagtgacaaaggagaaatgtaataaatgttcttgcaatattgaggatcatttctatggtgataa

SEQ ID NO: 345 - DNA, 1012 bp, Eucalyptus sp.
gcttctttgttttctctcaagtttctctggtatactgaaacatgggaaggtcaccttgctgtgagaaggctcacacgaacaaaggtgcatggaccaaagaagaagatgagaggctcatcgcgtacatcagggcccacggcgagggctgctggcggtcgctcccgaaggcggcgggcctcctccgttgcggcaagagctgccgcctccggtggatcaattacctgaggcctgacctgaagcgcggcaacttcaccgaggaagaggatgagctcatcatcaagctccatagccttcttggtaacaagtggtctttaattgccgggagattgcctgggaggacggacaacgagataaagaactattggaacacgcacataagaaggaagctcttgaaccgagggatcgatccggcgacgcaccggccattgaatgagcccgcccaagacgcaaccactatttcgttcgcagcggctccgtcaaaacaagaaccgcgagacgacgccatcgccgccgcgctcggctacaagaacgagaacaacccgacaacaacggcagcaacggttcaagaaaagtgtcccgacttaaatcttgagctcagaataagccctccttgccagcagcagcatcagcctgatgcgtcgatgggaatggttgagggaaatcactgctttgcctgcagcctggggttgcagaacagcaaggagtgcagttgcaggagaggagcgagcgggggaagcagcgcccatggcggctacgactttttggggttgaagacgagcgttttggatttcagaactctggagatgaaatgaaatcgaaactcatataagtgggagattttggatgttcaaggcagttttacaaagagagataagaaagagatttgctattagtttataatctctccggtggtttctcttttgcttttcttctcattggggggtctaatttgtaatgatcaatcttagtgcatagttctatatacttaatcaactagtacagaaaaaaaaaa

SEQ ID NO: 346 - DNA, 1287 bp, Eucalyptus sp.
gagagagagagaatggggagagctccgtgttgtgagaagatgggtttgaagaaaggcccctggacccccgacgaggaccgcatcctcatcaactacgtccagcatcacggccacgggaattggcggaggctccctaagctcgccggcttgttgaggtgtggcaagagttgcaggctcaggtggacaaattacttgagaccagatattaaaagaggaaactttagcagagaagaagaggacaccatcatccaactccacgaaatgcttgggaacagatggtcggcgatagcagcgaggttgccgggacgaacagacaatgagataaaaaacgtgtggcacacccatctaaagaagaggctaagaaaggagcacgaggcggcagtgctcgacaatgttccgtccaaaaggctagtcacgatgtcgcataccaacaacgaaccacatgctaaatatgaaagccacggtgggccaatctcatctccccaaactcaacagagctcaagcagcgtgtctctatcctctacgaccacggaagacaacagcggcaatgataacaaatgcatcaaagaggcgcttgaagatgcaatctccggattgatagacgagaatttctggtcagaattggtatcatcagatgacaacaactcagccatgagcgatgattttcttgcggttagcagtgagttccaatcgtccctaagttcaaacgttggaccgtgggacatgaatggaggtgggatggtggattgtttttggtatgatctcctcaaaggagctgaattagcagatgtctaggtgacagttgcaagaattagtccatttcttcttcttttctgaaatttttttatccttgttctgttgttttttgtattgaggttttacgtgcggactcgagagtcatgattttgaaggtgaccactgccgttagcgaccggacttagctgaccaatcgagttggaccaaacagtgatgaggatttgtgggtgggaagctttcaaacttcgctggagagaaccttgttgtatatgtaccgaacacacatatggagacaacaccatcgctggtggttctcgaatgaacgaccgtcctttactaattcttactttcatcgtgctgaacagccggaaacgtgtattattaaattcctatcggctgccttgctgctcagttccatgcgtgaatagcataggaaatgaaaaaaagagagtaaaggatccggattccatcacatcatcagtttaacctaacttcataaagaagatcttgaagtttagaagaaaaaaaaaa

SEQ ID NO: 347 - DNA, 1079 bp, Eucalyptus sp.
atgcaattttgagcgtcgcgagtaagccggagcgaggggagagcgatgggcaggcagccgtgctgcgacaagcttggggtgaagaaagggccgtggacggcggaggaggaccggaagctggtcaacttcatactcacccacggccaatgctgctggcgggccgtccccaagctcgctgggctccgccgctgtggcaagagctgccgcctccgctggaccaactacctccgccccgatctcaagcgtggcctcctcaatgaagccgaggaaagcctggttatcgatctccatgccactctcggcaataggtggtccaaaatagcagctagactacccggaagaacggacaacgagatcaaaaaccactggaacacccatatcaagaagaagctcattaggatgggcattgatccagtcactcacaagcctctccaagaacaagctaacgaacaggtcccttctaaagccaacgagcaagccaagttcgaagttagcaaccacgagacgccagtgtatccttgtgacggaagctccgacaacttcagctctccaataatcgataacttctcgacaggcaagtctccatccttcgacccgaatattagcagcttcgacgacccctggatgaatcacgtacggtgggagacgttcctcgggaacccgtcgtcatggaacttcatgttcgagggagatcgtcaagaggattacggcgaattcggggtgtgtccctcagcgggtggcgacccttcttggttgttcaaccgcgagagtaccggagtcgaaagttttgcccagagtggcttcggcgacatagacatgagcgaattcgctaggagcgctaacgtccgctcctaggcggaagaagggcgctctaggctcttccatgcgcggaccattcaataacatttaattccaaatctccgcaacctaagcttgtacaaaaaaacgtcgaaccttagctttcactaataactgcagcgttaggaagcggcagaactgagaatctatgcaaaatttctcctcccatgtaacaataatttcagatgctgaatataataatgaatcagcgaaaaaaaaaa

SEQ ID NO: 348 - DNA, 1091 bp, Eucalyptus sp.
gagagagagagagagagtctgcaaactgcgcgtcccgcgtcgccgatcgccgggagaatcgccgccggcgagatatggggaaccagaagctgaagtggacgaaggaggaggaggaggcgctcctcgccggaatcgccaagcacggcgccggcaagtggaagaacatcctcaaggaccccgaattcgcccccgccctcgtcaatcgctccaacatcgacctcaaggacaagtggcgtaacttgagcgtcggtacttctggacaaggttctagagataaacaaaggctgtcaaaagtgaaaagtctgatggccgctcctcagtccagtaccgtgcctctaaatccacaagctcatgctgcatctactgatgttgcattggtcaattcttcaaatagctttcaagatggcaaaaattattcactggacaacacgctaatctttgatgcactttcatccccgaaaggtcccaatggatccgacattggtgctattgttagcttcattgagcaaaggcaagaggtgccaccaaattttaaaagattactgagttcaaaattgagaaggcttgtttctcaaggcaaactcgaaaaggtggagaaatattataagatcagtcgacaagctcctctaggaacaaaaacatctgtcccagagcagaaggtagttcggtccctgccatcacagcagttggcattgtcaagtcatgagacaatgaaagaggtggcaatggctgctgcctacaacgttgttgaagcagagaacaaatcgtttttggctgctgaggctgttaaggaggccgaacgagtctcaaaaatggcagatgatgcggttatgacgctacagctagtacaagagatctatgaacaatgtttgcaaggtgaatttgttctcatgacataatgcattcattgtaactccaaaggattatacttgctgtaattatctgacttgccttgcatgtaaatttttccatctaacatacttaggattttcttgcctcaagcgctcttatttggttgaatacctgttagatcatatatgttgctgcttactagtaaataattctttatttgttctgcttcaaaaaaaaaa

SEQ ID NO: 349 - DNA, 1279 bp, Eucalyptus sp.
ctctcctcctccaccttcctcctcctcctcctcctcctcctccctcgcggacctcgctgatcgccggcgccggagttcatgggtgctcctaaacaaaagtggacagcagaggaagaagcagcccttaaagccggagtaatcaagcacggtgccggaaaatggcgtactatactcacagacttggagttcaaagagatcttgaagatgcgatcaaatgtggaccttaaggataaatggagaaatatcaacgtgactgcaatatggggatcgcggcagaaggccaggcttgcccttaaaaaaaatctcctgacgcctaagcatgatagcaacaccttggctttggcctctgcaaggaatgatgaagagattcttgatgccacccctcttgcagtttccagcgaaacaattaacaatgcaaatccaaaagagcgaatgaaaagtcggttggataatctaataatagaagcccttacaaatttgaaggatccaagtggttctgatagagctgcaattgccgcttacatagaggaccaatacttggcaccaccaaacctcaaaaagttattgtcagcaaagttgaagcttatgattgcaaatggtaaattgattaaggtaaaacaccggtatagaattgcacaaaatccaaaaacgatggaagcacgaagaggctcttctaggtcaattgtagagggaaggccgaaggattcttttaaaggagataagagagaggtcaagatttatactaaaacacagattgacgcagagctattgaagatgaagagtatgactgctcaagaggctgctgcggctgctgcaaaagcagttgctgaagcagaagctgccatggcagaagctgaagaggcagcaagggaagcagaggctgcggaggctgaagctgaagcagcgcaaatttttgcccaagcagcaataaatgctttgaaatgtggaactcttcatgcatgacaactgctgtgacctgcaggtgatctcaaatgctggacataaaccatcgctcaggatggatgggaaccgacccagctactttttgtaactctttttttcactgtaaatatgttttgggctgtaaatcttgggaatatttgggtaattttgcatctacggggaaaaggaaaaaaaaaaaaactgtgtagagctttttaggtcttttgatctgaaagaccagaatcaaatagaggcaaaagtaggggagaatatggggaattgaggtgccaattatatgctaagataacgttgtctttgtttctgaacaatggagaga

SEQ ID NO: 350 - DNA, 1240 bp, Eucalyptus sp.
ataaagtctcgtcttgtcacccgctacgttacttgctcacttcctgcgcaatcctccagtttcaacttttgtttggacgagcatttggagagatgggtaggagtccatgttgcgagaggaaggacttgaagaaagggccatggactcccgaagaagatcagattctaatcgattacatcagcaagaacggccatggaagctggcgtgttcttcctaagcttgcaggtcttctccggtgcggaaagagttgccggctcaggtggacaaactatctgaggccggacattaagcgcggctccttttctctccaggaggaaaagcttgtcatacagctccatgggattctcggaaacaggtgggcagcaattgcggctcagttacctggacgaaccgacaatgagatcaagaacttatggaacacccacctgaagaagcgtctgctctccacgggtctcaacccgctaacccaggatccattcagccctcaagggtccatgacaaagttgcctgcatcgtctattactcgacatatggctcagtgggaaagcgcgaggctcgaagctgaggccaggctctccagggagacgttgttgcttaatacactgccactgcaacaaaaaactgatggagactatttcttgcgtgtctggaattctgaagttggagagtcatttcgaagcatcaatagaagaagcaaaagtgcgagcctcagcgcggtttctcaagcttcttcctgtgctgaatgtgaaacaagctcagttgccaccatagagattggcaccacatatcttggagcagatgcagattcaacaccaaatgatcatgataacgatgcagatggaaagagcagcggggcagagtatgaagccctggctacatctgaatactctggctctagtgagttcgacagttcgacagtcactgcactagagatgctatttgatttcccaatcgacaatgacatgagcttcttagaaggaagtgcttaatagaccgcatgtctcgttctacttcccaagaaccaaacctccatgatcgttccctggtgaagcatgtctgaattatatattctgaatctgaagcctcattagttgaaagtttaatctgattttggcatccaaattaggaaagcaaagaatcatctatcatgtatatttgatgtagtaagcttcttttcgaagagctgatctgctggttctttatgcaagttgcagtgggccccatttttataaaaaaaaaa

SEQ ID NO: 351 - DNA, 1444 bp, Eucalyptus sp.
accaccaccagtaccaccacctccctctctctctctctctctctctctccttttccctctgttcgtgttcggtacgattgcgaagcggaaagcgaatgctcctctccggattgccatgaactccaacgcttcctccaacccccagtcgatggccacctccacgacgtcggcgaccactccggcggcgggcggcgacggcggcaagaaggtcaggaagccctacacgatcaccaagtccagggagagctggaccgaggaggagcacgacaagttcctcgaggccctccagctgtttgaccgcgattggaagaaaattgaggattttgtgggctcaaagactgtcattcagatccgaagccatgcccagaaatacttcttgaaagtccaaaagaatggggcagttgcacatgttccacctcctcgtcctaaacgcaaagctgctcatccctaccctcaaaaggcatcgaaaaatgttttagtgccgctgcaagcatccatggcccagccttcttcaacaaatcctgcttttacaattacaccaggaaatgtttcatgggatgatgcatccgtgctcataaacaatgcatccagcaataatatgttaagccaggatgagtttagcaatttccaagctgatattggatcaaagggctcatcaagggttagttgcagcactgctgctggtgtccgaagttcaagtagaacgccatctagcttggagatatctaaacaaaagagacaaacacccgtaatgcatgggatacctgatttttctgaagtatatggcttcattgggagtgtctttgatccaaatgccaaaggccatgtgcaaaagctaaaggaaatggaccctatcaattttgaaactgttctattgttgatgaggaacctcacctttaatttgtcaagtccagattttgtaccagtgaggaaggtgctgtcatcctatgatgtgaataccaaaactgtaggtgctccattagaaaatgttgtacagagcgatctgacatgttgaattgcttggcccattggttctgaagcagcaccctttgatgtcaaggccccacctgcatagttgcagcatcaacctggaggtgcagggggtcgccagactgccagtggctattcaggtgcaaacggatcttatatgctgcttgcttctatataacatgtgatccgggaagtgtgtatatgtagcaagactctgcttttttggtagcagttatatatctacttagaaatgtccaatgtttctcttgacatgcaaaatagattgtctgtctttaataaaaccttatgcttcacccttcctgtgtgttgatctatacagagaatgtggaggttgaagtacgtttgtttgttcttttgggacttgaacactaacctgcccttgtactgtctcactaataattggaggaatttgagttgctgtgtaaaaaaaaaa

SEQ ID NO: 352 - DNA, 1339 bp, Eucalyptus sp.
atttttcaactccccccccccaccccgaatcaaatcccattccctctctgcctccctcccttttttttcccccaatcttttgttgcgttttcaagcacccacgccccccaatctccaacgccatcaatcaagctcaagcaccatcacctcaagaagaaagaaggaaagaaagagagaaggaccggagacccgacagagggtcgcgcgcgcacgagacatgggacgatccccttgctgcgagaaggcgcacaccaacaagggcgcgtggaccaaggaagaggaccagcgcctcatcgactacatccgcctccacggcgaaggttgctggcgctccctccccaaatctgccgggcttctcaggtgcggcaagagctgcaggctcaggtggataaactacctccgccccgacctcaagcgcggcaacttcaccgaggaagaagacgagctcatcatcaagctccacagcttgctcggcaacaagtggtctctgatcgcggggagattgcccggaagaaccgacaacgagatcaagaactactggaacacccacatcaagcgcaagctcgtcagccgcggaatcgacccccagacccaccggcccctcaactccgccgcccccggcgttcctccggcggccacctcccctccctccttgcccgtcacggaaatcagcctcattagctccagcctcgaccgcaggccccacggcaacggctactacggccgcgagaagctcgagcccaaggcagagcctctccgggaagacaaccactgcacgacgagcagcggcactaccaccgacgaggagctgaaggcgccgcgaaaccgacggcaagcccagggcggaaccgaactcaacttggagctctcgatcggcttggccccgtcctgtcgtgagctcaatcgcaacgcctcgtcggtgactgcgaatacggcagagtctaagcttcaggaggtcccctacccgctcctcaccgtgccaacgcccgccgcggcggcggcggcggctgctgcaacagcggtgtgcttatgttgccagttggggtctcggagcggcgggatgtgtgggaattgccagagcaacggcggctcctttggatactacgcacagttaggttcatagtctttcgggaaaggagaaaagaacaagggaagataaaaaaaaaaaaactctagtttgtaatgtttctgattaaaagtatagatgctcactcgcttctgtcacctgcccgaactgaatcaagcacacccattttggttcattttgtcatcatgacattgttgaagtaatagcaacagatatggcgcaaaaaaaaaaaaaaaaaaaaaaaaaaaaaaa

SEQ ID NO: 353 - DNA, 1282 bp, Eucalyptus sp.
gtcacttcgatctcgatccctccccgagatggagtaaatcgatatgggcatttagaaaactcctcacgagttacatgatcctctggtggctcctctctctctctctctccaagatattctttttactactaccctgtacttcttttgctctgtttcactcgccgactgatgatgagcttcgaaggcgtttcttgattctcctagggtcttctattcccgggtaatgctgtggtaactttgtgagagagagagagcgagagggagaatgggaaggacgccatgctgtgacaagaaggatttgaagaaagggccatggacgcccgaggaagatgagattcttgttgagtatatcagacagaatggccatggaagctggcgttctctccccaagcttgcaggtcttcttcgttgcggcaagagttgccggctaaggtggacgaactatctcaggccagacataaaacgtggcccttttactcccgaggaggagaagctggtcattcagctccatggaatactcggtaacaggtgggctgctattgctgctcaacttcctggaagaacggacaatgagatcaagaacctgtggaacacccatctaaagaagcgtcttctttgcatgggcctcgacccccagactcatgaacccttcctgacccgaggccctatgacaaactcacccgcatctacagtcactcgtcacatggcacagtgggaaagtgctcggctcgaagctgaagctcggctttctagggaatctaacctgtttaatccacttcctcttcaaaaagctgacgccgaccatttcctccggctatggaactcagaagttggagaatcattcagaaagataaacatggaaatgggaagaagccctgtttctccggcatcttcatgtgcgaagtgtgaatccaattcagccatcagtgctgaaatgggtccctccttgggtggttctgctgctgtcacaaatgatggagacgaagataaggaatgcgagacgtacaaatcctacttccaacaaatggctgcagggacagagtcctctggctctagtgctttagaagattcatcagacaccgcgttgcagctgctgctggattttcctatcaacaatgacattagcttcttaggaggagatatcgatcaatatgcttcatcttctggtttagtttagaaagttctgaaatatttgcagttaggaaaacccggctaagcctttgccttttataaggcctctcctgctagagttttgagctttttccattggcaagaggggatg

SEQ ID NO: 354 - DNA, 1336 bp, Eucalyptus sp.
ctttactattctaagtcctctacttctggtttggaatcactaatttcttggtctcactttcgcttggcctatcacccgagagttctctgcagaaacttcacagccgtcctctgctctttcaccaaccattgtatgcctggttttactagggctaggaagatgagcatgtccggagaagaagagggtgacctgcgaagggggccatggactcgcgaggaagacaatttgctcattcactcgatcacatgccacggcgagggacgctggaatatgttggcgaagagcgcaggattgaagagaactggcaaaagctgcagattaaggtggctgaattacctgagacccgacatcaagcgcgggaatctcaccccgcaggaacagctcatgatccttgaacttcaccacaaatggggcaacaggtggtcgaaaatcgcgcagtatctcccaggaaggacagataacgagatcaagaactactggaggacgcgggtgcagaagcaagcgcgccagctcaacatcgaatccgacagcgagaggtttctcgatgcggtccgccatatctggatgccccggctgctccagaaaatggagcaagcttcgtcctctgatcaaacaaccaggacttctgatatgagcatgaattgttctgtttctgcctctccagtacattatcctccctccacatcctcacccagcaaattgacccagaactcgaattcttcgatggaggtctcgagttatacgatggctgatgcagatatttctccgaatttcccgataacgggacagacacctgaaattcctgaagcattctcaaatgcagatgtagtaggctttggcaacagtactgcgtacaaccctttgcttgcgggcgacggttacttcggggacggcaccagctatgatgtgaacgactatgccaccatgtcagcactgagcgcttgcaacgggtttccattgcagggccacgtggaaggaggcaactgggcggtcgatgatgtggcggatgcttgttggacagtcgatgacatatggaagtttagagactaatgcagggctggaggatagtctagttatttatgcgtagaccaatcccaagatcttttcaactgggtctaaaatttttacttattgattcgtcataagcttcttctgtgacaccctagaagtgggttcgattttaaatgcagatgatgttaatagttctcattttttgaaaattattggcatgacgttagcacttatccaagcagtgccctaacataggggttttgttgcaattttattgaccagcccaaaaaagtggtagataattgttcttatattaaaaaaaaaa

SEQ ID NO: 355 - DNA, 1357 bp, Eucalyptus sp.
gtccggtctcctccctcccttcctccctccttccttctctctctctctctctctctctctcgccgtccaaccgtacggactctcggttttgccgcgaaacggaacggagcggacccggtccctcgccgtcgccggtgcgagagaatgcctcccccacgcgccgccacccccgacgtcgccggcgacgagagctccggcgccgacgccggcgccggggagatcatgctgttcggggtgcgggtggtcgtggactcgatgaggaagtgcgtgagcctgaacaacctgtctcagtaccagcacccgcaggacgcgaatccgcccaacgccagcggcgggagcggcggcaacaaggaagaggccgccaaaggctacgcatcggccgacgacgccgcgcacaaccccggcggtggccgcgagcgcaagagaggagttccttggacagaggaggagcacaggctgttcttgttgggattacagaaggtggggaaaggagattggagagcgatatccaggaactttgtgaagacccgcacgcccactcaggtcgcgagccatgcccagaaatatttcctgcgccgaagcaacctcaatcgccggcggcgtcggtccagcctcttcgatataaccaccgattctgtgactgcgagtatgatggagactgaacatgttcctcatcaagataatacatatcagatgaatcccttgcctcggcatccgcttttgcaagatacttgcaacccgaatggctatgttgcaatggcccctttcgcgatgccgattggaccagcagcgtttccaattcctgttcagaatcaggtcccaaatctaactctaatgcaagggggcgggctcagtgattcaaagtcgaagctcgtccagccgacacctcttgtcccaatccctcacgctccgcttacctccgatcaaagtgcaaattcgaagtcaacaatggagcctctgtctctatccctcaatctctccctgccttcagatcaaggagattccccttcaagtcgtacatccttccaggcgatgtctggcttccgcggtggggagagcataatcagtgtggcttgagaatctttttatcttgatagaaaacaagacaaggaaggggggacaaggaagggggttcatgtttagatcattatccgggtaaagataagataaaggggtgtatgggcgactgaatttgatttgccaaattgttgtacagagcatggggcgacaaagtagaacattgccatgtgctttttctttctatttaatgctctatctccatcaggtatctgttaagtttgtcggcttacatgtgactggaaaaaataacatcatcgatctttggctaaaaaaaaaa

SEQ ID NO: 356 - DNA, 1406 bp, Eucalyptus sp.
gaacacccggaaagtaaacagagaaaaaccacagccacatagagagagaaagagagagagagagagagagagagagagaggttgcagagatgggaagaagcccttgttgctccaaggagggcttgaacagaggagcgtggacggctcaagaagacaggatcctcaccaactacatcaaggctcacggcgagggcaggtggaggaacctccccaagaaagcagggttgcagagatgtggcaagagttgcaggctgcgatggttgaactacctgaggcctgacatcaaaagaggcaacatatctcccgatgaggaagagctcatcatcaggcttcacaagcttttggggaacagatggtctctgatagccgggagacttccagggcgaacagacaatgaaataaagaactactggaacaccaacttaggcaggaaggtccagagcaataccccaaccaactcgcaatctcgcagtggtcatgtcgatcaattatccccaaatcatcaacgtgacgatgatcgaccccgcaaagtaaagagcccgagacattccgagacatcgaaaatgtctaccgacgataatagtgcctctgagtcgccatcaagtaagcccgatgctcgttcggtcaagaccaatgcgttcaagtgctccaaggtcctcatcgacccaccgccagaacaagaacttcaccgaaatgaagatcctatcaacacggactttgcagcatcggcggcagtggacccggctcccaccggagtcttgccgccattcacggggaatattccggcggatctgtcgatggatgactttgagattggggatatctgcttgtcagagttcctgaatccggacacatcgagcatcgctaaccaaggtcaattcaacagcaataacagcatcacgatcagtgacgatctgttcgctgatgatagccaagtgcaaggtctgggttgggcagcactgagcagtgacagtgttcctgataatcatcaagcaaatgctggtcccaacttccatcaggcttttgcctcctttcttgactataatggaggagaccagtggctttgagcacgacatgagaactgtacgacatcgtcaaggagccatttttcatacaagaatttgcatatagggacatactaggccgtccccgctgttcatgattcctttctttttgtccttttttttttttatgggtgtctgccaatcactctgtttattcactccaggatcagctgttggggtctcaaactaaaacatcattgcacaacacgatgttggcccaacttgtcagataaataatcccatgactagctgtacttagctccaagagagagaaagagaggcctctgtaaaggaaatctttttcaagttcttacttcgacttacttggaactaaaaaaaaaa

SEQ ID NO: 357 - skipped

SEQ ID NO: 358 - DNA, 1643 bp, Eucalyptus sp.
ttaccaccacccctttgttttattttcgatcctgcatctctcaaaatgaggaaacctgatgcctctgggaagaacagctccaacagcaacgctaacaagctgagaaaaggactctggtcgcctgaagaggacgacaagttgatgaactacatgctcaacaatggccaaggctgctggagcgatgtggcccggaacgccgggctgcagcggtgtggcaagagttgccgcctccggtggatcaactacttgcggcccgacctcaagaggggcgctttctccccacaagaggaggagctgatcatccacttgcattccatccttggcaacaggtggtcgcaaatcgcggctcggttgccgggacggactgacaacgaaataaagaacttttggaactcgaccataaagaagaggctcaagaactcgtcatcatcttcttgtagacactcgccaaacacgagcgattcctccttgtcatcagacgttaaagatgtcatgggaggtctcatctcccttcaggaacaaggactcatgccactttatatggactcgttgtcgtccgtgcaagctttggctcttaaccaggttatcgatccattactaccctcactcaaccaaggcctcgacctccccggtttaagtggatactgtgatgcaaattccaattactgcgcagtgcaaggcggagttagtggtgaattcgggagattcggaggtgttgttggttgtggcagtaatggagatcaactctatgttcctccactagagagcataagcattgaaaatgtgaaaactgagaacacatatgacagcgaacacaatagcagcaacgaccttagtaacttcaactataccactgatgatgtcgttgataacataggcaactttaacgactatggcagaatagaaagcatggctggtctggggaacttgtggaacggaggagaggagatgaaagtgggggaatgggacttggaggagttgatgaaagatgtctcttcattttcttctgctgatttccaggttattcaataggtggtgatagctctctcccaaaatcaccgacagtttttttcctttgtttctctgtcctccactctaagtgatagaactattctcactttggattaagaaaagagcaagaaccccagaatatacacgttcttgaatttaggaaacccgtctgtcatagtcacatatgattccacaacaaaaataatttccccagctgtccctcttgtctttgcttaatttcctgacgaccggcctatgaccatggtagtttatagtgtatatcccttttcttccccgccccaaaataaaaagtgagcagtggtacctggatttggaaggtgaagcatcgaattggtgtaattaaggtgcgaactggctggtacgcacttttgcttgtaagtagattgctgaagtcacatttctgtcgttacgcgatcatgtgaagttccggaataatggtcgatgtatacatgtcagagatggatgtgggtagacaataaaggtagagagaaacgtcaagttggtaggtttgcaaatttgtgatcattatgtgatgtacaaaatcgaaagtcgggggggtggaagttgttattagtggagagttatctgatataaagtgaaatcatacatat

SEQ ID NO: 359 - DNA, 1382 bp, Eucalyptus sp.; identical to SEQ ID NO: 333

SEQ ID NO: 360 - DNA, 1501 bp, Eucalyptus sp.
tctccatccaaattcccaccttcctcccttcctccctttccccctttccttccttctgcaccgaaggaagcccccgcttcgcaagccacctctcggtaaagttcgctcctttttgggtcggcgaatcttgggtcgatcgatggcttcgaggaaggaggtggatcggatcaagggaccgtggagccccgaggaggacgaggccctccgcctcctggtgcagaagcacggcccccggaactggtccctcatcagcaagtccatccccgggcggtccggcaagtcgtgccgcctccggtggtgcaaccagctgtccccgcaggtggagcaccgggccttcaccccggaggaggacgacatcatcgtccgcgcccacgcccggttcggcaacaagtgggccaccatcgcccgcctcctctccgggcgcaccgacaatgccatcaagaaccactggaactccaccctcaagcgcaagtgctcccccccgctctccccgctcgccgaggaagggaacaacagggcgttcgacgctgccgcggggtacgacggggacttgagcccgcgggagcggccggcgaagcggtcggcctccgccgggccttgcctgagccccggcagcccgtccggatccggcatgagcgactccagcgtgcacttcgtgtaccggcccgtcgcgaagaccggccccgtggtgcccccgccggtcgaggcgacggcggcggcggtctcttccaccgaggatccgccgacgtcgctgagcctgtcgctcccgggggccgcggacgcgtgcgaggtctcgacccgggtcccggccgagccgactcagccggcgacgcgcccgatctccttactgcccatggcgtcagatcccgctccgacaccggcgtgcgctccgccgcaggcggtggcgctgcccgagtacccaaggtacagcggcaacaacaacagcagcagcatcttcccttacccgcctccgtccccaagggtcggagccgacttctccccgttcaaggcggagttcatggcggtgatgcaggagatgataagggcggaggtgaggaactacatggcggggatgtgctcgcaggccgcggcggccgacataaggaacgccgtcgtgaagcgaatcgggatcgggaagatcgagtgaagacaacgacagagagaagaagaaccgggatgatgatttcttagttggttggcggcggcggcttcggagaaaaaaaggagaagtcgaaatgcgaagaggaggaggaggaggcgaggagatggagaaaactgggactctgtttttccaccccttttttttctttatttttattttaagtagagtaaaaaagaaataattttggccgatgtacagtgggaaaagaaccagggagaggagggagactcagcgaaacctctgatctgtctcctcttcaggctttggtcgagaaaaaggcggaggagtagaaacaagaaaatgtgaaaatctcaaaactcgaaaaacccaaaaaaaaaa

SEQ ID NO: 361 - DNA, 1669 bp, Eucalyptus sp.
gctgcctccaccaccaccgccgtccccaccgccgccgccgccaccaccaccaccaccaccaccaccaccttatactgtacaaataatcccttggcctcggccgttatagcctcttactcaaaaatcagtttttacccttttctgttgcgtagtcgtagttttgggccaggggttctattcggtatatgtagagaagtcagtgggcgaaaccgagcgtcgagcggtcggccatggcttcctcttcttctgtagcttccgcgaggaaggacgcggatcggatcaaggggccgtggagccccgaggaggacgaggcgctgcagaggctggtccagagctacggcccccgcaactggtccctgatcagcaagtccatcccggggcggtccggcaagtcgtgccggctccggtggtgcaaccagctctcgccccaggtggagcaccgccccttcaccccggaggaggacgaggccatcgtccgcgcccacgccaggttcggcaacaagtgggccaccatcgctcgcctcctcaacggccgcaccgacaacgccgtcaagaaccactggaactccaccctcaagcggaagtgctcctccgcgtgctcggccggcggcgacgacgccgacgccctcgcggagcagcagccgctcaagcggtcggccagcctcgggacgcccacgggcggcaacaacgccgtctccgatctgttcttcagcccgagcagcccctcgggatcggacctgagcgactcgggcttgccggtggggatgccctcgccgcgcgtgttccgccccgtggcgaggacggggccgatcatgcccgcgctgtcgggccagcacgccgacgcgtcgtcgtctaccaccacggatcccccgactctgctcagcctgtctctgcccggatccgatatggccgaggtctcgaaccacggatcggcttccgggtccgtaccgacccccgactcaagacccagccctaccctattctcagccaggacccagacgatgcaggcgacgccccctcctcccccgccgccggtaccgccgcagcccccgattcatcatctgggtcactacggcgataggatggaggcagcggctgggtacgagaagcagttcttcaacgcggacttcatggcggtgatgcaggagatgatacggaaggaggtgaggagctacatgtccgggatcgaacagggcgaggccgttcggaatgtgaccgttaagcgcatcggcgttagcaagatcgactaagacaaaatgataaaaagagattagtaagggaccatctcaggttttatgttgtcgatcatcttcactaatgatcgaagcacaagaactcgtcaaatcggcgctagagagagagagagagagagagatcatcgtcggttcgttttagtctagcctttttttttttttttagtcttttccttagtttcgtatcatctacacagatggtaataacttgggtggaggggttgtatataaagggaagggaagaggagaatgggaggtgggttttgtcggagatagaatggatcggttgaggaggacgaaagaaaagccaagaagaagaagcagagcagcaagcaagcaagcaagcaagcaagagcaagcgacgtaattcccgaatgtgaaaaatcaagaacaaaaagaacaaaacaaaaaaaaaa

SEQ ID NO: 362 - DNA, 1546 bp, Eucalyptus sp.
atctctcttccttcctctctctctctttctatctatctcactctctctcatcgcaaaggcccgagttctctctctcctcgttcttccaccttttctccgccatcgatcaaaccagtcggtcagtccccacgaggcgagggaggcggagacatcgagaacggggctagcggcggccgagaggaggacggtgaggatggacgcgaaggggatgatcagaggcgcccaccacagcggcagcggcggcgacagcgacagccaggaggacgatcagcaggcgattatggaggacttgcggagaggtccgtggacggtggaggaggacctcaccctcgtcaattacattgccaaccacggcgaaggacgctggaactccctcgcccgcagcgcaggtttgaaacggaccggaaagagttgccggctgcggtggctgaattacctccgccccgacgttcggcgcgggaacataaccctcgaagagcagctcttgatcctcgagctccattcccgctggggcaatcgatggtcgaagatcgcgcaacacttgccgggcaggaccgacaacgagatcaagaactactggcgaacccgggtgcagaagcacgcgaagcagctcaaatgtgacgtcaacagcaagcagttcaaggacgccatgaaatacctctggatgccgaggctggtcgagaggatccaagccgcctccgcctctgtctcgaccgctactgtcgccgccgccgccatggcagccccacccacaatggccaccaccgcagcatccaacatcggcggcatggctttcccgccggccctggcgggcatgggcggcgacttcaggggcgggcgactgaatgtggcgcccagctacagcaccccggagaactcctgcacgacggcgtcttccgactcattcggtgcgcaggtctcacccgtctcggaccttaccgacctgaccgagtactaccctatcccggccggcgacaacccgaacccggattactaccagcctaacaataatggccaaggatgctaccaggagtcgtctcttactagtccctgtgcatacttcaacaactatggaatggacttccaagcgtgcatggatcagaacaacaatcagtggttggacgatgggggcacgtcggacaacttgtggaatttggcggatgattggtactcacaacagcagcagcagccgcacgcagcttctatcatcaacaataacttctgagaagaagaaggaaagaaattataaaaaaaaaaaaaattatgttaggaggctcgaaagcgaaattcgattgtaaacagggaaatttgtgaaaaaaataggggaatcgatctccctcggcatgaaaaatataacttttgccgagcgagaaacgaaaaaaatcgtagtagcggttccggttaatttccgtaggggagtcctaatttcggatttttcttggtcgtactttctttgtttgattttttctttgattggggggcgaacttgtaactcgagcttattctcgcttaatctattttttttcttcctctgtcaaaaaaaaaa

SEQ ID NO: 363 - DNA, 1384 bp, Eucalyptus sp.
attatcaccatcttcttctgtagccacactatgaaagatctaagtttgaggcaatgggaagtggtgtctacacctggcaatgaaggaaagacagcgttggagagctgaagaggacgccttgttacgtgcatatgtgaaacagtatggcccaagggagtggcaccttgtgtctcagcgcatgaacactccccttaaccgtgatgccaagtcctgcttagagaggtggaagaactacctgaaaccaggtataaagaagggatccctcagtgaggaagaacagcgtcttgtcatccagcttcaggcgaaacacggcaacaaatggaagaaaattgctgctgagatcccgggccgtacggctaagagattggggaagtggtgggaggtatttaaagagaaacagcaaagggagcaaaaggagaacaaaggtgctttaccaattgacgaggggaaatacgatcatatattagaaaacttcgccgagaagctagtgaaggagcgatcgaccccagcacttctcatggccacagcaaatggtggcttcattcacaccgattcacctgctcttgctccaactcttctacctccatggctttcaaattctaatggcaccccaactctgaggcctccttcaccgtcagtaacccttagtctctcccctgcaacagttccagcatctcaaccgattccgtggctgcaggcagatagaggactcgatagtggttctctctcactgactggtttgcccaaccatggtccactccctacttcaggagaaaatatcttaatgtctgagcttgcagagtgctgcaaggaattggaagaagggcaccgtgcttgggctgcacacaagaaggaagcggcatggaggttgaaacgactggagttgcagttggagtcggagaaggcgtgcaggaggagggagaaaatggaagagatagaggcgaaaatcaacactctcagggaagagcagaaagcttctttggataagattgaaacagaatacagagagcagctggcaggattgaggaaagatgcagaatccaaggagcagaagctggctgaacagtggacggcgaagcatgttcagctctctaagttaatcgagcaaatcgggtttagaccccggattgcagatcatgacaggcagtgagagttaccgtgagtcgtagtcctttatatacacgtctctttcttgtgccaatgatgtcattcaagtctgcttattagaattccaagactcccttttcctacccaacaaacacctacctttacgtatatctcaataacattacagagcttctcatcctcagctaagtcctttgagacattttgtatggaaatataccgggcaaactgccttcataagtatttatcaaaaaaaaaa

SEQ ID NO: 364 - DNA, 1855 bp, Eucalyptus sp.
ggttgcttgctttctctctctagcttagcttggagcttacctactgtactgtgcttttcccccccctctctctctctctctcgctctgaacgtttttcagtcatcgagccgagctgaactcctctctctctctctctctctctctctgggtgacccttcttcccttttctctgcgcttccgtcgaagtgaaagagggcgccgaggttgtcgtccgagatgcgtcggagaaggacctctctcctgatttcatgagaccgaccaccacactatgaaagatctaagtttgaggcaatgggaagtggtgtctacacctggcaatgaaggaaagacagcgttggagagctgaagaggacgccttgttacgtgcatatgtgaaacagtatggcccaagggagtggcaccttgtgtctcagcgcatgaacactccccttaaccgtgatgccaagtcctgcttagagaggtggaagaactacctgaaaccaggtataaagaagggatccctcagtgaggaagaacagcgtcttgtcatccagcttcaggcgaaacacggcaacaaatggaagaaaattgctgctgagatcccgggccgtacggctaagagattggggaagtggtgggaggtatttaaagagaaacagcaaagggagcaaaaggagaacaaaggtgctttaccaattgacgaggggaaatacgatcatatattagaaaacttcgccgagaagctagtgaaggagcgatcgaccccagcacttctcatggccacagcaaatggtggcttcattcacaccgattcacctgctcttgctccaactcttctacctccatggctttcaaattctaatggcaccccaactctgaggcctccttcaccgtcagtaacccttagtctctcccctgcaacagttccagcatctcaaccgattccgtggctgcaggcagatagaggactcgatagtggttctctctcactgactggtttgcccaaccatggtccactccctacttcaggagaaaatatcttaatgtctgagcttgcagagtgctgcaaggaattggaagaagggcaccgtgcttgggctgcacacaagaaggaagcggcatggaggttgaaacgactggagttgcagttggagtcggagaaggcgtgcaggaggagggagaaaatggaagagatagaggcgaaaatcaacactctcagggaagagcagaaagcttctttggataagattgaaacagaatacagagagcagctggcaggattgaggaaagatgcagaatccaaggagcagaagctggctgaacagtggacggcgaagcatgttcagctctctaagttaatcgagcaaatcgggtttagaccccggattgcagatcatgacaggcagtgagagttaccgtgagtcgtagtcctttatatacacgtctctttcttgtgccaatcatgtcattcaagtctgcttattagaattccaagactcccttttcctacccaacaaacacctacctttacgtatatctcaataacattacagagcttctcatcctcagctaagtcctctgagacattttgtatggaaatataccgggcaaactgccttcataagtatttatcactttgttgtcctcctggtcggcagcttggctggtttatccttattgatcattaccgtgggagacttttgttctgggcttgcagcagaacgtatgatgaaagctgagatgtgcacatgtaactgttgaggtaaatcttgtagtatctctaaaactgagtcctgacattcagattcatgatggtcaagggatgcttcttgggtgttattgcaaattcagattcatgatgcaaaaaaaaaaaaa

SEQ ID NO: 365 - skipped

SEQ ID NO: 366 - DNA, 1490 bp, Eucalyptus sp.
ccagttcgagtcctttctcggcctacgacgtcttcctaaacccgccacgatctcgctacactaccagtagcgacgctcacaaccgactcggaaaataaagcgagtcgacattcgagcgagcgagctggtgagggagtgagtgaggatgggaagagcgccgtgctgcgagaaggtggggttgaagagagggcggtggacggcggaggaggacgccatcctcttgaactacatcaaggccaacggcgagggtcactggaggtccttgcccaagaatgcagggttactgaggtgcgggaagagttgcaggctgaggtgggtgaactacttaaggacagacctgaggagaggcaacatctccactgaggaggagaacgtcatcatcaagttgcatgcttctctgggtaacaggtggtctctgatagccagtcacttgccaggacgaacggacaacgaaattaagaattattggaactcgcacttaagcagaaagatcgacacttttcgaagaccatccattgacgaggcactgcctatggcgatgaacctcgtcaaagtcagccccccgaagaggaaagggaggaccagcaggtgggcaatgaagaagaacaagaacttgctcggaccgaagaaaaacccaaataaagaaacgagtgctaatttcgacatggtttcgtcgcctgccacacaaccggtagagagagagagattgtccaccaccaaagccagttctgaggatagagaaactaaggagagagaaagtctggctactgttaatgttgcttctgttccttattccgtcggagagggcggtacgacttcgccattgtcgtccaacaacctgagtaatccattaatgttgagcccaagtggggggagagaggatgggacgattctaggaccattggaaggtattgatgaggaattgtcgttgagctttaatgacatcgtggactatgccccccttcttgactcaagtgggatcatggacgtgagcatcgagacaagcggagatcatgaggaggctgcggcagtgggctcagggcttgagagaaagagcgagggcggcgagtggttctcttgtgttgaggatgactgtgtgaattgggattgggagaaccatgttgttcaagggcatggccacgatcagacggcggaggagagggatggccaggagatgctggcgtggctttgggagaccgatgggggagagtggggaagtcaaagttttgaggaggttgaccgggagaagcaaaatgccatggtggcttggctgctttcgtaggggcaaatccattaggacattaaacttaggtctccattatttttcggataaaagattggcgagctcacatagagcaggaaaaaaaaagaaaagaagacagcgtgaagtgggagagaatgggagggaatcaaggcctacgtgtggatatgttttcttttgtgcatttcaatgtctcttgtagctaagttcgtaggaagtggtaattagc

SEQ ID NO: 367 - DNA, 1689 bp, Eucalyptus sp.
gtgatttcgggggcaaatgggtagatccccgtgctgtgacaaggtgggattgaagaaagggccgtggacacctgaagaagaccagaagctcctcgcttacatcgaagagaacggccatggaagctggcgtgctttgccttccaaagctggtcttcagagatgcgggaaaagctgtaggctaagatggactaattatcttagacctgacatcaagagagggaagttcagcttacaagaggaacagaccataattcaactccatgcccttcttggcaataggtggtcggccatagcaactcatttaccgaagcgaacagacaacgagatcaagaactactggaatacgcatctgaagaagagattggcgaaaatgggaattgacccggtgacccataagcctaaaaatgacgccctagtctctagtgacggtcaatccaagagcgcggctaagctcagtcacctggctcagtgggaaagcgctcggctcgaagctgaagctagattggctagagaatcgaaattacgttcgcagtcattccagcatcaccacagcagcagcaacagcagccaggtttattccgcggcttccgctttggcttccacttcagctgcaccgcccggcctcgtcaaaaaagccaccgccccactgccaccatcatcaccgcagtctcttgacactctcaaagcttggaccggtagctcatggccgtcaaccaagtccggcgaaggtagtggcggtgctggaggttcagccaacgggatcgctggcgatcttgagtctcctacttcgacactcactttctccgagcctatgaacgtgctttgtgagaatcccaagcaaatgatcgagtttgtcggttcgtcggggtcgtccgactccgggatgatcaaagaagaaggtgaacaagagtggaaaggccttgaaagctcaattacgttgccagagttcaaagagggtatggggaacaacgcggtctcatttacatccacgttccctgaaatgacaatgtccctagaaggtccctggactccggagtcactgagggcgagtagcgtgcatggtaacgtggaaaataacgacatggaagaagggttcactagtcttttgcttaatagctccggcgaccagagtttatcagatggcggtggtgaatctgacaaacgtagtgattactatgaggataacaagaattactggaatagcatccttaatttggtgaactcttcgccatctgagtccccaatgttctagaaatcataaattagtaagcttcacaagcttctccatgatttgtgtgtgaggaaaaactcttgtgcaagtcccccttcctcaatcatagcacagccgagagccctaaagtgactttaagctgtcatattagtgaagtgagattcataggaaaggtaatcatttggtagccaacaagctcttggtttcttccacaggtttcaacatgagatacatatcgatttccctgagctggaaaggaacaaaagctgcttgtgaagcttgtctctcaagcgaaatgttaatagttcagttcagcctcccctttcttcactgctacttgttttttcttttcagaatgatgtaaaaaacttgactcagctttttctttgggcaagaaaactcgactcagcagcgaactctttatcgttatcattacaactttctttttaaaaaaaaaa

SEQ ID NO: 368 - skipped

SEQ ID NO: 369 - DNA, 1690 bp, Eucalyptus sp.
gctgttttcacatctttttgaacacgcccctaaagatccgccctcagagccgcctctgtccggtggctgctgacattccacctagaaattcccgaccaagttccccctttctaagccagattgggaaaggttcatatttgtccaacagtagtagtggatttaaatggggaggcactcttgctgctacaagcagaagctgaggaaaggcctctggtcacctgaagaagacgagaagctcctcaggtacatcacgcagtatggccatggttgctggagctctgttcctaagcttgcaggtctgcagaggtgtgggaagagctgcagattgaggtggattaactacctgaggcctgatttgaagaggggcacattctctcaagaagaggaggacctcatcattgaacttcatgcagttctggggaacaggtggtctcagattgcggcgcaattgcctggaagaactgacaatgaaatcaagaacctgtggaactcttgcctgaagaagaagctgaggcaaaagggtatcgaccctgccactcacaagcccctctctgaggttgaacatggtggcgatgacaagagcacgacacccaaaagccacgaaagagccgcattctccgggtcctcaaatggtctgtcccagacccaacaagctcccaattcagagaacactctgcttgagcattgttccagttcaaacgccaacaatagcagcaagatcagcaatctgatgaattctggtcttgacaaagactgcttcccaaatgggcttctgagctccacctccagttgtcagccttctgatgatttggtgggtcatttcccacttcagccactgggaaattacgcgtccatttcaaggctctcagaagcaatctccaaccatagtccttggttcggacaaagcggcaaaagtttcagcataaacacggaattcggctgcagcacgatgcctgccatccttccgcattcaaacatttcatttcaccatgacccagtaggctttagacctgccatgaccgttccgaatgataattactgtttcaagccgttcacagtcgatgaatccagatattgggaagtcaatgctcctaccagtagcggtgcggcgaatgcagaattgttaggcagtggctcgtacttcgagaatagtatgctctcttggggactagagaattgcagcacaatggggaaagaagccgatatgaacaatcctccgggcggccatatcggggatatcaagttgcccgattactttcacgacccactattgataggagccacttcacaacaccaagcgccgcaatctctgtacaacgagatcaagccggacactcattttgataccaattatagctcaagcgccatgtggcttcaaaatcagcaagaccaaggacttttgccatcatctgatacatcatcatgtcctaagaacatccaaagacttactgctctctttggacacatttaagcatgcttctttctagcttaaggaaggatcaatttgtggatctttcgtcccaaaattagagcaaactcaaagaaattaccgtgatcagcattacagtacgattacagaaacgagattgttctagtgtctgcttatggcctcactgcatccgcagcatggcattgtaattcatctgtaaatcattcttcaaacaaagttcccttcttttgaaaaaaaaaa

SEQ ID NO: 370 - DNA, 2521 bp, Eucalyptus sp.
ggtctgaagctaaagcagagcattctcttttaccaaaatctttgcatcccactttttctctcacagagagagagaaagagagagagagagcatgttgtctgatcaaaggtgaatcgaaaagttgcaaactttagaatccgaggcgtctgggggtctgtgggttacagagttttatagttcatgagaaggcgagctctgtcttagtcccgtttgaaccgaacagtgaccgataaagttggttggaacggaaaagggcgcatttttttagtacagtggtcacctgttatgagccatgacactgtgagattgagtttggtctctataaagagaggagcgtccaagaaaacatagaataagggacggagcgggcagaggaatagcgatgcaggatatgaagatgacgactgacactgaagattcgaagaagaaagagaggcatattgtgacttggtctcaagaggaggatgatatactccgggagcaaatcggtatacatggaactgagaactggtcgattatcgcatcgaagttcaaggataaaacgacgagacaatgcagaaggagatggtacacatatttgaattctgacttcaagaaagggggttggtcacccgaggaagatgtgcttttatgtgaggctcagaagattttcggcaacagatggacagaaatagcaaaggtggtttcaggcaggactgacaatgccgtaaaaaatcggttcacaaccttgtgtaagaaaagagcaaggtacgaagccttagcgaaagagaataacactacattcatcaccccaaacagcaaacggatcatctcgcacaatccatcaagtgtagatcgaccggcggaatctgcagcactggcaaagaggatgaggagggctcacattcagaatatagcgggagattgcaacttgaaagacagattacatatacaaagtggaatcacatatagtcagcaacaaagagctcccttttccacattggcgcaaaacttccgcactagcaattcgcccccccagcaatctgaaagcaaccaaaaagaagccaccgatgatgctcatggcaccaacgtccaaggaacatttcttaaaaaggatgatccaaaagttactgctctgattcaacaagccgagctgctcagttcccttgcgctgaaagtcaatgcagataacatggaccagagtcttgaaaatgcttggaaggttctccaggaatttttgagccacaagaaggatgatgatattctccaagattgcatcaccgacactgatctccagtttgaagatttcaaagttatggtggaagacctcaggagcagcaatgagggaagccaaacatcttggaggccacctgatctgtgtgaggaatctccagccagctcagagtatagcacagcttctactatttcgactcatcctgtctatgataaagcggaagagcctcaagccgaagaagttgcattgcacaaagttattgaaactgaactacaaactaaccattctgatgaacaaggtgtagtccataactgctgtaaagggattctttccagctcagtcactcatggaggtacttttcaatcttgtgacgagcatgtaaccgccactggagtagtttctgtctcatcaaatacggaatgcagttctcctgttcatgtaactccacttttcagatccttagcagcaggaattcccacaccaaaattttcagaaagtgagagacacttccttctgaaaacatttggcatggattctctttctacatctcctccaactaattcggcttatcagccgccctgcaaaagagctctcctccagagtctgtgaccaaccatgttaatccaacttcagtaaccagagccccaaacacaccccagacacctttttgttttctttggctgatcccgccgatagtaagttttctagtcctgttcaagatccaatttttttcccaatgcagccactcaggcctaaatttttacaaaaaaaggcatattgagtctgcattttgaagggtcccctgattgggttccagaatgttatggcacattctgcaatcctgacagtttgagagcttgtcagaagtcactaccagtgaccaagtgtgcttttagaagtgtgtggttcccttagtgatttctcgtttccctccgccaaaggttgtttcaaggtgaaacaacttctattcagttttttctgttgatttttggtttggacagacctgctacataaatccttatagccagagtgtaattatgcagcggcaaatcgcccatagcctacctccaatagatgatcataatttgaaaatagagaaccaagaaaaaggaaaaaaagaaaaaaaagaaagaaggacccccccgtccccagggactcctgtttgatattttttttggccccaacattcctggtgggcatatcatataggacaatctttttgccctttgtattcggtttttgatgtaatgatacttaccaagattggagtggaaatatgatacggtttttggtgtggtaaaaaaaaaa

SEQ ID NO: 371 - DNA, 1707 bp, Eucalyptus sp.
ctcacttcactgcagagcaaaaaccctagctacaccggcggagtctgccgagagtcgccgtccgatcatcgctctcggccgcggagtttcaataatggcgagaaagcgaaagcaggagccgaccccgagcgcttccgccgacgcgagtcaaccgccgaagaggcagcagcaacaacagctgataaagcaagagcagcaggaggctgcggcccgagaacagcacgccgttgattatatagaagtagaagtagaagaagaagtcgaagaagaagtcgaggaagaagtcgaggaagaagaagaagaggaagaagttgaggaagaggaagaggaagaggaggaggaggtggtggaggaggaggaggaagaaggggaggaggaggacaatcagaccgctaatgaagacgacgacgacgacgaacccatacagaaccttctggaaccattcagcaaggaccaactcatctctctgctctttgaagcggcagctcagcatcgcgacgtggctgatcgcatccgccagatggccgatgtggatccagtgcaccgtaagatattcgtccacggccttggatgggacgccactgcggaaaccctaaccagcgcattcaaacaatacggtgaaattgagaactgcaaggccgtctgtgataaggtctccggcaaatcgaaaggatacggtttcatcctttttaaatcgcgccgcggcgcacgcaatgccctgaaggagccccagaagaagattgggaatcgcatgactgcgtgccagcttgcgtccattggccccgtgcctactcatgcgggagcgcagtcagcccctttgcagctaccgcagcagcagcagcagcaagtgtctgagtatacgcagaggaagatttatgtgagtaacgttggggctgacttaaatccgaagaagttgactgaattctttgcaaagtttggtgagattgaggaagggccattggggctcgacaagtcgacaggaaagccgaaaggtttttgcttgtttgtgtataagacggttgagagtgccaagaaggctttggaagaaccgcataagagtttcgagggtcatgtgttacattgccagaaagctgtcgatggaccaaaacctgggaagtctcagcatacgcaacatcagaatgcaagcaaccattcccaaaggaatgacagtgcagggtttgcaggtgcagctgctgcaggacttgggcaattgaaccctgcaggaattgggtttggccagggagctgcagctgcacaagcattgaaccccgcacttgggcaggcacttactgctttgtttgcgactcaaggtgctggattggggctaacgaacttgttgggaactctaggatcagccacggctgttaatccagccatgccgcctgctggtcatggattgcaggcagcctacggaaaccagatgaacattagccctggactaattggaggaggatatggaagtcaagctggatatgcaaaccagcaaatgggtcaaggtgcaggtagtagagggcatcatgccggacagtttagtggcagtggaccatatatgggtggtcattagaccctgagagatccaacaaaggtgcatcagtcttttagtactgccttggtgattattctgaagtttcaagggctcatgcaatcgccatatttctgcttatgatgagattgtttatcaaagctaccaagactagagtatttaaa

SEQ ID NO: 372 - DNA, 642 bp, Eucalyptus sp.
gtgtcgtaacagggatatcatcatatatgatttgctgtaacagaaagtcttttatcagtgtccactgtcgacaactgaaattagattttgaatgcacaggaaaggcactgtcgaatggatcccactacttctatttcagcagaatgatgaacaatcgaattacggaaaatgggtactggaaatatttagacatggaagagccagtgtttggtgaagctggagaaattataggaatgaagaaatctctgactttccacattggagaggctccaacaggtcaagagacaaactgggtgatgcaggagtaccatctcgtgtccttccatgaattggctaattcaacacaagaacccggttcgctggttctgtctcgagttcatgaaagcaagacaagtcatggacaaagcttatgctcgggaggagatgaggatagtgagactgatctctcgtacatggacgagatgtttatgttattagacgaggatcttgatgatataagttcgggagattaagtatgcatgtctgtatcgtacgttcgaacatattcatacccatgacatgtatataaactatacgaggcatcttgccgatcatcatcagcgtgtcagcaagttaatttagtggttaaaaaaaaaaaaaaaa

SEQ ID NO: 373 - DNA, 988 bp, Eucalyptus sp.
ctcatctttatacttcatatttcgccataaaaccgatattgttcatcccctcttcgtccccagttcttgttttggtgacctgtgcctcttgttttctctctagtttgatacatatatgcctggctatctatagacgagatcgacaacgccgagattggaagcgatgggagataacaatgtgaacttgccacccggttttcgattttacccgaccgatgaagaactcgtcgtccatttccttcaacggaaagccgccctcttgccgtgtcatcccgacgtcatccccgatctcgaactttatccatatgatccgtgggagcttgaagggaaggccctgtccgagggcaacaaatggtacttcttcagcaggaagacgccggacaggatcacgggcaacgggtactggaagcctatgggtgacgaacccgttttcacgagctcgagcaagagagtcggaatgaaacagtcgttggtgtattacttaggagaagctccaggtgggacgcgaactaattggataatgcatgagtatcgtctctccaatggtactaattctggtagcagcagtagcaggtcgtccaaaagaaaaggatatcctaagattgactatagcaaatgggtggtgtgccgagtttatgagcacggtgacgacgacaacgatgacaacggagcggagctttcgtgcttggacgaggtgttcttgtcattggacgatcttgacgaaataagcacgccaaactaaatagagaagatagagaaccataagcacgtggtcagattaggggactcactaaagaggttcaaatcaaattgtagagctctatcgctgttgggtgggcgggttaatcattgtggcgaaaaccaaatagcacttgtaactttccctttttctttttattggaaaatgctctctagggtttacttatggtgcaagcaaaatgtcggcatccttttataactaattgaaagaatgcccataaaaaaaaaa

SEQ ID NO: 374 - DNA, 908 bp, Eucalyptus sp.
ggaattcattgacgacgacgagttaacgtcgaccaatcggagaaattggtaaagaaaggcaagatcatcaagaattaccatacatagaataatccgcagttgctcaaatttgctggttttggcttgtgatcatgagagatgtaaaggaaaaggaagaaaaagatgatggcaagatgctgaagctaccacctggatttcggttctcgccgacagacgaagaacttgtccttcactttctgcatcccaagaagcagcaggcctctctgtctcctctctatgctcacctggttcctgatctcaagtctcaccaccatgatccttgggacctccatggaaaggcgctgtcgaatggatcccactacttctatttcagcagaatgatgaacaatcgaattacggaaaatgggtactggaaagatttagacatggaagagccagtgtttggtgaagctggagaaattataggaatgaagaaatctctgactttccacattggagaggctccaacaggtcaagagacaaactgggtgatgcaggagtatcatctcgtgtccttccatggattggctaattcaacacaagaacccggttcgctggttctgtctcgagttcatgaaagcaagacaagtcatggacaaagcttatgctcgggaggagatgaggatagtgagactgatctctcgtacatggacgagatgtttatgttattagacgaggatcttgatgatataagttcgggagattaagtatgcatgtctgtatcgtacgttcgaacatattcatacccatgacatgtacataaactatacgaggcatcttgccgaccatcatcagcatgtcagcaagttaatttagtggttgtacattgctgtgatgtaattatatggccttcttatttaaaaaaaaaa

SEQ ID NO: 375 - DNA, 1018 bp, Eucalyptus sp.
ttcaacaacacagaatctttagctgctgagccaactcgaaaccctagggcacaaaacaaccagatatggaggagtatccgacaggtttcaggttctacccaactgaggaagagctcatttcgttctacctgcacaaccagcttcacggccttcagcaggacaagattcatcgtgtcatcccagtcctccacatcttcgacactgagccatggaatctcccacagcttgcgggagagctgtgcagagaagacagagagcagtggttcttcttcgcgcccatgcaggagagggaggccagaggagggcggcccagcaggagcatgaccaccggctactggaaggccaccgggtctcccggttacatctactcatccgacaacaaggtgatcggcgtgaagaagtcgatggttttctatgtgggaaaagctcccaaaggaagaaagacccagtggaaattgaacgagtacagggccattgaactctcgccgaccaatcccaattcatcaagcagtaacatttccattactaagctgaagcgggagctcaccttgtgccgagtttatgtggtgtctgggacgtctcgagcatttgatcgccgaccattggaagcagtggttggagagacaacaatccagggtgggggctgtgctactagcagtggaggcataggcggtggatctggagatatatcatcatcaggaatagtagcaggcgatgtaggaagttccaatcaatgggagacggcaagtttggaagaaccaacgtgggattgggaccaactggattggctctaactttatgtagcagttctctgatgatgaagtgagcttctccaagtatcaatatttttacattcacagtcgatgtgttgaagagcttgtgactcgtggtttataagaaaatcatttgatcaagattgaataccagtcaatcttgaacaaatgttagaaaaattagggtcagtaaaatgtgggagtatcttgtaaaataataaggaatcggtgagataaaaaaaaaa

SEQ ID NO: 376 - DNA, 1115 bp, Eucalyptus sp.
ccagcaccagcaccagcaccagcagcaccgccgcccgcagccgccgcccggatgcctctccgccgctctctctctccccgttgagctctctggccatgcgttcttgggctccagctcgctaaagtcacgagggtccgtcgccgccgcgaggttgctctcgttcttcttcgttttcttttttgttgggggaccgtgtgagaaaatggaggtgccgaggttcttcgcgagcgccgcggggatcaagctgccgatcgggttcaggttccggcccacggacgaggagctcgtggtccattacctgaggcggaaagtcctggccgtcccgttgcccgccgccgtgatcccggagctcgacgtgttcgggaccgatcccgggggcctgccaggcaatttgagggagaggaggtacttcttcagcagaagaaataggagctccggtggccgtgagtgcatcagagtcgcagctggttttggctattggaagtacaaaaccaagagcaagcaaatcttagcttctgatggcacgggaaaccaggtcattgggatgaggaagactctggttttctgcgaagggaagcgttcggcttgtgatgccgccggcgctcgatggatattgcacgaatttaccatcgcgggcactcgcgagaactcaaaatcgacctcgatggctcgcgcgggagatgaaaattgggcggtctatcggctgttccagaagaaaacgaggcccaagagaagcgacaatggcaatggcgatttttctcatcgcaagaggaagaagagtagttcagtgatcgatctcaggagtgaagccattgctggtgattcaccaggcactcctccaccaccatcatctccgtgttcaagctcaatcactgacaatggctcttcttgcaaagcgttggatcaggaggatattagcagctcttctcgctagtttttttatccatctacttagatttcagatgcagtaaaatcgacctctcttttttcaccgaatcattagtcctttctcgcacagcgaaattacacattgccagcccaaaagaggcggggaaaggaaacgaagtgccattttcacatttcaattggagaattttcttgctctaaaaaaaaaa

SEQ ID NO: 377 - DNA, 1384 bp, Eucalyptus sp.
cccacgcgaccatcttcaatttctgccgcagccaggctgtacttgccatcgtccgccttcttgccttaaaagggtcttcttgttttgatctgccatctttttggggggagagagagctggaaaccttctctttttttccgtgtttcgggaagagccgagcggtcgtgaatttgaggcggaactgttgagaggaaaagcctgaatttttgtccgtttaaaatcttttttttttggggaggcgaaaagaggttttaataaggcagcgtatttggcgagatggataagcttaacttcgtgaaaaatggggtcctacgattgcctcctggttttcggttccacccgacggacgaggagctcgtgcttcagtacctgaggaggaaggtctactccttcccgttgcccgcctctatcatccctgaagtcgaagtctgcaagtccgatccttgggacttgcctggcgacttggatcaagagaggtatttcttcagcacgagggaggccaagtacccgaatgggaacaggtccaacagagcaaccgtctcagggtactggaaggccactgggatcgaccggcaaatcgtgagctcgagaggcagtcagagccaagtggtggggatgaagaagaccctcgtcttctacagaggcaagcccccgagcggctccaagaccgattggattatgcacgagtaccgcctggtcaaccctgaagcttcggtccctcccaagatcatgaacttgaaccagacccctgttgagccaatggaaagctgggtcctgtgccggatattcttgaagaggaggagctccaagaacgaaggcgaaaccccggtcccctgccaaaacctcaaggaagctccaaaatccaggaaaaacaagcccgtgttctatgactttatgaccagagacctgaacctggctccttcgtcttcttcctctgggtcgagtggggtcaccgaagtgtcctcccataataatacagatgaacacgaagagagtagttgcaatagcctcagaaaagctctaaagcactaggattttgcaccaaatctaggttttctcgaaccaaagtttccggcgcatccctgtttaagccagtttaaaagaagaagaagaagaagaagacgaagaagaataacaaccctcgaggagtccaagaggagtccacatatctggtcttgttaggtttcttttagttcgcatctctttctctgtaatatcatgggactagagacagagagatgtccacagaagaaagttgaaaggggagaagtttcggctattaacttgttttgctaacatctagagtccatggatgttgttaagagtcatgatcgaccgatactgcatgtattaatctagggaatttcagagtttaaaaaaaaaa

SEQ ID NO: 378 - DNA, 1233 bp, Eucalyptus sp.
attttcaattcccatagccttgcttttcctctctatggctaagacatattgcagacgctaggtggttttagcatcagcactttgttttacctgcttttcactcctttccagtttcgagtttcgggtttcgagtttcgagaggtggcaatgaatcacgaactccctcctggttttagattccaccctacagatgaagaactgatcgtgtattacctccagaaccaagtcatgtccaggccgtgccctgtgtccatcatctccgaactcgatatttataaattcgatccatggcaattgactgaaaatgccaagcttggcgagaaggaatggtacttcttcaccctgcgtagccggaagtatctgaacggggcgcgtcctaaccgagcagcagtttcggggtattggaaagccacgggttctgacaaggcgatctatagcgggtctaagcatgtaggagtgaagaaatcccttgtgttttacaaaggccggccacctaagggcttaaaaacggattggatcatgcacgagtatcgtttggctgattcaaggacgaacgtgcaacatcgctctatgaaattggattgggtcctatgcaggatatacaagaagcaacgctcgagtaaatctttggatagaaaagtggaagacttccatggccaaagtaaccgaaccatgacgaatgaggctagtgacaagcaagtcatgagattacctaacttttgctcacttactcctgatctgttgcaattggactactttggtcccatctcacagtttctgataggcagctcataccatccaacctttgatggccaaaacatcattgttgatggtgaagcttatggagctgagaagaaacttcagttacatggaaacaaagtgtcttgcctttatgcagatcaagggaaattatgaccaaacagaaaaatctcttaagccacgcaagatatgtctgccaaacactgtatatggtgtattgtgatcgcttgcaggctgataaactaaaagaggattgtgctgaccgtcttttaaatttgtgaaatttgtgtgtttagacttgagagcgtacatacttcttttgacaagttgtgaaatttgtgtgcaactaattttgaaatgtaatggttcttgaagattttagccattctgcaatagcctctaagtttgacaagttgctacatccagcagttacaattgaaagcaaaatattacttctttttagcaaaaaaaaaa

SEQ ID NO: 379 - DNA, 1288 bp, Eucalyptus sp.
gatggaggatttgccaccaggctttcggttcttcccgacggaagaagagttggtttcgttctatttacgaagcaagctcaagggaacaagaggggctctgcacgggcttattgaccgggtcatacccgttcttgatatctacgagttcaatccgtcggaccttccacaatttgcaggagatctatgccgcagagatccggagcaatggttcttcttcatcccgaggcaggagagcgagtaccgtggtgggaggccgaggcggctcacgaccactgggtactggaaagccacgggctctcccggtttcgtctactcaaacaatcacattgtgggagtgaagagaactatggtgttctacacaggacgagctccgaacggtgggaaaaccgaatggaagatgaatgagtacagagccattgaaggggaggctacttctcctcaagacatctcagtggtggtatgtgatgccctaatccattttttttttttaacgaaaaactgttggataatctatgtcacgcacgtatgaaatagtttaacgtggttgaaaatgtttctcgcgtaatcttattctggacatggttatgctggaggtggtgcaactgcaatggcattaacagtaatcaagacgaaaaaagatccgcgtaacctaagtgcaagtgcttgtaccaacctgagcatactctcgttcgtctttattttgaatgaataattgcaggcgacgcaagaattcagcgtgtgccgggtgtacaagaaaacaaagaccttgaggtcattcgaccgaagaccgataggagatataattggaagcagcagccacacatttcaacagaacaccatgccaaatgatggtcgacatcctcaggatatgacatcatctcgtcggggtagtcctccacccacggagcgagcaagctcctcggcagacagttcaagcgcctccggggaccatgggacaattccgtcgcaagcagggggattaggaagcggtattgacatcgagatgctgcccggtgagagcgaattgtccttgcaggactgggaacagttctggtctggtcctaactaagaatgttacttcaatacgtataaataaacaatcgcagattcatgttgtcatgatttaggtagatgcttagttctttcgaattacctcggtggtgctaagtagatgcttagttctttcgaagtttatagtccgttcaaagtgggtcagtatcttaaattcgaccatggatgtagaactgatataaacgtctagtggatgttttctcgtgtaaaaaaaaaa

SEQ ID NO: 380 - DNA, 1293 bp, Eucalyptus sp.
ccagccttcctttgctctggaggttggcctctcgagtccctctctctctctctctctctctctctcatcatcgtcatcatcaccatcctcagctaaagaatagtttatcgagtgtggtgggaactctactctcgccaatcaccgaccgttgtactcctcaatttgtctttgagctcttcgtgttcagctgttgctccccgctgaaatgaagggcctgtctgtttcttctggctctggccttcctcccgggtttagattccaccccactgatgaggaactcatcatgcattacctaaggaaccaggccacgtctaggccgtgcccggtgaacatcatcccggaagtggatatctacaaattcgatccctggcaattacctgacaaagcggagttctgggagaacgagtggtacttcttcacgccgcgggaccggaagtacccgaacggggtgcgccccaaccgggcgaccgtgtccgggtactggaaggccacaggcacggacaaggcgatctacagcgcgtccaagtacgtcggggtcaagaaggccctcgtgttctacgagggccgcccgcccaaggggatcaagaccgactggatcatgcacgagtaccggatgaccgaagtgaaaggacaagccaagaaacggagcgggtcgatgagactggatgattgggtgctgtgcaggatctacaagaagagggcaaccggcaagacattggagcccaggatcgaagaatccaaccataatgtccaggcgaccgacaaggcctatgccaatctcgatgcaaccgacccgacaatgctgaaattcccgaggacattctccctgacccatctgctggaaatggactacttggccccattctcgcacatcctatctgacaatccctacagcgcaatctttgattatcaaaacaccataagcagcaacaactctgcaaatgactctgctgatcagaaaccacacgggggacattttccccaccacgtggcagttcagaacagtgccttgaaccagaacatgatcatcaaccccatctttgacctccagtgattcctgggggggaccccaaaaaatggaaaaaaagagaaaaaaaattcatggcttttaaatagaaaggagacttgaaatttgattatgtgaagaattgaggattggcaggacaccagcaactcaagaaccgaaaaaattctgtaatttgtttgcaagggttttatatatatatatatataattatatatatatataaaattatagaatgaatctgtgaaaatttttacgtaaaaaaaaaa

SEQ ID NO: 381 - DNA, 1211 bp, Eucalyptus sp.
ctcggaagaagttgtcgcggggaagaattgtgttgagggttcccatcctctcgtccaccgccaaaccctaaagaaaagagacgttctctctctgctcctcctccttgttgttgggctcaggttttgtgtttgggttcttgaaatggggttgagagatattggggcgacgctgccacctgggttcagattttatcccagtgatgaagagctggtgtgccattatctgtacagaaagattgccaatgaggaggtgctgaaggggagtttggttgaagtcgatttgcacacttgcgagccatggcaacttcctgaggtggcgaagctcaacgcgaccgagtggtacttcttcagcttccgcgaccgcaagtacgccaccggctaccggaccaaccgcgcgacgatatcagggtactggaaagccacgggcaaggaccgcgtggtgcacgacccgagcacgcaggaggtcgtggggatgaggaagacactggtcttttaccggaacagggctcctaatgggatcaagaccggttggatcatgcacgagtttcgcttggagtccccgcatatgcctcccaaggaggattgggtgttgtgtagagtgttctacaagagcaaggaagataacgccatcaacacgttgccgagcccacactacacgttcaaggaagcaacggccgcatcatcagctccatcggcgaatttcgacacgtcccattatatttcctccccgaatcaagccttctcttgtgggatgatgacctaccctcaggttgcttcgttgtcctcaacgtcgtcgtctctcctcagccacaagccccactccacaccgaatcttccgcatcagtccaagggagcaagcaccaagctcatcgatgatggttacggattcatgtgggacatgaacttcggagacaacagtttggtaggagatgcgttgccctcgaacttggatgacatgagcattgacatggacggtggctcagttttcctctagttagcaactgcgtcttccagcacattcatgcagtcgtgtatagagtcgaatgctgttgtacactatgacttttgtgtccgggcgagaatttgggagttcttgcttgcttaggtctgtaacaagttagtgtcggatataggttctgtttgatagtgcttcgggttacttgtgaattttcgttatgtacatagggatagatgaaagatagtcagggatt

SEQ ID NO: 382 - DNA, 1355 bp, Eucalyptus sp.
cgacttcgaaagttgaaggagttcagagcttggagagggagaagaagcagggaccaaagagttgccgaagaaggcgaacagggtcgagaagagaaagagagagagagagaagatgaagaaggcgcagttggcgttaccagcggggttcaggttccaccccacggacgacgagctggtgaccgattacttgattcgcaagtgcgcttcgcaacccatttctgcccccatcattgccgagatcgatctctacaagttcgacccctgggaccttcctgaaatggctctgtacggcgaaaaagaatggtacttcttttctcccagggaccgcaagtaccccaacggctcacggccgaaccgggcagccggaactgggtattggaaggcgaccggagccgacaagccgatcggccgcccgaagacgctcggcataaaaaaggcgctagtgttttacgccgggaaagctccgagaggagtgaagaccaattggatcatgcatgagtaccgcctcgccaacgtcgatcgatccgctggcaagaagaagaactcaaggcttgatgactgggttctttgccggatatacaacaagaagggcaccgtagagaagcatttcccctccgcgctcaacaaaacggcagagtcccccgaaatggacaccaagccacagatcgtcatgccggcggcgctgaacccatacacacctccacaaatgactgtagatcacatgtacatggactcgtcggagtcgatgccgaggctgcacacggaatctagctgctgctcggagcaagtggtgtccccgaacttgtcatcgtgcgagaaggaagtgcagagcgaggcgaagtgggaggattgggagaacaatctcgacttcatggatgacttcttggacgatccgttcccgcaaggacagctccagtcggatcagttctcgactcttcaggacatgtccgcctacttgcagaaaccattttgaacaagtccgttcagtaacgcagaagtagaatttgcttttataggagcctgaagcattccattcgcgttggtacgcattgacaagatggactgattgctcatgtggggctaatagactagagttagtcctaggatttttgcttgttgccagagagaagcaaagcgttgtgcatccagtagcacggtgaaaacaatttgaccagctctaaattggccaggtgacgacgcggcagaagtgccgcaatcttgataggcctgtatagttagtgtttagcatcatgttacctcctgtcgtctcctgtaaatacctgatgaaagtctgtagggaacttgtttgctgtaagattatagcaacattgtttcaatatttcataaaaaaaaaa

SEQ ID NO: 383 - DNA, 1021 bp, Eucalyptus sp.
gttcgtgcgaaggcttcagacgcttcagggttgggagagctcttctgggttctcgctcttttccactcaagagctgcaagaaagggaggtagcagaggagataagagagagagagagagaaggtgaatgaaggctgagttgaacttaccagctgggttcaggttccacccaactgacgacgagctggtgaaccactaccttctcccgaaatgcgcttctcaggccatcggcgtccccatcatcgccgagattgatctctacaagttcgatccatggcagctcccagacatggctttgtatggtgaaaaggagtggtacttcttttctccgagggaccggaaatatcctaacggttcacggcccaacagggctgctggaaccgggtactggaaagctaccggagctgacaagccgatcggacggcccaagccgctcggcatcaagaaggcattggtgttttatgctggaaaagctcctaagggagtgaaaaccaattggatcatgcatgagtaccgtctggcaaatgttgaccgatcagccagcaagaagaacaagaacttgaggcttgatgattgggtcttatgtcgaatatacaacaagaaaggtcagatagagaaacactacgtgtcggaccaaaagcctgtgccgttcccagaaatggaagataagaagccagagccgtggatgctcaaccagagtgcatgctcgccactgtcacaactcgtgcagtcaccaatgaccaacgatcttctacacatggacacctcggagtcagttccaaggttgcacacagagtcgagctgctcagagcatactttgtcacctgatttcatgtacgagaaggaggtccagagcagtcctagatggaatgagctcgacaagtcgttcgagttcatcaatagctacttcttagatgaaccctttgcagctcaagtgcagtatcagccagttcaggtctcgccattgcaggacattttcatgaaaccattctgatccaaaacccaaaaaaaaaaaaaaaaaa

SEQ ID NO: 384 - DNA, 1358 bp, Eucalyptus sp.
cgaaagttgaaggagctcaaaagcttggaagcgaaaagcagggaccgcagaatcgcagcagaacgcagagtcgagagagttgagaagagagagagagagagagagagagaagatgaagagggcgcagttggagttaccagcggggttcaggttccaccccacggacgacgagttggtgaacgattacctgattcgcaagtgcgcttcgcacgccatctccgttcccttcattgccgagatcgatctctacaagttcgacccttgggtcctcccagaaatggctctgtacggcgaaaaagaatggtacttcttttctccgagggaccgcaagtaccccaacggatcacggccgaaccgggcagccggaaccgggtattggaaggcaaccggagctgataagcccatcggccgccccaagacgctcggcataaaaaaggcccttgtgttttacgcggggaaagctccgagaggagtgaagaccaattggatcatgcacgagtaccgcctcgccaacatcgatcgatccgctggcaagaagaagaactcaaggcttgatgactgggttctttgccggatacacaacaagaagggcaccatagaaaagcattcaccctccacgctcaatgaaacggcagatttccccgaagtggagatcaagccacagattgttatgccggcggcgctgaacccgtacacatctccacaatatgcggattcgccgatgactacagatcacatgtacacggactcgtcagagtttttacccaagctgcacacggattctagctgctcggagcacgcggcgtccccaggctcagcttgcgagaaggaagtgcagagcgaggtaaagtgggacgattgggagaaggccctcgatttccagttcggctcaatggatgacttcttggacgacgctctcgtgcaaggacagtttcagttggatcagttctcgcctctcgaggacatgtccatgtacttgcagcagtcattctgattgagtccattcgggttgctacacattgaaattgcatgatccactggcgcggtgattaatcaagaccatctctgtcttgcactaattgctcatgtggggctatagactagagtccagggattttgctttgctgggttttgccagagagaggagcaaagcgttgaggtgcatccaataacacggtgcaagtaatctgtccggctccaaattggccaagagatgacacggcagaagtgccgcgatcttgatgggtttggaacttgtaaatacctgatgaaagtctttagtgaaattgtttgctgtaacattgtagcaaaattgtttcaatattttattgaaggaagattgttttaataaaaaaaaa

SEQ ID NO: 385 - DNA, 1210 bp, Eucalyptus sp.
cgggggttgagcaagttcaaggcttggtagaaaagggcacggaccggagagagtcgcagaagaagacgaacagagtcgagaagagagagagagagagagagagagagagagaagatgaagaaggcgcagatggagttaccagcggggttcaggttccaccccacggacgaagagctggtgagcgattacttgattcgcaagtgcgcttcgctgcccatctccgcccccatcattgccgagatcgatctctacaagttcgacccttgggaccttcctgaaatggctctgtatggtgaaaaagaatggtacttcttttctccgagggaccgcaagtaccccaacgggtcacggccgaaccgggcagccggaactgggtattggaaggcgactggagccgataagccgatcggccgcccaaagacgcttggcataaaaaaggcccttgtgttttacgccgggaaagctccgaaaggagtgaagacgaattggatcatgcacgagtaccgcctcgccaacgtcgatcgatctgccggcaagaagaacaactcgagggttgatgacggggttctatgccggatatacaacaagaagggcaccatagagaagcatttcccctccgcgcacgataaaccggcagagttcccggaaatggagaccaagccgcagattgtcatgccggcggcgatgaacccttacaacacacctccgcaatatgggtcgctaatgactatggatcacacgtacatggactcgtcggagtcgatgccgaggctgcacacggattctagctgctgctcggagcacgtggtgtccccggattcggcgtgcgagaaggaagttcagagcgaggtgaagttggaaggttgggagaaggccctcgatttccagttcgaatcgatggatgacttcttggacgaggcgttcgcgcaaggacagtatcagttggatctgttctcgcctcttcaggacgcgtccacgtacttgcagaagccattttgagcaagtccgttgagaaaacagaagtggagttctcgatgaaattgcgtgatccaccagcgtggtgatgaatcaaagacaatctctgtcttggacaaattgctcatgtgggggctacagacttgagagtcagtcctgggattttgctggagagagaagcaagtgttgaggtgcatccagtagccaccggagaaaaatttttgtagtgcttggc

SEQ ID NO: 386 - DNA, 965 bp, Eucalyptus sp.
gggaagaacaggaaatcatgacttggtgcaataatgacaataagagtgatgagcagagaaatgagagcgcaacctcaccaccgccatccaacaacaaggccggtgttgttgccaagaggcctccagtgttcaggacttgtccttcctgcgggcatgaatttgaaatccaggaccagactgggattcaggaattgccagggctgccggctggagtcaagttcgatccaacggatcaagagctgctcgagcatttggaagggaaggtgcggcctgatgctcggaagcttcaccgcttgatcgatcagttcatccctacccttcagggagagaacgggatttgctacacccatccagagaaattaccaggcgtgagcaaaaacggcatgatccgccacttctttcaccggccctccaaagcgtacacgaccggcaacaggaagagaaggaaggtccacacggacgaggaaggcggcgagacaaggtggcacaagacgggcaagacccgcccggtcttcatgaaaggagagctcaagggctacaagaagatacttgtgctctacaccaactatgggaagcaaaggaagccagagaagaccaattgggtgatgcatcagtaccaccttggcaacaatgaggaagagaaagaaggtgagctggtggtatcaaaggtcttctaccaaacacagccaaggcaatgtggttcgctcatgaaagactcatcatcacttaagctgaatggaccgagcgggcacgagaatgctaatctcaagaacaatcctgccctggtggagtactataactcttcttacatatcttttgaccaaggaagccaaaatagggcaagctctcaacatcagatgatccctcgccattttgcagtccatggtgggtcttcttttgtctcttgaacatacatttgaggaaacccagaaaacgaagagtatattatgcaatgcttttaactt

SEQ ID NO: 387 - DNA, 1189 bp, Eucalyptus sp.
ctcgagagaatcaagaagatagggcgcagagagagagagagagagagagagagagagggagagagagatggaacaacgagatagtagtgatacaaggttacatgacaagaagaagaacaaggatgatgaggaagaagtggtgcttcccgggttccggttttacccgaccgacgaagagcttgtcgggttctatcttcgccggaaggtggagaagaagcctctcaagatcgagttcatcaagcaggtcgatatctacaagtacgatccctgggatctccatgatgttagcaaaatgggagagaaagaaggctacttcttctgcatcagagggaggaagtacaaaaacagcataaggccaaatagagtgactggatccggattttggaaggccacgggcatcgacaagcccatatattccggtaaatatccccacaattgcgtcggcctcaagaagactcttgtttactaccgcggctcggctggcagaggtaccaaaactgactggatgatgcacgagttccggctgccgcctgtggagaaaggcggtgatctatcagatgcaaatgacacagtcactgaagaagcagaagtatggacgctttgcagaattttcaaacgcatatcctctagcagaaaatacattgcaacaacagaatgcaaagagaccaccttcaagcagagctcaatcaattcgtgttctaaatcgagcagcttcgaatctgagtacggagaccaatgcctgagttttggatcggaccattcggccgtccaaccaagcgaccaaaagccagcgacccgccatgttgagcaagcacagctctcatgggtcaaccattgccattccatccctcaggcccctgtggcgacgccatgcttgagcctttggaatctaaatggagacgatattttcgcgaacggaataaactgggatgaactgagatcgatagttcacgaagagtgattcttcgtgaaaatttgtgagactggtgggaactggaattggaggatccgagcgcaaatgagaaggattcgaatcaagggatgaacatgatgcaactgaagtttttcttcttccttggatttattactaggaaattaggacagatatggacctccaatcttagtttggcatggatgtaaacttgaactgaccagtttgacaatagtagatttttttttaaaaaaaaaa

SEQ ID NO: 388 - DNA, 1341 bp, Eucalyptus sp.
gagattagagttgagcagatactccagacgagagagagagagagagagagagaaggacagagaggcggcgagagatgacggtggatatggagctgccgccggggttccggttccacccgacggacgaggagctggtgatgcactacctcgtccggcgctgcacctcgcagccgatcgccgtccccatcatcgccgagctcgacctctacaaacacgacccctgggacctccccgggctggcgctgtacggggagaaggagtggttcttcttctcgccgcgggaccggaagtacccgaatgggtcgaggccgaaccgggcggcggggagcgggtactggaaggcgactggggccgacaagccgatcgggagcccgaagccggtcgggatcaagaaggcgctcgtgttctacgccgggaaggccccccgtggggacaagaccaactggatcatgcacgagtaccgcctcgccgacgtcgacagatccatccgcaagaagaacagcttgaggcttgacgactgggtgctgtgccgcatatacaacaagaagggcgcgatcgagaagaagcagccccacgtgcagccgcagcccccgccggtgccggcgccggcgccggcgccggtggcgatccagtctctggggcccgcggcggccagcagcttcacggagtacgaggacgagaagcccccggtcctgacgatgccggcgctgcctcccccgccgccccccgtgctgaacgatctggtgcacttcgacacgtcagactcggtgccgaggctgcacacggactcgagctgctccgagcacgtggtgacgccggagctcgcgtgcgaggtccagagcgagccccggtggaagaatgaatgggagagcatgctggacttcgggggcggatgcagctacgggtacttcactggcggcgccgccgccggtcagatgtcgccgctgcaggacatgttcatgtacctgcagaagccgttttgaatttttctcgtttcgacaaccacgagcgtaccgagccagatttggcggagcacgcgacggtagcacgagaccgcaaagtccatgagtgcgctggtgcgggcgcggcatccgggagatgattatttcgaccgggcagcgatgtttggacgtttaattgtagcagcagatttagtcgcctatagcttgtgtacatcatctgtgtatatgcatgtttcgtgtatgcatacaaaaaccattagtctatgaatgaaattagggtcgtctcttcttgtgaaatatccaaggctgtaagagaggatttgagaagatgtaattgtatctaacgaccgataatgaaattatctatttaaaaaaaaaa

SEQ ID NO: 389 - DNA, 1375 bp, Eucalyptus sp.
tgcgccacaagcctctcttaccttcttgaatatcatcacctgatcgaaagactatcgaaagcctctcttgccctccattgaactccagatttttcaattcatttgccatttagaacctcaaaggaccgtgtgaaactattgggacttcaaagagcgttatgatgagcggcaccatgattttcgaaggagatgaacagatggaattgcctccggggtttcgattccacccgactgacgaagagctgatcactcactacctcaccccaaaagttcttgacggcagcttccgtgcaagagccatgggggaggttgatttaaacaagtgcgaaccgtgggacttgcctgggcaagcaaaaatgggcgaaaaggaatggtacttcttctgtgtgagagacaggaagtacccgaccggtatgaggacgaatagagcgaccgaagccggctattggaaagccaccggtaaagacaaggagatccgcaggatgaagaaggtggtcgggatgaagaaaactctcgttttctacaggagaagagctcctaatggtcagaagaccaactgggtcatgcacgaattcaggctaggagacggctattatcaacaccatctttccaactcacaaaagaacgactgggtcatttgcagaatctttgaaaaaagacctgatgggaagaaagctgatcagcctgagactctgcctggcggtctagagaggctgagctcgtttgacaacgaaccgaaagcatctcttttgcctctgcctccactggtggagtcgtctccattcaccaccacctccttctccgatcgacccgaggatcgcaatgttcagaagacttccctcttctcttctccatcttcatcggagctagaccagtctctcggccccacgccttcgttcggctggtcggacacggtcttcatgcacgagcaggcaattctgaggatgctgctcgagaactcggcgtcaaacgcgaaggctgagtacgcagacttctcgcaagcaagacgccaggacagagaggcgacgatgccgacgtcttttcagtgcgatgtggattgcctttggagaaactgaggctggatggagatggaagattaggcatcaggtgaaggtgaagaagagaacgatggtttagatgatttggatctttctttttgctctttctggtttgttctccattgtttgaagaggccttttgtgtttgtgcgtgcgtttgtagagtgtctctgcatcctcatcactttttttttttcctgctgctttgtctatatctctctataactatccaaggtgaacagccaaggataatttcaccctctggtttttgtcaataaaaagttttcttggaaagcaacttactgcaaaaaaaaaaa

SEQ ID NO: 390 - DNA, 1550 bp, Eucalyptus sp.
gaacaagctagaaaagcagattacactcaatcggggagatgaatacgatatagctgaagagagtactcaaaattatctgaaacgggctttacatatagttctccaatccccgatatcttttctctcctgtgctaaactcggcgcatgtttcatcagagttggggagagcaggagcggctaaatactgttgatttggatgagagactcgaagcgaagagaaagagatcatgacatggtgcaataactccgatccggaggggaaagcaattcagattgtcgccggcgatgcttctagaggcaactgcataatcgatccccaaggtagcgctgtccggacagtaacgtgtccttcatgcggccacaatattgaattgctagatcagggcatgatacatgatctgccgggcttaccgtctggggtgaagtttgatccaaacgaccaagaaattctggaacatttggaggcgaaagcagcggccgatgctcgtaaaatacatccgctaatcgatgaattcataccaacattagagggagagaatgggatctgctatacccacccagagaagctaccaggagtgagcaaagatgggcaagttcgccacttctttcaccgaccttcgaaggcgtacacgaccgggaccaggaaacggagaaaagtgcatggcgacacggacgggggtgagacaagatggcacaagacagggaagacccgccctgtcctcattggcggggcagtgagagggttcaagaaaatcttggtactctacacgaattacggaaggcaaaggaagcccgagaagacgaactgggtgatgcatcagtaccacctcggtgacaatgaggaggagaaagacggtgagctggtcatgtccaaggttttctaccaaacgcagcctaggcaatgtggggcgagcgttcgagatccatcgctagacaagagatacacgaaggaacatcaggtgttgcacggtacaagcgtggtcgattactacaactacagcaatcctaatttcatttctaattacgaccaagtgaacccaaatagagaaagcccaccacagttgattccgaatttggtggtacaaggtgacgggtcttcgttcatccagttcacaccggatgcaagcaaggggaagcttgtaagaaacagagatggaggtggtggttgattggtcagctcaagaaatatcattattgttgcgtaacaccaacaataagttatgtatatgctttcttgatttttaatatatttttttgggtgatattgacaagggaagctaagtgggaacaagaggaaattgctgcttttcaggccgacgaaaatctggggaagttttttctggatcaagatagtaagttggacgtgaaattttaacttctgtcgagtccttatctgttttattgttttgaaactttcacacgcatttgataggaacacacaattgatgagagacttggttccgtgggaatgctccatttatggagaccccgatgagaatcttgtagaaaggtcatgaaattgaattaaatcatactgtttaaaaaaaaaa

SEQ ID NO: 391 - DNA, 1520 bp, Eucalyptus sp.
aaagcacaaaagccttctctctccacgagttcttcgactccccaaggacgaaagaacacaaacagaaacgaccacatcccactcctaacatcgtcaatggagttggaatcgtgtgtaccgcctggatttaggttccatccaacagaggaagaacttgtaggctactacctcagcagaaagatcaactccatcaagatggatatagatgtcatagctgagcttgatctctacaagatggaaccttgggacattgaagggaggtgcaagctagggtacgaggaacagaacgaatggtacttcttcagtcacaaggacaagaagtacccgaccggaacccggacaaaccgggccaccacggcggggttctggaaggccacggggagggacaaggctgtgctctcgaagaacaagataatagggatgaggaagaccctggttttctaccggggtcgcgctcctaatggaaggaagagcgattggatcatgcatgagtatcgcctccagacctctgaacatgcaccacctcaggatgaaggatgggtcgtgtgccgagcattcaagaagccctgccccagccaaagacaagggttcgaagcatggaatcatgcgtactacgtacgagactacatgaatcctcggcctcccccttcgctcctccccgacgcaagccaagccgtctctttcagccggcaccaattcgctccctgtcaagagcccgtctcgaatcatcaatctctctgggacagtcagctcagtgagcttccgcagcttgatagcccaactctctcgacgagcttaacaacgactaacaactacgtgtcgacccacgaagagtatgatgacgggaggagcaagaacatcaacaatgacggcgtccagttcatcaatgagtggacaagcttggatagcttgctcacatcgcacgtgaacagcagtggcaacgactacaccacgaggctaaccgagccgagcatgcacatgcagtcgagctctctcggtttcgctcgtgaaaccgagagccaggtcggccatttcctagggtgctttccagactcctagcaagaactcatctccttacttcccgcactctattaatccgatactaaggtagccgtgctttacaaataatttgcttttgaacagaacgtcgaatgtcgtctgtcatataaaaaggtttctgcaagatccgcgaagccgagtcttatgatatgaagaaatgggagatagttctccgccttgtttatcatgctgattataggttaagttctacttgtttgacagcttctcaaactcttagtcgttgtaaactggctttgaatgacaatagccatctttgattacatttaacggtcgagggtttgttactacattgtttcgcattcgttgttgtcggctccatatcgttcttcttcatggtgtcctgatgcattccgttgacaaccgggcttgtaacaggaattggccctcctgtcatttgccatttgccatttggtcagtgatgacttttgctaaaaaaaaaa

SEQ ID NO: 392 - DNA, 1234 bp, Eucalyptus sp.
atcattgacaagcttgacatcttgcaatatagttctcctccccctccaaaaaaaaaaagggccaaggttttgaaatttggcttcatcaagaatgaagaattgccttcaaccaaatctcccaccaggtttcaggtttcatccaacagatgaagagctcatccttcattacctcagaaagaagatgacctccactcctcttcctgtctccatcattgctgaagttgatctatacaagtttgatccatgggaattaccaggcaaggcaacgtttggggagacagaatggtacttcttcagtcctagggaccggaaatacccaaacggcgcgaggccaaacagatcggcggcgtcaggttactggaaggcaaccgggaccgacaagatcatattggactcgtccaccggcaagaatctcggtgtgaagaaggcgcttgtgttctaccagggaaaacctcctaaaggaatcaagagccagtggatcatgcatgagtatcgcctagcgaactctcccgttcccatctacagcgacaaagccatcaagcttaaagagttgtccatgcgattggacgagtgggttctctgtcgcatctacaaaagatcaagtgcagcatattccataacaccgatggcgacagcgagcgatgatccggaggaagaacagcgcttgactagagaagatatcaataacgacaacagcaccgtcgatgcgatcaggcccatgatgatgatgaacggttcttcatccttctccaacttgtttgatgccgtggacttctcgatgctgaggaacttcctgtcggacgattacaatggccagtgcagtaatgctaatgatgttagggacgtcttggtctcaactcagagtgcgaatcaagcgagtttggaccagaagatgtttcagagccttcctcagttgacaagctactcagcggcatcgcagaatccgctcaagcgcaagtattcatggaacgaagattcagatgcggcgaatttggtgaagagaaatttgatgagccagacgttcttggatcagcatgtgctcttgagcccgcatcttcatcatcagtttcaagggttttgaattgttagatctccggaaacttgaggggaaaaaagaaaagttgttgtgaggagattcatatgggaatgtaatttatttagcatattgtcaaagttcaccattagtgaaaatatattgtacgtcaatatatgagattttatgataaaaaaaaaa

SEQ ID NO: 393 - DNA, 1253 bp, Eucalyptus sp.
ggataactgagtgttttatttcatggtggatttgatgcagtgtgttagcaaaataatttaagttgatatggagacgatggagtcgtgtgtaccgccagggtttcggttccatccgactgatgaggagcttgttggctactatctgaggaagaaggtcgcctcacagaagatcgaccttgatgttattagagacatcgatctgtacagaatcgaaccgtgggatctccaagagaggtgcaggattgggtatgaagagcaaaatgagtggtacttctttagccataaagacaagaagtacccaacaggaacgaggaccaacagagccaccattgctggcttttggaaagcaactgggagagacaaggccgtctacgacaaggccaagttgatcggcatgaggaagaccctcgttttctaccgaggaagggctccgaatggtcagaagagcgactggatcatgcatgagtatcggctcgaatctgatgagaatggacctcctcaggaagagggatgggtggtttgtcgagcattcaagaaacggaccactgggctgaccaagagcaccctcgaaggctgggacacgagctacttctacgatgagcaaagtggcacaagctcggtcatcgaccctgccgagtgcatctcgaggccagtccttggctacatgcccaattcgagctttgtgtgcaagaaagagatagaagtggcggagaacctgaagctcttcaacccggacgacagctacttcctacaacttcctcagctagaaagtccatctcttcccttaacgaagaggccgatgagctcggtttcgctagtttcagagatcaataacaataaccacaacagtaacaataacgagcacttagaggaacataatgatgatgattccaataagagagtgactgattggagggcccttgacaagttcgttgcttctcagttgagtcaagaggagaggtatgagggcgatggaataaccgcaagctttgatcagcatgacagctcagacatggctttgatgttgctagagaatgctcgagaatgcgaagcgaccaagttgagcagtttcttgacttcaggcgctggatgcgacgctggcggcatatgtttgtttgagaagctatgaatttgttaaggaagagaaaggttttatatctgataagagcatatggccctctgaccttgaatgaggaagagtggatattatttctgttgaacataatgtgttgtgaaagtttgtaaaaaaaaaa

SEQ ID NO: 394 - DNA, 1416 bp, Eucalyptus sp.
tcccctcgcaatcttcttctccactgtactctcttcgatcttgtagttttctttattgggttctctctctctctctctctctctctctctctctgtggtgctgccaaacccttcgagagttcgtgagctttcagctgccatggaagacgaaatcgtagaactgcctccgggcttcaggttccaccccacggacgaagagatcatcactcactacctcaccaagaaagtcctcaaccccaatttcaactcctgcgccattggtgaggctgatctgaacaagtccgaaccctgggatttgcctaagaaagcgcatatgggggagaaggagcggtacttcttcaaccagaaggaccggaagtacccgacggggatgaggacgaaccgggctacggagtccggctactggaaggccacgggcaaggacaaggagattttccgggggaagagcaacctggtcgggatgaagaagaccctcgtcttctacaagggaagggctccgaagggggagaagactaactgggtcatgcacgagtaccgcctcgagggcaaattctcttactacaatctcccaaaggtctcaaaggatgagtgggtggtgtcgaggattttccacaagagcactgggatcaagaagaacgagagcggtctgattccgggcctgtttccgatcgatccttccggtgatgacgagctgccgaatccttctccttctccttcgcttcctcctctcatggatgactcttatttcgcgaggccaatctcaagcttcccgaaaagtgagaatgatttcccaggcatgacaagcgcgtctgcaccaagatcggctgaaggaaattacggggacgaaatgaatgggttccacaggttcaacccaagcaataccaactaccaaacagacccaagtagctcggccttcagctccatgttctccgggcaattgtcgttccccatctcgccgtatgatggcatagataatccggacttcttcttgggattcggctatggaggcagcgacaatactcaggcgatcatccgagggatggcggcgagccaacacgagacgcggggcctggagcagacgctgatcaagggagagcagttcgcgatgtcgaacaacaagtccatggtcagccactcgcaggacaccgggctgagcactgacgcaaacgccgagacatcctcctccgccatctccaagcatgaagccgggaacttctccgacttcctctgggaatagcacgtagcgccaccagctggcttcatcacccgcatatacatacgattcaatttcacaaatagatccagctgtcttctttgtttcgtaggaatctagttaggccatgagttgattgttatgtgtagctggtgttgtacagattgatgatgaatttctgaacattcttcagaaaaaaaaaa

SEQ ID NO: 395 - DNA, 1384 bp, Eucalyptus sp.
gctcgccctccctcaactttccaccatagctttcgttactggcttccccccaaatatctctctctgtattcactgaatctcacatcccctgttttgtctctctctgcttgtctgatgtataagcagcatctcgtgagtggttttagctcctacccttcagaagctttcgcgtcctcggcgattttttgaggtgctcggtttcgggctcttcgattcttgaagaattttcgatctctctcttcttttctttttctctttttatctatgggcgatcagcagtttcgagaaatggagaacatggctaggctcgggaaggaagacgatcagatagagttgccgccggggttcaggttccacccgacggacgaagagctcatcacccattatctgcagaagaaggtgggggacactggcttctccgccaaagccatcggagaagtggatttgaacaagtccgagccctgggatttgccttggaaggcgaaaatgggggagaaggaatggtatttcttctgcctgagggacagaaaatacccgactggtttgaggaccaacagagccaccgaatctggttactggaaggccacggggaaagacaaggagatctacaggggaaaatctctggttggtatgaagaaaaccttggttttctacagagggagggctccaaagggggagaagacgaattgggtcatgcatgaatacagattggaaggaaaactctctctgaattatctccccagggcttcgaagaacgagtgggtcatttgcagggtcttccagaagagctctggtgggaagaaaatccacatctcgagcctcgtggcggcggggtctctcgagaacgaaatgagctccggcttgccgccgttaacggattcctctcctcacgattcgaagacggaatccaaccccggatcggcttacgtgccctgcttctccagcccaacagagttcgaaaggaacaaggaaaacacgaacaattacttcaacaatcccatgttccccatctcctcgaaccccacgaacaccacccccaaaatctcgctcttgagcccagtgtaccctcaccaggccatccccgtcccagccaattggcaacacctggggggctccgtcttcatgcccgagcactcggtcctcagggctctgctcgagggcaccgggctgaacgcgaggcagagcgcgagggcggagcgggaggcgatcagcatctcccaagagacagcgctgaccaacgacttgaacaccgagatctcctccgtcatgcaggatttcgaaatggggaggaggcagttcgaggatcagcagcaagttccatcgaccttagctggaccaatggacgtggacctcctctggaactattcaagttagaaaaaaaaaa

SEQ ID NO: 396 - DNA, 1448 bp, Eucalyptus sp.
ctttcttgatgaagacggcgaactggcgactgcgaacgagacctccccgtcctgttctcgtctcgacgatcagccgcgcgaaccgaaccgacccaattcgagcttgacgcgggagaagatggacggcgtgtgcagcgacggaagggatgggcggatcgtatcgatggccgacgcggcgtcgatgtacccggggttcaagttctcgccgtccgacgccgagctcatctcgcactacctgacgaagaagctcgagggcatcgacaagagcgtggagcagctcatccccgaggtcgacttctctgcccacgagccctgggacttgcccgccaaatcgatcgtcccctcggagagcgagtggttcttcttctctgttcggggcaggaagtatcctaaggggtcccagagtaagagagcgaccgaacatgggtactggaaagccacagggaaagagcgcaatgtgaagtccagctctgcggtgatcggtacaaagagaaccctcgtcttccacctgggtcgggcaccgaaagggaaaaggacggagtggatcatgcatgagtactcgatgaatgcaaagtctcagaatcagcaggattctctagttatctgccgcctgcgaagaagcagtcagttccaaatgggcggtgcctccgatctaacgcaaacgtctgatgttgaccggacagatgtctctgaaggagacaacttggctgaaggttgtgcgaggaattgctctggaagttacaattcacactccgtcgagcaaattgagtccagctccaattcctcccatcaaaagaattccgatggcaacgaggacttttatgcagatatactgaaagatgacattgtcaaattagatgagtcttctgtttctccaactcgcgacagcctgcccactgttccaaataatctagaggcagagctaatgtctcaagattcgcaaacactagtgcaagatttcatatcgccgatccctcctttccagggcaccgcgaatcgaagaatcagactgaggcggcataagccagagaggtctagtaagatagtgctggagatgaaggccaatgactcctctgcagagaaggcagaacctcaaacaggaagctcagggccctcagagagaagaacccgtgtgatcattagtcggtggcttgtgtacggtatcctaatcggcctgaccttattgtttgtttatctgcttggtggtttccaactttccatagagtcgagatgattgtacatacatcctgaactttggttgctggctctgttagaagcaggccttatatggtagagggtttcttcttcttctctctctctctctctctttctgtctttttagagagagagagagagagagagagagagagattatgccagaattggctgatcctatgaccttcaagaatgatgtaagcagtttttcaggaaaaaccctatgcattaaa

SEQ ID NO: 397 - DNA, 1449 bp, Eucalyptus sp.
ggtttcaaaagcttctgcttcatccaaaggatcaatttgtaacttcaggctatatgctttagaagagatggacatgaatttgtccataaatggccagtctcagattcctccaggcttcagattccatccaacggaagaggagcttctgcattattatctgagaaagaaaatgtcgaacaaaaagatcgatctggatgtgattcgcgatgtcgatcttaataagcttgagccatgggatatccaagagaggtgcaagataggatctgggccccagagcgactggtacttctttagccacaaggacaagaagtacccaaccgggactcggacgaaccgcgcaacagccgtggggttttggaaggcgaccggccgcgacaagatcatatacggcggttcttcgaggatcgggttgaggaagacccttgtgttttacaaaggacgagccccacatggacagaaatcggactggatcatgcatgagtaccggctcgacgagggttcaaacagttccgtgggtccgagcttggtttgcgagtcctccccggaagacgggtgggtggtctgccgggtattcaggaagaagagccatcaaagaacactagagagtcctaaaagcacgtcgacctcgtccatggacaccgagatgctgatgaacgcgagcgcagacagcagcgtcctggatcagatactatcgtacatgggaaggactaactgcgaatcgccagagaattatcaagcgcccatcaacatcagcagcatgcaaactcaactgatccatgggaagttcttgcacctcccaaggctggatgacagttcgcacttgggtcaagagaccggcttgaggacattttatcagaagttcgatgaaatccgcatcccagggagcgatgacccctcctccaagcacaccagttctgattacgaaccgaaagctgggactgctgggatcaatgactgggtcgcattggaccggctcgtggcttcgcagcttaatggccagcttgagatcagcgctgcatccaagcaatcgccttatcccggagctccaaacccggtactggccggtccggctccaggcgaccatcaagtagggcaactgtccccgctgcagctaaacagacccaatcaaatctacagtagcgagagcagtttcgactggagcttcggaaagtcgtcgtcggtgaccccatcgaacccgctgcaccacttgtcagtataattatagccaagatatatcgatcaataaccgattagcagctcctacagtgaagttacattttcctgtgtacatgtacgcatagattacttaggaataaacgtgttctctatacaattctcggttaaaatactgcttagtcaccttatctgaaataatcaatgcagtggcattctgtcccgcaatatctcatcttcaacgcaacgtggatttgtcgtttgttaaaaaaaaaa

SEQ ID NO: 398 - DNA, 1513 bp, Eucalyptus sp.
cccaaacgaccctcctttctagggttcgtcttgatcgtgagcctctttcctctttgtttctagcgttggtttagaagaaaggattgaactcttaacatgatcatgaagaacccacaatcatccttgccaccgggatttaggttccacccaactgatgaagaactcatcctccattacctcagaaggaaggtcacatcctcacctctccctgtttccatcattgcagaggttgatatctacaagcttaacccctgggaattaccagctaaagcagcttttggcgagaaagaatggtacttcttcagccctagggataggaagtacccgaatggagcaaggcccaacagagcagctgcttcagggtattggaaggccaccggcacggacaaagtgatcgtgacttcatcttcttcagcatccgcacatcagcaccacgagaaactcggcgtgaagaaggcgctggtcttctacaaggggaagcctcccaagggaatcaagacgaattggatcatgcacgagtaccgcctcgccgagtcgcccgcctacaacagtcgccccaatactaaccccttgaagcttaaagattcttccatgaggttggacgattgggttctgtgtcggatttacaagaagaccaacttgtcccctaccgccggagcctcggtggccacacctgatcaagatctggaagaagaagaggaagaaggcctcagtaacattcaccaaaacgaaatgctaaaacccttcgcggacatccccaacaatcacgttcaaaacaacggaggcctcatgtctcagaagtcctcttcgttctccaatctaatagacgccttggactactcggtgctcagtagccttctatctgacaacaccccgcaaggggtcggcgtgctcggattcgaccaattagctccattgattccgaataacagtaaccatgtggacatcactgatccgcacgtgttcggcagtgggacttataataatggaagcagcaattgctttccccagaagctgccccagctcagcccctcatcatcagctccattcatggaggagaacaggctcaagcgtcaccgctcggacgccgacactgcggcgtatcaggcaaagaagctcctcagccactgcagcttcaccaacactgcgagtcaggcggccgactttccgcagtataacttgatcaatagctacccattcttgaaccagcagttgctactaggacccaataactacgcccattttcatggttaaaacggatggcggaaaaggcgagattaaaaagggaagagacgattgtttatgggttgcgccggacgcgcgtgatataagtgaagtagggtttttagggaaataatattggctgtgcatgcatgatttttctccccctttgacaacgaggggaattagaagtgtaaccttagactgtaaggatccagcagaaagatgcgaatggattgaaacgggaggtctatgctgatgaaaacttaatcgggtttccgtaaaaaaaaaa

SEQ ID NO: 399 - DNA, 1937 bp, Eucalyptus sp.
ctatcctaaattctcactctcagctagctcgaatttcacttgtgcgagaggagaaaaagatatggaaagtaggatctctccgatgaatcaacaacccgcggaaaaggtagtcacggagatcgcgctattacttcagcaggcaatagtcggctacagattccatccaaccgacgaggaactaatcaattacttgaagtcgaaagtaaccggatgcagagaaactttctgcattattccgacactggaaaacatctacgagattaatccatgggatttaccagccaagttcgacgagaactcgatcgttcgatccaaagatcaagaatggtggttcatatgtccacagacgcagaaccaacggattagcaggaagacaccatgtggcttttcttggaagattactggtaaacatatagatattaaggctaaaaatgacgacaaaaagatcggttccaagataacattagttttcattgatggtcggaattccaagggcacaaggtccaactgggtcttgcatgagtttcatccgcatcctgatgatacgggcttcgttatttattgcctaaagatgaagcaatatgagaaggcagatacccatgcagctgtggcaacgaatggagatttttcatcaacgcctcagtttcagaatcacgaagtttcttttagcgagctaaatgaggttattggcaagttatctgatgaagtttacggccagagtgacggatcatatcagaatcgaacaaaatccctagccctgatacaggaagacaatcactactcttcacctaatcaggagcgtctcgaagggactaaagatccctctagtacagaaaattcatcaggaagggggcttgctgtacccgacccaacaaatgatgagttaaatttcccacatccttttcctaatgttgatttttgcagtgcaaatgaagctgaaaaagaaacaataaatcagctggtggctgaattatttcgttctatggaggaggaagtagatgagatgtctggtgaacaagcagataagagctgtgatagcatggattgtgataatccagagcaacttccttctgcagagcatcgtgtccaagaaattcagaaccaactgcgtcgcctaatcacgaacgagagttcctctagtacggaaatatcatccggaagttgccatactgttccagcgaatggagtaggattaggccccggatgccccctcttggtcatgctttgtttcctaatggtgacctttttcgtctaaatgatctgagtagtgaaactgaagcagacagagtaattcagtattgccaacttggagaaactagccgggacaattgtagggctgagaagaaccagcgaccagtctgtgacactcttgaaggagctgttccaggggaagagaaaggatttgctgaagagaaactcaaccatcctcacgacatggaaaagatcataacagagtgcacatcttctgatggagtaccagcaaaaggaaaggcacaggctggggagttcaaagagaaggaaactaccatgattcggccacaggagaagaactttgacatgaagattgaatcagacaacatgttccatggggagagctggactgaatcgctttcaccaacgagatcaattccatcaaccagctgtagctgccgaaacaaatccaccattgatccagcagttcactttgccaggttaatggtacttgttcttgtggtaggcctgattgttgacggaatatgcagaatatctgatagaatcagcgagacaatggaggtctatgcgcttcaccggagattttagcaaatgtcttagatgccacgagttcatttcatttgctcaatgtgtcccctcttagttccctctgtcgcattaatgagtgtctaaggttatcttccccgtttgcgaatgaagttgatatatgttgtgcaaaaaaaaaa

SEQ ID NO: 400 - DNA, 1567 bp, Eucalyptus sp.
gcgcctcctctctctctctcggtgtgccggcggttcatctctcttccatctcaaaggacgagtttttcggtttttatcttccttcaggtcttttcctatggagttcctcatatagatcaaaaatctccacacacacacacacacaacgctttccactcgacacgctgagcatacagctcggtaattcggtcctctgttgtaagagaaaatgaacctgtccataaacggccagtctcaggtgccgccaggtttcagattccatcccaccgaagaagaactcttgcattactacctgagaaagaaagttgcctatgagaagatcgacttggacgtgattcgtgaggttgatctcaataagcttgaaccatgggacatccaagagaagtgcaggattggatcgaccccccaaaacgactggtacttcttcagccacaaggacaagaagtaccctactggaacgaggacgaaccgggcgacagctgcagggttctggaaggccacaggacgggacaagatcatctacagtgggttcaagcgcataggtttgaggaagacgttagtgttttacaagggacgagctccgcacgggcagaagtcggattggatcatgcatgagtatcggctggatgagagcacacatgacccgaatgctctgagtccagctggagatgcatccccagaagaagggtgggtggtgtgccgagtgttcaagaagaagaactatcagaaaaccctagacagccccaagagcccgtcgtcttcgacctccatggactcgaaggccatgcaacagatgctcgccgccactgccaatgatggtgtattggaccagatactctcctacatgggaagaacttgcaaggttgaaagcgagactcccaccaaactcaatctctcccacaacaattacaaccacaacaacaacatcaagtaccccgtttcaaacaccgatctcctccacgggaagttcatgcatctcccgaggctcgagagcccgatcctccctttaatccctgtagcgagcccgccgttcgaccaccaagactgctctttcaagctgtcttaccattcgcttgacgagatgctcgctgagacctcgggacaccaagggatcggtaggtctcccaccccggattgggtcgccatggaccggctagtggcgtctcagctcaatggccaagttgccgagacaccaaagcaactctcgagctgcttcagcgatgaccctggttccgatgtcggcggcctgagcatggatgatgaggtgcagttttcacacaccaaattaagtaacaagccttcgggtcagcaaagtctggagatgtacggctgcgagagcaacgacttgtggagcttcacgaagacgtcgacgtcgtcgtctgacccattacgtcatttgtcggtataacgggagtgccttgagatttgtcatattaaaacctagttgcttcctaaaacctagggtttgatatgttgtaacaacaaagagaagaaggaaccgcctaggttcatgatatatacaggttaagtacatgcatgtagtgaataaaaaaaaaaaaaaaaaaaa

SEQ ID NO: 401 - DNA, 1559 bp, Eucalyptus sp.
caaaatctccccaatccagtcttttctgatcggcagtgccttttcccttaatcagtttcctctcttctcttccgtttcttcgaaagttggcggccatggaagaagaaggtatggtggtgaaccaagggagggagcatcaggagctgatggacttgcctccgggcttcagattccaccccacggacgaggagatcataacccactacctcactcccaaggtcctgaacagctccttctccgccagtgcagtctcggaagtagatctcaacaagtgcgagccctgggacttgccaacgaaagccaagatgggcgagaaagagtggtacttcttttgccagaaggataggaagtacccgacagggaccaggaccaatagagccacggagtctgggtattggaaggccacaggcaaagataaggagatttacagagggagaggcaggctcgtgggaatgaagaaaacccttgttttctacatgggtcgagcccccaagggagagaagactaactgggtcatgcatgagtacagattggagggcaaattggcttactacaatctctccagggccgccaaggatgaatgggtggtgagtagggttttccacaagagcacgggcgtcaagaaagatccgtctccaggcctgctcacaagaatcaattcttatgtcgatgactttctggatatgtcttcacccccgccgcctctcatagacgccccttcttcaagcagaccgagctcgagcttcaccgatggggaaaatgaactgaagggcgtgatcaattcaggcccaagagcgctggatgggaacggcagttacttttattttccggcagattcgactgataaccagaaccaagtactactccaggagcaaggagatcgcatgaattattgtcatgtgatgaacccaagtattgatgccagtcattgccctccacaattatcgaatcatcctcctctctttccctctcacgggtctacaaatcctgaggagtacttgcaccaaggaccaagcgacgtgggatcaagctttggtggcacgggtttcagctgtgggagcaccgatcctgctcttctaagagcaataagggcaaattttggggcatcgaacccccaaaataacaatcagtgcaaagtggagcagttttcatccaatcattctatggttagtctatctcaagacaccgggctcagcacggatgttaacaatgagatatcttctgtaccgatctccaagcaagaggtgggcagctgtgacgcatttgaagacctcgagggtttatcatcagtaggcccgattcaagatttcggtttttgggactactgatcaagattacaaaacatagacagcatcttatagagatgattattttagaacagtgatccctcttgagtatatctagttcttcaggttcttggaaccttatattcctgtacataaaatattcccgatgtccagcacctcttagatccttctcttatcgagggactaaagggaacgtattacgtgattataatttatgaacatcttatgtaaattattgttttaaaaaaaaaa

SEQ ID NO: 402 - DNA, 1614 bp, Eucalyptus sp.
ctccaatgcccctctctttcttctcatccaagtaaactccaactggtccttctctcctctctctctgaactgcgcccgacccttttggcccctctcccacttcgcttcatttgtaagctctcgtcagcatcccactaccggaagcttccaagatatgggtcctgaaacatcaacaccttcaacatctgaaatatctgcacctccatctgctcaaaagactagctccactgctttggcccctggttttagattccacccaacagacgaagagttggttatatattatcttaaacgcaaaatgtgtggcaaatcattccgctttgatgtgatagccgacgtggatatctacaaaacggagccttgggaccttgcaggcaagtcaaagttaaagactagggaccaagaatggtacttctttagtgcattggacaggaagtatgcaaatggggctagaatgaaccgggccaccagctctggttattggaaggcaactggaaatgatcgcaatgttcaacatgaatcacgtgttgttgggctgaaaaagacacttgtttttcatagtgggcgagctcctgaagggaagagaacaaattgggtcatgcatgagtacaggctagttgaagaggagttggaaaaatgtggtaattacaaggacgcatatgtgctttgtagaatatttcataaggccaatttagggccaccaactggtcatcgttatgccccttttgttgaggaggaatgggatggcaaagataatgtggttccgagtgtagaaaccagagaagaagcagtacctcagcgaaatggcatgcttcaggaaatgccgtctcatgtgcctcccgtttgccgtaatgaacttccaactaagacccagtgccttctggctgtttgcaagagtgaaacaatgggcgagactatagatgatccatctgcaatatgtccaactaacagggaaactgcaccgcttcttcattacaaacgaaggagagatattgatttaaactcaattgattcaacgggttcagaaaattcacccaagaaaaccgaaggtccttcttcatctaccattacgacagcaaggtcagctatgaatttgacatgtggattatcaacattggtggagtattctttgatggaatcacttgaaataaaagaaaaaccccatcttcctctctcgacttttgcccccgccaatctcaatacaacagcgcctcccgaatgcttagacttcatccacagtttacgagaggagatttataaggtgtccattgagagggaaacattaaggcttgaaatgttgagcatccggtcgatggctaatgttcttcaatccaaagtcgagcatctgacaaaggagaatgaggagctgaagcggaaggttcaagatgcttagttgctgctcgatggctttgatgttgtagctttgccttttcacctcttccttcttcctggttgttgtactgttgtctatcggtggccttcagaagtccacttgttcgatgtaccttgtaagtcgtcgtagttgtagtgtttctgcctgtctgtgtcccttgtctgtcttgaactaaaagatactttgaaccagatagacaatgattgggcctaaaaaaaaaa

SEQ ID NO: 403 - DNA, 2165 bp, Eucalyptus sp.
ggagagcggagagcggagatggcggggccttcttcgagagagccgcagataacgatggcggcgtcttccatgttcccggggttcaggttctcgccgaccgacgaggagctcatctcgtactacctcaggaagaagctcgacggctgcgaggagcgcgtcgaggtcatcgccgaggtcgagatttgccgccacgagccctgggacttgccagcaaagtccattatcaagtcggacaacgagtggttcttcttttcggctcgtggaaggaaatacccaaatggcacacaaagtaggcgagcgactgaacttgggtactggaaggccactggcaaggagcgcaacgtcaaggctggctccagagttattggtactaagaggactctcgtcttccatttgggccgtgcgccgaaaggtgagaggacggaatggatcatgcacgagtactgtatggatgggaagtcacaggattctccagtcatctgccgccttcgcaggaataccgagttccggattaacgaaggcacggatcaggcttctccgagtcaaagggagctgtcttctgtagatgatagaaacaacgttacatccaagggcggcatcgaagggataactctgtctgaagcaggggaaggcttcgcaagaaggtgcccgagcagctacgactctcattctgttgagcagacggactcggcatccgaatccaaccagaacttattgaacgaagggacgatgacagaatcttccatccaccagaaggatgatacggagttgcccgatgtgaaatttcaggaccctgaagacgacgaagaagatttctttgcggacatactgaaagacgacataatcaaactagacgagtccgcggtttccccagcgccccctcccctgcctatggtgtcccgtcaactggaggccgagaggcgatctcaagagtcgatcatagcgtccctgttgcaagtcctaaacttcccgaccgagccgggccaaagaatcgatgaccccagagagccggaacaagcgataacgtcggcactggatggattagagctgaacaaggaatacgctgccgacaaggacaacaaaccaagcgacgagcaatcacagacgtgcttgttcacgaccattttctccgggaaaacatttggtcgccggctttcggccgcggtcctggcgattgcggtcctcgctgggttgctggtgctcctgctaggagggtacccgcgagcgaaaacggtcgcgcgggacttcgggttttacgttaacttttggaagtaaacgttagctggtgtgtctcgatcgcttttctgatgccggaggatcggttggtggatcggaggagtgttcatgtataccaaaaaagtacgtatagaaaactagtttcattacccgcgtagagagaagcaaatatttcttaagtagtataattattgaagttgtattaaaagggtttttctaagggcgtcatgctttctgatattaaacttaattgtaatttttgcaatagcaaaataattgataatcgtaaattgaaaagataaaataaaaggaaatctatgtctagttaggtgaacttatttgttcaaaagggattagatgatgcaatagaattcaagactaaatttagtccgcgatttaggaactctgaacatattgcgtcgaatgaacgttctctattaaacagtgaaaaaaaaaaaaaaaaaaacccacgttgttactctccccgcatcgacgaattcccccggagaaaccgaggcagcggatcgagcgagcaagatgggtttgaaggaggactttgaggaatatgctgagaaagccaagaccttgccagagagtacaaccaatgagagcaagctcatcctctatgggctttacaagcaagccacggttggaccggtgaacaccagtcgccctggaatgttcaacatgaaggatcgggcgaagtgggatgcatggaaggctgttgaagggaaatcggcggacgaagcaatgaacgattacatcacaaaggtgaagcagctgttggaagaagctggtgcctctgcttgaagtctgtgactctatctatcctctaggggcttcattattgccgtgtttaaaactcgtaccctatgaaaattaagaacactatgtgatcgctctctttattacttttcagaaaaaaaaaa

SEQ ID NO: 404 - DNA, 1614 bp, Eucalyptus sp.
gattcgctttgctcgcatcacaggaaggattcaaacgcaggcggagcgagacgagcgcgtcccccccgcccccccacttctgatcgcccggaatggctggaccatcctggctggtggacagtcatagaattgcaacaaaaatcaggagtgcttctggtgcttctgatcctgagaaagtaaaatggaaaagtaatccaactagagcctgtccaaattgccaacatgtcattgataacagtgatgttgcaaagcagtggccaggattacccacgggtgtgaagtttgatccatctgactcagaaataatgcatcatttgcttgcgaaagctgggtttgaaggtttgaaatcccatccttttatcgaggagtttatacctactgttgatgaagatgatgggatctgttatacgcatcctcggaatttaccaggtgttaaacaagatggaagtgtggctcacttctttcaccgggccattaaggcttacaatactgggactagaaagcgtcgaaagattcttggcgatgattttggtgatgttcgttggcataagacgggcaagactaaacctgtcatggttgatggcgttcaaaaggggtggaaaaagataatggtcttgtacacgaatctggtcaggggaggaaaatctgaaaaaactaattggaagatgcaccagtatcatctaggaactgaagaggatgagaaggatggagagtttgtgatatctaaaattttctatgatcatcagcagcaacagctcgatcaaggtgaaaaaaatgaacagaataatcgggaaagagttgatgctacaacaatgaaagcagatccagtgagtccaaagtctgcgacgcccaacccacctcgtacggagaggcgatcttgtgattctgatccggttcaggattctgcttgtggaggcccccttgctcagcatgttgagacacagtgtgcggatcttgatggtccactggaaatagaaaatccccagcatcgtgagcaaaccatttctgctccagaaatgatggtagatggtgatcaacaggctgaggaagagtcaaaatggtgggacagtgagtcacagaatctactggattcacaacagcttgtggagggattgtccttatgtgacgagtttcttcaatctcaatctcctaatagagatgacataaaccaccatgtggagtcaaaaaaaagaatccttctttctgattatgctaaattaggacctgaagacttgaagaaggatctggaggagtgccacaatctggcacttgatccagcaaatattgagcttgatacccctcctgattttcgattgagccagctggaatttggatcacaggatagctttcttgcttggggcgggagcaaggtggttgactagataggattggggcagttttttgatgtcaggttcatgtaaaattggcctccatcgcctgctaattcgtacctttgtaaccatgggtttttaacaaacttgacatgtaagtaatggtgatgcagcttttgtttctatgtcctctgaactgaatctcttctcacattggtgaacacgtaaatgttgtgaggcatgtttgataaaagtatatgaagcttatttcctaaaaaaaaaa

SEQ ID NO: 405 - DNA, 2180 bp, Eucalyptus sp.
tttgttagggttttgaagggaagacgaagaggggtcttcctctctgtttctctttctctctgccttttagcttcgttgtcgggcgtgtgagcgctggacatggcggtcttgcccctcaactcgctcccactggggttccggttccgacccaccgaccaggagctgatcgaccactacctgcggctcaagatcaatgggagagaccgggaggtgagggtgatccgggaagtcgacgtctgcaaggtcgagccctgggatttgccagatttgtcagctatagagtcaagggatccagaatggttcttcttttgtccgagggaccggaagtacccaaacgggcatcggctcaaccgggcaacaccagctggatactggaaagccacagggaaggaccggaaaataaaattgggacggaatttgatcggaatgaagaagactctggtcttttacaccggccgtgctcccaaagggaagaggacttactgggttatgcatgaataccgaacaactttggaagagctggatggtactcaccccggacagggtgcatttgttctgtgtcgtctgttcaggaagcaagatgagactcttgaatgcccaactcgtgatgatgcagaagtagtggttgtttctccaacagccaactctttacctgatgatactgagtcagagctagtgatagctcaagatggaccatctgtgatagctcaagatggaccatcttctgcgacacaagataaactgccacatgaagattgtgatttagaacgacgccagtgtgtgcttccaaagaatgaggtgaatttgccacaagaaagtgatttgaacttgcttggagatgcaatgacgcacccaccattgccgttgccgatgaaagaagagttggaaacttccttcatgcatgaggttgtgaatgccattagcaatcatgaaactggtgtgcagcttcagaatgacaaaaatgaagatgatatatccgacttctttaactcgatattcaatgtcgactatgaaggcccttgtgatgagagtggtcagtgcaatttggactttggcagcgagattgggaagaacgggcctatagtcgaggacagtttattgcaaaatgatctacttcaggaagcgactgaaagacagagtggatgtcaattagagtggaatggagcaaaagattacgagatagacacgttacaaatggggatggctcgaggaaacttccaaatggggttccctgattccaactttcatcaggactctagtgcagcagcttcattgtttggaatctctgatgcatctcaatctgatgtgaggccaaacagcattcaccttcaagatctaggcacttcttcaaccgatcttcagagtggtaacccttttggaactggaatcaggataaggtctcgctcttcacaaattttgcaacctcagtttgatcatggggcgcaaggttctgccccaagaaggttacgtattcagtgtaaacttcaaattggtccactaagctgcagtaggaagccaaatgattttatttcttgtgatgaagttaaaaaattcaagtccattaatgcagaggtaagaagctcatgagcaccaatagtctttttgacagaataaatctctataggttgccttgtatttgctgtgtaaatcttatcaaagtgttgtgcgcaggaggaaaaagttttcgataagctggttgagggtggtgaagattcggttggtgacgaatctgttagtagtagttctagtgaaccccagaagcttacgctttgtgatattaatgaagagagcgaagtttctcgagagatagtcagtacgcaggatgcaagatcgaataagcaatattctaggatcagattactagtctcttctctgttcacagagggacctgctattcgatcagggaggtcccgcattaatctgtttagtttttttgttttcttagttttttctctgggtgcgatcagcgcgtggagatatattcgcctgtgaggcttttgaggagcattcctctgtgtgtattattatagtttccgtttttcagatgaccagttaacctcataggcgggagattcagtagatttcgctttgtctatattgttatatgtcgtgtatttaggctgatctgaacaatggatactctaatcatacggttttccatttattcgtcaaaaaaaaaa

SEQ ID NO: 406 - DNA, 3047 bp, Eucalyptus sp.
ctccacttccatctccctctctctctctccctccctccgtccctcccttcctccacaagcgcaccacctcgtctctcgcttcccccagctttccaattctcttggccgcgttttctccattcggggtttttatcgcacgccagatgtcttttgaagggagcgagagacactcatcgtttcttcactgtgtctacattttcgtctacattttcatgatccgcgggaggctctgctgcactgggaagatcctctttcgacactggacctgacagatcgtcgtttccttacagtttttttacgtttcggttctagtcgtttttttacaaaaccttggtgtacatcttctggagagaggactccgaggctctcagtttttaggattaagaaaaatttctctagttggtgctgcttctggggagaaactttattggctacaagtgcctccgaaatttactttggtcttccgatggcgatgggatctcttggcccgggtttccgttttcaccctaatgatgatgagctggtcctttattatctcaagaagaaagtgctgggaaagagatttcttaatgaagcaattgcggaggtcgatatatataattttcctccttgggatcttcgagctcatgctcgtttgactagagaactgaaatggtatttcttctgtccccgtgagaggaaatatgcaaatggcgccagaacaaaacgatcaactgattatgggttctggaaaactactggaaaggataaacctgtgattaacaatggcaaaactgtgggaatgaaaagaagcttagtttttcaacgtcttggtggagaaaagaagacagagcgaacagattggatgatgcatgagtataggcttgttgaggatttgaagttgaaaggggtggctcaggacacatttgtaatttgcgtgatctttgagaaagatggtcctggtccgagaaatggtgcccaatatggagcaccttttgttgaggaagagtgggaggacgatgacaatggagaagctgatgtcccctctgctagcggtttcactcaagaatttattctacctgatatgcagcagcattctgagcggtactgtgtagggtctacatccaacgcatgcccagctggaccatctcagatggcaccttctgttgtcaatgtgcctccaccagctcctgtcaatgacgttgtaatggaggattttcagaatccatgtgatgaatatcttcattcaaatggtatcttcgttgatgatatcccagcaacatcttctgagaatgcccgagttgagaactttgacaacatcaatcttgatggagatcacaatgctgaaaataaaaaggatgatacctatgagggtttagaagaccttagtccatatcgttgcgctgatgacttctctttcattaactctgatgcaaatatatgtcatccatttgaaccatttatggagctgtacgatattgctgctccattgacttcaactgatggtcttggtctatctggacacaataattcagagggatttgatcatattattgctgctcagggtccctggacttcagtatctgcagatgatgaaaattgtcatgggatgggggtgaaagatctcgagactgcaataaattgtgatagtgaggctggtcaatccaatggagtatattttgattcctcaatttctaatctgggtggtaacaatgatttagttacacctggcatcatctccaatcctcctatttttgctcagccattctgtggttcagaagtaacatgcaatgctgaggatttccctcagtttaaatggcgccctcaatcgcaggggtttgagggctgtgtggatatgcaccgggagggttatggtgttgaatgcacaaatcaagagattgtaagatatgatgctgttgcagcaaattcttctatcaataatcctgatctgggatgtgcacatgcttgtgaaaaccaaggaagagaacatgtgggaatattctgattgatggacatcttagtgcattcttcatctatgtttgtggttgcttgtggtgatccaaacaataaatgctcggggtgtccgagcgttgtttggggaagagacaattttctgttgtatggttcgattcttggagtatccctcatatccgagttctgccgtagagcgccctgctccatgtattggagcgaagagatctgatgggcatgctctctttcttctctacggatactcctccttccatatcaaggccgaggtgactcttggaggaggtggacgtgggtgcactaacgacgccttatcttgcgggttggaggggtttccgtttgttactgatcgcgaggagaatggaagtggatcaggaaaaggagcggctaactacggatgtgggatctcgtcaacactattcctgttgactctccggtcaccatgctgtcctcctccctggggggacgacgtgtattattggagacttacttcttggttatcgtttcttgctgcggcgtggctgattgtacatatttctgtttggtgtgcctgcattgaactatcggtttcttctgtgtttctgcttgtgttgcatgcgttttcctcgccctttgcaattcgcagtatttcagctccccatgtcatgcgcaatatcattagtttctgaagtcgggtcattgtttaggtttcagttgatctccaccaattcgagtgtttagaggtgaattccagcgtaggaggaagatcaggatgagaatgtgccgagttctaaactataaacgatccgaagaccctttccccttgggaaactgcctcagcttaagtagtaatctttatggtttgaggttctactctctcgatttcccattgtgtgtaagtccgaactgtggctcccatttgcttaaaatttgacgttgattcttgattatgatcttaccatatgcacggatcactacgcaaatttggcaaaaaggctaggtgtgaaatagtgctttattgtatgttaataagattgagacgaatctccttgtatgggtcgatgttgtttgtaagtactaatggttaattaaaaaaaaaa

SEQ ID NO: 407 - DNA, 2406 bp, Eucalyptus sp.
ggttgcttgtgaagagaaactttattggctacaagtgccttcgaaatttactttggtcttctgatggcgatgagatctcttgccccgggtttccgttttcaccctactgatgccgagctggtcctgtattacctgaagagaaaagtgctgggaaagagattacatattgaagcaattgcggaggttgatatatataattttcctccttgggctcttcaaggtcatgcacgtttgagtagagatctgaaatggtatttcttctgtccccgtgagaggaaatatgcaactggcggcagaacaaaacgatcgactgcttatgggttctggaaaactactggaaaggataaatctgtaattaacaacggaaaaactgtgggaatgagaagaagcttagtttttcaacgtctaggtggagaaaagaagacagagcgaacagattgggtgatgcacgagtataggcttgttgaggatgaggatttgaagacgaaaggggcagctcaggacacgtttgtactttgtgagatctacaagaaagatggttgtggtccaagaaatggtgcccagtacggagcacccttcaatgaggaagaatgggatgatgatgatgtagaagccgatgtcccctctgctagtggtttcactcaggaatttattctacctaatatggagcagcattctgaacgatactgtaaagggtccacatccactgcatgcccagctggaccatctcagatcgtgccttctgatgtcaatgtgcctccaccagctcctgccaatgacatcacaatggaggatactcaaaatccattcgatgaatatcttcgttcaaatggtattttcggtgatgatatcccaccaacatcttctgaggatgacagagttgagaactttgacaacatcaatcttgatggagatcacaatgctgaaaataaaaaggatgatacctatgagggtttagaagaccttagtccatatcgtcgcactaatgacttctctttcattcactctgatgaaaatatatgtcatccatttgaaccatttatggagctgtacgattttgctgctccattgacttcagctgatggtcctggtctatctggacacaataattcagagggatttgatcattttattgctgctcagggtccctggacttcagtatctgcagatgatgaaaattgtcatggaatggggttgaaagatcttgagactgcaataaattgtgatagtgaggctggtcaatccaatggagtatattttgattcctcaatttctaatctgggtggtaacaatgatttagttacacctggcatcatctccaatcctcctatttttgctcagccattccgtggttcagaagtaacatgcgatgctgaggatttccctcagtttaaatggcgccctcaatcgcaggggtttgagggctgtgtggatatgcaccgggagggttatggtgttgaatgcacaaatcaagagattgtaaattatgatgctgttgcagcaaattcttctatcaataatcctgatctgggatgtgcacatgcttgtgaaaaccaaggaagaggggaagagacaattttctgttgtatggttcgattcttggagtatccctcatatccgagttctgccgtagagcgccctgctccatgtattggagcgaagagatctgatgggcatgctctctttcttctctacggatactcctccttccatatcaaggccgaggtgactcttggaggaggtggacgtgggtgcactaacgacgccttatcttgcgggttggaggggtttccgtttgttactgatcgcgaggagaatggaagtggatcaggaaaaggagcggctaactacggatgtgggatctcgtcaacactattcctgttgactctccggtcaccatgctgtcctccctggggggacgtgtattattggagacttacttcttggttatcgtttcttgctgcggcgtggctgattgtacatatttctgtttggtttcagttgatctccaccaattcgagtgtttaggggtgaattccagcgtaggaggaagatcaggatgagaatgtgcccagttctaaactataaacgatccgaagaccctttcctcttgggaaactgcctcagcttaagtagtaatctttatggttcgaggttctactctctcgatttcccattgtgtgtaagtcttaactgtggcccccatttgcttaaaatttgacgttgattcttgagtatgatcttaccatatgcacggatcactacgcaaatttggcaaaaggctaggtgtgaaatagtgctttattgtatgttaataagattgagacgaatctccctatatgggtcgatgttgtttgtaagtactaatggttaattagagtggacctgtcttagcaaaaaaaaaaa

SEQ ID NO: 408 - DNA, 2420 bp, Eucalyptus sp.
gagaagacgctccggaatccagtcagtcagccggccagtcaattcgccgccgccgccgtcgtcgtcgtcgccgattcggcggcgatcttcgagatcgagtcgaattctgctgattctctaccgcgaagatcccagggtgggggggatttcgcttctgctttgctgctgcctaagcctttctgtctttctttccttctttctttctttctttctttcgttccgatcgcgagtgtcttcggtcggtgccgtgctgtgtcggtgtcgtctggaaatgggggtgctggagatggaggcgctgccgctggggttcaggttcaggccgacggacgaggagctgatcaaccactacctgcggctgaagatcaacggccgccactcggaggtcaaggtcatcctcgagatcgacgtctgcaagtgggagccctgggatttgccagacttatcggtgataaaaacggatgatccggagtggttcttcttttgcccccgggaccggaagtacccgaatgggcatcggtcgaatcgggccacggatgctgggtactggaaagccacgggcaaggaccggaccatcaagtctcgcaagtcagggggtgctactgccagcttgatcgggatgaagaagaccctggtcttctacaggggtcgtgcgcccaagggtgagagaactcactggattatgcacgagtatcgtgctaccgagcaggatcttgatgggactggacccggccaggctgcttatgtcctctgtcgtttgttccggaaggcggaggagaagcctgaagttgtgaagtacgatgaagttgaacaaactggcttatctccgacagccaagtcctctcctgatgaggcattatcggatgtagttccagaaactcctgtttccaatgtccaagtaaaatcacaatcagacggaatcaagcggtggttgactgatgagtcggacaaaatgactcctagtactcagatgcctgttgagagctgctccaatagttacattgcctctgatgtggaagatggtaacactgatggaacaccattggaggtaaatccattgctcgaaagtggccccaaattctatgatctgccttgtgatccaactgatcacaaaggtttattccctgagcagacacagctaaaaacagggcaagctccttacatggattctccttttgcctgtgattttggcaatgatcttgagggactactattccacgatgctggtgagcacgagatcacactctcggatttgttggatgaggtcttcaataatcaagatgactcctgtgaagagtccaccagtcagaagaattcagttggaagtgagattccatttgatcctccgttcaacttatcccagccggtcctaggggtcaaagataatgtatggtatgatgatcttgttgacaataataattggatggatgcgttacctttgtggggaccatctggagctgttgcttcaaataatatggcagaatcaactggtgaatctttcaatagcaatggtggaactccgatcaagatcaggacacgtgactctcaagtcctaccacattcaagtgattatggagcgcagggtactgctcctagaaggttgcgtctggcggtggatcgagccaatcaactaccaagaagcgtaaagctagaaggagctgatgagggaatgagaggtactggctctaatgcagaagaagaagttcagtcaactgctgaggagagttctgttaaccacaatgacaacacgattgtcggaaccaatatcaagataaggacccgtcaacctcgacatcaaccaggctcagagaattcaatagttcaaggtattgctcccagaagaatccggctgcagatgaacagtcaatctgggtcaactagggatgatgaagttaaaacttcaagcttcgatgaagaagtacagtctgctcctaccaaggtcaaagaagaaacggacaatatttctgatcacaacgaaccagagagagacggtcagcttcctgctcatgataagatgacagaaattgtcgaagagccgtgtacaaacttaacgttggggtcaaaaaccaggtggggaatcgcgcagtcatgcgatggctccagcatctttgggaataccttcagtacgccctgcttctcgttcccgcttatctttacttttcgcagtcggcatgtctcttgtcatagtcctggccgtagttttctctggtggggtacagagatacatcaaactggacattgcgtagagaaagagccgttttccatcccatctttacatatggcatagggtatgcgtggagacgtctaatagaggatgatgcagatattttatgtattgcatcttttgctgtaaaatatatttccctgtatctagcagaggagcctgctctgttgtgggcttctggattcagtgaaaaaaaaaa

SEQ ID NO: 409 - DNA, 2656 bp, Eucalyptus sp.
gcgcctgtgcacgagtgaagtaacagaactagaaggagatgggagctgtgatcatcccacggaatccgccggtcggatacggattccgtcccaccgacgaggaattggtcgatcactacttgaagctgaaagtgctcggaatcacaggcgacgtctgcatcattcccgaggttgatatctgcaagtgggatccttgggaattaccaaaaaaatttgaggagcaatcaatcattcctcctgatgacaaagttcaagagtggtggttcttctatctgcaaacgccacgaattcaaagatcgactccactgggatattggaagaagactggtgttgacaggactatcaaggctggagacaggaacagagcaatcggtactaagaaaacactggtcttttataagcgtcacggctctgaaggcgtcaagaccaactgggtcatccacgaatattatctactgaccaacaatctcaatgaactgtttccacacgctctgaccaagagctacgttgtctgtcacttaaagcacaaaggaaatgaagagtctgatttttcagccctgcaattaaatggtggggccattagcttgatggacttggattcaggccttcatcaacctgcacaaaataactcatttccagaaccgtggagtgaggcagttggaaactcatcaattagcttggccgacttggattcaaatcttcatcaacctgaacacgagaacttatttccggaaccttggattcaggcagtggaaaacccatcaattagcttggttgacttgcagtcagaccttcgtcaacctgaacctgagaactcatgtccagaaccatggattctggtagactcagcaacggagccctcacttcagcaggacaaccaagttcaagtcattacatcaattctcccgcagacttctttccaatcagaaattgttgactcccaaaccgacttacatgttagaaattttggaagtccatcttttgcggacctcccattggatgatgatttagttgtttattttgatgaatccaaccagttgcaagtcggctacattgacagagatcaaattcaaacacagtatggcccaaaatgtagcccagatgatgaacatgctgttctgaggaagagtcagcgagcaaaaatgatcaaatcactccatggtgtagtttcactagatgaaaagaaagggttcattgaacataagttcaatgggttacatatctcctccccgaagcatatggagcctccaaaaaagcctgaaattgcaagaacttacagcactgatgaagaatcgagggtcgaaaaggtggagaagctggaacttgctgccagaaatatcaaaccagaatgtgttactctggatgaattagaagccaaagcaaagtatggccaaacatccagctcacgtaatgctcatgctatggtggagaattggcagacaccaacaattgaaactctccatggccaaacatctagctcacggaacaaaaatgctacggagaagactgggcaaacactagcaattgaactaccccatggatgtcgagaagttcctccagaggaaaagaaaagctttgatgggaatgagtccaactgctcaaatgtctttcccccaaaacgtatggatcctctggaagagcctgcaactgtaagaatttatagtaaaggtgaaaagatgaggtttttagaggtcaaaaagcaagaacttgcagccaaaaatatcaaaccaaattgtgcattattggatgacttggccaccaaagcaaagtcgcataatgaacatgttgtgcgaattggaacagttgaacctctcaatggagttgctcctctgcacaaaaagaaaggcttcgacaagaataagtttgacagcttacatgtctcctccacaaaacatacggagcttcttgaaaagcttagaaaggaagatctggcaaccagaaatagtaaatcagtatatatacctttggatgaatcaatagccatagcaaagcatgaccaagcatctaggttccataaaggatctattctagaggagaattggctggcatcaacaaaaaaatcactcgatggtgttctgaagggaaaaaagggctttaccgagagtgagttggacggatgggagattgtctctgcaaaacagacagagcatccaaaaaaggctgggaatgcaggaatttcttgcaaatacaaagatccgaggttagaaaaactcaagatgccggaattttcagccagagagatatcaaaccagaaggttcacctttggttgaatcagaagccagatcaaaggtaatactctcgagtactttttggagtattgtattggttggattgatacaatatactaaggttttagagtgatacatagtcacagaggagaaagcaatgagcacagggaggagactgaaccagccagagagatatcaatttcagctactccatcggctggatcaacaagcaaccacgcaaagattagtgccaattcttcagccttcaaaatcaccaaaagattcatgccttggtgatacaagcctctcgattaatttgtgtatataggatcacttgtagcttatcttcacttggattgccatgccttgtacttatctgtaatggaataaagactcttgctaaaagcgttcaccggtaaaaaaaaaa

SEQ ID NO: 410 - DNA, 3199 bp, Eucalyptus sp.
gtttggtaaaattcaggcaaaaattagctttttttccatgtggacagggggttttggaagagagagagagagagagagagagaggactggaagtgatagacccttttatcagccaaatctttgttggtgatgtaccgctctttgttgctcagatatggatttgcccgaggcatattaatcatacccacctcaaaaggacccagttctagttggaaaaacaaatcagagcgttggacgaggccgacataaatccttcctggaagttcctatttctgtttttcatcttcaccgggcttctgtgttttgggtcataatgatgttgcaactaacaactcagtgattactggttatggcatctgcttgattatttgaggatagaaaataatggaggatgttgctttcacccctaatttcacaagtgagagtctcttggattctgccatggacttggacttgatggatcaactcttgttagaaggatgctggttagaaacaacagatgcctccaactatccatttcgaggcatctttcaagaggaagcaggaaaagacttcgccgaaagtccaccctcaacgtgtcctagaatagaggaaagattggagatggagcagaaaaatattaatccttttgaagctacggcatcttcaagtcaatctgaaggttttcagattgaaggcaccgaagttgggagacggtgctggattgccccaacggcaaacccgggtccctcttcctccatgaagcagagattgatgatggttctcgggcgtctgaaagaatgcactaaagacaaagatgtgcttgttcaaatatgggtgccggtaaagaaaggggggaggaacgtgcttaccacaattgaccagccatatgtccataatcctaacagcaagagccttgagagttacagaaatgtttcaaaaacatatcagttcctggccgatgaggagactaaagagtcagttggcttgccgggtcgggttttcttggggaagctcccggagtggactcctgatgttcggttcttcagtagtgaagagtatccacgtcgtgactatgctcagcagtatgatgtccgtgggtcccttgcgcttcctgtttttgaacggggcagtgggacttgcttgggtgttgttgagatcataacaacttcccagaagatcaactatcgtccagaacttgaaactgtctgcaaagctctcgaggctgttgatcttagaagttcccagaccttcagaccacctagtgcgaaggcttgcaatcagtcacaccaagctgcactaccgcagatcttagaggttttgacatctgtatgcagacaatacagactgccactagctttgacttgggcttcttgtctccgcaaggaagcatgttcagagcatcacctgttaagaggacaaggaatcgttgggagggcatttacaataaaccagccatgttttgctgctgatataactgcattcagcaggaaggaataccctctggctcaccatgctaggatgttagggttatgctgtgccactgcaattcccttagcaagcatccacaccggatcggttgactttgtcttggagttctttttgccaagagattgcagagatgctgaagaacaaaagcagatgattaactcattgtccagttttgtatgtcagacactccagaattcccaaaaggaacagaaggaaacgctcgtgtcatccacaagatatactggagttaacacttcagataaaagaattcaggttgaagaaaccgataagttgctaccttctcttaacaaacgtcatccgcaagaagtgtcgtggattgcaaatatggtggaggcccaaaagaacagcaaagggatctctgttccatttgaggttcagaaagaacccaaagaagaatttacagtgacgaccaaatgggaagaaactgaaataggactacagcatggacagttccatccagagttccaccgagttcagcagaacttagaaaacaagcctaatgtcgagggtggggatactcttggtcagtttccctccataggtggtagaaaatcaggtcagaggactcgtacaaagactgagaagacaatcagcttggatgtcctccggcaatacttcgcagggagcctcaaagatgctgctagaagtattggtgtttgtcctacaaccttgaaaaggatatgcagacaacatggcatcactagatggccttctcgaaagatcaagaaggtaggccattctctaaagaagcttgagagcattataaattcggtccaaggtgctgagggtaccatacgtattcgctcattttatgagagcttcccagaattgaactctccaagacactctgagaagggaactttttcatcagctaatctgggtaatcctctggagcaattaaatcctcagactgagaatggtttgttcagctcaggagccactacctcgaattctccatcttcctcatgcagccagagctctggttctactacctctttctcaaccgggacaaagcagtgttttactgcaataactgctctgagcagcggtgatccagtcatgtccaataacccctctgaagtgctaaaacgaacacgcagcgatgcagaattacatatttccactcacgaagagccgaagcctcttataagatcccaaagccacaaatcattggacgagtggggaagtctcgagaatgtagccactttaccgaaaaccaacagcccccgcataacacgtgatttgggcatttatagaattaaagcaattttgggggaagaaaagatcaggtttagcttgaaacccagttggggacttagagatttgcaacgtgaggtggcaaaccgtttcaacatagaagatattgggacaattgatctcaagtacttggatgatgatcaagaatgggttcttttgacatgtgatgctgatcttgaggagtgcattgatgtgtacagaatgtcgcgaaaccatacaatccggatctccattcaccaatcttcacatcaaaatctaagaagtcttggtggtagcagcggtgaggctcagcaccgaggccatatccatttataagtttccagtgttcgggatctgaatatccatccggcaccaaaatttctcctttgtagacagagcaagaaggcaaaccatccgttggaggcagggacgtcagaccaggtttgaaccccggctatagctaaaaaaaaaa

SEQ ID NO: 411 - DNA, 1296 bp, Eucalyptus sp.
ttcattcattcacccttccatctctctctctctctctctctctcagctagacaaaccaaaactcgaccggcaagcaacacacagagcaatggatggtatcagctgcaccgacgagagcaccaccagcagcgactctccatccttctcccccccgcccgccaagccctccccgccgccgccggggagcctgtggcgcgtcggcagcgcggccagcaccgtcctcgaccccgcgccggacggcggcgccgaggccgagtcccacaagaagctcccctcctccaagtacaagggcgtcgtcccccagcccaacggccgctggggcgcccaaatctacgagaagcaccagcgcgtctggctcggcaccttcaacgaggaggaggacgccgcccgcgcctacgacatcgccgcccagcgcttccgcggccgcgacgccgtcaccaacttcaagcccgatggcgccatggaccccgccgaggccgacttcctggccaaacactccaagcccgagatcgtcgacatgctgcgcaagcacacgtaccgcgacgagctagagcagagcaagcggagctacaggggctccgccgcggaacgggccgggaggggcgggttcgggccggggcggacagagtggtcggccgccgcccgggagcagctgttcgagaaggccgtgacgccgagcgacgtggggaagctgaaccggctggtgatcccgaagcagcacgcggagaagcacttcccgctgccgggcgggccggcggcgacgatgaagggcgtactgctcaacttcgaggacgtcggcgggaaggtgtggcggttccggtattcgtactggaacagcagccagagctacgtgctcaccaagggttggagccggttcgtgaaggagaagagcctgaaggccggcgacaccgtctgcttccagcggtcgaccgggccggacaagcagctctacatcgacttcaagccgcggggccagccgccggccggcccggccgcgccgccgccgccgcccgtacagatggtgaggctgttcggggtgaacataatggaggtgccctattgcggtggtgggaagagaatgagggatgtggacttgttgtcgttcgagtgtaggaagaagcagcagatggtggttggcgctttgtagcacctaacatcttccatcttttgatcttctcctttgaacttctttcccttaggtttttgaattttccttttttcccttagttgttatcatgttttgtgaattatatgaggaagaaagaggggggttatgttgtagatccaaaaaaaaaa

SEQ ID NO: 412 - DNA, 740 bp, Eucalyptus sp.
gcagtccctctctctcccctcctctcttttcaccttttccccctcgcttataagtccactccaccaccaccaccaccatcgccatcgccatctccccctttctctctctctccctctccctctctctcatcaacatccccccccaaacaagctcgtcggaagcgctccacggagcccctctttccgcgagggcggccatggagaagggaaagcacagggcgttcctcgaggagaagttgaaggccgagcccgcggccgagtgcgaggacggccccggcggcggcgacggcgaggacgacgacgactccaagaggaagaaggtgccgccgtcgagcgggagcaggcgcgggagcggtgccacgtcgaggaattgccaggcggagaagtgcacggccgatctcacggaggcgaggcagtaccaccggaggcacaaggtgtgcgagcagcacgccaaggctccggcggtggtcgttggcggcctttaccagcggttctgtcagcaatgtagcaggttccatgagctgttggaattcgatgaaaacaagaggagctgccgcaggcgattggcgggacacaacgagcggagaagaaagaacccggccgagcctcacatcgagggctcgagtggaaaagctggcggcagcactcaaatgaaggagctagtctgtggacaagtcgataatcggggccggatccaagagaatgccacctacaaacatttccagatcagataagcccgt

SEQ ID NO: 413 - skipped

SEQ ID NO: 414 - DNA, 1579 bp, Eucalyptus sp.
aaattctggagctgacagaacagagcagagcagagcagagccgagcccttcctctctctctctcttccatccttcccttaccttcagcctgtcatgtcccacttcttgtcctctcttcctcctcagttgtagcgtctccctctctctctctctctctctctcgagaacacacaaacgcgggcacagagaaacagagagagaccagtgatggtgacccgataaaggtagctgcccttaacgggtagtgctgccctccgcgctgctcatgcgggaatggattcgaggcggcctctcaaccactcggcctcctcgtcgtcgtcgtcgcccccgacctctgctagcaccgacggccccgaaatccacttcggcgacgtgggcccgggcgtccaggccaagccggggggctccacctcgtcgcggtccgggtcccaggggacgccgccgaagaaggcgaggggggccgacggcggtagcggcggcggcggcgcccatcagccgccgaggtgtcaggtggagggatgcaatgtggatctgagcgaggtgaagacctattatttgaggcacaaggtttgtgggacgcattccaaggcggccactgtcgtcgtccgtggcctcgagcagaggttttgccaacagtgcagcaggttccatcagcttaatgaatttgaccaagggaaaagaagttgccgcagacggttggccggtcataacgagcgtcgtaggaagccacctcctggatcagcacactactctcgccactctcgcttctcttcctctatttttgataacagcactggaagcgcaggacttgtgatggacttcagtgcatatccggggcctcctcctagggaagcatggatcgcacctcaagcatccaaccggggacctggaaatcagaccctgggccgggaaaagctccagttacatcctccgtggcagagcagtcctgaaagtcatcaatataacctcttccttcaaggtccgtctccatcagtgggggggaccagctttcctggtcccgggattcctcctggagaaagctttaaccccagctgtgctctctctcttctgtcaaaccaacaaccggactctgcaagtcaagcgtcgggtcgtgcacttaacagcgatgtcctgagtcgtcaagcctcagtcggggctcaagtaataaatcctctcgatgctgctgtcggcaatttttcgagcgcctcatgggctttgaaggtaaatgaggctggtggcagtacacctgatatagcccctgatcttggtttaggtcatgtttcacagcctctcaatggtccgttctcgagtggcctcgagttctctctgcagagcaggaggcagaacacggaccaagatcattctcaggattacaactcaactcagcagaggcattggtcgctctaagcacccagtcctgtagaattttccaaacccgtggatataaaggaatttgatgtgattccttttttctggatttagctcatcttgcatcgacctaccctttttttcctgcttaagaacattgaaatacaatgtaacgaacaaagatgctggacttttcagtctaaaaaaaaaa

SEQ ID NO: 415 - DNA, 1550 bp, Eucalyptus sp.
ctctctctctctctctctctctctctctctctttctttctttctttctctctctagcagaggcacagaggcgcgcagagggcactgatgatgacgactggggtagctccaatgaatgggctctagagaacctcgctcatggacgtgggttcgggctcgtggacgacggagtccgggtcctcttctcctccccctctcgagtccctcaacggcctcaagttcggccagaaaatctacttccagaataataacagtagtaataatgccgccgcacccaagcacggctccggctccggctccggctcctcctccgccgccgcgcccgcgcccgggtcgggcacgcccccgaagaaggtgagggcctccgccggcggcggcggctgcggggcgatccagggcgggcagcccccgaggtgccaggtggaaggctgccgggtggatctgagcgatgccaaggcttactattccaggcacaaggtgtgcggcatgcactccaagtccgccaccgtcatcgtcgccggcatcgagcagaggttctgccagcagtgcagcagattccatcagcttactgaatttgaccaagggaaacgaagctgtcgtagacgtttggctggtcacaatgagcgccggaggaagcccccacctgggtcgctactatcctctcgctatgggcgactgcaatcctctatatttgagaacaccaccagagtgggtagttttctgatggatttcacagcatacccgaagcatgcatggtcagcgccacgtttttctgagcgcacgacacctggagatctagtccccggaccaggaaaggtctatcctcatccatggcagagcagtcctgagaaccctccctctgaccttttcctgcagtgctcatccggtggcacaacagctttccctgctcctggaattcctcctggcgaatgcttcactggagtagctgactcaagctgtgctctctctcttctgtcaaatcaaccctggggctccacgaaccagccgtcacctctcgggacgaaccacatggtgcacccccagggctcgaccctggctcagtcgatgcctcctcatagttcggccattcacttcactggtcctggctctgcgtgggccttcaagggcaacgacgctggtgggagctccattgggctagctgctgacctgggcttgggccagttctcacagccactgaacaatcagttctctggtgacatggaattgtctcaacacagcaggaggcaattcatggagcttgatccctccagggcatatgattccacccaccagacgcactggtcgctctaggtgaccccatcatgtttatgttgggttctcttgcatcgctgcatttgaatattttttgcgcataagactgcatgccctttttttttgttttgatgaacacctgacgtgatttcggtgtctatcattgctggatgtggactttgttaaggcaacgccctaacttgaactaggacttcgcttttgtcttgaacactttgctgtcagatgtggattgtactcccagttgtcttaaaaaaaaaa

SEQ ID NO: 416 - DNA, 884 bp, Eucalyptus sp.
ctaaactttcctaacaatgggctccattgtctcccctcaagacttcccttcctctgaccagaattctccccccaacctcgccgccgccgctgtcgaggctccgccaccgaagccccaccggcaggtggccctctcccggaaaagcacagccgctcctgccagggaccggcacaccaaggtgaacggccgggggcgccggatacggatcccggcgctctgcgcggcccggatcttccagctgacccgggagctcggccaccgctccgacggcgagaccatcgagtggctcctccgctgcgccgagccctccatcatcgcggccaccggctacggcagcatgcccgcggaccccatcaccaccaccgtgggggcgctccctccgtcctccacgcccgcatcagccccgtgcccggcccagccgctggcgctggctcccccggcggccggccacggggcgttcccgatctcgccgccgccggactgccggctggacctgagccagccgaacgggttcgacttctcggcggggggctgcgcgaccaacgggtaccgccatatgcccttcacggcgctgctgctgcagccgacggcgacggaggaggcggaggagaggcagcagagggagattcttggctgagagaaagataaggtctttgagctagtgtcctttggggggttggttttctggtaaagaatatatgacgtggtatatgtctccatcgcactcaatgtgtatttcttcttctctttctcatcttcttcttttgttttttccatagtttatggagacagggcgcttaaattagagcatgaagaagatgcacaatgttaggagttgaatcgttaaatgtattaattgaaaaggaaatttgagaaaaaaaaaa

SEQ ID NO: 417 - DNA, 1590 bp, Eucalyptus sp.
ctctctttctctctctctctctctctctctctttggcagagacaagatcagaagaaggccaaggaggatctgaatcttccagacacacagagcttatccaccaaaattaataaccctagagagaaccacaggcataacaccaaaagcaggcaaggccctataaatcccattaaggccgtctcattcattcagaaggagaagaatcagccaaaaaagaaggaggtgtattcttttctcaagacccttcttttatcttaaattatgcaaaaagctccaaaactgtgaaatgggaatgaagagcacagaaggagagattgtccaggtccagggaggccacatagttcggtcgaccggccgaaaggaccgccacagcaaggtttacaccgcgaaaggcccccgggaccgccgtgtccggttgtcagctcacaccgccattcaattttatgatgtccaagaccggcttggctatgaccggcccagcaaggccgtcgactggctcatcaagaaggcaaaggcggccatcgacaagctcgccgagctgccgccttggcagccgaactcaagctctgttccttccacctccactgccccagacagcgcagcacacaatgggaattcggccgagatggcggttgcggaggaatcggagtctcccaagtacaattttcagctccataggcaaatcagtgccaattcaagaaacgcaacaagccaattcttgccaccgcagctggagaacgatcagtccatgttggagacgatgaagtcgttcttcccgacgagctcggccgcatcatccatcaatttcagcagctacccatccgagattatgtcgaggagcacccagcagaaccaagaccttggcctttccctacactctcttcagtctcaatctgctctaattcaccaaagcgatccgcaagagaatgaaatgagccaaacccttttctcgacttcggcaccaatggtgtacgaacctgggtttcagagaatgatgggttggggcaccgacccatctggcacggacaaccggagtggcggcaggtttctgttcaactcgccaacgccgttgacgctgcctttgccgctgctgagtcaaggctcagcggcgtttccacaaaggggaacccttcagtccagtttcgcaccgacttttcgctctctcgacgagttttctgtggactcggctgaccatcacaagtcgcaggtcatccatcacccgtcttcgctctttggcaacaggttcgtctccgatggactgcctggcttttgcatttctccacaaattcagaacaacggggcaccgcacgatgttgtttccgcgaggccatcatcttctgcttctctgagtaatggccgttgattaaagagaggaagtcctcatctttatcactactgaggaatttggcgacgggagccgtggaaccagtccacatgtcgacgaaacaagagaggagattctcgtcgcgtcaatttgtgctccttttggagaagatcatatcaggcttgtttcaatcgtctagagggcctttctttaaatcaattccccagttataccataatatattaattttgttgtgaaaaaaaaaa

SEQ ID NO: 418 - DNA, 1535 bp, Eucalyptus sp.
gaaagcaaagcaattccacaaactctctgcaactgtcgctcactctcagggaagaagaaggaggagaaggagctgtgcaggcaagaagcaagaagaagagagaagagaacgagggtgggttttgctagaaggagaaagggagagggagaggagagcttggattacatgtgataatggaaggaggtgatcacgaccacttccaccaccactaccaccaccaccaccgacgccccaccttccccttccagttgctggagaagaaggaggatgagcaaccatgctcgacctccaactatccctcccttgccatgtcctccgacgacgcgcccccgaaccctaaccgatcgtcctccacctcgaacaccctccagatcgtcccggcggaggatcagcagcagcagcagacgctggcggcggcgggggcggatgcgggggcggcgggggccaagaaaccgccgccgaagcggacctcgacgaaggaccgacacacgaaggtggacgggcgggggaggcgcatccgcatgccggccctctgcgccgccagggtcttccagctcacccgcgagctcgggcacaagtccgacggggagaccatcgagtggctcctccagcaggcggagcccgccgtgatcgccgccaccggtacgggcaccatcccggccaacttcacgtcccttaacatctcgctccgcagctccggctcgagcatgtcggttccgtcgcagctccgatcgagctacttcagccccaacttctcgctcccgccgcagcgccggggcaaccccgccttgttccctgggatcgggctgtcgccggaatcgacgacgacgctgctcaatttccagggctcctctagcaatttgagctccatgctgtttcaggccaagcaggagctccgggaagcttcgaatttggagctgtcggagggcgccgatcacgagggcatgagcaagaagcgaaggcccgatcagcttgatctgtcggccaattctcagcctcagtcgcatgcggggagctacctgttgcagtcgagctccggcgtccttccggcgagccacgggaatcttccggccaacttctggatggtgacgaacccgagcaaccaggtcatgagcggcgatccggtatggacgttccccgcctcagtcagcaatagcgccgccttgtaccgaggcaccatgtccagcggcctgcatttcatgaacttccccgcgcccgtcgccctattgccaggtcagcatttgggctcggccgccgccgccgccggggccggcggcggcagcgaagggcaattcaacatgctcggcgggctgagcccgtaccggcccatgtcgagctccggcgtgtcggaatcccaggcaagcggctcgcactcgcaccacggcggcggaggcggcggcggcggcggcgggggcgacgaccggcagccaccgttctcagatcccggcggcgattgaatttggtgggctagtttgattgatgtgttgtacacacgtgaggtttttggttgtcgttaattggatgagctgagcttc

SEQ ID NO: 419 - DNA, 1834 bp, Eucalyptus sp.
ctaatccgcgattcggtttttcactattcacagtctccctcgaaagcttacacttcacgcacctctctctctctctctccccctttcaggcctctgtacaaaggccaaaagaaggagaaggagaaggagaagaaggagatgcgaatgagctgagctgcagccgagctgagctctcttccacttcactcctcgccggttctccggcgccgccccgttcgatccccggccggcgatggtccctccgccgcggctcctcccccccgccgtctgagcccgccgccgccgccgccgccattctttcccccccgggagaagccctaaatcctccctctcccgccggccgccatgtacctgtccgagaagcctcgcccgatcgatttctacaaggaggagtccgcccctcgcgacatgatcatcgaggtcgtctcctccaacggcgacatcccgccccaccacccgcacccgcacccgcacccgcacccgcaccagcaccagcacccgcacccgcaccagcacccgcaccagcaccaggcgccgcccgcgccgccgccgccgccgccgccccagccgcaccaccagatgatccttggcgagagcagcggggaggacctcgaggtcaaggccccgaagaagcgcgccgagacctgggtgcaggacgagacccggtgcctcatcgcgctccgccgcgagatggactcgctgttcaatacctccaagtcgaacaagcacctctgggagcagatctcgtccaagatgagagagaaagggttcgatcgttccccgaccatgtgcacggacaagtggaggaacctgctgaaggagtataagaaggccaagtaccaggatagagggtccgcgaagatgtcgtattacaaggagattgaggagattctgagggagaggagcaagaataatcagtataagagtccgacggcctcggctttgaaggtcgatccctacatgcagttttctgacaaaggcattgaggatgctgggatgactttcggacctgtagaagcaagtggtaggccgactctcaaccttgaaagacgtttggatcatgatgggcatcctttggccataactacagctgaagcagtcgcagctaatggagttccaccttggaattggagggaaacccctggaaatggtgagagtcagtcatatggtgggagggtcatctcagtgaagtggggtgactataccagaagggttggtattgatggcactgccgattccattaaagaggcgatcaaatctgcttttagattgagaaccaaacgagcattttggttggaggatgaagaccaggtaatacgaagtcttgacagagatatgcctttgggaaattacaatctccagcttgatgaaggactggccataaaagtttgcctatatgatgagtcagggcatatttcagttcatccagaagataagattttctacacggaagatgattatcgtgattttcttgcccgaagagggtggacgtgtttgagggaacttgatgggtacagaaacattgataatatggatgacctacggcctggtggaatctaccgcggtgtgacatgaggcctgcgggctctaatgtgaggggaactttgtaattatgaccatgatggagctgaaccgtgacgttaaattgtgtatagcatcttggcacgagatgttattcgattagcagtgtgctgaggcatttcaaaaatgtatatatcactccctggattaccgaaatgctgttgacataactgcctttttggcctgtaacaatgttgtaattacatttggctttcctctgaaaatctctttgagaattcttccaaaaaaaaaa

SEQ ID NO: 420 - DNA, 2393 bp, Eucalyptus sp.
cctctctctctctctctctctctcatctttttcttctctctacttagctgagctgagtgagctccagttttctctttccttttcgccctctttcccctcagcgaatggagatggaagatcaccaccagtacaccgcggcagatttgcggcacctcatcaacgcccgtccacctccacccccaccgcacatccagtcgatctccccgcctgagctattctgcggcggcggcggccaccggaacccgacgcagcacttggagtcgatgatgatgggtggcggcgggcttcacaacggccaacgccaaggccacaaccatcaacaccaccaccagtttggccgtgatcattcttctccctcttcggtcgccatggctggtgcggcagggggtttagagagtgagaacggcggaaatgggagatggcctaggcaggagactctcacgctcctcgagatcaggtcgaggctcgactctaggtttaaggaggccaaccaaaagggtcctctttgggacgaagtttcaaggattatgtcggaagaacatgggtatcaacggagcggcaagaaatgcagggaaaaattcgagaacttgtacaagtattacaagaagacgaaggaaggaaaagcgggtaggcaagacggtaagcactacaggttctttcgtcagctcgaagctctctacggagagaacgccaattcgaattccatcctccaagctccatctcttccacactcactccactttcatcctccacccaacatcaatgatattaaccaagatgcgtctcatcatcgtcatcctcatcaactgcagagaccgtgcgaaagtctcagcctctccaattcctccgactttgacacctcttcgtcagacgacaatgaagaggatgtgtccgtggagaagggaaagaaggtaaggagaggcaaaaggggttggaagataaagatcaaggagttcatcgactcgcagatgagaaagctagcagacaggcaagaagcgtggctggagaaaatgatgaaggcccttgaggagaaagagcgcgagagagaactgagagaggaggaatggaagcaacaagaaatggcccggatcgagagagagcacaagttctgggagaaagaaaaggcgtggatcgaagctcgcgacgccactttcatggatgcgttgcagaaattgacagggagagacctgaagtttgtgccttcgcctaatgagctcttagcggcagctgaaatccaaacccatcagagcgatggcctcaccaaatggagtaaggacttcgacaatttcaagaaacgcaaggacaactcgcggtggtgtcattatccaagcgggagcgatgaggtcatgtacaaccaaggagggtcaaattgcgaaataattaaagagcaaggaccggaaagtatgacccgatcagttcaaatgaacaacggttcgagctcaccttctaattccaatgcgggaaatgcaatgcaggagagctgcttccgcttcatgatggttgagggagataatttgtgggaaagctacggtatgaagctcaccaagggagatcagaaccagtagatcatcgattatcggcattagagtgagagagattgttgtaggaggatggatttgacagtgatagtgagatgggattggataatttttagcaagaaactgacccggatgatggattaattgttgacgcgtggtggaaattgcgagggaaatgggcattcccgacggctataacaagaatggacttatatgtatatatatctctctctgatgattttagtttgataacgaagatctttgaaatgggagatgcagttgctcatagaaggctaacaggatcattatcactaccgacaacagaagatctcttttctaaagtacgtattattcatggtgctctctttccgtggtagttgtggttctgaatgtggatcattgttttagaatggtttagtgttcgtctaccaaagatctctaatatttagtgttcaggcttttatggcttgcaacatgctttgcctgatgtcctagcatattaatgtgcttgttgagtcctgcctttcgttctcataagaagttgtctttagttcgatttgtacttcttggaatcagtagtttttgccatcttcgtacagtccaattgatgtgcatcattgagcggctttccaaggtgcaactgagcttagctgtaagatttttgaacaatctcaagttataggggatcatatgccaagaatttgggataagttctcatcttggttggcaacaaaaaatatgttcatactcattaaatcaccgatttttgggtacattcaccgttgagaagctaccttataatcatctcatatatgttttcttgtgtcaattagtgatcatatttgaaaaaaaaaa

SEQ ID NO: 421 - DNA, 1681 bp, Eucalyptus sp.
caagaacccccaccgccatctccctctccctctccctctcaaggagccacctttctgcctggaactgcaacatgctccactgcagcacttaacccatcttccgtttccctctcctctttccgtgtgaagacgaaggaggccaaacgatcttcttccgacggcgagcacacatgccgatcaagagcctcatccacgacatgcgctcgcgctcgagccgcgcggtccacgacggctcggctgcggcggcggcggcggcggcggcggcggaggaggcggcggcgcgggcggcggcggaggcagacggcttgagccggagctgctgggccaacatgccgcaggagctgctgcgggaggtgctggtgaagatcgaggcgtcggaggggtcgtggccgtcgcggaagagcgtggtggcctgcgccggggtgtgccggagctggaggcacctggtgaaggagatcgtgaaggtccctgaagtctccggaatcttgacgttccccatctcggttaaacagcctgggcctagggaatctctgctgcagtgctttatcaaacgaaacaggtccaatcagacgtatcatctctatgtcggtttgactaatgcacttagcgatgacgggaagtttcttctcgctgcacgcaagtgtagacgccccacctgcacagattatgtgatctccctgcatgctgatgatgtctctaagggtagctgcacctatgttggaaaactaaggtctaattttcttggaaccaagttcacaatctctgatgggcaaccacctcatccaggagcaaagatgccaaaaagtcgctcaaccaggctagtcagttcaaaacaggtttcacctagggctccagcgggaaactatccggtggcccacatttcttatgaactgaatgtgttaggttcaagaggaccaaggagaatgcactgtactatggatgccatccctgcctcagcaattgaagctgggggagttgccccaacgcagacagagttgcctcttagcagtgtcgagttctttccctcacttccttttttccgaacaaaatcaaatcgcgcggagagtgttagttcaggacctctggttagtcagaaagatggagccttggtgttgagaaataaggctcctaggtggcacgaacaacttcagtgttggtgcttgaattttcatggacgagtaacagttgcctcggtcaagaactttcagctggttgcttctccagaaaatgaacctgctgggccccaacatgagaagatcatcctccagtttgggaaggtggggaaggatttatttacgatggattatcggtatcccatctcagcattccaggcttttgcaatctgtctcagcagctttgacacaaagattgcgtgtgagtgaatagtgaacaggggatgcctagtctgtcgcaaggtaaaactcttctgagcaggcaatgacagtttctggatgatggtgcactcgtgggatgcagaagctgcttgcgatgaagtgtgaaattatttagtcatttagctcggtccttgagttagtgaataattggagagattttggcatttgagcttaggcgagaacattgtagcccattgtccactgtccatgtcctattttgtttctgtacataagtttctcgtgtacattaagttgttggtgcttctgtgtatgttatacactaatcg

SEQ ID NO: 422 - DNA, 2587 bp, Eucalyptus sp.
tatattcatgtgcttttcgctcgggttagttacatcactggatcttctgggtgttcttgctgggtggcttttgggtgatgtgaggagatggaactgagaatgggcggtggctgggtaggcgggaggcgctcagggtgttgaaatttggtgtcttccggcgagaattggtcattttaagaggttgtgggatcgcgagggttacggatatggcgtcgttcaagagcattattcaggacgtgaaggatgagattgggaacatctctaggaaagggtttgaccatgtgaagtttgggtacgggctgaggtcacgctcgcaccgggttgtgcaggacagttcggtggtggttgacgcattgaagcagagttgttgggcgagcatgccgcccgagctcttgagggacgtgttgatgaggatagagaagtcggagagcacgtggcccccgaggaaaaatgtggttgcttgtgctggtgtttgtaggaactggagggagatcatgaaggaaattgtgaaaacaccggaggtgtctggcaagttgacatttccaatttcgttgaagcagcctggtccaagggactcccttcttcagtgttatattaaacgcaatcgcagcaaccaaacatattatctctacctcagcttagatcaagctttaaatgaagatggcaaatttcttctcgctgcacgtaagctccggcgccctacttgcacagactacgtcatctctttaaatcccgatgacatgtccaaagggagtagcacatatattggaaaattaaggtcaaactttctgggcacgaagttcacagcctttgatgcacagcctccaagtgctggctccagagtcatgaaaagccggtcgaccaggctagtgaactttaagcaagtctccccgaaagttcccgctggaaattaccctgcagtgcacatatcttatgagttgaatgtcttgggatcaaggggaccgagaagaatgcaatgtgtcttggacgccatacctgcctcttcaattgagccaggaggagttgccccgacacagactgaatttgtgtccagcactctcgacacatttccctcattctcttttttcagatctaaatcgacgcgcgtagagaaccttgagtctgggagaccaatgtctgctccgaaagatgggatgctggtattgaagaacaagtctccgaggtggcacgagcaactccagtgctggtgcctaaattttcatggacgggttactgttgcttcagtgaagaacttccagttggtggcttctccagaacaaggagtcgccggtacagagcatgagaacgttatcctccagtttggaaaagtggggaaggatgtattcacaatggattatcaatatcctatctcagctttccaatcatttgccatatgtctcagcagtttcgacactcgaatcgcttgtgaatagttgactgccaggcagagaaaagggtctctgggaaggcatagaggtttaacgtgtttctgggagcattctgattaagggattttgccagagctcggtagcaccttttttttttcttttgaagtttaccctgactcgtctggttttcctattgatttttcattgtatatatgtgcttttgcagctgagagacatttgtgtgtatgagtttggtttcttgtgcttttgactagtgtattcgaattctttggtgaatgattgctgagagatgcctagtcagtttgctgacagctttgaaagaaaaaaaaaaaaaaaaaaaaaaaaaaacacgagactagttctctctctctctctctctcctcgtgccgaattcggacgaggagaagaagagggagaagatggcctcctcaatgctctcctcggctgctgtcgccgccgtcaagagcaccagcccggttcaggctgccatggtggctccgttcaccggcctcaagtctgcctcggccttcccggtcacccgcaagagcaatgacatcacctctctccccagcaacggtggaagagtgcaatgcatgcaggtgtggccaccggtcgggctgaagaagttcgagacgctgtcctaccttcctcccctgactcccacacaattggcgaaggaaatcgactacctgctccgatcgggctgggttccttgcttggaatttgagactgagaagggcttcgtctaccgtgagcaccaccactccccggggtactacgatgggagatactggaccatgtggaagctgcccatgttcgggtgcaccgactcggcccaggtgttgaaggagcttgaggagtgcaagaaggcttaccccaccgctttcgtcagaatcatcggcttcgacaacaagcgtcaagtgcagtgcatcagtttcatcgccttcaagcccccgggcttctaagcaagcttatgtcatggtggatcgtggggttaccctcgaagcggcatcgttccaaacctttcaattgtagctagatgtcgaatgatccatttttcccttattacccaagtcctgtgatatttgtgtacttttgagttcgcagatgcgttgcattaagacccgatttattctatgaatgaattcagctgtttgcttgcttgcttaaaaaaaaaa

SEQ ID NO: 423 - DNA, 1991 bp, Eucalyptus sp.
cttggatccgttttaagagagagagagagagcgaacgagcgagcgagcgagtgagagaaagcgagagaaagagtagagagagaaaccactgtgttctcgagatcttcgacggcggcggcggtggtcgcggtggcgctccggcggcggtggcggagatgacgtcgcggcggtgagggaccggagctggggccggtcaagcgctcttctcgctcgcgcagccgcgggaatcgcgcgtggggagtttcagcccccggggttcctcgtctcgatctgatctcgctctcgaacgaggaaggcctctcggtgtcgttccggatctgtttcctccggatgctccgaatgtagcttggcgctcgagctggttctggaacggtgcgggttcggatctgtccgcttcgcgggagcagggtggcagtttgtccgagaaggttgaatttggtgcggtcgaattaaaatgtccttaaaaaactttgtccgtgagctgagaagagagatgaaggacgggattggtaatgtgtcgaggcggggatcggaagggaggcgttggtgtagccgtacgcggtcgcacatagccccggatcacgcggcaccaccttcgatgtcggttgaacaagggcggtgggcgaacctgccacccgagttgctgctggacatcattcagagagtcgaagagagcgagacattgtggccttctcgtgctgtggtggtagcttgcgcatcggtttgcaagtcatggagagagatcaccaaagagattgttaaaactcctgagcaatgtggaaagctgacctttcctatatccttaaagcagcctggacctcgcgaatgtccaatccagtgctttatcaaaagggacagagctacttctacttatttgttgtactttggtttggttccttctgaggatgagaaagataaaatgttgttagctgccagaaagattcggagggccacatgcacagattttgttatatctctggttgctgatgatttttctcgggccagcagtacatatgtaggaaaattgaggtctaattttctgggaaccaagtttaccatatatgacacccaacctccatgtgaagcggctattcaatcaaacagtcggttgaatagaagattcaattctaagcaggtgtctccaagagtttctgcatgtaactacagtgtaggcaccgtctcttatgaattgaatgtcctccgcactagagggccgaggaggatgcattgtgaaatggactccattcctatctcttgccttcaggagggtggtagtgtcccaacaccaagcttgttcacccactcattcgatgagccatcttctctgtcacctgcctcaaaaggaaaagacaaggtcacagaatttagctccacaagtctcttagatattccagttcctgttccgggggcgggtgacccactggttctcaaaaacaaggcacctaggtggcatgagcagcttcagtgctggtgtttgaatttccggggacgcgttacagttgcatctgttaagaactttcagttggtggctgctgttgatccctcccacaaaatttcagctgcagagcaagagaaggtaatcctacaattcggaaagattgggaaagacatctttacgatggattaccgctatccactatctgctttgcaagcctttgctatctgcttgagtagctttgacaccaagccagcgtgtgaatgacatgacacttaagctggacgccatggacagtgtttactatttaactcaagcaaatgctcaagcataatcattacatgtggaagtttgtatggccaatcaacagcggagaatcttcgctgagcatccatagctactctatcgaagctggggattgtgaaactgaaaacttgtatgttatgtttgtatggcattgccttaatcaagtctcccaaggtctagcgcactttggatgtatttttattagctggctacttgactcttaattatcaaaactcttggaaaaaaaaaa

SEQ ID NO: 424 - DNA, 1823 bp, Eucalyptus sp.
aacagaggaagttagagaaaaatccaaaagagaaaaagaggaagaagaaaggcctccggttctcgtacgcagctgctcggctggcgcttccgcagccgtggcggtggaccggtggtttcagccgtatcgtctcgggacgaagaacaaaccaactcatcgacgacgacgaggagcccatttactagatcgctgaatatctcaccgcttggacctagctaccgttaggaccttgcgcaaatgcatatcaagagcattgtacatgagctcagggagatacgagacagaatcaaagacatagcggggagaaaactcgagcggagacacgtgcatcgccaagggagatcgcacattgttcctgaaaccacggttccaacgccttcgcgtccggaggcggtacagcaggggccatgggctaatttgcctcccgaattgttgcttcacataataaagcgtgtcgaggcgagccagatctcatggccatctcggagagacatcgttgcttgtgcctcaatttgtagatcgtggagagaggtcaccaaagaggccgtgaagactgcggagcaatgtgggcgcctgactttccccatttctctgaagcagcgaggacctagagattttccaatccaatgcttcattcgcagggacacggcaaattcaacctttttcttgtatctcggtttgagccccgacctgtctgaggggacgagcaaactgcttttggctgcaagaaagatcagaagggccttgagcacagattttgtaatatcattcatagcagatgatttttctcaagctggaacttcttatgtcggcaaactgagcaggtctaatttcatagggaccaaattcactgtttacgacagtcaacctccatgggacgctgcaatccaatcaaaccataagtcttatggaagacagaacccaaagcaggtgcctccaagtgtcccttctggaaaatttagtgtggccaccatatcttatgagcttaatgttctccgaagcaaaggcccaaggagaatgcactgtaacatccgttcaaatcccacctctgcaatccaggaaggcggtacagccccaacgccaacagaattttcaaggatctctgtcgagccgtacttgtcaccgctgccactgccagcttcaaatggaaagaagcagctcaatgagcatagctccaccagctgcaagctgttgaagtcgacccatggtgcatgggatccattggttctgaggaacaaaactcctagatggcacgagcagcttcagtgctggtgcctgaacttcagaggccgtgtcacaatggcctctgtcaaaaactttcagctagtcgctgccttggaaccttatcaaaacattcccaccacagaacacgacaatgtgatactgcagtttgggaagattggcaaagatatattcactatggattacctctatcctctctctgcctttcaggcctttgcaatcagcttgagtagttttggcaccaagccagcctgcgaatgacctccgtcttggatgtgtcttctctgtcgctggccaagagcatgatgacatttctcctgttgttgattgtacatatttttccatcgaagagatgtgcttggtaactttagtagttcccagtagtggctgcagcattgcaagagacaaaatatatcaactgttaccaatttattttgatctcaaacttctgcttgcagcagcttgcagatgataggcattgtcagatgactaggatgtcgcctgattctgtggatcttctagttgtgtattaagctcatgtgatactttcgaatgtacttttggtatatctaaaaaaaaaa

SEQ ID NO: 425 - DNA, 1852 bp, Eucalyptus sp.
ggaggagagagagagagagagagagagagagacttttcggatagaggagactttttggagagagagggagagagagaagaggagctgtgttgagtttgaagtgatctgaaggggggagagagagatctggagaagaagctaaagcagcatcctttttgcctgcccacaccaaagaaggctatgaacttttacatctactggtgaatcagagtaaatgtcgttccgcagtattgttcgggatgtaagggatgggtttggaagcctttcgagaaggagcttcgatgtgaggttgcttggtcataacagaggaaagtcacagggttcagttcatgaattgcatgatcaacctttgcttgtacagagcagccggtgggccagtctcccacctgagcttctacatgacgtgattaggagattagaagcgagcgagagcacctggcctgcccgcaagcatgttgtttcatgtgctgctgtttgcaggtcttggagagaaatgtgcaaagaaattgttaagagtcctgagctctctgggaagatcaccttcccagtctcactgaaacagccagggcctcgtgatggaacgattcagtgcttcattaaaagggacaaatcaaatttgacttatcacctcttcctctgccttagccaagctttgcttgttgagaatggaaaattccttctttctgctaagcggacaaggagaacaacctgcacagaatatgtaatctctatggatgcagataatatatcgagatcaagtagtacatatattggaaaactaaggtcaaacttcttaggcactaagttcataatttatgacacccaacctccatacaacaacgcacagttatctccaccgggccgtagccgtagattttactccaagaaagtttctccgaaagttcccacaggtagctacaacattgctcaggtcgcatatgaactgaatgtgctgggcaccagggggccacggaggatgcactgtgccatgcattcaattcctgccgcagccctcgagccaggtggtactgtccctggccaggccgagcttcttcctcgctctcttgaagactcgttccggagcatctccttctctaaatcaatagatacttccacggagtttagcagctcacggttttctgatatcatcgggccccgggacgaagaggatgacggaaaggacaggtatctggttctcaaaaacaaggctccgaggtggcatgagcagctgcagtgctggtgcctcaacttccgcggaagggtgactgtagcttcggtcaagaatttccaactgatagctgccaatcaaccgtctgccggcgcgccaacaccgtcgcagcccgctcagtccgatcatgacaagatcatcctccagttcggtaaggtcggaaaggacatgttcaccatggactaccggtatcctttgtcggcattccaggcattcgccatttgtctgagcagcttcgataccaaactggcatgtgaatagacggcgaagggggtgaggaaaagaggaagtctcctgcgaaaatgatttgcgtcgcgaatgataacgtcgagattgagagttaccgccagggattgtgtgcaaccattgtacaatccatgatagtgaactcttattttaaagtgcacaagtttgcataatgcttagggaggggtcttctatttcttttctcatcctcaattcccttcttctttcttcttctttcttttctaatcttttccagcgtagttttcattctaagtgggtcgcgtttcatctgttccttactgttattgttgtacctgtaactgttcctttaacagaggaagaaagtgaagatttgaacttggtcttaaaaaaaaaaaa

SEQ ID NO: 426 - DNA, 1980 bp, Eucalyptus sp.
tttttggagagagagggagagagagaagaggagctgtgttgagtttgaagtgatctgaaggggggagagagagatctggagaagaagcttccgtgtgtgtgggtttgatcgattgctaaatctgggcggagagatcgtcggtggaatgcgcttgtgtgcttgacctcccgcgttctcgacgctcgtttccctcgatagattggtggtcggctggatcatttcctttcccgtctttggctaaagcagcatcctttttgcctgcccacaccaaagaaggctatgaacttttacatctactggtgaatcagagtaaatgtcgttccgcagtattgttcgggatgtaagggatgggtttggaagcctttcgagaaggagcttcgatgtgaggttgcttggtcataacagaggaaagtcacagggttcagttcatgaattgcatgatcaacctttgcttgtacagagcagccggtgggccagtctcccacctgagcttctacatgacgtgattaggagattagaagcgagcgagagcacctggcctgcccgcaagcatgttgtttcatgtgctgctgtttgcaggtcttggagagaaatgtgcaaagaaattgttaagagtcctgagctctctgggaagatcaccttcccagtctcactgaaacagccagggcctcgtgatggaacgattcagtgcttcattaaaagggacaaatcaaatttgacttatcacctcttcctctgccttagccaagctttgcttgttgagaatggaaaattccttctttctgctaagcggacaaggagaacaacctgcacagaatatgtaatctctatggatgcagataatatatcgagatcaagtagtacatatattggaaaactaaggtcaaacttcttaggcactaagttcataatttatgacacccaacctccatacaacaacgcacagttatctccaccgggccgtagccgtagattttactccaagaaagtttctccgaaagttcccacaggtagctacaacattgctcaggtcgcatatgaactgaatgtgctgggcaccagggggccacggaggatgcactgtgccatgcattcaattcctgccgcagctctcgagccaggtggtactgtccctggccaggccgagcttcttcctcgctctcttgaagactcgttccggagcatctccttctctaaatcaatagatacttccacggagtttagcagctcacggttttctgatatcatcgggccccgggacgaagaggatgacggaaaggacaggtatctggttctcaaaaacaaggctccgaggtggcatgagcagctgcagtgctggtgcctcaacttccgcggaagggtgactgtagcttcggtcaagaatttccaactgatagctgccaatcaaccgtctgccggcgcgccaacaccgtcgcagcccgctcagtccgatcatgacaagatcatcctccagttcggtaaggtcggaaaggacatgttcaccatggactaccggtatcctttgtcggcattccaggcattcgccatttgtctgagcagcttcgataccaaactggcatgtgaatagacggcgaagggggtgaggaaaagaggaagtctcctgcgaaaatgatttgcgtcgcgaatgataacgtcgagattgagagttaccgccagggattgtgtgcaaccattgtacaatccatgatagtgaactcttattttaaagtgcacaagtttgcataatgcttagggaggggtcttctatttcttttctcatcctcaattcccttcttctttcttcttctttcttttctaatcttttccagcgtagttttcattctaagtgggtcgcgtttcatctgttccttactgttattgttgtacctgtaactgttcctttaacagaggaagaaagtgaagatttgaacttggtcttttcccgtttatggtaaggctcgaaatttgccaaaaaaaaaa

SEQ ID NO: 427 - DNA, 1792 bp, Eucalyptus sp.
agagagagagacttttcggatagaggagactttttggagagagagggagagagagaagaggagctgtgttgagtttgaagtgatctgaaggggggagagagagatctggagaagaagctaaagcagcatcctttttgcctgcccacaccaaagaaggctatgaacttttacatctactggtgaatcagagtaaatgtcgttccgcagtattgttcgggatgtaagggatgggtttggaagcctttcgagaaggagcttcgatgtgaggttgcttggtcataacagaggaaagtcacagggttcagttcatgaattgcatgatcaacctttgcttgtacagagcagccggtgggccagtctcccacctgagcttctacatgacgtgattaggagattagaagcgagcgagagcacctggcctgcccgcaagcatgttgtttcatgtgctgctgtttgcaggtcttggagagaaatgtgcaaagaaattgttaagagtcctgagctctctgggaagatcaccttcccagtctcactgaaacagccagggcctcgtgatggaacgattcagtgcttcattaaaagggacaaatcaaatttgacttatcacctcttcctctgccttagccaagctttgcttgttgagaatggaaaattccttctttctgctaagcggacaaggagaacaacctgcacagaatatgtaatctctatggatgcagataatatatcgagatcaagtagtacatatattggaaaactaaggtcaaacttcttaggcactaagttcataatttatgacacccaacctccatacaacaacgcacagttatctccaccgggccgtagccgtagattttactccaagaaagtttctccgaaagttcccacaggtagctacaacattgctcaggtcgcatatgaactgaatgtgctgggcaccagggggccacggaggatgcactgtgccatgcattcaattcctgccgcagccctcgagccaggtggtactgtccctggccaggccgagcttcttcctcgctctcttgaagactcgttccggagcatctccttctctaaatcaatagatacttccacggagtttagcagctcacggttttctgatatcatcgggccccgggacgaagaggatgacggaaaggacaggtatctggttctcaaaaacaaggctccgaggtggcatgagcagctgcagtgctggtgcctcaacttccgcggaagggtgactgtagcttcggtcaagaatttccaactgatagctgccaatcaaccgtctgccggcgcgccaacaccgtcgcagcccgctcagtccgatcatgacaagatcatcctccagttcggtaaggtcggaaaggacatgttcaccatggactaccggtatcctttgtcggcattccaggcattcgccatttgtctgagcagcttcgataccaaactggcatgtgaatagacggtgaagggggtgaggaaaagaggaaagtctcctgcgaaaatgatttgcgtcgcgaatgataacgtcgagattgagagttgccgccagggattgtgtgcaaccattgtacaatccatgatagtgaactcttattttaaagtgcacaagtttgcataatgcttagggaggggtcttctatttcttttctcttttctcatcctcaattcccttcttctttcttcttctttcttttctaatcttttccagcgtagttttcattctaagtgggtcgcgtttcatctgttccttactgttattgttgtacctgtaactgttccttta

SEQ ID NO: 428 - DNA, 748 bp, Eucalyptus sp.
ctgcgacgagcctctctcttcttctctctctttcatggagaacctgagctactcttcttcactccttccttgcccaccttcaccgccgctgtcttcttcatccccgtcttttctgtcattgaaccctagattgaccggcttgggtgcttacaacgccgaattcaaaggacatggcgataacaatatcgagcaaagtggttatctggggctggacatgtcgaactcatcgtcgttggatcaccgtcgcgtgcctgaagcgccagcagcggtggatgagaatgacgccgagaacgccttgaaggcagtcaagaagaagggagggaagaaggtgaggaagccgaaatatgctttccagacaaggagccaagtggacatactcgacgacggttaccggtggaggaagtatggccaaaaggccgtgaagaacaacaaattcccacggagctactaccgttgcacgttccacggctgcaacgtgaagaagcaagtccaacgactgaccaaagacgaaggcatggtggtgacgacgtacgaaggaatgcattctcatccgatcgagaaatccacggagaacttcgagcacatcttgagccagctgcagatctacggtgcctccctttagataggtcaccaacgcccgttgtcgctgttaactttttcacattctgggacatcgaaatagtagtaacatacatattgtatattgaaaagagggttaactgaccacgcacctcatttaaaactacac

SEQ ID NO: 429 - DNA, 1384 bp, Eucalyptus sp.
gggagaagaaggagaaggagaaggagaaggagacgggaagggaataatttttctcctggaaaacattcccgcgtagcgttcaccagttgacccgaggggcacactttacttgcactcgcgtgtgaacgcaagaagttgccttcgacaacactcgaacaggtcgtacggacgcgcaccgagcggaattggtcagctgggagcttctctaatcggcgccagataatttaaggagaagggaggattcgatccgaatggaaggtgaaagaggctcgtcgtcctcctcggttccgaactacgaccttcaagtcaccttctccggcgccagtcatggcattcatgagatcgggttcgtcccgttcgaagaccagaaccaggtgctcgggttcttgacgccggcgcctcctctcatcgccgccggcgagggcgccacggccgccgcaaccaccaccactagcagggttgggctgggccaccacaacggcctcgtcgccagatcgtcatggaataatgaccaggttggcgcacacgatccaaaggctgtcagcgacgagaattgcagcgcgaatcctagtgaaggcaacaattcgtggtggcggagctccacggcggcggcggagaaagggaagatgaaggtgagaaggaagctgagggagcccaggttctgcttccagacgaggagcgaggtggatgtgttggacgatggctacaaatggaggaagtacggccagaaagtggtcaagaacagcctccaccccagaagttattaccgttgcactcacagtaattgccgagtgaagaagagggtcgagcggttgtcggaagattgtcggatggtgataacgacctacgagggcagacataaccattccccgtgcgatgactcgaattcatccgaacatgaagggttcaactcgttctattattgccccaagacagaacccaaaaagcattgtcctggtgaatttggaggacgttagcgtgtgatgatgttctgtactatcgttgcaaactgactccgacttccctggtcgtgtaatctatgtctaggagcatagttacgttgttgtacttgaacttatttgcggctccttgtgtatatcgtggccgctacattaatttcctcttgtgcaatgtgacttgtcttccgttgtttgtgaatgcactcgccttaggagattaagttgaggatgtacgaaaacacagttctttttatctggtttaactgttcgtaaccagatctctacaatctttgcggagtcggttcagtttgtgtaatgccaaaatctctgtggagacagatcggggagagatgcaatatcagtaggcagatttggctgatatggacaataatctaaatgggctacggttcattccaaaaaaaaaa

SEQ ID NO: 430 - DNA, 1221 bp, Eucalyptus sp.
cgaaccgagcgcgaatcggctaatgttcatcggaagcttctcataagaggaggggtccgaggcttcaattttcgagcagggctcatggatcgtcggttctacaccaaccccttcgtgcatgatcaagaagaagaccccgagcccgagcaaggccctgattcgccctcctcgggggaagactccaaggtgaatgctagcgagccgtcacaaaagagaaggaagagcgtgaagaagcgagtggtgtcggttccgatcgcgggcgaccccgagggatccaagagcaaaggggaggcctacccgccgtccgattcgtgggcgtggaggaagtacggccaaaagcccatcaagggctcgccttacccgaggggatactaccgatgcagtagctccaagggctgccccgccagaaagcaagtggagcgcagccgcctggaccccaccaccctcctcgtcacctactcctccgaccacaaccacgccgtcccctcctcctcctcctccaagaaccaccaccacctccgcgccgccgccgtcagcgactcctccgcctccgcctccgcctccgcctccgcctcagcctccgccgccgaccccgacgactgcatctccgccatgttcgagccggacgagctcgcgggcttcatcggcggcgccactctgctcgaccccgggttcgactggctcgccgacgtggcctcgacgtcgtcgttcttgcagaggcccgtctacgagggaggcggcgcggaagcggcgcctgtacataggatgagggacgaggaggagggcgaggatccgctgttcgccgatttgggggagttgccggagtgctccttggttttccggcggactaagctactcgaaccggagggagagagccggaggcgcggtctgagcgcggttccctgtgtcggcaatgtagtatagcttaggttttggtcatccaatcaagcggttctgtgtatcagtccgactcggcgggggtcacgcgccgcgagaagcaacacggcgtctcatgcaccgacgaatctctttgtgggacgttgctgcagtgtcgtttcatcccaccgggtcgtcgcaacaattgtaaaacagtaaagagcgttgccccatttgaggagacgacgacagatgagaatgctttcgtcttaccctagtacaggcagccaacagtatattcttgttcttctatgtagaattctggattttgctgtaaaaaaaaaa

SEQ ID NO: 431 - DNA, 1207 bp, Eucalyptus sp.
gctctgtctctctccaacaccgcagcgtctgggagcttcgcatctcgtcggcgggggatctcgtttcatggcagtagactgcgtcaagatggtggacaacgagcgggccatccaggaagcggccgcggccgggctcaagagcatgcagcatctcatctccttcctctcttctcccccccaacccagctccaacccggatccccaccaccaccaccacctccagcagccctccgattcggccgctcacctcaccgactttaccgtctccaagttcaagcaggtcatctccctcttgaaccgcaccggccacgcccgcttccgccgcgccccgcagccgcccctccctctcgatctcgtcctcgaatccaagcccgaccccccgaagccggcgaccaagcccctgagccaggcccacccctcgctgtgccagtcccagtcgctgtcgctgtcgccgtcccaggacttcttcagcatgtctcagcccatgtcgtccgccacctcgtccttcctctccaccatcaccggcgacggcagcgtctccaacggcaagcaggggctgtcgcccccgacgatgtccgccgggaagccgcctctggcgtcgacccacaggaagaagtgcgcggaggaggccctctccgccgggagatgccactgttcgaagaagaagaagcacagagtgaagagggtcgttagagtggcggcggagacagcggcggaccagtacacgtggaggaagtacggtcaaaagcccatcaaagggtcgccattcccacgagggtactataggtgcagtagcgtgagaggatgcccggcgaggaagcacgtggagagagcccaggacgatccgaggctgctggtcgtgacgtacgagggggagcaccgtcactccgtctccaacgccatctcctacggctcgatgcccgacgcttgagaattcggaaaggacgcacgagatctggtgtccgaaaggggggtcctttgccgtgggggggcggtggtcacgggcaactgcagcggcagagcaagaagacaagagagacaggggggcgagagagttcaacttgcgcacggaattcaacgcaaacttccacgaggaagacttggtggataggcatctctttttttggttgcttctgtaaattatagctgaagaacaagaaaaattagtggaaatgaaagatgcgagttcatttagtcaaaaaaaaaa

SEQ ID NO: 432 - DNA, 1191 bp, Eucalyptus sp.
acttgctccttgtcatttctctctctatcctcccctaccttcctctcaatgcccctctccctttctctctctctctctctctctctcaaaatcaactggagcacaccttgatccataccctcttcttcactgctcctgctgcatcctaatctttaacaattcttgggtttcttgaaagtttgtgttttgtgaagcatcagtggagtctgtcatggctgctgattctgtcgcgccgaagctcgacatggatgatcctgagggagctaaaccagagggtcaggcatccaagagaaggaagttggtccataagacagttgtgagggtgaagattgaagcgaacgtggtgaagcagaagaacgaagggccaccttctgatttctggtcctggagaaagtacgggcaaaagccaatcaaaggatcgccttacccacgagggtattacagatgcagcacgtcgaaggggtgttcggccaagaagcaagtggagcgatgcaagacggatgcttcggtcctggtcgtcacctacacgtccacccacaaccacccaggccccgacattcactccctcaaccccaccgttcagccgtccgaggccgacgatgatcctgaagaaaccgcggtcgcggtcgcggtctctcccgctgtctcggcccaagaagaagtgccagagcaagatcaagatcaagaagatcaagatcaagaacaacatcttgatctcggggacaaacaagatcgagatcgacacacccacgtgggcatcgacgaagccgaccgcgcacgagaagataacttccactacctccggtctccgaccaactgttcctcccaagacctggtgatggagcaagacgacacgctcgctccgcaactgcaagtgtacgaagagcctctagtctcttgttcccgcgaggacccgagcggtgtcggggcggctccggtgccacctgaaccggagcccgagccgaaagagggccacgacttcttcgacgagctcgaggagctccccgtgttctcttacttcgcgaacctcaacaggatcaaccacttcatcgatgacaggattcccgttgtcccttcttgatcggagagcgcagagcgcctcggtgttccctcggtttcctcggcaacctcgggaaggcgaaaggactgtaacccatgaaagatgaaacttttttttgtccaaaaaaaaaa

SEQ ID NO: 433 - DNA, 1122 bp, Eucalyptus sp.
tccatcggctctcccggttttccgcaacgaccagccgcctgtgtccggcagttctcacggcgagatcaggtgctcgtctcatccccccgcccccaccatgcatggaagttttcaaagcggctcgttcatgaccgagcatgacgataatggaagctcgccagagaatagcattggagagtcaccgccatggcctagcagatatggcgatacgatgaagaccggccccacggcaacatctcctaagaggagtaggagaggtatgcagaagagagtggtttcgattccgatcaaggacgtggaaggctctcggctcaagggcgagggcgcgccgccgccatccgactcatgggcgtggaggaagtatggccagaagcccatcaagggctctccatatccaaggggatattataggtgtagtagttcgaagggatgcccagcccggaaacaggtggagcgcagccgcgaagaccccaccatgctcctcatcacctactcttgcgagcacaaccacccttggcccgctgcgaagaacaaccaccaccatctcaatcaccaaaactcctccgccgtgaccagtgccgtcgaagagaagcccaaaatgcttgccaatctacccaatccagaagccgagcccgagcccaagcccgagcccgagctagagcccgatcctgaacccgaagagaagtttccagacatgagcgacgaatcggtgctcatgtgcgctacggacgagttcagctggttcatggacatgccgacgacgtcgtccacgattttggagagccccatttttacagagagcggcaacaatagcgccagcaagggcgcggccatagacgcggacatggccatgtttttcccgatgagagaagaggacgagtcgttgttcgccgatctgggggagctgccggagtgctcggtggtccttaggcacggtcggagcggtggtgtgagcacccaagttcagatctgctgacccttcttttttcttaattaaatttctaatcccacttgtatttgtattttcccacttttctttttatctaattttttcccattcctggttaatttattgcttatggataaaataaaaaaagagagaggagttgttcaaaaaaaaaa

SEQ ID NO: 434 - DNA, 1074 bp, Eucalyptus sp.
ggatttctgagctaaaccttcatcacttcaggttttcttttttctggttcttgaaggcgtcgagtgcaagtccgatgggatcgaattggatagtggacacttccctagagcttaacacatcgtatccgaagaaggaaattgttctggaaaatgataactctcgaagagggcgaccagaagagcccgtcattaagcatgaggctggtgcactaatggaggagtatcgccgagtcagccacgagaacaggaagttgaccgaaatgctgacccttatgcacgatagctacaataccctgcagaaccaattgatcgtcttggagaataaaacctccgacggtgaactcggagcatcaagaaagaggaagcatgaagctaatatcgctgcagaaagttgcagttacgaggaagatcggatctgcaagaagccaaaggacatcttcaaacccatgatcactaaactccacttccaaactgatgtgtccgacatgagccttgtagtgaaggatggttatcaatggaggaaatatggtcaaaaggtcacaagagacaacccatctccgagggcttactacagatgttcctttgccccaacttgccctgttaaaaagaaggtacaaagaagtgttcatgacccatctgtccttgtggcaacatatgaaggagaacacaaccacctgagcccatctcagcctgcgattccactaggttctgacaaacagggactgaatcagggcacccgtccaattccatcgccctcgaagtcaagatcttctagtcctaggagtactcctgatttgattcgcttgggttgtgacactctatctgcaaaaacgggccaagaagaagaagtgaccgcggcatttcaacagtttctggtgcagcagatggcctcttccttgaaaacagatcccaattttacagcagcacttgccgctgcgatatcgggaaaattagttgaccaagcccggatcgggaagtggtgaatagacagggcattgatttgtccgagttgtgtattgaggatgatttacatatagtcgaggattaaatttgacggtgggatcgtggtgatag

SEQ ID NO: 435 - DNA, 1475 bp, Eucalyptus sp.
aaattcggcgcctccagcattcaagaggatactctctctctctctctcaagaagaagaagttcgcttttgcttcgtcgtcctccgccgtcttcctccgcttcgcttggttctgaagaacaagacaagaacaagaacaagaaaaccgaccctttgtcttcggcgttccatggattcttcttcctggattacttcttctttggatctcagcattagaccgctgcaagtttcagaagaacctccgaccaaagtggtggagagcgactttatggagctgggaaggactggttctgggaacaaagatgagagtggtgctctgcatgaagaactgaatcggctggctgctgaaaacaagaagctcagtcaaatgctgatgacggtgtgtgagaactacaatgccttgagaaaccatgtgattgaaattgtgagcaaaaatgctgagagagaagtcagcccgtccaagaaaagaaagtccgagagcagcactaacgacaatggcaatgagatggtagttaatagagcctcggagagcagctcgacggatgatgatgatttgtacaagaaaccaagggaagaaacaataaaggcgaagatcacgagggtttattataggaccgaagggccaggcactagccttattgtgaaagatggacaccagtggaggaagtatggacaaaagatcaccagggacaacccttgtcccagagcttacttcaaatgcgctcacgctccaagctgccttgtcaagaagaaggtgcaaagaagtgctgaagaccaatcggtcatagttgcgacttatgaaggcgagcacaaccatccaagttcatctctactcgaggcaacatgtggctcaaatgcccgtgccactcttgattcggttccccgctcggcttctcttagttcatctggacccactgtaactctcgacttgatgaaacccaagcaggaaaccgatgtcaaaagttcgcaaccgaaagtagattcaccagaactgaggcagtttctgatagaacaaatggcctcttccttgacaaaagacccgagctttacgactgcacttgccgcagctatttcggggaaaatggtcggcccatatccaactgaaaaatggatataaattggcgagaccaggatgatttctcatcgtttcttgaaaggaattccaggaggtgtctgtacatacaaattaggagggaaaaagcaaacaggaaaagttctcaagcttcagagtctgtccaacttcaccattgactgctgctgcacgtgtttgaacatttcaagttggaagtagttggagttgcatttcagaacagaagtcaaatggttcgttctagccgttgttgaatgttgaatctccaattcggtggatatatcaactcatcacgacaaggattttaaacttgaaagcaccccctcgtgtactcccttttgacatttttctaatgtatctagcgtaccctctttgacaaaaaaaaaa

SEQ ID NO: 436 - DNA, 1368 bp, Eucalyptus sp.
ctttcctcacatcttccggtgatttgctgtcctctttcctctctccttcggcaccaagggaataaaaaccccatcatccatcactcgcccagaaaaaatccaccgtgaaccacaagagcggataagaatctgccatttttacacggaaagatggaaactttttggctcgagagatcattatcgactaatagtagtagcaagagaagagcgatcgaggagctcgtcgatggccgtgaatcggccatgcggcttaagacccttctccgtaaaccctctgggaataatgggtctcagccggccgacgaacttgtcgtgaagatcttgagatctttcaccgagagtatctctgccttgagttcttgtgaagagagtgaggttcgtgaggttatgtctccccagattggtggcttcggcgccggttgtgacgatcaggggtctgaacattccggcgagagtaggaagaggccgggcttgaaagacggaagaggttgctacaagagaagaaaggagtctgaaacccgcacaacaatttctcccaccaaggatgatggtcatgcttggagaaagtacggccaaaaggacattcttaattccaagtacccaaggtgctacttcaggtgcacacacaagaatgaccaaggttgcagagctaccaaacaagtccagaaaatggaggacgaccccaaaatgtaccaaatcacatacattggcaatcacacatgcagagagatcacgagggccccacagatgatcacagactctgatccctgggaatcctcttacactccctcccgcaacaattcggacacaaagcctctgaccaattctcagcaaagttttgtcctctgctcagctaacaacagcatcaagaaagaagaggaactagcgccagttaaggaagacaccacaacaacctcaagcgacttgacggataacctttcatccttcgattcacttttgcccccagaactgatgggttttgaatcatctgacccgaccgccatgtacctgtctggtgtggatgatagtccgcagagttttctggacatggacacgatgggacgattcggttttgatggagagtttccattttacgagaacttgcagttttcctagcactcgataacacgagtcagcatcgcttgtatactcttgtttgtactgtttagctccgaattcgtcagctgtcttgaggaaaaaccagtttaggaatgaaaaattttcgctctgcactcgtgagagacttcggactgtgttgagactagtcttttgtacgcctaatgggacactaagtaatgagatctgttcctcgtgtaccccttttacacttgcaaatgaaaatttgtgtgctttttatgaaaaaaaaaa

SEQ ID NO: 437 - DNA, 1312 bp, Eucalyptus sp.
actggctgcacaactccaagagcttactctctctctcttcctcgagttcgaatatcggtggtgaatccttggtgggaagttgcaccataccccagccatccccccccctcctttctcgagcagcctgatgaaagagcgcgcgaagatggagaacaccgacgggtccgcatcattactgttcgccgatcacgggcacgggggcctgtcggatttcgtcttctccgagttcgacaggagcatgatggccgggtcctcaggcttcatggagctcctggggttccatcaagactcctccggcccctcgctgttcgacgtgccgctccagcctccgaccagcaatgcgatggagtcgtcgtcggaggtcgtgaacccgccggcgacgcccaactcctcctccatatcctccgcgtccaacaacgacgggctgaacaacaacaacgaggaggaggagcagcaggtcaaggcgaaggttgaggatgaaggagtagagacgcaggagcaagaagagcatcagaagactaagaagcagttgaaagcgaagaagacgaacgagaagagacagaggcagcccagggtggcgttcatgacaaaaagcgaggttgatcatctggaagatggataccggtggcgaaagtacggccaaaaagctgtcaagaacagcccctttcctaggagttactatcgttgcactagtgcctcatgcaatgtgaagaagcgagttgagcggtcggtgaccgacccgagcatcgtgatgacaacctacgaaggccagcacaaccacatgagcccagtcatgccccggtcgatcctcgctggagtcacccatccccctgccggagccgccgccaccgccttctccgtgcctgccatgccgggagcgagtttaacccaacaccatgcccttcactatcaactacaatcctacgccaacaactggtcaatgagcaacaacagtgcggtggttccaagttcggggtcaacaaatgcagctgtacttttgaataagaggcgtttttgcagtcccggcccttataattttcttgccgacaacgggctttttcaagacatggtcccttttcatgtactcaaggaggaagagtagtaatagctgatacgagatattgacaagtgcatactattctttttcttttttcactgatgaatgactgaaaatgaaagagaggggaagcgccggtgatggactttccatctgatcacttgcagtgttcatgacatgtattgttacgttgctcatgcagaggtatttaggcactaatcctgtattgtgaaaaaaaaaaaaaaaaaaaaaaaa

SEQ ID NO: 438 - DNA, 1668 bp, Eucalyptus sp.
cttctctccttgcccttttctccttttcgtcttttcgctttaatccttcacctgtcatcaccgaggttgtcgatccagccgagcccacagtaatctcatccgcactctctggctttatatcttgacgggctcgatcccagcatgaggaaccagtaggcacccttcttcgttttcggcaacagtcaccttcccttcccgtcgaatattttctagagagataagtctcttgtgactgtagcttgttgggcctgatctttgcaaaaaatggagaaggtcatcagctgggagcagcacaacctgatcagcgagctggtacaggggaaggatctggcgaagcagctgcggaaccacctcgtcagcccgtcgtcgtcccgggagacgcacgagtactttgtcgagaagatactctcgtgctaccagaagtcgctggcaatgctgaattgcgatgcgttggcggaggagcacaggcccgccttcagcattgggactagcggcagccccaaggacgagggggacgcctgcaaaaagaggaagacgatgccgcggtggacggagcaggtccagttgaactccgaagccggactagaggggcatcacgaggatggctatagctggagaaagtatgggcaaaaggagattcttggagctcgtttccctcgggcatattacagatgcactcaccgcaatgcccaaggctgtttggctacgaagcaagtccagagatcggaccaagatccgactgtcgtcgaagtcaagtaccgcgggcgacacacttgcatccaagcccgtagttcagccatcagtccagacccgatcatcaaggaagagcctccgaaagcaaccgcaatccggcaagaacagcccaaaccatctctagacacccttttgagcttcaaatggggactcaacgttaaagctgagaacgcgaggcaggatgatgtgttcccgttgttcaccttctcctcccccgcagtcgagaccgagaatggagagagggattactttgctgatgcgctgatggatgacggcttcatggacactttctcgtcgccggcgacatcagggtccaattacttttccctgtcgctggaccacatggccaacttctgccctcccatcagcgtgcagacgccagagtccggcctcacagaaatagtctcagctccaacctcggtcaccaattccccaatgggggacgcggctttctcggctttctcgctaggcaaggatgatttcaacctggactgttccttcgacggttcggaattcttgttatgattgctggggctgagctgtgtagtgaatttggtcagtaggagagtagaggatgattcggatttcagttcctggacatcattgaaagaggcgaccgaacaaattggtagagcaaaccaggccacctagggtccttctacaatgtccaggagagttgatgcttagatttcaccaaaacgaacgtgtaatttgtgtgcccttttgttctcgcttttgctgtttcccctttttctttttgtttaatttgattgagcatattcttagaaagttaggactacagcttcttcttcctgagaagatatatctgactgcaagatgcagcttgtaaaatgttcactattgtattttgcccagatttagagaagaaaaatttgattctgaggaaaaaaaaaa

SEQ ID NO: 439 - DNA, 1287 bp, Eucalyptus sp.
aaattttttccggagtcctccatgaaagcttgagatcgagagagctcgccaccgtcgtccgccgccgcagaacccatctcacccctcctcctccccggccgcctcctctctctcgggccgtccgatggcgatcgagctgcatcttggcttctccaagatggaggatcacacggcgatacaggaggccgcgtctcaggggctgaagaccatggagcacctgatcggcgtcctctcccgccagaacctccaccaccccggcgccgtcgactgcaccgacctcaccgaccggaccgtctccaagttcaggaaggtcatctccctcctggaccgcaccggccacgcccgcttccggcgggccccgctcccatcctcctcctcttccacctccaagtctgcccccgtcgcttcccctgtccccccggcggttcagtctcggagccagcctctagcgccgacgcccatccaggccccgacgagctcgcagccgtctccggccagcttcctccacgcgcagcccaagcagagcttgaccctcgacttcacccggccgagcatcctgggccccaactccaaaggcgtttccgagatcgagttcgcgaaggacagcttcagcgtgtcgtccaactcttccttcatgtcttcggcgatcaccggcgacggaagcgtttcgaacgggaagctggggacgtcgatgttcatagctccggcgtccggcccggcttcgtccgccggaaagccaccgatctcgagcgtgccgtacaagaagcggtgccacgagcacgacccctccgataacatctccggcaagcactccggctccggcagcggcaagtgccactgctccaaaagaaggaaaaaccgagtgaagaaggtgacgagagtgccggcgatcagcaacaagatcgcggacatcccggccgacgagttctcgtggaggaagtacggacagaagccgatcaaagggtctcccttcccacgaggttactacaagtgcagtacaatgagagggtgccccgcgaggaaacacgtggagagggcccccgacgatccaacgatgctgatcgtgacgtacgagggggagcatcgtcactcccagcccgcgtcgcaggagattgtgcccgccggtgcgatgaacctggtattcaagtcaacctgagggcggctgacaagtcaaagccggaggagatagggtttttttttacctcaaatttgagcggatgtaaattttgttttccccaactttgtattaaagaaacagaaattggcacaacattttcaaaaaaaaaa

SEQ ID NO: 440 - DNA, 2029 bp, Eucalyptus sp.
ggacagctcctcctctctgacgttctcatcttttctttctttcttatcttctttcttggctctctttcctcccccccaccgaaactcgtgctgcttcctccctctttcctttcctctttcctttttcctttttcctttctccgtgtctcttctatatattggcgttcactccagtcaatttgacacaattcagcgtctccagtctttcttttcgcgtgggggtcaatctgagggaagcccgacaacagctggccgatcttgaaaagaggggaagatacgagggaaaggaagtttgcttcttcccagctgagtttggttcaaggcagttcttggagtcgcctcctcccgctatggattattcttcctgcattagtacttctctggatctcaatatcaggccgctcaggcctcatgatgaagctccgaagagagagccgcaagagaccgactttatggatctgggtttgaatacatctgccaaagaagagactggtgctttggttgaggagctcaatagggtgagtgctgagaacaagaagcttacgcagatgctgactgtcatgtgtgagaactacaaccacattgagaagccaggtgatggattacatgagcaagacattgctgagaaggagctcagtccctccaagaaaaggaaatgcgatagcaacaacaacattggcgaaaacaataacaacatactcgcaaatggtgcttccgagagcagctcgacagatgaagactcatctaagaaaccgagggaggaaaagatcacggctaaaatctcaaggctctatgtgaggaccgaagcatctgacactggcctgattgtgaaagatgggtatcagtggaggaaatatggccaaaaggtgaccagagacaacccatgtcctagggcttacttcaagtgctctttcgctccaagctgcccagtcaagaagaaggtgcaaaggagtgttgaggaccaagctgttctggtagctacatatgaaggtgaacacaaccatccaactcagatggaggaaacacaaggctcaagcaggtgcatggccattggatcagtgccctgctcaacctcactcaactcatctggaccaaccatcactcttgacctcaccaaatcgaagtcccccatcgtttccccaagcagcaacaacaacaacgacaataacaacaacaacaacaacaataacaataacaacagcaacagcaacagcaacaacagcaacaaaatcaccttaaaacccaagacagagtcgcctgaaatccaaaggtttctggtggagcagatggcctcatccctcacgaaagaccccagcttcactgctgccctggctgcagccatttcagggaagatcttccaccagaaccctaccgggaaatggtgaaaaaattgagtaggggttcattaggtgttgattttgctttgtaaatggattgaaagtgaaagtcctaagaaaaaaagagaggaaaattttgttctgccaagttgaaagatgccattcatggttttggaagcaagttgctcaaattggacagtctagtcaaagcagtccaactcaagtggtgggctgttcgagtcatcttcttccaaaacttgttgaaagagctagtcctttctttttacttttgtcccacgtagcttgcttttcttgacttccttgcggggcaatttgagaaggaaggggctctctgaccgctccggtgcaataagattcggaaagcaacgttcgtggaaaatgggtgcaacttccaactcagcaggaaaatgcgagtctttggtcttctctttaccaagagtgaagacgagtggtgggagtatcctcattttcatgtttgtagcttagataggacaagcacgagaagagaatatcctgtaataggaaaaggaagaacagatattttgtagacatttacggatttatagctccagaaaccttgttactggacatggaagccgctcaacccagctggagctattgctcaactcagcgggaatatacggattccaagtatggttttcaactaaaac

SEQ ID NO: 441 - DNA, 1620 bp, Eucalyptus sp.
ctgcttcttgcaagcttcctgctctcaacctcacatagcattagcttgcttcctcctctgtccttccatcttaacctccactctgcaatcgctcagaaaagtttcatcatctcagaaacacccagaaaggaaaaaaaaaaaaaaaaatttactcttctgcacctgctcagcttctttgcttctgtagtttcgtctcgtcgctcttcgcctccgccattctcgtgcttcctgattcatctggtgccgacttgcttttcatgtaccatttgaatgtgctgagaaaaagggcgtcatccaagtcgtcgtgagttttgcattcacgtaataaacacgaaggatggatggtggttggagtttcgagcagaagacgctgatcagcgagctgatccaagggatggagtttgcaaaggaattgcggggccacttgacttcggcgccttcgactgaagccagggacgtgctgatgcaggggattctgtcgtcctacgagaaggctctcctgattctccagtggggtggaccaatgccacagtctcagcccgtcgtggcggtctctggcatccccgaatcaccgctctctgtcaacgggagccctcggagcgacgaattcgaaaaggggattggcgatcatcagcagaacagagatatatccaaaaaaagaaagctgatgccaaaatggacggatcaagtcagaattagttctgagaatgggcttgaaggacctcatgacgatggatatagctggaggaagtacggacagaaagacatcctcggagccacatatcccagaagctactacagatgcacctaccgtaacacccagaattgttgggctacaaagcaagtgcaacgatcagatgaagaccccacagtctttgagatcacttacagaggtacacatacgtgtggcaattccgggccttcggtcccatcaccagcgtcctcggaaaaacaagaacagaagcaaattaatcaccagagcaatcatcatcaacatctacaacaacaacaatcacaggagatgttgtcaaagtttcgagcaggactgagggtcgataccaataacttggacaacaatgaaaaggcataccatcctttctctttcccctcagcatcagtcggactcttgcagattgaacactgcagctcctccactttgacaaacgttaacagcagtcttttcgggagcttctcatcgacatttttctctccatcaaccccggaatcatgttatttttccatgcaccaggcaaatgacttggggcaggcccacaatatgcaacatttggagtctgatcacaacgagatcatctcaaccaacacctcgtcaacaaattcgccaataatggaccttgaattctccctcgatcaagttgggattgacccaaatttcccatttgacacctcgtttttcccttgattcatcagatgataataaaaaccaatatgaaaggtagggaagatgcaaatagccagataagcttttgtagccattgccgcagcttgtattttaaggagtgaggttttatgctttttatggggaggttctaaggatacaaaagagcctcctccattatcagctaaaagatcagaccagtacatttattttcaaaaaaaaaa

SEQ ID NO: 442 - DNA, 1693 bp, Eucalyptus sp.
gcttcttcatatgtgttccttctctagccgctccagggagagaggtatggccgtggagctgatgatgggttacgggagcggcggcgacggcggcgttggcttcgcggtgaagaaggaggagaccgccctccgggaggccgcctccgccggcatacagagcgtcgagaatctcatcaagatgctgtcttcctcgccttccccctccccctccggcggcggcgcgggcggcgggcggcgggccgggcaggactcgccgtcgccgtcgtcgtcctcttccgggggcccgagccccgccgtggacatcgaggccgccacggacgccgccgtcaacaagttcaggaaggtcatctcgctgctcgacagggcgaggaccggccacgcccgcttcaggagagcccctgtcgccgaccccctccctgagaaccgggaagcgtttactccggtccgaccggcggagaacccggtcgggagcgcccggttgcagagcgccgagccggtctcggctttcaaggtctactgcccgacgccgatccagcggctgccgcccctgcctcacaaccaccaccaccaccacaaccacaaccaccaccaccaccaccaccaccaggtccaacagaaccccatcccggtggttccgaaggtggagagaaaggagtccgcgacgccgacgactataaatttctccacctcgccgccgatctcggctgcgaactcctcgttcctgtcctcactgaccggggagacggacagcgtgcagagatccttctcctctgcagggtttcagatgacgcaccatctatcgcaggtttcgtcggcggacaagcctcccttgtcgtactcactgaagaggaagtgcagttccatggacgacgcggctctgaagtgcgggtcgtcctccggcaagtgccattgctcgaagaagaggaaatcgagattgaagagagtggttagagtcccagcggtcagttcgaaaatggcggacatcccaccagatgatttctcatggaggaagtatggacagaagcccatcaaaggctcccctcatccaaggggctattacaagtgcagcagcgtaagaggatgcccggcgaggaagcacgtagagcgggccctggacgacccgggcatgctcatcgtgacctacgagggcgaacacaaccactcccagtccgtcgccgacgtgaaggcgccgctggtcctggaatcttcctaggcccgccctctcgcccgctctctctcgatctctcgatccgactggggtccatggcgatctcccggtccccccggctgttgattgaacgtgaaggaagcgacaccgacgctgataatgctttaggggggagagagagagagagagagagggagggaggggctcaaattgtcaacgcgaagatgccttggctctgttctcaaggaggggagcgtggagggggaaattggattcctttgtcttcgggttcttttgtttactattttggcttcgcccccttcttttttaaatttatttcttttgtgacttctggtactaaagaaagaccttgttgattaagggggggaaagaaaaggaaaaggagaggatgggactgtagatttggtggggagtgaatcatccgactagtggggtggattttcgttttgatatttgggaaagtattattttagtgaaaccttagattaatataaaaaaaaaaaa

SEQ ID NO: 443 - DNA, 1742 bp, Eucalyptus sp.
ctcgtgccgtgggcttcgaaatctcagagctttctccgaactctctccccctctttctccctctccctcccctgcgaattgagccgcgccgccgcccggccgtttcgtcatcatcgtcgtcgcaatcgacggctgcggttcgcgggtggttgggtgggttggtggggtcgggacttgaattgggttctgatcgagctgggaaattgaagatggtagtgtgccttttgaccaagtgaagtctttaacaatcctaatctaaagtgacatatggctattgaagaaagtgcaccaaatgaaactggtcctgaaggggtgaagcctgaaaacagccctcaaaatggaggtgatacacctcagcctgatcaaaaatcaaattcaaaagaatcccctggatgtggtgtggggcttcaaggggtacagtcaaaggaacctttagcatcagagctgacccctgaaagtgttaagcatgggtcacaatctggtcaagaaggcagcactccctctatcagttatgaaaagagttcagaggatggatataattggcgaaaatatggccagaaaaatgttaaaggaaatgaatttgtgcgtagctattacagatgcacgcatccaaactgccctgtgaagaaacaagtggagcgctcgcgtagtggccggattaccgataacatctacttaggcgagcataatcatgctagcccacagaagcacctaccagtggctgtcagctttgccgtgtctatagttgaggagaaaccagagaagccttccccaataagcacgcaagacaaatcatcagaagtgaagagggaggcatcccatcaggtcgacgacaaaaaacctcctcagctttcggttcccactcctgctgatgtgaaacctgtggtaccagcaatagtcaaggtacaggatgaaatagctaccgatgaggattctcctggttcaaaaagaaggaaaaaggacagttgcaacccagatatcccttcaggggataagcctaccactgaagcacgcgtcattgttcacactgtcagtgaggttgatattgtcaatgatgggtaccgttggcgcaaatatggccagaaaatggtgaaaggcaaccctaatccaaggagttactacagatgttcaagcgccggatgtccagctaaaaagcatgtggagagggcgtctcatgatacaaagttggtcatgaccacttatgagggtcagcatgaccattctgtccctccttcaaggacaatcatgcctaatcctgggggattcaatggtcatgcaaccacccaaagtggagatgtgaacatcaaatctccggatggcgagaccgtgtctcacagtgttggggagaatgctagttcagcttctgggagtaagtcaaccgaccaatccaatggcaaggccgaagaaacatcgggaactggtgatgaagttggggatagaacggtattaaataatgatttgggtcctgaggatcgaattagcgagcaaaaagaagacctgtcgagtactaaatcaggggaccgtgatcctgttcatctcgactctgtcgtgaatgtgatggagaattcacacccaccgcaacagccatctaatgcagcagctgttcaaagctaaaccagtgtcccaatctgtaatgttcaacccgcgcacaaaacgttcgccgaggctgtactatttttcttatgttaatgtatgagtgatcaggtgtggcataggtcattggaagttgcctaaaaaaaaaa

SEQ ID NO: 444 - DNA, 1961 bp, Eucalyptus sp.
aaaaccttgataaaccttgagaatctgtctggatggtctctgtctgcaactgtatagtccttaccaaactgattctatgctgcactgtgaaggatgaaggaaatagtacttcccacataactgaaaaaaaatgtgatttacatcatccatcagttggagatggagacgaaagagacagacagagtagtgatcgcgaagccagttgcttcacgacccactagctcaaattttcaatccttctcggagctccttgctggtgccattaattcatcgccacctaatgcatgcactgaatctgcagttgccaccattagacccaaaacggtgaggtttaagccagtgccaaatcgagctccaactgcagtgaattcatcccaggcagaagtctctggaacagcaaccggcaattccaatgataaggctttaaagtcagatgaaaagcctaccgtaatatacaaaccattggcaaagcttgtctcaaggtcaaccgtctcgctcttggctaatatgggaagcttcaatatggctcaccatcaaacattgtcagttgccgaagcacgtgttaaatctcaactgcaggacaaaaacaattcgagatcccagcctattggaaatctccatcggagtgtctcttcacaagcagatatggatgggacaagtgaacccttgagattggcctcccagaacatggaagaagacacgagaacttcaccggccttgaacatggatcgcccttcttacgatggatataattggagaaaatatgggcaaaagcaagtcaagggaagcgaatatcctagaagttactataaatgcacacacccaaactgcccggtgaagaaaaaggtcgagaggtctttcgatggccggatagcagaaatagtctataaaggcgagcacagccatccaaagcctcagcctccaaaacgcagtttgtcaggaacacaagggttaggcaacgtactggaagggtctggcttagacagcacaaacaatcgcctgaatgaaagggatgaatgctctgaagatagagtagagaacaagaatcttgcactcacgacttaccatgggaaaggtcccctggcttatgatcctattgcaaatgtggcttctaatgctggtggtgcgacacctgacaattcttgcggtattagctgcgaatatgacgatggaagcaaggagttggaagtggaggatgatgagcccaagaacaagagaaggaaaagtgacaatcaattgaatgaaccgggcatttcgggtgaaggaatacaagaagcccgcgccgtgcaaaattcaacagattcggagattgtaggtgatggatttcggtggaggaagtatgggcaaaaggttgtgaaaggaaacccgtatcccagaagctactatagatgcaccagtgtcaagtgcaatgtgcggaagcacgtcgaaagagcttcagaagatccgagagcctttataacaacatatgagggaaaacataaccatgagatgccactaagaagtaccaacacagcaggctcagagtccgatctgcaagcagcctccagtaaagataagccttaactgttaccttaagtaacatctgatagcgttatgaagggcagaggacaggaagaacaagtcaaacaagagcaagaaaagaagaagggttgactcagacatcggaagctgagtcacttcagtaacctgctggaagtattcttttactgatgatagctttgacttgataagatttcttccctttgagtttttcactttcacatattcagctcacttgtcctgtcatcatttcagtatatagctcttcccaacttactaaaagttttgtcaaaagatgttgtctgccatgaattgttctgttagtttcttggatcagacgtaggttctctttatatgcagcttgagaagcaatgtaactgtagaaattttctatttattcatcttgtcttttaaaaaaaaaa

SEQ ID NO: 445 - DNA, 1843 bp, Eucalyptus sp.
acaacaccagcacccgtcgatactgggctttcccagaggagaaaaaaactaagccaagatatggccggaaagcagccgccgccgccgctgcggcccaccatatcggtgccgccgcgcccgccggcggccgccatgttcgggccctgcgcgagccccggcccgttgacgctggtctccagcttcttcgccgagtccgacggcgggtccttctcggagctgctcgccggggccatgtactccccgctcgccgtcaacgccgcgggcccaagctcgttcctttgggactacccgcgcgagaacccgtcgagggaaggggagcctcgagatgggcaggcgggcctgccggtgggtgctgtcaagtcgccgttgttcacggtgccccctggcttgagcccttccgggttgcttctgtcgcccggcttcttctctcctaagagcccctttgggatgtcccaccagcaggccttagcacaagtgactgctcaagctcatgttgcactagcacggtctcatgagcactcgcaattagaaattaatcctccatcagaagcatcaaaagagccactcccagatgaaccatctcttatgccaaatgaggattcacatcagctctctccatcagaagctaccacttccatggccgaatcctctgatttcgttagttccagtcacaaatgggaagctcttcccatggttctagagaagcccactgaagatgggtataattggaggaagtatggccagaagcaggtcaagggctgtggttttcccaggagctactataaatgtagccatctcaattgctcagtcaagaaaaaggttgagcattctcttgatggtcgtataacggaaattacttacagagggcaacaccagcatgaaatgcctcaagccaaaaggacttcaaaagatggtaacaacttgaacaggagcacaaattctctggctaaatctcaagctgttcttcaggggcagagtgggcgccaatctgctcctgcaatgctcaggagtggccaagatgaggagtcctctcaagcaatcgcttcaaataccagcgggttaagtaactatgtggagttagatgatgctaaatcaaagggagatggatctgatgtcgataatgatgatgttgacgctggtgatgacaaatcaaatcccaagcagaagattgtgccaattccatcaagcaaatatgtcacagaacccaagatcgttctgcagacaagaagtgaagttgatttgctggatgatggcttcaagtggcgcaaatatggacagaaagtggtcaaagggagttcctacccaaggagctactacaagtgcacttacgcaggctgcaatgtccggaaacatattgaaagggctgcgttggaccctaaatccgttataaccacttatgagggaaagcacaatcacactgcaccatctgctggaaagcgaggccgcactgttgaggcaacggaatttggcgatgcccaaagaccgtcggttctacggctgaaagaagagcaagtggctgcttgacccttaagctactcgatgctcatcttactgaaaagagctcgtggactcggtggattttggccagagtcacacaggccatgtatgatcgaacagaaatgtgataaatatgtaaatgagcgaaccctcttgctgtcacttggggcttgtgttttccatgcacaaaaaccacatcaagtgcaggggaaggttattgcttatgctttatgcatctcctcctgtaactaagcatcagtaactctgtcgtatcaattgctaaggctgaatctccaaaaaagtgagatttcaaatcagtctttactctgttttcccaaaaaaaaaa

SEQ ID NO: 446 - DNA, 2263 bp, Eucalyptus sp.
cttctcaacgcctttgactctctctcctcccctctcccctctctctctcgctctaaaaatccaacgggatggggtctcctcccgctcccgacttcgaaccgcacgagttccagttccgcagcgccgccgatcccagccccggcggccccttctcggactccgatgccgggcctctggccggcggcggcggcggcggcggctgcggcggcggcggcgggggcgccaggtacaagctcctgtccccggcgaagctgccgatctccaggtccgcctgcatcacgatcccgccggggctcagcccgacttccttcctcgagtcccccgtcctcctctccaacgtcaaggtggagccctcaccaactactggttctctgattaagcctcatatgatgaatggcttgattggttcgaattcggacacaagacttgccaattctggctgtcctgataactttgatgaaggcagatctggaatttttgaattcaaacctctagctacatcaagcatggtccccacagaggcaaaacaccaaggaagtgaacaggctgtgaaagtttcaggtcaacgtcattctcaaccatttgcatcactgtcttcagttcagagtgatttggctgtctcatcgaaggaattgtgtctatcggtacccactcaagcggttcgctcaggggctagtccacttgctgaagctgatcctgatggattgttaggtaggaaagagcagcccaataatgtgatgcaggtgacacaactggataataaagggaatggcccttcagtcatgactgagagactctctgacgatggatataactggagaaaatatggacagaagcatgttaagggctgtgaatttccacgcagctattacaaatgtacctatcctaattgtgaggtgaaaaagcttttcgaacgtgctcctgatggacatattacagagattatctacaaaggaactcatgatcaccctaaaccacaaccaagccgccgctttactggaggagcgaccatgccaatccaagaagaaagatctgataggttttcatttatacctgcagtggagagcacatcgaccgtatatggcgagacatcttataatgttgagactgatggtactcctgaactatctcctgttgctgagaatgacgaaactattgagggagcagcttcactatcaaataggatccaaaatgaagttgatgatggtgacgatgatgatccattcttaaagagaaggaggctggatattggcggggaagatgttactccggtggttaagccaataagagaaccgcgggttgttgttcaaactcttagtgaggttgacatactggatgatggctatcgctggcgcaaatacgggcagaaagtagtcagaggcaatcccaatccaaggagttactacaagtgcacaaatgctggatgccctgtgaggaagcatgtggagagggcctctcatgatccaaaagctgttattactacttatgagggaaaacacaatcatgatgttcccactgcaaaatctagcagccatgacactgcagctccctccgctctaagtggactgccaagaacaagatcagaaggtgaaacagtgagcctagatcttggtgtgggaagaagtgcggcatcagaaatggcatcagctgagaagcagcagatcctccggccaaaccctgtccaaagtcgaatccactatgccagttccgctttagatgcagttcaagctactccagttacagcatatcatggttttttaaatgggggcattaatcagtttggatatagagaaaatctgactgagggacatagcaagtccacagaatttctgcagaacatgggaagaatactgactggtccgtgactgagccttttatttccgttactagctgtataagatgctcagagttctcttgtgacagcaaagataaaagtaaaggtacagaattgaaactaatcaagcgggtaatgttgattatggctgccaaattaagagctagcatccattgacttcttcaagatacaatgttttatgtaaaaatatgtgcattacaggtttactactttgacttcaattgtacagtaagtcaagggtctcaacaagaatatccatgtggaagttgattaccaaaagtatgcactggtttgtaagttgcctttactgttgaggttttcgttattaatgtaacttgtttgagattgaaatgcgcactgaaggcgatactaacatagttgcaaatccttcatagaagaaaaaaaaaa

SEQ ID NO: 447 - DNA, 2726 bp, Eucalyptus sp.
gcaatcatgtcattttgacgcagagagagagagagagagagagggagagagagacaggagagaggggttaaagaagtgggggggcgtttttgtttttaacctcgtttttttccagacacccagaaacgaagtgggtgttcccattgagctgaattaagagaagggacaggacaggagccgtggaaaagaaagagaggattttggagaaaagggtaggctgaattttttaatttttgggcatttcaggaggaggtggtggcgtttgctgctgggcaggtccttgttgaaatcatcgtagcattgactccacaatcaagcagaacattctacaacaccgcgatagttttccgtctatcctcactttgagctaagggttagctacatcatgagtggggcagatgataatgttgccgtgattggtgattgggtgcctcccagtccaagcccaagaacctttttcaccgcgatgcttggtgatgacattggtttgaggtcaggactggaagcttctggaaacaataagacaggggggctttttctaggatctcaagagagggtgacgatgggaaactttgaaaacaaggacacaaaacgagtcggtcctagtggtggtgaccactccagtgaatctcgcttggctgtcgagcagaaagggtattcgcgtggatgtcttggggaaaggttggcagcccgagctgggtttaacgccccaagattaaatacagagggaattagatctgctgatctatcgtcgaatcctgatgttcggtctccttatttgacgatccctcctggtctaagtcctacaacacttctcgattccccagttttcctctcgaatacgctggctcagccctctccgaccacaggaaagttccctttcattcataacaataatagcaggagctccgggttgatgttagatgcaaatacaagtaaagataacccatttgaggagaacagttcttcatcctttgctttcaagcctcttggggaggcgagttcgtccttttttggtgctgggagcaaaatgaatcaagctacatttcctcagcagtcttaccacagaatcgaggtttcagttcagtcagaaaattctgtccaatctcgtaatgtggaagcaaccaaattgcaatcccagaatggaagtggcttccaatttcagggagacttttccaggtcatcagcagaaaatgttgctggtcatgatggggtgccatctgatcaaaggaacttcagtactgttactggtgatcctgaacattctccgccgctggacgagcaacaggatgatgaaggagaccaaagaatcagcggagattccttggtaggtgttaatggtggcagcccttctgaagatggatataactggagaaaatatggacagaaacaagtcaagggaagcgagtatccaagaagttattacaagtgcactcatcccagctgtcaagtaaaaaagaaggtggaacgatctcatgagggccatattacagaaatcatctacaagggggcccacaatcacccgaaacctccaccgaaccgccgatctgtcattgggggagctaatccctttggtgacatgcagttggacaatccagaacagatgggcttgcagaatgctacggacactgatcctgcttgggctaatatgcagaaaactgctggtatgggaggatcagagtggaggcaggataaccttgaggtcacatcatcaccatctgatggccccgaatttagcaatgctccgacctctttacaggcacagaatggtggtaatcaattggaatcaggggatcaggtggatgcgtcctctactttttcaaatgatgaatgtgatgatgagcagcagacgcacggtagtgtatctttggcttatgatggagaagaagatgaatctgattcaaagagaaggaaaattgaagcctatgcaactgatatgagtggggcttcaagagccattcgtgagccgagagttgtggtccagacgaccagtgaggtagatattcttgacgatggttatcgctggcgcaagtatgggcagaaagttgtgaagggaaacccgaacccaaggagttactacaagtgcacaagtcctggctgcacggttaggaagcacgtagagagggcgtcacatgaccttaagtcagtaattactacgtatgaagggaagcataatcatgatgttcctgctgctcggaatagcagccatgtcaactctggcgcatcaagcgctataccaacccagtgcaccacctctgcaattcagactcaggtccataggccggagccttcacaagtccatagcatgatggggaggtatgaggggcccgggtcattgggttcgtttagcctacctggaagacagcaactaggccctggtcccggattttccttcgcaatgaacccacccagactggcgaattttgcaatggctgggatgggtcctggccagggcaatcttccgatgttgcctgttcatccatttctggctcagcagcaccaagtacatgaaatgggattcatgttaccgaaaggagaaccaaaggccgagccaatgtctgagcctggtccaaacttgtctaacaactcctcggtttatcagcatattatgagtagactgccgcttggacctcagatgtaaatttcaccctttttgtttttgcttaaagagaagaaacatcacctgataatatatatagcttttcaatagcgatacaaaaaaaaaa

SEQ ID NO: 448 - DNA, 1130 bp, Pinus radiata
gttaaatgttgttcagcagaggggagagaagaagggttagggtttgatggcgaaatcgaaatcggtagcgaagaaggtcttgcaatcttacagcatcaagggtacgaacaagctcgttaaagccggggactgcgtattgatgcgcgcccaggatcccgagaaacctccatacgtagcgagaatagagagcatcgagatcgatggcaagaagaagaacgtaaacgtgaacgtgcggtggtattatcgtcccgaggaatcgatcggtgggcggcgtcagttccatggcgtgaaagaactcttcctgtcggatcactatgatgtccagagcgcggacacgatcgagggatattgtaaatgcgaaatgccctacaatcccgacgatttgatggtgcagtgtgaagcgtgtaaagactggttccatcctgcttgcctcaacatgaccataaatcaactcaaaacaattgagcattttatatgccaagattgctcagatgattccaaaaggaagccacgaaatggtgcaaaagattcctcatctcttgaaacaaagccagagacaaaacggaggaggaggtgagaatttatggggcaatttaccatttctgaagagcaatatcagataatggggtttatgatctgaactagattaaagtggcatgactccatatatgtacgtggatcacaaggcttcatgaagttggaatttcctatagttttatgtcattgggaaaactgcttgaaatataagtgctgcaatgtgtcccttggtgggtgatatctatttggtgaagtttggcttttaaaatttaaaattaaacaaagagttgaaactaatattttcaggttgagctattggacataacagtgagggaaatatgttgcaacatagtctattgcactgcacttgaagatagctggttccccttcaaaaagcaacacacatggactgttagcattcgtgcatttcaaggtcatatgatgcaaacaggcaactttgttcttgtatttatattgtaaatggccaggcttacaactttttataaactgtgacgtttgtaagacatttgtcgactcttttcccctttttttcttttcaataataaaatcatttatattaactaaaaaaaaaa

SEQ ID NO: 449 - DNA, 1282 bp, Pinus radiata
gtagaagtagcaggagcgagagtaatatggctaagacgcggcctgctaaaaaatccttggatgcatataccatcaagggaactaacaaagtcgtcagagcgggagattgcgtgttgatgcgcccgtcggattccgataagcctccgtatgtagctcgagtggagaaaatcgagagcgatatccggaataacgtgaaagtgaaggttcgttggtattacaggcccgaggaatcgatcggtgggcggaggcagttccatggtgccaaggagctcttcctttccgaccactttgatgtgcagagtgctgacacaatcgagggcaaatgtactgttcacagcttcaagaactacaccaagctcgagagtgttggtgccgatgattatttctgccggtttgagtacaaatctgctaccggtggtttcaccccagacagagtggcagtgtactgtaaatgcgagatgccctacaatcctgatgacctaatggtgcagtgcgaaggatgcaaagactggtttcaccctgcatgtatgaatatgactccagaacaagcaaagaaagtggatcactttttctgtcctagttgttcctctgaagatgaggacaaaaagactcgaaattctcatgttgcttcaccactggcagaggcaaagctggaatccaaacggcgaaagaggtgactgtattggtagttcagttttcattttagactgtaacaaagcagaactttcttgggaaggtgaaatgattcaacaagtgtgcagggaaatatgtattaaatcaaggatatttataggcatatttcagtctccatgttgagggtttcattgtacagtttaatatgttaatctatggtatgggcctctaattcaaatttgagctggctgggtaagatgcatattatgctttctacataaatgctcaagtgaaacatattttgtgtgtgcactgtgtgaagtctttcagttcagggtcatattgctaagagtcgatgggaaagtattgtcattttccgaacaagtttcatttagatgacaataacatcttctactgtactatgtgtattttcaactcagattttgtgaactaggtttgaacgtcttatattttgttttagaatggtcatggcctttaagttatgtcggatagttgtacaagtttggttgaaaacttgaaacaaccagaaatttgaattattgccattgaatttgacaatgatgaaatgtgatgatgtattaatggctatttgtgtaagaggtcgatattttgattgctaaaaaaaaaa

SEQ ID NO: 450 - DNA, 922 bp, Pinus radiata
gggtttgttatctcttcttgttggccatgattgatctgttctcatactgccgcctgtgaattcacagcttgtacttgccggacgatgcgtttttgcgattcgaagcttggactgctcgtgtatcattctcatattttcttgcagaagaaatttagggccagaaacgcctcgttagggtttccatagcatcgacaagaaaaatggaaggcggtggtttcgttcggcgcactgtggacgacgtttttaaagatttcaaagcacgtcgagctggcttgatcaaagccctcactacggatgtggaggagttttatcagcaatgtgatccagaagaggtgcctcctgaacttcccgagccagctttgggaataaactttgcaagagatgggatgcaagaaaaagattggctatcactggtagctgtacacagtgattcctggctacttgcagtttctgtgtactttggtgcacgatttgggtttgacaaaaatgaccggaagcggctttttaacttgatgaatgaacttccaacaatatacgaggttgtcactggaactgcaaagaagcaagtaaaagaaagatctacagttaccaacaacagcagtagcaaaaacaagtcaggagggaaggtgcggtcatctgaatctcaaccaaaaatgtcgaagttaccactatccaaggatgaagaagatatcttagacgaagaggaggatgatgaacatggggagaccctctgtggagcctgtggtggagtttattcctctgcaactgcagaattctggattgcatgtgatatgtgtgagaattggttccatggcaaatgtgtgaagatcactcctgcaagagctgaacacattaaacagtacaagtgtccatcttgcagtaataaaagagcccgtgtttaactaaaaaaaaaaaaaaaaaa

SEQ ID NO: 451 - DNA, 1226 bp, Pinus radiata
gatggatgatacgcttcttcatattgtgtgctcatcaccctcccgccgacctcaattcgattcctattaataacattattttgattttgggcgcgttctaattgttatggaggagaattggagttgcgcaacatcgttacagtagcaacagtaataaagctggtagaaccagagagttagaatccaaattattatattattggtatcattattataagcggggtgttggccatggagacagccgcctcaatttcttcaaaccctcgcaccgtggaagaggtgtttagagattacagaggccgacgaactgccatcgtccgtgctctcaccactgaggtcgagcgcttttactcactttgcgatccagagaaagagaatttatgcttatatggatatgctagtgaagcatgggaagttaccttgcctgctgaagaagtcccaccggagctcccagaaccagcactaggtattaattttgcaagagatggcatgcagcgaaaagattggctttccttggttgctgtgcatagtgatgcttggttgcttgctgttgctttctaccatggtgctcgatttaacaggaccgagaggaaacgtctttttagtatgataaacgatctcccaactgtgtttgaggtggttggtgataggaagcagacaaaggagaagactaattctgataatagtggaagcaaatcgaaaccatctggaaagcgagttggtgatggtcaatcaaagaatcttattaaaccaaaagaggaggatgatgaaacatacgatgatgaagaaggggagcacagtgatacaatctgtggaatttgtgaggagacctattctaatgatgaattttggattgggtgtgatagttgtgaaaggtggtatcatggcaagtgcgtgaaaatttcagtggctaaggcgcaaagtatcaggcaatacaaatgccctttatgtaataacaagaaagttcgctagtgaacactatgagtggtagttagcctgctagggtgccttgcaacatgtgcaccctatcaagtcctttggaagctgctttaggcatagtttgaagtcattagtcttttcaaagttatggtcattgtttgaatttgatcacttgaaactgttgttttaaggcatcagtgttgctgtctctacggcgttgaacatgtacttgtagaagcttaacggtatattattcccggagaaatttcactttctcaaaaaaaaaa

SEQ ID NO: 452 - DNA, 1438 bp, Pinus radiata
gcagttttcaaaccctccgtggctctgtgttctgtccgagataactgtgagaagggattgcgagggaaagggtttgttatctcttcttgttggccatgattgatctgttctcatactgccgcctgtgaattcacagcttgtagttgccggacgatgcgtttttgcgattcgaagcttggactgctcgtgtatcattctcatattttcttgcagaagaaatttagggccagaaacgcctcgttagggtttccatagcatcgacaagaaaaatggaaggcggtggtttcgttcggcgcactgtggacgacgtttttaaagatttcaaagcacgtcgagctggcttgatcaaagccctcactacggatgtggaggagttttatcagcaatgtgatccagataaggacaatctatgtctttatggattttcaaatgaatcatgggaagttaatctacctgcagaagaggtgcctcctgaacttcccgagccagctttgggaataaactttgcaagagatgggatgcaagaaaaagattggctatcactggtagctgtacacagtgattcctggctacttgcagtttctgtgtactttggtgcacgatttgggtttgacaaaaatgaccggaagcggctttttaacttgatgaatgaacttccaacaatatacgaggttgtcactggaactgcaaagaagcaagtaaaagaaagatctacagttaccaacaacagcagtagcaaaaacaagtcaggagggaaggtgcggtcatctgaatctcaaccaaaaatgtcgaagttaccactatccaaggatgaagaagatatcttagacgaagaggaggatgatgaacatggggagaccctctgtggagcctgtggtggagtatattcctctgcaactgcagaattctggattgcatgtgatatgtgtgagaattggttccatggcaaatgtgtgaagatcactcctgcaagagctgaacacattaaacagtacaagtgtccatcttgcagtaataaaagagcccgtgtttaactacaagcaaaatattatctaatgtttcaaagaaatttgtggctccagccaaaagtgtttggaggcattggagctttgtttcttgcaattgaggttgatgattaaggcaggctgagacaccgtgtgacctttgaggtcagatagacaagtgcaacatccatttacatgctgagctagttacttgtttgtttttctgatcgtaatttgtaggacttcaaaagttttgataactctctacgtaaagttatacacttttgaaacctttgggacgtcatgaagaatacagctgtatgcatgttggttagttgctttttatttcttaatgcacattgtaaaacacgacagtttgaatccatcaagggtttaatgttgaatgggataacctgtgttcttcaaaaaaaaaa

SEQ ID NO: 453 - DNA, 1413 bp, Pinus radiata
gctctccctccttatacgacgtctgcgttcgcctccaggcaagtccgcaccgagtccgtgagcgttagggtctcggcaggtactatatccatcgggtctgggaactaccaacaaacattcgtagaccctgaaaatatacacgaaatcccatcgaagctctccgacccggtttgataatccagaaggccctgtccggtccggttttcacccatccatccttctcttcgatgtttaaattcggcttgatttagttcaagtcaagtttaatttcgtcaaactctcggcagcaacagaagagtctatggaaggcggttcagggccatacaatccgcgcacggtggaagaagtctttaaagacttcaagagccgcagaaatggattgataaaagccctcacaacagacgtggaggagttttatcagcaatgcgaccctgacaaggagaacttgtgcctttatggattcccaaatgaatcatgggaagttaatctccctgcggaggaggttccaccagagcttcctgagcctgcattgggaatcaattttgcaagggatgggatgcaagaaaaggattggttatctttggttgctgttcacagtgatgcatggctactttcagttgccttttattttggtgcacgatttggttttgataaaaatgacaggaggcgtcttttccacatgattaatgaccttccaacaatatttgagagtgttactgggattgggaaaaggccaacaaaagaaaaaccggctgttaccaacaacagtagtagtaaaaacaagcaaagtggaaagatgagagcatctgagcctccgatgaaaatgtcaaagacaccaccacctagggatgaagatgactcattggatgaagaggacgaagatgagcatggagaaacgttgtgtggagcttgtggagataactatgcctctgatgagttctggatctgttgtgatatgtgtgagagatggtttcatggtaaatgtgtgaagattactccagctagggctgaacatatcaagcagtacaaatgcccttcatgcaccaataaaaggccccggacctgaaaatgcacaaataatattttgaacaatggacatcctccgatggttttcaagcatggaggctgcagtccccaagtatttgtgtgcattttagcagcttaaaggatacacatgactttcctcaggctaatgctggtgaaacatatgaggagctgtagacagttttcatttttatattgttttaggtttttgtttacaattttaatgtaatactctttagtttctatcgtcctgtgtcgtactgttaattacatgcaaaaattgtgtaatatttctttgggctgatgttatgactgtaagatagctgttttaattaatattcaaacaaggtttccggttcaaaaaaaaaa

SEQ ID NO: 454 - DNA, 1456 bp, Pinus radiata
ctgcgcttctctattttagagggattttcatcccattcctcctatcaatcgtacaagtaaaaaagtcgattgactgaggccgcgaggatgaagcatccgtaattcgcctttgtggaatgctttggaacaagtttttgtctgagaaattccgccagaaatcgacgacgcaggtaacctgtttaaagatttgtggcgcagaatcgactcagaagcatggagggcgctgctggaccttacaatggccgcactgtcgaagaagttttcaaggatttcaagggccgtcgagctggaatgatcaaagccctcacaactgatgtggaggaattttaccagcaatgcgatccagagaaagaaaacttgtgtctgtatggccttccaagcgaaacatgggaagttaatctacctgctgaagaagttccacctgagcttcctgagccagctctgggaattaactttgcaagggatggaatgcaagaaaaggattggctatctttggtagctgttcacagtgatgcatggttacttgcagtggcattctattttggtgcgcgctttggatttgagaaaaatgagaggaggcgtcttttcaacatgatcaatgagcttcctacgatatttgaggtggtgactggaactgtaaagaagcaaacaaaagagaaaccaaatgtaaccaatcacaatggcaataaaagcaaacctaatgcaaaagtgcagcgtgtttctgaatcacagacaaaagtaccaaagttgcaacctccacacaaggaagaggatgatacccttgatgaagaggatgaggaagagcatggcgatacactctgcggagcctgtggtgaaaattatgcctcggacgagttttggatctgttgtgacatgtgtgagatatggttccatggtaaatgtgtgaagattacaccagcaagagcagaacatattaaacagtacaaatgcccgtcttgcagtagcagcactaaacgggcccgagtttgagactggcatacacagtactgtttttgtctgtattagtctgagactgatgtttcctggcatatacagtactgtttttgtctgtattagtctgagactgatgtttcctggcatatacagtactgtttttgtctgtattagtctgagactgatgtttccacatggccgcttcacgtgcgacgacatttattgtgattcacttgcaatcagaaggctgtaaatttggtttgatgcaggttgggaaatttgcccccgggaatgctgtatgcagcatatgtataaatattcagttagctgtttttattttttatttttaggactggttcagtttcagaagattttgatctaaatcagcaaaattcgtttagcagactctgctgaaaatgtaggtatgtgctgtgattacttacagcgtttttcctctttaaattggtaaaaagttacccagtctagaattttaaaaaaaaaa

SEQ ID NO: 455 - DNA, 1380 bp, Pinus radiata
gggaatacatttggatttgtttttgggaattgtccattgcttttcattcgttcgctctagctatgtatcgtcaaccaatctgaacaaatagattacaagcccaggagccggaggagtcataaccagctccatctctttttctgcatttcacagccagtgcaggcaaataaaatatatacagagacatcatatccatggaaggagggtatatcaaatcaatggaaggagggtcgggcccttacaatccgcgcacggtggaagaagtcttcaaggatttcaagggccgaagagccggaatgattaaggccctcaccaatgatgtggaagagttttaccagcaatgtgatccggagaaagagaacttgtgtctttatgggttgccaaatgagtcatgggaagttaatcttccagctgaagaggtaccaccagagcttccggagccagctctgggaattaactttgcgcgggacggaatgcaagaaaaagattggttatctttggttgctgttcatagtgatgcgtggctgctggctgtttcgttctactttggtgcaagatttgggttcgacaagaatgaaaggaaaagactttttatcatgatcaatgaacttccaactatttttgaggttgttactggagctgcaaaaaagcaatcaaaagaaaaatctactgtaaccaacaacagtagcagcaagaacaagtctggtataaagccccgagcatctgaatctcaaacaaagccatcaaagttactaccacctaaagatgaggatgatacgttggatgaagaggaagacgatgaacacggtgacacactttgtggagcttgtggtgacaattatgcctctgatgaattttggatctgttgtgatatgtgtgagaaatggttccatggcaagtgtgttaagattactcctgcgagagctgaacacattaagcattataaatgtccaacttgcagcaacaaaaggccccgagtttaatggatgactgaggggaactttaattgaacttaacagtgatgactatctctgatacctagcggtttcagatgcagaagtgtcttcagcccttgtggtttgttccttgcacttggaaggcttccaattaagctctaggctgtcgcaagctgagacctattggaggtggtcagttttgtatgcagtatctgtacgaatattgggctggctggttgtttgattttcttgtaagacttaaggcttaaatctttcaagttttagatctccatatacctgagccattggaaactttctatttaaagagttgagtcttgtgcgatatttgttttgaatattgttgatctctaattctggtttttttacgatattataacatccactatttggtataaaaaaaaaa

SEQ ID NO: 456 - DNA, 667 bp, Pinus radiata
acttttcttctacttctgtatccgcagttataagaggagcagaggccgtaaatgtgaaggtaaagacacagctacaggaagagcagagtggaaagatgaagccgatgaacagaggcaggcactacagaggagtgaggcagcggccgtggggtaaattcgcagctgaaatcagagaccctgccaagaaggggaccagagtttggctcggcactttcatcaccgccgaagaggctgcccttgcatatgaccgcgctgccgtcagaatgcgcggagccagggctctcgttaacttccccctcgctctcaattccagtacagaaaatgaatcggccgtaggtcacatggcgcacaaaaggaagaggggcaaagaagaaacggctgagggcggggcggcttgtagtcgtaggagccgcggaaatggaagcggaagctgaagctccgggaatggattagcgtcgataaatttaatcattttattaataatatgattatgaaaatgtagggttgagaatggagactgaagtggcaatatccaaccattttctgaaaatgcttttcccatatttacattgtactctgaattccattgtttagattgcatgattgtaatgaaaaggtgagattataattttaaggagtatgaagtatttggaaaaaaaaaaaaaaa

SEQ ID NO: 457 - DNA, 767 bp, Pinus radiata
gtaaacttcaccaccaggttccgagttcgagttcgctcacatggttaaacccttgccaaaacagagcagccctgtcaggccggaaaaccagtcactgatgtcacggcaattcaagggaatccaattgagaaaatgggggaaatgggtgtcggaaattcgaatgcccaattcccgggccaaaatttggctgggctcctacgattccccagaaaaagctgcccgcgcctacgacttcgcagcgtattgtttgagaggatccaaggccaaattcaattttcccgacacgccgccggaaattccctacggctcttctctatcgccgctgcaaattcaatccgccgcgtccaggttcgccgcggaagaattccggctgccgtcgagaaacgacgcggggtcctcaaattcctgttcggacgcagaatccagcattgacggccaacagatttccgcagagcagggcgcatcgttttgggattcattagtgcttcaagatctggatagtgctaagatgattactctctaaatcattttcctcttttaaaagggtttttgggttcagcgtacataagactcggcggttttctaaacagaaatccgcattttccttacttctgacatcggtgaaatttttaagggctttcatcaatggaaattgatgtgcccttccccaaatcatgactggccaacggcctctacattttttgatctgtatataattaaattaaaatgcttattccaagggcctctacttttttttaaaaaaaaaa

SEQ ID NO: 458 - DNA, 856 bp, Pinus radiata
gttcgctttgaactcattgctagtagcagctcttccaagttcaaatctcttgctgtcactctgtcctaagttcaaatctcgtagtgtcactctgtcccctgctttagatactacaaatttatgagcacgtcctgagttcgagtccccagtagcctcatcatcccgattcccgacatggctacaccctcaaatcagaacggccgcatggaacccgaaagccattcacaggggacgcggcggttcaggggaacccgaatgagaaaatgggggaaatgggtgtcggaaattcgaatgcccaattcgacgggccgaatttggcttggctcctacgacactccggaaaaagctgcccgcgcctacgactttgccgcctattacctgagaggatcgaaggccaagctcaattttcccgactgcccgccaagaattcccgccaattattctctttcgccggagcaaattcaagccaccgccggcaagttcgctgcagaagaatcccggctgccttcggaagacggcgcggcgtgctcatcttctaattcagaagcgatatgccatattgacgatcgacagattaaggcagagcagagtccggaattttgggattcactgtcgcttgaagatctggacagttacaattctgttagtgtggatgattttcccggaatattttgagtttcactgctagcgcaaggtagagttcagatttttttttcacccgaagaaatagcgcctgaagcagctcactggagaacccaaacttgggcttggggaattcatgatttttctctgttgtgccagataccgttatttgaaaaacgattgctgaattgatgcccccttagcaaaaaaaaaa

SEQ ID NO: 459 - DNA, 1064 bp, Pinus radiata
gcacaagcttcggaagccagtcctaagttagcctccggattaccaagatcatgtcgaaagcttcacaaaaccagacgcgtaacaaaagatgcgaaaagcgctcactgaagtcgcggcagttcaagggaactcgaatgaaaaaggggggaaatgggtgtcggaaattcgaatgcccaaatcgactgccagaatttggctaggctcctacgactcacagcaaaaggctgcccgcgcctacgattttgccttgtgttgtgtgagaggagcgaaagccaagctcaattttcccctttccccgccggaaatcccctgcgcttcatgtctgtcaccgccgcaaattcaagcggctgccgccaggtacgccgaagaagaattcccgctggttttatctctatcaacgccacacactccagctgtcgccgcccggtatgctgcagaagaatgccggctgctttccgaagatgtggcgttctcgtcctccagaattgaagcagaaagcgaccaagagacttcggcgttttgggactttgttcttgaagatatggatagtggcgggtcactaaactgtccacccttggatgtgctattccagttgacggaaaattggggctacgagggtttctaaattaattcttgctgctggagattctggcatgaggattttgagattctattccagttgacggaaaattggggactatgagggtttccaaattaattcttgctgctggaagttctgccacgaggattttgaggttctatgccagttgacggaaaattggggctatgagggtttttaaattattttttgctgctggagattctgccatgaggattttgaggttctattccagttgacggaaaattggggctatgagggtttctaaattaattcttgctgctggagattctgccatgaggattttgaggttctattctagttgacggaaaattggggctgtgagggtttctaaattaattctcgctgctggagattctgccatgaaaatacagttaatattttcatgaaaatacgagttaatcttcattcttcaaaaaaaaaa

SEQ ID NO: 460 - DNA, 940 bp, Pinus radiata
catagaaagagctttatgtgtcctgaatttgaaccctctcctcgttttaaagaatccgagctttgcaaacacgccttgagctagactccggaataccccagcaacaatccgacatggctaaatcctcgcaaaaccagaacccccgcaacagacgcgaaaaccgcttacggaagtcacggcagttcaagggaatacgaatgagaaaatgggggaaatgggtgtcggaaattcgaatgcccaattccactgggagaatttggctaggctcttatgacacgccggaaatggctgcccgcgcctacgattttgccgtgtattgtgtcaggggatcgaaaggcaagttcaattttccccactccctgccggaaatctcctgcgcttcatctctatcaccgccgcaaattcaagctgccgctgccaagtacgccgcaggagaattcctgcttccttctgaagacgcggcgttctcaatttcccatacggaagtggaatgtaggaatgacggccaagagatgttagcattttgggactctgttcctgaagatatggataatggcgagtctctaactttagaggattttccaccattggatgtgcctatggatgattttgaggttctgttcccgatgatggaaaactggggcagtggggctttctaaattttttttttttttttttttttttttattatctggtgaagattccgccatgaaattcgagtttaagttttatacttatttaagaaattgatgagattagtgaattgttgctgtgaaatggctcatctctgggagcaaacataccataaaacattgaatctcgccaaattttaaagggatgatccgtgttttacgtctggatcagagctctgagtttgggccaaattttaaggaatgaacagagttctcaatcttagcaaaattttaagggaaaaaaaaaa

SEQ ID NO: 461 - DNA, 616 bp, Pinus radiata
tccgctcttactcgcgtagtctgtgggcatatccttcatcccatggaaggcagcacacctcctttagtagccgggaagaagagatgcggagatgaggaacagacgatctcatccaccatgaattgcgccaagccggacgatatttctggtcaacatcttacattctctccagaagaatcgagcacagtcacgcatctccaacaccagcaaagtattcgggaagatgacttgaggtccaagctgaaggatgaaatccaacagccacagaatccaacaaaaaagaaacgttatagaggggtaaggcaaagaccgtggggcaaatgggccgctgagattcgagatccaaagaaagcagctcgagtatggctgggcacgtttgacactgctgaaggtgcagcgagagcatacgacgacgctgctttaaagtttcgaggggtaagggccaaattgaattttccagaaagagtcaccctccgggatgaggataatcctggtgtgaacatcgggaaggaggaaaacgccaccattacccgacttcagtgttccagttgcacccgcaacctactacccatctgcaccgacatgtagcgataatttgtcggcgccggaacgaccg

SEQ ID NO: 462 - DNA, 888 bp, Pinus radiata
gaaacactctcagctgaagaagcagccggttccgagttcgaatccttgccctaacgcagtcccgtgttttaagactcaatctttagtgactcccccgcaacatggttaagcccttgccaaaacagagcagcccgagcggatcggaaaactgccaaataaagtcgcggcagttcaaaggaatccaactgagaaaatgggggaaatgggtgtcggaaattagaatgccgaattccagggccaaaatctggctgggctcctacgactccccggaaaaagctgcccgcgcctacgactttgcggtgtactgtctaagagggtcgaaggccaaattcaattttcccgactccccgccagaaattccatgcccctcttctctgtcgccgccgcaaattcaagccgccgcagccaggttcgccacagaagatttccggctgccgtcagaagaggacgcggcaacctcctcttcggaagcagagtccggcattgacagccaacagatttctgcggaacagcgccccacattctgggattcgttactgcttgaagatctggacagtggcgagtctctaaatttagaggattttcctcccttagatttctctatggacgattttgggtttctgttcgagcagaccaaagactggggccttttctagagaaaaagattcatctacctctgcaggcgattttgccattaaagatagattaacgtatatgctctgtctgcaatttatgagattagtgaggcttccgagggttttcatcgatggaaattgatgcgtccttggggaaattgtaagctgtgcggccgcttgaaaatggcgccatctatctttatttgtatataattagaaatttaacattgattattctttaccaaaaaaaaaa

SEQ ID NO: 463 - DNA, 773 bp, Pinus radiata
cactcgcacaactctaggagctaccaccatctctgtgattcctgacttcaaatcccctcactacttcctccctcgagagacttcaaagtttaccgggcccgtcctcagtgcgactcccctgcaaaatcttgcaatgactaaaccctcgcgaaaccagagctgccgcagcaatcccaaaagctgctcactgaagtcgcggcacttcaagggaatccggatgagaaaatgggggaaatgggtgtcggaagttcgaattcccaattccagtggcagaatttggttgggctcctacgacaccccggaaaaagctgcccgtgcatatgactttgctgtgtactgcctcagaggaaccaaggccaagctcaattttccccactctccgccgaaaatttcctgcgcttcgtttctatcaccgcagcaaattcaaacggcggcggccaagttcgctgcagaagaatgccggcttctttctgaaaatggcgaggcatcctcatcatacggtttggaagaggaatgtgatattaacagtgaacagattatttgggaggagggtgcgacatttggggattcagtagcatttgaaagtatggagaatggtggatctttcaacgtagaggatattcctccgttggaggggttgatggaagattttgggattccgttccagatgccagaagactgggagctgggaattttctaattttcttattctggtgctgaaattctaccctgagaatttaattaaattatattattatttgagaaaaaaaaaa

SEQ ID NO: 464 - DNA, 774 bp, Pinus radiata
gcattcacttgcacaactccatcatctctttcattcctcacttcaaatcccctttactatcacactacttcctcccttgagaaacttcaaactttaccggcacgtactcagtgcgactcgcctacaatatcttgcaatgactaaacccgtgcgaaaccagacctgccgccgcagtcccaaaagctgctcactgaagtcgcggcagttcaagggaatccggatgagaaaatgggggaaatgggtgtcggaagttcgaatacccaattccagtgccagaatttggttgggctcctacaacacgccggaaaaagctgcccgtgcatatgactttgccatgtactgcctcagaggatccaaggccaacctcaattttccccactctccgcccaaaatttccttccctgcgtttctgtcacagcagcaaattcaaagcgctgcggccaagtttgcggcagaagaattccggcttcttcctgaaaatggcgggacatcttcatcatacagtttggaagaggaatgtgacattaacagcgaacagattatttgggagcaggctgcgacatttggggattccgtagcatttgaaagtatggagaatggcggaggtttcaacgtacaggatattcctccgttggatgtgttgatgaaagattttgggattcccttccagctgccagaagactgggagctggggattttctaattttctttttctgctgctgaaattctaccatgagaatttaattcaattattttattatttgagaaaaaaaa

SEQ ID NO: 465 - DNA, 915 bp, Pinus radiata
gattgacgcagatattcagttgtgcggaaatacctctatttgtcccgagttcaaaccctataaccttcacaaactcgctgtaaagatttcaaacttcaccagtacgttgtcagtcctttgcaacaactcaacatgaccaaaccctggcaaaatcagaaccgccacaacggtaccaaaagctgcgcaccgaagtcgcggcagttcaggggagtccgacagagaaaatgggggaaatgggtgtcggaaattcgaatgcctaattccaacggcagaatttggctaggctcgtacgatacccaagaaaaggctgcccgcgcctacgactttgctgtgtattgcctgagagggtccaaagttaaactcaattttccagactccccacccgaaattcccaacggttcatttctatcgccggagcaaattcaggcggccgccgccaagttcgctgccgaagaattccggccactttcggaacgcggcgcggcctcctcgtcgtcctgtttgaacgcggaatgcggcattgacggccaacagactacggcggagcagagttcggcatttcgagtttcagtaccacttgaacgtctagccagtagcgagtctctaaatgtggaggatattcctctcctggatgtttcagtggaggatttcggagttttcttccagcactcgaagaccaatggacagggggtttctaattatttctagacggtggccagtctccacatagagaggaaagaagatagcagtagtctaaatagaaaggagagaggattgtaacagtctttacagttacctgttttattttttatttttttccacagatatttatgtcatgtccagagagattgtgcagttcagtgtcgaaattataaattttttatatattaaaatatttacaaaataaaaaaaaaa

SEQ ID NO: 466 - DNA, 749 bp, Pinus radiata
tttcagactctggatatggctgtggagaccatgcggagagcgagagtggggatcggaggtcacgagaacgaatcacgggccctcaaagaaacccatttcaggggcgtaagaaagcggccctgggggagattcgcagcggagatcagagatccatggaagaaagctcgagtgtggctcggcacattcgacactgccgaggatgccgcccgcgcctacgatgatgccgccagggccttgcgcggcgcaaaagcgaagaccaattttgctctcgccgccgacgacaatgcctctgctgcgctcgctcgggcgcgcaacccccgctgggttcgaacgctgcaccctcagcagcagtggcctcatgatctcaaggcctcggctttggcttcttttccttccgtgccgactttggaatcaagcaagagacgtaaagccggcttggcaagcaactgccggcccgagttcgaatctcgtaacaattctccctgctctgcgctttctgagcagaaaacctcttcttccccgcggaggaagaccccttttctgctggatcttaactttcccccttcggctgagcaggacaacgagaacgagagcgcggctctgtaaatttaatggaatctatttatcaaaagttggcccctagctattttgtaaaatttcggcgtgccaaatcacacctttaaaactattgtacagcttcacaaaattaaattttcaggcttctcttctggttattttcaaaaaaaaaa

SEQ ID NO: 467 - DNA, 804 bp, Pinus radiata
ctcacttcactgactcccgccgtgaaatatcactattttggcttcagagtttctgcaaattgccaaatatggagaattttcccgagcgggaacctgacaatgccatttctctgccacacgaagatcgcggttcccgccaatttaagggaatccgactgcgaaaatgggggagctgggtctctgaaatccggatgcccagatccagaaagaagatttggctcggctcatacactactccggagcaggctgcccgcgcatacgacgccgcagtgtattgtctgagaggacgcaatgccgaattcaacttttctgtgcccgacattccgactgcgtctcccctttcccgtgagcaaattcagcatgccgccgccgaatatgccttgggccaagccccttctagttttccctctttcgtagcgtccccccggcattcgtcttcggtttcggaaatggagttggccggagacaactttcagatatatgaggagaggcaggacttggcgctgtggtggtcgatgctggcgggatctgacggtgccgggattccaaatttggaaatattcccgtcaactgacgaggtgtcgacgttggatttccttcccactgaggaggaggagcagaggtacatattgacagatctctggaatttccaagacgtttgacttcttgagatgaggaagccgacaaatctggcgtgtcggattcacgtggggaacacgtggacgcagttggaagttacaagtgtgtataattaatattgttatattcaaatgatggtacttaattaattattgaaaaaaaaaa

SEQ ID NO: 468 - DNA, 1001 bp, Pinus radiata
gaattcctagtctcatttcagtgattcactcactgaaattattgttagaatcactgttttggccccagagcttctgcgtcgccaaatatggagatacgcctccagcaggaaaacgaccaggacattgctccgccacacgaagatcgcgtgtcccgccaatttaaaggagtccgaccgcgtaaatgggggatatgggtatcggaaatccggatgccgagatctcgacagaaaatatggctgggctcgtacaaaaagcccgagaaggccgcccgcgcctacgacgccgcagtgtattgtctgagagggtcgaacgccaagttcaatttccccaattctgtgcccgacattccgtctgcgtcttctctttcccgccagcagattcaactcgctgccgccaaatatgcgttggatcagtccccttcaagcccgccgtctctgaacaataataaagaggaacccgcgtcaccgtcgcagtcgtcttcgatttcagaaacggatttgtcgagagacaacccgcggatatcggaggagcggcaggacttggcggtgtggaggtcgctttttgcggcatcagacggcgctgcgttgccgaatttggaaaaaatgccgtcaatagacgatgtatccatgttggacctcgttcggatttcgcagcaacagcaggaggagggttacatcttgacagacctgtggaacttccaagatgtttgagtttttggaacaattaaatctcccttcttttagtcgtttcgaacgtgcgacctcctcctgccccactccgaacgttttgtgcgatttgggaggtcgagtcttcgagtttcggcacgtgctcataatccaaaattctttcggataagaccgcgcggaagttggaaccctgacttgcactgccctccttttgctcgatagttccgtgcatatagatcatctttgactatagtttcgccgtgtcgatttgcgcaaattgatatattgtacttttctatgattatgttatgcac

SEQ ID NO: 469 - DNA, 1208 bp, Pinus radiata
gcttgtcttccccccagctgaggctctctgagaccaaggtgagattcagccagtagtaagctatagattgatagttcagagaaaagactgaaaggcaaaaactatatagacataacaacggagagagcagcacaggaaccaggttgcataatggctaggcctcaaagatacagaggagtccgtcagaggcactggggatcatgggtctctgaaatccgccatcccttattgaagaccagaatatggctaggaacatttgaaacagcagaggatgcagcacgagcatatgatgaagctgcaaggatgatgtgtgggccgagagctagaaccaacttcccattcaatcccaatgcacctccatctccatcttcaaaggttttgtcctccacgctcactgccaaactacaccgatgttatctggcctcgatacaaggaccgagatctggctcatcgaagaaggatgccatggcaagagctgataaaaataacaatatacatagcagcaatcagtccctcacttgcttaagattggataacgaaagatccaacaacattggtatttggcagaagaaagctgggtctaagcaatccgaatcaaattgggttatgaagttggagttggatcatgatcagcatggaaacagtacgctgaaacgggagacagatgatgatattgctcaaatgattgaggaattacttgactgtggatccttggagatctgctctcccatggcttctgctgattctagtatcagtagtgcagagtcgatgcttaattagcctttccagtgaatgttaagtctaatggccagcatgaaattttgcatgaatcctattagattctggatgtgcaggagaaattcttactcatgatctgcaaatttgctcagtcaaagacttgcaaggtgcaatttatgtgaggccatggaagttggaaggcttgatctatcagagaagttttataatctcaatcgtgatcttccacacctatattatagtaacctagcccgattttgttaaagggttgtagagatataggatatcatctctctgatctctttgtgcgctcctgggagacatttataatcaagtttctatataaatagccttttggcgtagtcttgtagctgttggcttcttttgttgaagcttgtggctaatatacttcacttaatgtatatctacaaaaattacagtcaaaaaaaaaa

SEQ ID NO: 470 - DNA, 876 bp, Pinus radiata
ccttcatggatatgttggagttgattcgccaccatttgctggaagtggaggacaatatagatatagatattgatattgagggaacttcgccgttgttcttcacccccactgccattgagagtggcgattatattaatattgatgatcatgacgatgatacccgagcaaatgccagagcgaccagggcctcatgccaaaatatcgtcagcagaacaacattaaaagagaacgcgaatgaatttacacaacagatccattcttcatcttctccaagatgctcagttatgaaaggagcagaggcgtttcaggtaaagcaacaaccacgggagcgggagaatggaaagaagagagagacaagtgccaggaattacagaggagtgaggcggcggccgtggggaaaattcacagcagaaatcagagattccgccgcgaagggtgctcgggtttggcttggaactttcaacaccgtcgaagaggctgctcatgcatatgaccgcgctgcctacagattccgtggagctcgggctcttctgaacttccccctatccttcgcttgcaattcagagaaaggatcggccgtaggtaacatggcacacaagtgcaagagaggaaacactggcagcggggcgggatgaacgtcggatcggagtcgaagggagaagctggatttgggattgtgaaaataggataaatacctaaaagggtaaaaatccagcaattttagctgaggccccttgcggcatctccatccttaatctcccttatgtatgcaaaactgaaggaaggagattgggagctatgtctggattatgattttacttgttgcgaagggcatgaataaaataaatgtttgaattttgatttccaaaaaaaaaa

SEQ ID NO: 471 - DNA, 1009 bp, Pinus radiata
gattgtttttccgcaggaagttttgatttgagtaggaaatcctttggcctcctggagctttgatttgctcaggaaaccctagcccttcggttcctgaagctttgcttttcgtaggaaaccctttggcaccggtaggcgatggctcccagcaacaacagaagagacgacaatggagcacgaggagttcacttcaggggcgtcaggaagaggccctggggtcgatacgcggcggagattagggatccatggaaaaaagttcgtctttggctcggcacctttgacacggccgaggaagccgcccgggcttatgacactgccgctatctccctcagaggtccgaaggcgaaaacgaattttgcatactcctcgccgtcctcctcatcatctctgcacaataatcagagcagtagccaaaacagcagcacggtggagtcctggccctctgcggcccctgtgactcgatccggagacctcgagcttcccgcttcttttctccctcgcctcggagtttccaccgggcggcgggttttaaatggtggaaacccccggtccgggcgccggcggagtctttcggagaaaaacagcggcagaaaagctgaaggcgccgaggcgcgaaccaccctaagcgattctgattcttcttcttctgcggttctagacggtgaaacacaggctcttcctcctcctcctcctcctgctgcgaagaagccttttcttctggacctaaatcttccaccgccgctcgacgatgacgaggagcctcagcagatcggttcttgaccgcaatttctttaaattgtttttcgtctcaaatttttttcccgctttcaaccgtttcagctgctgcagcctcggcggccaaatgcctttattaacatgccgaggactgcaatgcaaagctcctccaagaaaatgagggtttgcttggtttcatttcttctggcaatgtacagaaattcgaaaatttaatttcagaattctcttcgacttccggcttataaaaaaaaaa

SEQ ID NO: 472 - DNA, 1061 bp, Pinus radiata
gactgtatgttaacctattaactcccattttgagccctgccactacagagcatcttgtgtgccgctaaatatggaggatttggatgaccatgcccatgctccagaagaagaagttcgcgggcaaaagtgccgccaatttaagggaatccgattgcgaaagtgggggagctgggtagcagaaattcgaatgcccaaatctcgagagaagttatggctggggtcatacaaaaagcccgagcaggccgcccgcgcctacgacgctgcggtgtattgtctgagagggccgaacgccaaattcaatttacccaattctctacctgacattccgtctgcgtcttgtctttcccgccggcagattcaactcgctgctgccaaatatgcgttggatcaattcccttcgagtgcgccccctctgcagaattttaataataaggccatggacgaggccgcatcgccgtcaagaccggatccggtatcagaaactgagttgtcgagcgatagtcatcaaatatcagaggaagggcagttggatttgtgggaaagtccgattgaggtatcaggcggcaattatgaagggcgcatgaacctgaatttgcagagaatgccatcgattgaggaggtctcggccttagaacttatttacagtatttctcagcagcatgaggaggaggaacacataaaccttttcctcgaccccacagagttgtggaatttttgagtaattacttacagaactggaatatccggaatatccgcgttctgaaatctcagctcatatgccgctgcagcgagaggcgagtatcgaacgaacgacctctttattgagggcccatgccgcacggattgcggagttggctaggtctgggataccgctgcagtgaggggccagttccgaactaatgacctctttattgagggcccatgccgcacgtattgcggagttggctagctttgggttaggtatcggaattgttgggtagggaggggctccataactttaatgtattttaaaaaatatctgatttgagtattattttaccctgttgtttttaaaaaaaaaa

SEQ ID NO: 473 - DNA, 867 bp, Pinus radiata
gttgaattaagtaaatcgcagcgagagagcgagagtgcgatccccgcgccgccaaattttggagtctgtgttttcacccacgccgagcttcttctgcgccgccagatatgcagagaccatccccgcaggaggttgaggatgcccatgttctagaagacgaggatcgcaaccaaaagtgcaggcaattcaagggagtccgattgcgaaaatgggggagctgggtatcagaaattcgaatgcccaaatctcgagagaagttatggctcggctcatacccaactgtcgaacaggccgcccgcgcctacgacgccgcagtgtattgtctgagaggtcccaccagcaaattcaatttccccaattctgtgcccgacattccctctgcgtcttccctttcccgcccccagattcaagtcgccgctgccaaatacgcgcgggataaactcccttcgagtccgcccactctgcaggaaaaagagattgcgagggaggacgccgcgtcgccatcgagatcggcttctgtttcagaagcggaggggcggagcgactgtcaacagattttggaggaagatgcgttgaatttgtgggaatctggatcggacagcagggatagttggcacactctgaatttggaaagaataccttccattgatgatgcattggccatggagctcaattcctgtgtttggcaggagcagcagcagcaggaagaggagcacgctaacatcattgtcgaccccacagagttgtggaacttttgaataatggttgcagcaatgccgaggatcgtatgtaaagcgtagtctaactaccaaaggtttttgtccttttttaaaagcaattttttggccaatttccgcaaaaaaaaaa

SEQ ID NO: 474 - DNA, 975 bp, Pinus radiata
tgtgtggtttgttctcgtttttcatcttaaagcggcggttgcaggaattgattgtgtgaggggacgagatgtgtgcagaggtaagtcagagtgccatggccgtgcacactatgcagatggcgagaatggaaatgaagcgtgaaataggagtctgtgagcaggaagcttcgtcggccgtgaaggaaacgcatttcagaggcgtgaggaaaaggccgtggggaagattcgcagcggaaattagagatcccttgaagaaaaccagagtctggctaggcacttttgacactgccgaagaagctgcccgagcctacgataatgctgcccggaatctccgcggcgccaaggcgaagaccaattttggcccctccccactgcacgacggtaagcccctgttcaacaatggcttctctgctcagaaacgagactctctacggcggcctggtttgtgtcccaagcaagagccgggcgttccagttcttccgtcccctgatgttcaggcttctacttgcgttaatatcgggaacctttcgccaaatccggcagtcgagaaacagacggtttctaataaaaagccgatggttttgttcggtacccatctctcggtatcgcctcgcaatttgctgctgcagcagcaacagaaagaagaaatttgtaggtcgcaggggcggcgccaagcgcccctgtggctggaccttaatctgcccccggttgcaaacgatctggaattacttatatgaggaacttgtaattttcttaaggcaagaaggaaaggaacagcttttctgatctaaactatataagctgagatgtaggcacgccacagaacttggtctctgccatttgtatttcccaagtcagtttagcgtattgcctccgaccatttcttttatttcatgtacaggtttacaccctatttatatttaaagaggtttcggcaatctttcagctgagatctgtctattgataaaaaaaaaa

SEQ ID NO: 475 - DNA, 821 bp, Pinus radiata
cacgatggaggtcacacaagggatgagtacgaacattttgaatgtattggagttcattcgccaccatttgttggaagaagaggacgaactggatattatgcatcatctatatgattcaggaattgaatgcatgtcctcatctctctccttctcgcccggcggagattatctccgcgccactagcagtggctcatgccaaaatatgagcagcaaatcgacatcagaagagaatgagaatgaatatacacaagcacaggactcttcctcttcttcttctgtatgcgcagttatgagagcagaggcgcttaacgtaaagccacaggcacgtgaggagcagaatggagagatgaagcagatcagggccagacaatacagaggagtcaggcggcggccgtggggtaaatttgcagcggaaattagggatcctgccaagaaggggtccagaatttggttaggcactttcgacaccgccgaagaagccgctctcgcatatgaccgcgctgccttcagaatccgcggagccagggctctcgttaactttcccctcgccatagcttccaattcagaaaagggttcggcagcgggtcacatggtgcacaagagaaagagaaagacaaagagaaaggagaaggaaaccgtgaaagacaaagagaaaggagaaggaaaccgtgacagtacactgtagtggtcgagggactgccatctggtaaaagaaaatttggggtgcaagaagcggaagtggagcgagttcaataaatgttacaataaaatatattaatgatgttgcaataacgtaatgggtaaaaaaaaaaaaaaaaaaa

SEQ ID NO: 476 - DNA, 1330 bp, Pinus radiata
tcagagtgcgggcgccaactgttttaagagttgtgtgctttttgagtttgttcttccggttgcagtgggcaggagttcccgcaagctttaagaacccttccctttgtgttagacctccaggttcctcaggtacgcagtctctacatcgcgtgacgttcaagggagacgggatattcagagtccgatcgccgccatggccgtagacaccatacagatggcgagagtgggtgtaaaaatgaagatcggaggaggcggctgcgaggaagaggcgtcctcggctgtgaaggaaacgcatttcagaggagtgaggaaaaggccgtgggggagattcgctgccgagatcagagatcccttgaagaaaaccagagtctggctgggcacttttgacactgcagaggaggccgcccgagcctacgataacgctgccagaaatctccgcggggccaaggcgaaaactaattttcttctgtctccccacaatgacattagcaccaagggcagcagcagcgccgccctgtcgagcaatagcaccaccagcgccgcctctggtcaaatccaaaaccaatggcccctgcggccatatttctattcgaatcaaggtccagccatagtttcattttcttgcgctcctgccgcgtcgctttcacccatcgacaacaatcaaggcggcggttctagttgcgttaccaggggatccgcttcacgaaattcggcggaagagaatcagacggtctacaataaaaggggaaaatttttgttcggtatcgatctcatgatatcttgtgattcccagcagcaggaggatgatgcagagatctgcagctcggcacggcagaaggcgccgtttttgctggatcttaatctgcccccggccgcaaacgatgtcgagtaacataactgacaaatttgtaaatttcgggaggcaggaggaaggagtaacaacttttctctaaatgagacctgcgcactgcttggtctaagcctatgccctgtatacccaactaagccaatttttgagtcctttctcctagtattcattttatttcatgtacagtttggtatcctatcattatctgaaagttttcagccattttagagcaggcgtttttatgtatatacattctggtattttgtgttcagtaaaatcgaggcgattcattctattcgggtgcttttttttccttcggaatttggttatacaaatgtcggcgagatcgtgtatataccaatgtgggcgagatcgtgtatatttatacaaatgtgggcgagatcgtgtatatttctttattgctatctaacatttttaaaaatttctaaatcaaaaaaaaaa

SEQ ID NO: 477 - DNA, 1280 bp, Pinus radiata
gccacagtgttttgatcctgccagatttgtttataaaatatcaaaaagttgaggattttgagtacttggccgttgcattgttgattggttttgaagaaaccagatagatcgaagctattttttttgaaagatctattctttaagaatgttgacacagccaaaggtggcgccgaaagatgttggatctgcatacaaagaagtccatttcaggggtgtcagaaagaggccatggggaaggtttgctgcagaaatcacagatccaatgaagaaaacccgtgtatggctcgggacatttgacacagcagaggaagcagccagagcatatgatagtgcagccagagcactcagaggacccaaggcaaaaactaattttgcgttggttcctccctgtgatgataggagtactagtcttagcagcactgtagagtcttggagcagtcccaagaataacactaataataatacaaggaaaaacctatccttgaataaagcagatggcataacacataagattgatctgaacattgcgcaagaggaatttggcaggaagggttctgtaccatatttagaagataagatcctcaatatatcaaagaaacagaaaaccttcaaaaggagctgtgcaccagacagggccgcggaggcctacaattggtccagacagcagtatccacaaatgggttttgacccaaatgcctgtcatagtgattgtgattcatcttcatctgttgttgatgatgatgaagtgggtacttctagcttgaggcctcagggagtcaggttattaccagatttgaatcttccaccttgcgatgacgaagaggatttcagcagcatgttattgcatctttgaatgcgctcttcttttttactgccctgcaaaggccacgggtattattgccaatccaatgaggtccctattttcttctctctgccattgaatcaaccatttttgacttcagtgcataggtatagcaagcattagttctttgtaatcctggccttgatatgaaggaacttatctgctatattttactagatttaaattcattattattgttcgtattggcattggggactgcatgaaatacacaaaggcagttattcctattttctgatctaacaacagtgtaggaataacaatgatcaatttacaggctccgggagggttgggacaccggctaatatatgatcatcattgctgacattttgtgtttatatttgacaatgtaaccctgaaaaagagtttaagcagtaacttctatttggcaaaaaaaaaa

SEQ ID NO: 478 - DNA, 1106 bp, Pinus radiata
aattttttcacttgcagtggaaatagaagcctgcaggtacctctaggctaccggagttcaaatcccgcacgatcacactcccttcttttaacattccgagttcgaatccccggaaacttctcgacatggttaagccctcgcaaaaacagaatatccatgtcaatggcaagccggaaagccgctcactgatgtcgcggcaattcaagggaatccggctaaggaaatggggaaaatgggtgtccgaaattcgaatgcccaattgcagggccaaaatttggctgggctcctacgaatccccagagaaagctgcccgcgcctatgactttgcagcgtattgtctgagaggatccaaggcgaggttcaattttcccgactcaccgccggaaattccttgcgcctcttctctatcgccgtcgcaaatccaagccggtgcggcccggttcgccgcagaagaattccagatgccgtcagatgacgacacggcgtcatcgtcctgcggttctgaagcggaatccgacttgccgccggaaattccatgcgcctcttctgtatcgccgccgccaatccaagccgccgcgcccaggttcgccgcagaagaattccggttgccgtcagatgaggacacggcatcatcgtcctgcggttcggtaacggaatccaacattgacagccaacagatttcggcggagcagggttcggcattttgggattcactattcctggaagatctggataatggcgaatctctaaatttagaggattttcctcccatagatttgacaatggacgatttgggttttcttcttcagccgtcggaagactgggggattttctaaacaaaaatctaagtttggcatggctgcctgaaattttggcatgaaactttgattaatgtagattctcatctgctgaagtttggatgagatttttaagggattgcaacaatggaaaattaaaattgttgcccctacgacaaattatagtgagccgcaggcgcttgaaatggcggcaaatgcggcaattgtctataaataacatttaaatttgatgattcgtttaaaggttaaagctgcagtgcaatttttgtgctaaaaagaaaaaaaaaa

SEQ ID NO: 479 - DNA, 1066 bp, Pinus radiata
tatcgttaaattcactcttttggtctcagttactgcgtcgccaatatggaaaatctccccaatcagcaacctgaccttgaaattgctcaaacacacgaggatcccgggtcccgccaatttaagggaattcgactgcgaaaatggggaaggtgggtatcggaaatccggatacccaaatctcgagagaaaatatggctgggctcttacacgactcccgagcaggctgcccgtgcttacgacgccgcagtgtattgtctgaaagggcccaacgccaaattcaactttccggaaaccgtgcacgacattccgtctgtgacttctgtttcccgtcaggaaattcagcacgccgccctcaaatatgccttgggccagccccctccgagtttgcagtctctggaagggcacgccgccctcaaatatgccttgggccagccccctccgagtttgcagtctctggaggggcacgccgccctcaaatatgcattgggccagccccctccgagtttgcagtctctgcaaggtcacgcgtcgccgtcacagtcgtctaccgtttcggaaattgagttatcgggagaacagcagaagatatcggaagagtgccccgacatagcactgtggcggtcgctgcttggggtatcagacgacactgggattcccaattcggaaaaattcccgtcgattgacgaatatttcagtgcgactttgcaggagcagcgggaggaggattacatttccacaaatttgtggaatttccaagatcaagatgtttgagcttttaaaacagtggacagtgaacacaaaacattcaagtacagagtatttaatattttagagtttagatcatatccaaattaaataggttagttatatattttggagttttaaaatgttgttatttagttgagaatttgtttctctgggatgcaaggaaacaggttaattgtcgaagacataagttgtttttgcattagtgaaaatttgttttttatagattaccaacaattttaagttgtgtcatttttcttgaataacaatgataagtcaattttcgggggcaaaaaaaaaa

SEQ ID NO: 480 - DNA, 1150 bp, Pinus radiata
gcagctttcccagatcttatccaccataccggccccatatcgcattactttcgctttaggattattattgtttggctcggcataacattcaatacccttatgtgattttagtatacattttgatattaagggaattcatagttattttccagagaagcccaatggtttgcagaagtaaagaatcagagtgccaccagaaggtgttggtcggatcgcaacagcactcagaacgcagagaatgccaagtttctagtaaaaggaggagcagaggatctgggcagccgaggcagtacagaggcattcggatgaggagttggggatcatgggtttctgagataagagcaccccatcagaagacaaggatctggttgggctcatatcctacagcagaggccgctgccagagcttatgatgcagctgtactctgtctcaagggctcctctgctcctctcaatttcccagaatctgccaccactattcatcttccccagagctgccagtcaccattgatgtctccgaggtctatacaaaacgttgcagctgctgctgcctatggttatcctagtgctactattgatcttgcaggctccagtggcgttggctgtgctgctgaaagccttcaagattcttttgcctccaatgtaaaaacagctgttggtactgaaacaatgcccagtactggtcacaacaatgacaatgtgggtgcagtaagggaggagaattcatggttagagcagctgttagagtctcccagcagtgttgataattatgggtatgatgatgagatgatctgctgtgcatggctatcgtctgatctgactccattgtccaactgggtggatgagagttatggtcccgatcattctcaggatttctgcagcctctggagcttcccctgatttctcctctgatttatataaattaggcagaatgtgcctaatttatttacttttggttctaatttgatttgataatattttttcttgtgtacactgcaaatgcactgtcacagttatactcctgtaattagttacagactatataattatatagcgacttcgttctaaggattattatttcttgctgaatcaggatttgtatgtacgtactaataaaaagtaatttctgatattattatgtaaaaaaaaaa

SEQ ID NO: 481 - DNA, 1365 bp, Pinus radiata
gtctgtcgtgtccatgcccgagttttggagggctagaatgcaatactaaccaacaacagtttgtgaattttcttgtggggaatcaaagtgagctgcagcctatggctgctagttgtcaactaacaccttctcagatccattttcagcttctgcaaagacaggtagacgagatcgagcagctccaatggtttccatctgctattgcagatccaaaaccagaattggcacaacggagcagtacaatggaccaccttggccggaggccttggccaatgaaacatcctgctaagcggggcctgaaaccatgcagcaatcagcccaccaagctatacagaggagtcaggcagagacactggggaaaatgggtggcagagatcagattacccagaaacagaaacaggctttggcttgggacttatgatacagcagaggatgcagcattggcctatgacagggctgcttacaggttaagaggtgagtatgctcgcttgaattttccaggtttaaaacatcaactgcaattgagtcatgatactgataggccaaccccatcctctacatccaatcaggattcaattacagccattagcaatcaatctggacagttttctgctcagcaaacttctgtagatgctaagctgcaagcaatctgtgaacgtttatctgcatccaataagccatcacatggagaaatgttgggccataattttttgaatcaaaagactatcacggtgacactttccaaggagaattcactcattgaggtgaaatcagaaagtcctgatatatgcaactgtgagggaaataaaacttcagtgattactgcactgaattctaattctgaaatgccttgttagatctgtgatagatgtactcagcactatgccatcaatctttgcttcagcctcattgtcagcgccagcttcaatatgaacagatgttgatgaagtggatcctcttatcagaatgccttctttggacatggacatgacttgggacgtgctggattctgataatgcatatataacatgttaaaaagcaagcaagtggctagaacatgggtgactaatcaccaaattattgagccctgagtttggccaaattatgtttgagccctgagtttggccagccttgagatcttactgtttcacacaattcattcatttaggaagagtacaaaagtagctacggtaaacacctggtgttgtaaggtccatattcatgtttagtaggagaatgggatatacatgtaattgttatacaggcatatctcatacaaatgtttgttatgacatataactactcagattttgaaacatagctgattcacagaccatattatcaatcaaaaaaaaaaaaaaaaaa

SEQ ID NO: 482 - DNA, 1246 bp, Pinus radiata
ttttttttgccttgcattctgtggcggtagcagcttctgtttttaaaacagaaaaatgtgcggagatgaagcggatatcattcccctcaaccgatctcggcgtgtaactcccagggatttcgatacgttcgctgacttgttcatcaatggtggagctgtgtcggaatctttcaagaaatcgtgcagcttcgatgacgaagacaagcaaaaaattgagcctggagctgtgtcggaatctttcaataaatcgggcagcttcgatgacgaagacaagcaaaaaattgagcccagcaagagcattttcaacttcaagcatgaattttcttcaggcggtgaaaatgaggcgattccttctttgaaagatttcaagattcctcctttgaagggtttcgaaaggtcctcagccaaaggcaccgggaggaagaggacgacattgtatagaggtatcaggcagcgtccacggggaaaatgggctgcggagattcgagatcccagaaagggcactatggtttggcttggaacgtttaatacggcagaggaggccgccaaggcctatgatgcagaggctaaaaagatcagaggcaagaaagccaagcttaactttgccgatcactcgtgttccgtaaagatggacactagcaagaaaatgtcaaggaagaaagtaaattcatgtacagaaaaccctgatttattgttgggtctgaacataaacagtaaggtaaaacctttatattcacgaaagcctgacttatcaggagggttaatctcagttcctaaaacccagtgcttcatttcaaatgcatccacagaacaaagcatggcatcgtgtagcttgaattttccaaagaattatctgcgttcgaatcataccttgggttaatcttaagcaactatggatgcatcaatagaagttgcggatcaggctcctggctcttttccatatgaggagtgtttcctgaaaccctggatgtatgacgatctgcccatttcgggttcagtttaccaaagcagtctcggcgatcagcgaattgcagattcggcttatcaaagtactcttgggttttgctaaccaggcatattatcaatacataacaggcaggaagactagtggtttgtgttgcaagcctatgtatagcatgtactcttttaaatttaaactcgtgttttggaccttttgtttatattttattattgttttcaggagtaaagtatctactaaaggctgaagaatgttagaaaaaaaaaa

SEQ ID NO: 483 - DNA, 1338 bp, Pinus radiata
tgcacgtccgccctcattcagagcttccccctccgtgccttgtgtctccagcccttttaaagtctccataccctggagctcccttcagtccttacgtaggcggtaggctgatcatagatcaaaatattttcttgtttccgggctttacagcagaacagatcttttccctcggctacctttttgcttgatttctgttggagatggctccaagagatgagctgcagaactgtggaagaggagtcggtcagactacggccaaagaagtgcatttcagaggtgtgagaaggaggccttggggtcgattcgcggcggagatccgagatccctggaagaaaacccgggtctggctcggtacttttgataccgcagaagaagccgcgagggcttatgataacgcagccaggactctgaggggcgccaaggcaaaaactaattttgccaccccgagggacaaccagagtagcagccagaccagcacggtggaatcttggtcgagtcctaagaacgtcatcgtagctcgttccggtcccccttctgatgcctcctggaggaatttctacagcgccaaatacttggacgcggcaagggttactggtaacgcaaacggaaacccttgctttaaagaagctgccgctgccgctgcctggaagacaatttatgttaacagaggcgtggagagcagagctatcgatctaaacatctcggctctcgatttcggtcgtgtggatgatgcggccacgataaatgcaagggcgcatgagagcataaacggcgccgttgcgcttcgttgtcctgccgtgaatcccttcgactgtccctcgcaggtggcgctgcccggaaagctgttgctgtttgacgggatcgcgtcccggcctgaaaagagacagaagacctgtgtcagaagcggtgacgagaagctcagcttggggcagcagtggtcggtgctcaataagagcgccggcgttggtgaggaggtcgagacgcggaacgtacagagcgactgcgattcttcgtcgtctgtcgtcgttgacaccgaggctccaactgaagccaagaagacgataccatttttggatcttaatcttcccgcatccgccgaagatgatgcttagtcgtcaacgttttgggtttttttttttaccttgagcaacaatctctattttgttgctcagcgctattatatcttccctgggagatatgcggctgtatgatatttcttgaaatcttctttctattttctccgtgagaattagttttggatcgactctgaagaatgtgtatactttgccagatcagtgcggcatccgatgtatttttctctgaaattttaatggagaa

SEQ ID NO: 484 - DNA, 1587 bp, Pinus radiata
gcgatgatttcattgtgactcatcaccagtagtttcttgatcaggcaattgttttgtgttctgcggatgcagcagcaactgtttttaaaacaaaacgacgtgtggaggtgctattattgcggatttcattcccgccaacagatcccggcgtgtaactcctagggatttatggccggatttcgataccttcgctgacttgttcatcaatggcggagccgtgtcggaatccgtcaataaatcggacagcttcgacgagggatacaagcagaagaataagcccaccaacaatattttcaactccaagcacgaattttcttcaggtggtgaaaatgaggcgattcctccattgaaggattttgagattcctactttgaaggatttcgaaaaatgcccggccaagagcgcggggaggaagaagtcgaatttgtacagaggtatcaggcagcgtccatggggaaaatgggctgcggagattcgagatcccagaaagggcattagggtttggcttggaacatttaacactgcggaagaggccgccaaggcgtatgatgcagaggctaaaaagatcagaggcaagaaagccaagcttaactttgctgatggctcctgctctgtaaaagtggacagtcgcaacaaaatgttaaggaagaaagtaaagtcctgtgccaaaaaccctgatttattattggctttgaatataaagagtacggtaaaatcttcatattcaccaaagcctgatttattagaggattgctatcttcaaatggaacgctctttgaaggatgtccgcagatccgatctttcaatctatggctacgatgatatggagtacagggactctcagttcataaattcccctgttccatctcaaagcaattcaaatgcatccgcagtccaatcttctgagcatagccatgccagccaaaattcgcagaaatcgttctcttgtgagctctgtagccttaactattcagaggtgagcaatttcatgttccctgcttatggcgataccccaaaatttgaaccagtggaatcttcctatccagtaggttattttgattctgatcatagcagcaactcatttgatggggaacatttctcatgggctcatgaaatgaaaaccccagaaatatcatctgtatataatgatgatggacatgaatctctatttgtggacataaaacctccagtccatggtgttgttaaggacagacctgtggatacctctataaacgtcaacactgggacagaaagttttggcgtagatacctctatggaggtcaatgacgggacagaatgttttgctgtggatatccctgttgaggtcaatggtggaacaggatgttccaaaacagaggataacatcctgcagcttgagctttctgaaaaattgtctgctttggaaaaatatcttgggttgtcagagggtgacacagcaggctcttttccagatgagtggtccttgaaaccatggttctttgacgatgtgccaatttcagctttacctcagagtagtcctggtgatccgggaacttcaggttcagtttatcaaagcagcgctggcttttgcttttaaaaaaaaaaaaa

SEQ ID NO: 485 - DNA, 1467 bp, Pinus radiata
gagtggattaggtccctaggaattataattctcaatttctaaggtttcccacattgcagaaatgaacgtcctcgatcagattcggcaacatctgctcggcgaatctgacggctcgccttcgttctggaccggatcaccggcggagtcctgcttgacggaaaattacgcgtcttctaacagctggaacgcctcagaggaactggactccggctttgtccagagcgcgctggtaagcgattctgttgaagaagaacagacggcgtcggagaatcagccatgcggtggcagcggcggcaccaggttttcccgtccggtgctctccatcaccgttccgcggagggaatgcttcgagtgggagaggcgttccgctagctggggcgcggattcaaggaattttgtgaccgcctgttgcccggcgtccatcagacggtgcctttcctgcgactgggggaagcttccgttagatgaaaacgattcgcaggacatgtttctatatggggttctcaaggaggcgacgcagaagggttggacgccgttaactccaaaggaaatcaagaacacagacgtcaaacagataaatccccggcaggagacggggcgtgaggtgtcggaaaaggaccagaagagcgggggaaggcatttccggggtgtgagacggcggccgtggggtaaatatgcggcggagataagggactctgcgcggcagggatctagagtgtggctcggtaccttcgacacggcggaggaagccgcctttgcatatgatcgcgccgcttacaagatgaggggcactaaggccttgcttaattttccccttgatttggttgctaagtccatggattccctcagtgaggttgagagttgctgtagaaagaggaagttgaatgggcaagcagagaggggagaagaaaagaggcaccaccatgggccgaatttcgaagagtgtggggtggaatctcaggaatcgatcgtggtggaggatggagagcagaagagatttagacgatgaatgaatattcgtgagcgtggggtggattctgaagagaaccgatcccggtggaggatgcagagcagaagtggtttacaccatgaatggatattcctcatttggctgagggattcggtgaagttgacttgtaaatattatgaatatttcatataaagttatccacattaattctttcttccttccttccacctttaaagtgattcttcttggaatgcacattgcgatttggtaaagagatttgttgtcgctgaattcttaaaccctcttagcaatcgcaatacacagattatttttattttttttaacttaaaagtgtaatctgccccccctaagtctgcaatcattatggccgtagaccgaattcgagtcacaaagatgattccttcggataagagcatgtgaattgcttttatctttcttaaatatatttgccccttttttaaaggttaaaaaaaaaa

SEQ ID NO: 486 - DNA, 1426 bp, Pinus radiata
aatccaagagatccggagcatcacgtactcatcactcttatgtggccaaaaccgccgacaaattagagccagccaaatatgggtatatatctctactccttttatccttaattttcatccatccgtctttagagatttttcttgtgtctggcgaaaccctcgtcagagagcgagagatctttaatggagcacgaatgttcgacttctgaacctcatggcagcggtggaggtgggggcatgaagaggtccagtacaggagcagggggaggaggaggagtaggaggcggcggcggaggcaagggaagcccgtacagaggcgtcaggatgagaaaatggggaaaatgggtttctgaagtgagggagccgaacaagcggtctcgcatatggctcggctcctattccactcccgaggccgctgccagggcctatgatactgccgttttctacctcagaggaccctccgcgactctcaatttccccgaggaagcacgtaaggagcagcagagcgacctcaggctttcgcagctcggggagctctcaccgtcctctattcagcggagagcggccgaggtcggcgcggccgtcgaccatgccatgcaggcgggcccggttcctgctcagaccctgagggaaataaaccaagaaaatgatatgaagaacgccttgagctcaaaattgagcgagggcaataatttcaagatcgaagcaaaaaataatatgaggcagcagggcttgagttcgaaatcgagtgacaatattttcaagtttgacgaaaaaaataatacgatgctgcagggcttgagttcgaaaccgagcgacaatattttcaagtttgacgaaaaaaataatacaaggctgcaggggttgaatttgaaaccgagcgagtgcgatattttcccgttcgaagaaaagagtaataagaggctgccgggtttcatttcgaggtcgattaaaaagagcgacgtttgcaaggttgaaggtatcacagaggaggccgatgaggagaaatctgaccagatgcgactgaatttgagggagcgcgactggtttaagattaaagatcctgtttctggcatcggaacggctttaaatttagggcagttcgcaatacataacgtccaaggtattgcagaccatggcggagagcatacgacgttagggttgtctgtgtacagacccgagaaacgagtctgaaaattctggaagccgtggaattgctcgagaaaaagttttagaattctgttagccgtggaatcgctggagaaaatagtgaggatcctgtaagctgtggaattgccggagaaatgagtctaggaattctgaaagctgtagaatcgaataattttagtgttctgtatattgtattgctatttcttttaacactggaatacaattttctggtttctctttcgtttcaaaaaaaaaa

SEQ ID NO: 487 - DNA, 1247 bp, Pinus radiata
gagaacgttttattcgttttattcgcctttggcactgagcagcgtaaaacaagaagtcgagatacgcagatatgagtgccttggatcggattcggagccatttactcagcgattttgaacccttgttcttcggtacgggaaattgggtgtctgattccacaagaaattgtagccccgaagaagaaaacttcatccagactgcactcacagctgactcagtcgatgacagcagacgggaaataaagacggaaactctgatcgcggccgttaagtcttgccgtccctcgctctctgtctccgttactcgacatggatcagttgagtgtgagcaaattccggttgactgggaactcgagaattccgtgattccgtctgtgagcccttgcttatctgctgcctggacgaagcttccgttaaatgaaaacgattcagaggacatggttttgtacgggattctcaaggaggccgccaacaagggatgggtgccccgaacacccaaagaagagccggtgacggagatcaagaaagaagcggcttttcccgtcaaactagaggcagatatccgtcaagaaacgagagtcacgcccccgccgaagaatgtaaagaagaatgcggggaggcattacaggggtgtgaggcagcggccttggggaaaatttgcggcggagataagggactctgcgcgtaagggcgctagagtttggcttggcaccttcagtacggccgaggaggctgcgctcgcatatgaccgtgccgcttacaagatgcggggctctagggctctgcttaatttccccctccaagttggcgcagaggacgttaatacatgtaataatacgtccagtttggaaaaggaggagagtagtggtgagaataatttgaataggaagaggcagcctgaggaaatgatgagtggcggtgaagtgcagtgggatagacaatgtcgagtgagattggaagatagaaagaagatgggtagcggaatggttgaagagattgtcagtgggaaaatggcaacgccaccactcacgccgagggccattgagatgagcttcactggtttccactgcactggacagctcatggtgaattgaggtcttctctgcattatttcattctttccccgagggacaaaaaattatatccattctttctccacgagcctgtactttgtatgtattctttctatatgtaccaaaagtttgtattcttgactactgatcattcataaaaaaaaaaaaaaaaaa

SEQ ID NO: 488 - DNA, 1269 bp, Pinus radiata
gacaaagacgtcaaaagctctgagttttattcgcctttcaggagatgcgagatgccatccaggagcgtaaaacaagaagtcgagtacgcagaaatgagtgtgttggatcgaattcggaaccatttactcggtgattttgagcccttgttcttcagtacggcaaattgggtgtctgattccccaagaaattgcagccccgaaaaagaaaacttcatccagactgccctcacagctgattcagtcgatgacaacagactggaaataaagacggaaactctgatagccaccgttaagtcttgccatccctcgctctccgtctccgttactcgacatggatcattcgagtgtgaccaaattcccgttgactgtggactcgagagttccgtgattccgtctgtgagcccttgcttaactgctgcctggacgacgcttccgttggatgaaaacgattcagaggacatggttttgtacggcattctcaaggaggccgccaacaagggatgggtgccccgaacacccaaagaagaatcggtgacggagatcaggaaagaagcggattttcccgtcaaactagaggcagaaatccgtcaagaaacgagagccactccgcagccgaagaatgtaaagaagaatgcggcgaggcattacaggggtgtgaggcagcgaccgtggggcaaatttgcggcggagataagggactctgcgcgtaagggcgctagagtttggcttggcactttcagtacggccgaggaggctgcgctcgcatatgaccgtgccgcttacaagatgaggggctctagggctctgcttaatttccccctccaagttggcgcagaggagagtaatacatgtaataatacgtccagtttagaaaatgaggagattaatggtgagaataacatgaataggaagaggcagcatgaggaaatgatgagtggcagtgaagtgcggtgcgatagacaatgtctaatgagattggaagatagaaagaagatgggtagtggaatggttgaagagatgctgagtgggaaaatggcaacaccaccactcacgccgagggccattgagatgagcttcactggtttcttgtgcactggacagctcatggtgaattgaggtttctgtgcattatttcattctttcgccgacggacaaaaatttatatccattctttttgtacgatcctgtactttgtatccattctttctatatgtaagaaaagtttgtattcttgtttactagatctttcataaatctgtaaaaaaaaaa

SEQ ID NO: 489 - DNA, 1582 bp, Pinus radiata
ggctgaaatgggaaaaaaggaaggattttcacagatgggtaccggtttttctcaagtgggtatttgattttgggcccttgatgtgaggaaaaggggatttgctcaagtcggttgtaagtttttgagcctaaaaggtattggaaacattggaataatggtcagtttagaggcttgggggaagatggagggcgggcaagtagcaggaatgggggttgcagacgaagtgaaggaacaacagctaaaggaaggcaatgagagtgatctcctcaagggaatgaagaaggcaaggcgtgagagaggatcaacagcaaaggaacggattagtaaaatgcctccctgtgctgctggaaaacggagttctatctacagaggcgtcacaaggcatagatggacaggacgatatgaagctcatctttgggacaaaagtacttggaaccagaaccaaaataaaaagggcaagcaagtgtacctaggtgcctatgatgaggaggaggctgcagccagagcttatgaccttgccgctctgaaatattggggtcctggaactctcattaattttcctgttagtgactatgctagagatattgaagagatgcagagcatttcaagggaagatttcctggcttctctcagacggaaaagtagtgggttttcaaggggaatgtcaaaataccgtggactggccaagcaatcacaaactggtaagtgggaagcaagctttggtcgagttcttgggaacagatatttcagcatgggaagctgtagtacaagtgaggaggcagcagcagcatatgagatgtcacaaggtgaatacagaggttttggtgtggtcagaaacattgacttgagcagctacatcaggtggtggcagccaaacaaatcgcttgaggttgaaccttcagcacccagacatatggatgaatcacattctatctctgaagaaaggcatactcaaggtgaggaaccagagacaccacagtggccaggtcaggcatgtgagccataccaattgccttctctaggtgtgcctaataatggaaaacataacccttccccagtgactgctctgagtgtcttgcatcaatcttcatcattcaagcagatgcttgaaaaggcatctgcgaaaaaaggtaaaagtgatcaagatataaacgccaatgataatccagaaaatatacagttggagaagggcaagggaaagattttcctagcagaagacacgactggttccaaggaatttgcatatcagccttctggtcaaacgagtacaatatttccttttgctcaagtgcagcctgtgccaccaattcaagattgcaataccacagtccctgcatctgactccctttggaccaattttgtgccagcgactggtggagttgctctagcaaatgctgtcagcatttgttgaagccattatgatttctgtacatatcttggaccatttaaagagtaagctttactttctttatgccaggtagtcatgttctttagtatacatcatgtacagatacagagtcaatttaacattttgatgatttaagaatactagtccctgcaatgggtgtttttaaaaaaaaaa

SEQ ID NO: 490 - DNA, 1911 bp, Pinus radiata
gggcaattggtgtaagcgttttgatgttttgcgaattatcccctttctcagttgttcccgcttctttgaatcccattctctaattcattccatttacaggcggcgaagtatttttttcgttgggagccttcgagctctttttctttttgtttttacaaaaatctagaagcttgaattgtttcagatctagattcatttcttgctttacatatcttttatttttctagataggtagtctgcaaatttgtatgtgatggttttttctgttgtgggatcattttagaactagattttgcacagataatttagaggctgcatcaattaggttcccagaggcatttttaacgcctctgttagggaagaggggtattttttttaaaacctcatcccaatttttttttatagttattttctgtcgtccatttttctggcaagatttttatccttgcctgtaaattgggcttgtctttttagtttcatagggttgggttgttgtttgatcttgaatttttatatggatcggcaacgctctgatttttctaaacagggacagagatttgatctctgtactaacatggtagggaagatggatttgataactgaccctcaaaagagcgagggcccggatagacaagggtttagatttccaagtcttgtcagtaaccagaatttggggattttcaatgcaagtgtgcaggacgtgttcgaggactctgcgtccagctcgtcttctccttccaatggagatgcgaggttggagggtttggatgcctgccagaacttaagaatgccagaggcttctctagtctctggaaattctgaagtcttgtgttcttcgtcatcatttttccccaacttaccatcaaatggcttcggccactctgatggcctggtatggcgcccgagttttcaagggcagaaccagtacagcggagaatccattgaatcggccatggttttgtatgaattgttacatgtacagcagattcagcaaatacagcagcagcagtttcaattgcaacaacaacaaatagcagcagcggcttcaatccaccatatgggtcgaaaccctctgggtcccagagctcagcccatgaaacttcatggcagcagcctatcaaagccggctaagctttacagaggcgtgaggcagcgccactggggtaaatgggttgcagagatcaggttacccagaaacagaaccaggttatggctggggacttttgatactgcagaggaagcggccatggcttatgacaaggctgcttacaggctgaggggtgactatgccaggctcaattttcctcaccttaaacaccatttggaagcaaattccttcgccccctggactggtaattctgtgctgccatcgtctgtggatgccaagctacaagcaatttgccaaagcttgaaacaacctttggaaagcatgtctaagaccgaagaatcagaagaaatttcatgtgcatatgagaattcgggctctcttgggtcggtgcgggatgaagatgcgaagaagaatgatgttgtgtctgtcaagtccgagacttgtgattctgatagtagtgatgattccaccattacagcgttgaattcagctggggaatcagaatctcgttcggcttccaagtcggagacacaggcagagacagaaacggatactttgtgtagcatgccatccttctcggcctcctcgatatgggcagagcttgacgattatttgctcagtattcctcctctggacatggacattaactgggatgtgctctcctaatattataattgcttgtactagtgtaaagttagcattcagtagttgcagtttttagcatgatgggctatgcctaaacatgttgttatcagagagataaataaataccatcttcctctgtaatttattcaaaaaaaaaa

SEQ ID NO: 491 - DNA, 1842 bp, Pinus radiata
gcgaggatggggaaatccatcacggaccagagatttccaatatcggcgtcgcaagtctttgagtatacgggacgattcccgccgtcgatcgtaattcgtagaatctggacgcggctacaaaatcgctgcccgactccaacgttttctccagttcggccagtgaggaagtttgagggttcacgttattgagagaggacgctatttggttgcgatttcgagtgctgtaagcaggcaacgacgcctgttttgctttagagtttaacagaaaagaagaatgtgtggaggtgctatcatctcggactttataataccccctgcgagccgaggccgccgggtgactgccagggatatatggcccgattttgataagttctctgagtttattaatggaggtgctgcggtggagtcctttgatgtcagcgttgatgtcgatgacgacgaggaggattccgacgatgacgagttcctcgattttgaggagagctatcagaacaagaagaagaagcagcaacagccgatatcccccaccaagggtttcgagcttcctttagctcggggtcttgatggaccggcggccaagagcgcggtgagaaagaggaagaatttgtacagagggatcaggcaacgtccatgggggaaatgggctgcagagatcagggatcccagaaaaggcgctagggtttggctgggtacctttaatacggcggaggaagctgctcgggcttatgatgcagctgcacgaaagatcagaggtaagaaggcgaaagtaaattttgttgatgagccaccaccctccgttaagaaggaaagtaataatgctaagggttccaagaaagggtccagcaagaaaataaaatcatatactaccccaaaggctgactttttcgaaggtttcaaaacggcgaacccttcgattgcccaatacaacttccatcagaaattcccaaaccctagctgtgatgatctagggtatcaaaaccccttgtcgccattacatgccatctgcaatcgaaactttgccgccaaacagtcaagttccgcgttgcctgcatactccactgagttttctgatttcgatgattccgaggtcgataatctggtaccccagcctgcgagttttgaaccgatgaaaaacataaataaacgaaaagggtataattcctttgagtccgacaccagcagcgtgtctgctgatagatcccatatctcgtgggttacagaagtgaaaacccctgaaatatcttctgtaccaaaagccgaagccgactctgatcattatgattttgctgatatgtctacgccggttgcgaccagtgtttcagcaggcagccctgaggtacagcttcctccatttaataatggtttgaacaaatcccctagtgttgaagatggcgtcgctgccgaaaaatcccctaaattggaggaaagttcacagttggagatctctgaggacttgccttctttggaatcatatccgtggttgttccagatgccgtatttcgagggcctggatcagtcgttgcagggtgtgggtattggtgacgcttcgtttccggacggtgagaacgacttgcagctttggagttttgatgccgtgcctatttccgattcagcttattgaattagccttgaatctcttgcttgtaaacagtaattagtaattatgtaagaatcaaggagacttgttatggcttcgttttgcaggccttcgtctaatagggaacttgtttagatttttccccttttttttttttaaattcagtttgacggtgctactgtgatttaatctgcacatttatttttggattaggtttaacttattgaatcttttcaaaaaaaaaa

SEQ ID NO: 492 - DNA, 2033 bp, Pinus radiata
gtggcctcgtaagactatataaaccttaccagaaggtcatggtttcagctgagagggtggtctaagagctgatagtttgtttttaagtggtggttttttctggatatttttcctgaatattagcggtttctattcctgcggaaggcagcagcagctggtttgaaagcagcagcagctgttttggaaacaaaacaatgtgtggaggtgccattatcaaggaattcattccggccaatcgatctcggcgtgtaactgctagggagctgtggccggatttcgacacgttcgctgaattcatcaatggcggagcaacgcaagaaacattcaataaacctggcaagttggacgagggatgcaagcagaagagtaagcccagcaagggttctgtcaagacccagcaggaattttgttccgggtttgaaggtgggagaagtgaggtgattcctcctttggaagatgtggaagggtccacacccacgattggggggaggaagagaaaaaatgtttacagaggtatcagacagcgtccatggggaaaatgggctgcggagattcgagatcccagtaagggggttagggtttggcttggaacgttcaacacggcagaggaggccgccaaggcctatgatgcagcggctaaaaggatccgaggtaagaaagctaagctaaattttgctgataactcgtgttctgttaaaaatgacactagcaagaaagtgtcaggaaagaaaggaaagttgtgctcaaaacaccctgctttgttgttagagggtttcaatgcaagctgtaaggtaaaaccctcatattcagcaaatcctgatttattagggggttacaatataaacaggaaagtaaaagcctctttgagtggtgtcggcaaatctgatcttacaatctgtggatacgatgatatggaatatggtgactctgggttctcaaaacccagtgccccattccaaaacaattcaaatgcatgcacggtccaattttctgagcatagcaatttaacccaaacttcgaagaaatcgtgctcttgtgagatctgtagtcacagttactcagagatgagcaatgtaatgcctcctgcttatggcaatgctgtaaattttgaaccagtgcaaacttccaatccaggaggttattttgattctgaccatagcagcatgtcatttgaaggggcgcatttcccatgggctcaagaaataaagacgccagaagtttcttctatatgtgatgacgcaaatgagtctgcttttgtggacatcaagccggtcgataatgttgttaaggccaaacctgtggatacccctattgaggtcgatggtgggacagacgattgctacaaaacacaggatggcgacgggcagtttgacaaacagttgtctgctctggaatcatatcttgggttgtctgagaattctattgctaaagcaaatctgtgtatagaagatgcaggtcgctctgcgggctcttttccagatgagcagtgtttcctggaacaatggttcttggatgatctgccaaattcaggtttacgttatccaagtagtcttggttctcgcatctgaggcttactataaatacataacaagcaaacatactggtggtttcagttttgatgttgcaggcctatgtctagcctgtacagtcttttaaactcatttagtacttttttttgttttttctattgtgaagcctcttcgaaggttgaagacaggatactagaattaatatgtagtaattggttctgaaacatttgggtactcggtccttagtattataaagttgcagagaagactctgaagaatctctgaagatttttgtgaagatgttatttttcccatagactgcgaagaatctctgaagatttttataaagatgctattttgtccatataactactaatctagtagcttgatgtaggcaagaatgccctggcaggaggctccaatccaatggaaatccttctatctggttcggatacaatttgtagcatatctgaaaaattcttctttatggtgttaaaaaaaaaa

SEQ ID NO: 493 - DNA, 1581 bp, Pinus radiata
atcagcagtagtttcttgatcgggccgttattttgtgttctgcggaggcagcagcaactatttttaaaacaaaaagatgtgtggaggtgccattatttcggatttcattcccgctaaacgatctcggcgtgtgactcccagggatttatggcccgatttcgatatcttcgctgacttgttcatcaatggcgtagccctgtctgaatccttcaataaatcgggcagcttcgacgaggcatacaagcagaagaatacgcccagcaagaattttttcaagtccaagcatgaattttcttcagatgatgtaagtgaggcgatttctgctttcaaagatttcgagaatcctcctttcaaggattccaaaaagtgctcagccaagagcaacaagaggaagaggaggaatttgtacagaggtatcaggcagcgtccgtggggaaaatgggctgccgagattcgagatcccagaaagggggttaaggtttggcttggaacgtttaaaacggcagaggaggccgccaaggcgtatgatgcagaggctaaaaagatcagaggcaagaaagccaagcttaactttgccgatcactcgtgttctgtaaaaatggacagtcgcaagaaaatgtcagggaagaaagtaaagccatgtacaaaagacaataatttattatttggcttgaatatgaacagtgaggtaaaatcttcatattcaccaaagcctgatttattagaggattgctctcttcaaatggatgtccgcagatcggatcttccaatctatggctacgatgatatggagtacggggactctgagttcataaatctccctgctccatttcaaagcaattcaaatgcatccgcagtccaatcttctgagcatagccatgccagccaaacatcgcagaaatcgtgctcttgtgagctctgtatccttaactatttagaagtgaaatctccctacgctgtaggctattttgattctgatcattgcagcgactcatcttatggggcacatttcccatggtctcatgaggccaaaaccgcagaaatatcatgtgtatatgatgatggacatgagtctgtatttatagacataaaacccccagtccatggtgttgttgaagacagacctgcggagacctccatcgaggtcaacggtgggacaggaagttttgctgtggaaacatttatggagatcaacaacgggacggaatgcttggctgtggatatacctgtcgaagtcaatggtggcacagaatgctacaaaacaaaggatagcatcgcgcagcttgaattttgcaaaggattatctgccttggaatcatatctagggttgtcagagagtcctaatttgaatgcacccatggatgaatcaatagaagctgctaataagactccaagctcttttccatatgatgattgtttcctcaacccttggatctatgacgatctgctaatctcgggttcagtttactgaaggagtctcggcgatcagcgaatttcagattcagtttatcaaagcagtcctgtttcttgcctctaagtcttatcataaatacatagcaagtttgtgttgcaaaaaaaaaa

SEQ ID NO: 494 - DNA, 1848 bp, Pinus radiata
agaaccccatgcttccgttctgagtaatcagtattctctttaagctcgttgtttcctttcctgccgaggcagcagcacctgttttgaaaccaaaacgatgtgtggaggtgccattatttcggattttgtggccgccagtcgatctcggcggttaagtaccagggatttattgccggattttgataaggtcgctgaattgttcattaatggcggggcagtgtcgaaatcctccggtaaatccggcagcttgggcgagggttacgtcgtcttcgacgagggatacaagcagaagaataagcccagcaataatattttcaactccaagaaggaattttcttcaggtggtgaaagcaaggcgattcttcctgtgaaggatttcgaaaagcccgcggccaagaacgcgggaaggaagaggatgaatttgtacagaggcatcagacagcgtccatggggaaaatgggctgcggagattcgagatcccagaaagggggttagggtttggcttggaacgtttaacacggcggaggaagctgccagggcctatgacgcagaggctaagaagattagaggaaagaaagctaagcttaactttaccgatgattcatgctcagtagaaatggacagtagcaagaaaatgtcaaggaaggaagtaaaatactgtacaaaaacccctgatttattacagggttttaacatgatcagtaactttaaaccttcatattcaccaaagcgtgatctattagagggttactgtataaacggccaaatggaaccctctctgaaggatgtctgcagatcggctcttcaaaactatggctacgatgatatggagtatggggactctctgttcttaaaacccagagctccatttcaaagcaattcgaacgtatcaacagtccaatcttctgagcaaagcaatttgagccaaactttgcagaaatcgtactcttgtgagctctgtagccataactattcagaggtgagcaatttcatgtccactgcgtgtaacgatgtcgcaaatttcgaaccggtgaaatcttgccatccaggaggtcattttcattcagatcagagcagcatctcacttgatggggcacatttcccatgggctcatgaaacaaaaaccccagaaattacatctgaatatgatgacacgtatgagtctccatttgtagccataaaacccccagtcaatggtgttgttaaagacagatctgttcataccatggacgtcagcggtggaacacaaactttttgtgtgaattcttctatggaggtcaacgatgggacacaacgctctgctgtgaacatccctattcaggtcaacagtggcacagaatgctacaaaacagaggataacatcatgcagcttcagttttccaaacaaatatcagctttggaatcatattttgggttgccagacagtcctaataataaagcaaccatggatggatcaacagaagtagcgggtcatgctccaggctcttttccacatgaggaatgttccctgaaaccatggttctttgaggacttcccaaattcaagttcagattatcaaagcaatcttagtgatatgtgaatttcaggttcagtttaccaaagcggtccagattctcccttttaaggctggttataaataaacaggcagactagttttgagttttgtgttgcaggtctatgtgtaggatgcaggaagtagagtatatttgacgtagagtagaattcataaattggtccccaaacatttggggatagtagatttcatgtaataaattggtttgaaatatttgaaaattgcgacttattgaatataaacattcacaagtatcgttagctgcaaaaaaaaaa

SEQ ID NO: 495 - DNA, 2298 bp, Pinus radiata
gttggcgttgagtcctttccgtttgctttgtttgttttgccaaattttccaagactctctgatgctcaattattgtcttctataattggggagagatcatgacaacaagaacggggtcgttgatggatcttgatggctgttgcaagggtcaaggtaagagatctgccgctctgagggagtcagagattgattctcccaatgtggcgctaagtttggcttgttcccctagccagaagattgtttcctcagcggctactgcgattcatgttctcggcagccaagatcagttcgctagagatgaatctgtagagctgaggacaaatgaagaaatgaaaaatgggtgctacacggaagacaaccaagaagatgaaatgagcagcgctatgacggaagaatttaactgttctgtcatgggcgtctcggaaaacggaacgcagccgaagcaggagacagttgcgttcaaagatttgtgttcggcgagatccgtggaaaagaaccttcatgggctggagagaatggggagcggaataagcgtgttgtcggtttccggcggagagtcggagggatttgaagatccgagaaggtattctatgtcgacagagcaagctgggaagctgctttcgtctcagtacaaaggcgtggttccgcagcccaatgggcgatggggagcgcagatttacgagaaacaccagcgggtctggttggggacgttcaacagagaagaagacgccgccagggcctacgaccgagcggcgctgaagtttcgtggtcgggacgccatgacgaatttcagtccggtcggagacggagatccggaggtgcgattcatgagcgggcacaccaagagagaaattgtcgacatgctacgaaagcacacatatgacgaggaactggaccatcatggcaagaggatcaaaatattagcagctcagtcggccgccgtcaacaacgccgaggcgtccggtggcgtcgcagctcatgtatgtcaagaaaaccaaggccaactggaaggaaatgggaatgtcgcctcctcttccagcgccgacgccggcagggcgggtctgccgcacgagcaccttttcgacaaggccgtcacgcccagcgacgtgggcaagctgaatcgcctggtgattccgaagcagtacgcggagaaatattttcctctggatgtcaattccagcgagaaggggttgctcttgaatttcgaagacaacacggggaaagtctggagattccgttactcgtattggaacagcagccagagctacgtgctgaccaaaggctggagtcggtttgtgaaggacaagaaattggaagccggcgacattgtttcatttcacagaggatcggttcagtctgaccatttatacatcagctggagacgcaggccgccgggtcagccccgactaggagtcggctcacagtcactccaatccaaagggcccggagtcgtctatcccctcaaggagccgccgtccatgaatcctttcaatactgtaccacatgctgccgtcgtttacgatgctcaatggatgcccatcttctggcccagttccagtcatcccgacgcatttgcgcaattcaattcccatttcgtctccccggtcgtcaacaaagttgattccctgtggtctcagagcgctgcaacacccctgaacagcactcttcctttctatttctcggcgtcgcccaccaaccaaacgatccaaagcaagttttacgacatcaattccgcttcatgtcaacccacggaactgtatctcaattaccgcaactctcttaatcgcggcgatgaaattagtactaatctcaaaccactgcatccctttctcaaccctgctcgggcatcagaagaatcagaaacccctgaacacaaaccgtcgtcgactctcgatcccgcgaccaagaaaggagtgaggcttttcggagtgactttgccggaagcccagagattgtcatcgcagcatcattgacagttgaatctgtccctttcatagcctcttcctggagcttcttgtttgttgttgaagaaatgacaatgaggaagtcagcacagatgtgccgggagggatagaatcagtgaccacagtcactccattattgccctgtaagaggttgaactcttgatcctatactggatcgcttgtaaacataaacatgtactgattatttaactgtaagtgtcaaggattgtaagggagtaattttcctctgctatatttctaattgctatttttttttctctaactttgttatccaatcgattgaatttcacataaaagttcaccaaaaaaaaaa

SEQ ID NO: 496 - DNA, 4587 bp, Pinus radiata
agatgagtggagtgagttcggctcggagctgtgtcgaggttttgttgggcagaggctgctctgtggagcggatcgctcgccgtttgagtcgggtcgcaaacgggcaatttgcgatgtggaatgtgcagaactgtggaagtagggttaatggaagacaattgtgcttctgatgatcgggagcatatagctttaatcgattatacgtttgctctttgttagttcattgggttatagttgtttcagtggagtagcgtgcagcagtttgatcggcgaaaatgaagagtccttcaaccagctgcctttctcatccagtggagggggagcagaagagcataaattctgaactctggcatgcttgcgctggaccccttgtttccttgccctcagtgggtagtgttgtgtattattttccacaaggccacagtgaacaggttgcagcttctactcagaaggtagctgacacgcacattccaaattatcctaatcttccttatcagttaatgtgccaacttcacaatgttacgttgcatgcagatgcggagactgatgaggtatatgcacagatgactctgcaaccagtgaacagctgcaataaggaggagatattatcatctgatcttggccttaaacaaagtaaacaaccaacagaattcttctgcaagacattgactgcaagtgatacaagcacccatggtggcttctcagttcctcgtcgtgctgctgagaaagtgtttcctccacttgatttttcaatgcaaccgccagctcaagagctcatggcgcgagatttgcatgacaatgtctggacatttagacatatctatcgtggtcagccaaaaaggcatcttctaacaacaggatggagtgtatttgtcagtgcaaagagacttgttgctggtgattctgttgtttttataagggatgagaaatcacaactactactgggtatcagacgtgcaaatcggcagcaaacatctatgccattgtctgttttgtctactgatagtatgcatattggcgttcttgcagcagcagctcatgctgctgcaaaccaaagtccatttactgtattttacaatcccaggacaagcccttcagagtttgtagttcccttagcaaagtacaacaaggcagtgtatggtactcaggtttcagttggcatgcacttcagaatgatgtttgaaactgaggagtccagtgtacgcaggtatatgggtaccattgcaggaattagtcctcttgatcctgtgcgatggccaaagtcacagtggcgtaatctccaggtcagatgggaggaatcaggtgctggtgaaagaccaaatagagtttctatttgggagattgagagtgttgcaacccccttttttatctgtcctccattttttcggctgaagcgcccagtacaacctggaatgtttggggaagaatcagatattgaaagcaccaccaaaagatcttcaccctggcatagggaagagcatgatattctggactttcaacatccattatccatttttggtttagagccatgggttgggatgcaacaaagacatgacgtgatcaacccaactgtgccgcttgattaccatcgtcctatgactggttctacttcagaggtatttagaagcaatgatgcatgtaaagagctctgtgcacctcaacaaacttcacaacctcgtgaaatgcagcatagtattctgcagcaacaggaatatcaatcacaatctcaagtctcttggcaacagctacaacaacaaattcagcagcagcagcagcaattgacatcccagcaaatggtgctgcagcagctgcagcaaaatattcctctacagcagttacagaagcaagtgcaacagaacccgatgctgcaacagttacagcaacaaaacccagtcctgcaacagttacagcagcaacatgtactgatgcagaagtcacagcaacagcacacatcactacaacagttaaagcagttgcagcaatctataccagaactaaaacaatttgagaatcagccgctgcagcagttacagccattgcaacagcaacaaccatctctactgtcacaacagcaactccagcagcctatgccattgccttcacagcaaaaaatattgtccgtgcaaccagagcaattacataatcagcatcaaccaagacagtctcctatgatgggtcaatcttcagaaaatcacctccataaccagcaactacaactagaaaaatcaattctgcatcagcaaccagcacagcagagcctgccacctgctcaacaattctcgtgccgaattcggcacgagatcctgttgtagcccataatttggcgatttcgagccagaattgcccaattttgagggattttcacgacgattggactgagggggcgagctcggctgaattccgatggaaaataatgcctatccatctggtgcccaaagcaatgctgaatatcttgctcctcctcccgttgaaggtgtagccggtggtggaactggatatggttggaatgatgttaccctaaaaggacgtgactcttttctaaaagctatagatccaacaagactactgactacagatctcttgcatgtttgggtcatgccaagcacagcaacaattgggcatcaggagcccccaagacccctagaacctatatccatgcttgtagcaaggaatgagagagaaagtgtacagattgctttgcggccaaaagtttcttgggctggcgatggcaatgcaggaaatttgcaagttcattgttcggatttatgttctagttctggccagaggcttgaagttgggagatgtttgactttaagacgtgtggtaccaattcttggagtacctgatgcacttgtcccagtgagcttacccagtgcacggattagcttgcttcctggagaaacttctgcactgtgggtttcggttgatgttccttctgcacaacaacctggggtgtacgagggggaaatcttcatcaccgctgtgaaggctgatgcagactctacagtggaagaagtaagtgacattgacaaacatgaagttagaagaggtttggaggaaagtctttctatagctgagtctttaaatgaaaaaccacaggaggaaatgttagaaggactaagagcaattactactggattaagaaggctccttcaagcaccattcctttcttcttccagtgaaaatggcagcatggacatggacggggacggtcaagaagcttctgtgatacgtgtgaaactcagcattactgtttgggactttgtcttgccagtgactccctctctgcctgctgtcttcggtatatctgaaactgtgattgaggaccgatttggattggaacatggaagtgaagactggtatggttcattagacatgcattaccagtggttactccaatacagaataagcccctttttttgtagatggggtgataacatgcgcgttctgacgtacacctgtccctggcctgctgatcatccaaaatcagaagaatattattctgatccaagattggcagtttatgctataccctatgcacctgttttgtcaagtctggatgcagcaaaagatgtattgaggaaagagcttgaaattctgaagacaaaacctcattggaagaaatcatacttttatttatgggatgagcctttaaacctggagcagtatgatatgattcgtcgcatgtctcatgaaataagagcaattgctccagatgcccgtgttttaacaacgtattattgtggacccagtgatgctcctattgcaccaggcacctttgaggcctttgtgaaagttccaagttttttacgccctcacacccagatatattgtacaagtgaatgggttctaggaaatcgcgaggatttgatcaaggacatcaccgcagaattacatcctgagaatcgcgaggaatggtggacatatgtatgcatgggaccttcagatcctctcccaaattggcacctcgggctaagaggtacacaacaccgtgcagtgatgtggcgtgtctggaaggagggggggacaggatttttgtactggggagcaaattgctatgaaaaagcagttgtctctagtgctgagataaagttccgtcgagggttgcctccaggcgatggagtgctcttttatcctggagaagtgttttctacttcaaacgagccagttgcttcggcaagactggaaaggattctaagtggtttgcaagactttgaatacctacagctgtattcttctagatatggtagggctgaagccctagcacttttagagaagtcaggaatttattatggtcctgagcgatacacacacgaacatggccctgttgatctcatgagagaagaggttttccgtgcttgtagatctttgtgatttacaaaatgtgggcttgattctcaaactacattatatgttgcattatttctgtaatatttgaaatgcaagtcttcttctatgttggtagcaagatgtatttcacgtttttatcatagttattttgcctcccaggcccatttattcaggatatattgttatacttgcataataattgttgcaatctattttacatttgccctaaaaaaaaaa

SEQ ID NO: 497 - DNA, 2745 bp, Pinus radiata
tggctgtatacactggcagagagatagatatttgtatataggtgggtatgcctgtgccatgcacaatgaatggaccaaggatcacatcaatggattctgcacatgggtatggactggtcatgcagagaggggcagatgatgggaaccccggtcttgattcacagctatggcatgcctgtgcaggaggaatggtgcagatgccctctgtgaatgctcggatttactattttccacaagggcaggctgagcactcagccacaaatgtggaattctcagcaaatctcagggtcaagcctgcaatactctgcagggtgctcaatgtcaaattcatggcggacacagagactgacgaggtatattctcggatccgcctggtgcctattaagcccaacgaggctgctatggaggactgcagtgaggataatgataatgctgctgcaaatgagaagccagtctcttttgcaaagacgttgacacagtcggatgccaataatggtggtggcttcagcgtaccgaggtactgtgcagaaactatttttccaaggctggattacacaagtgaccctcctgtgcagactgttcttgcgaaggatgtccatggagaagtttggaagttcaggcatatataccgtggcacaccgcggaggcatttgttaacaactgggtggagtacttttgtgaaccagaagaagcttgtggcaggtgattcaatcgtattcttgaggagcctcaatggcgagctgtgtgtggggatcaggagatccaccaggagtactggtggaggggactcatcggcctggcacctggcaggtcagcagcagcaacatggcagctgtatgtctccttataggagtagttccaggtgggaggtcaaggggggtgataatttttctgctgctttttttggtggtggcgataagtctagtgccaatgggaattccaatgggtttgcaaggaataagggtaaagtgagcgccaaatctgtcatcgagtctgccactttggctgccaacgggcaaccctttgaagttgtgtattaccccagggccagtacccctgagttctgtgtcaaggcaaatgctgtggatgctgcattgcggatgaagtggactgcagggatgcgctttaagatggcctttgagacagaggattcctcaagaatcagttggttcatgggcaccatttctttggtgcaatgtgcagacccaattcactggcctacttcaccatggcgacttttacaggtaacatgggatgagccagatttattacagaatgtgaagcgagtgagtccatggctggttgaagttgtttccaatgtgcctcccatccaattgtcgcctttcacactacccaagaagaagctccgagtgagtcagcatccggagtttcagtttgaggggcatggaatcatgggaggacttcaaatggctacacttactaataatgtgctagggcagattaacccttggcacggtctttcagaaaatgttcctgcaggcatgcagggagccaggcatggtcatatttatggggttcctttgtcagattttcattcaaacaaactacaatctgggttgtcattagatagcttccaccagctagagcaaggagcactctcatcaacccctgtttccacagacctcaacattggttgtttctcccagcttgagcgctctagtgtacaggacaacctatcttgtgttttaacaatgggaaactcatcgcaaagcgaacagaaagcaactaaggggaggtccactagctcaaccacaaagagtgcaccctttctgctgtttgggaaacctattcacactgaacagtctcccaaatctgaacagcaacagcaatcgggagtgagctcttcagatggtccaggttttcatgtggtgaatgactctggttcgcccgggcttacaagcaacagctcaacagacggaaatccagaagttgtagacagattacaaagggcaatggccggtagatcagatacatccaaactctctgaaaattatggcttgaggctttattgtggggagacattggagtctacagttaacaatggtggtggtaacctttcatggtttaaagatcgtcaagtttctttacagaccttggagaatggtagtggaggaaagacatctgaagatggtgttgtacattgcaaagcattcttggagtctgaagatgttggtcggaccctagatctatcactgttcagtagctatgaagagctccacaacaagctagccaagatgtttggcatagaagattcagatctatcaaaccgtgttctttacaaagatgcagctggtgttggaaggcacacgggggaacaaccatatggggattttatgaagactgtaaggaggcttacaatcttgtctgattccagcagtgacaacatgggcagatgacaagatcagcttttaaagttgcatgcctgattcttctacaacctggtcggcatgaaactccaaagatgtcatagacttttgacagtctctgctcgtggcggattctattttgttatttgatataaaatatcaagatggaatgatggaaatttttgcaaaatatattttcctgaataatccaatttctgattagctgtacagtgaatgccttccaaagtgttagaattttttgctattgttttttattgacattgctacctttagaggaaattggatatcctctgtcaattttctttcaatgatatattcaaatttctcaaaaaaaaaa

SEQ ID NO: 498 - DNA, 3427 bp, Pinus radiata
gccacccaccaacaaccaggagtagtggcaagtcgcaagcatggggaaggggcgaaatctcgcttgggaatcgagagaattcggcgtatcgcttgatgggtgtgcagattacggcgaaatctgaactgggtcaaaggaattgcaagctggtttgagatgggtatgtctgggagtttaaggggagttgttgagattcccaggcctggttaaggagggcgggggttacatcagtgcaggtgggtttgatagaagcggcggagacggcttttgggagaggatattagctggccgctgtaaaaagttagtggtggttatggcttatgctgaaaatttgaggaattttggttttggggccaataatggtggttctaatcagagcaatagcagtaatgggggtgtagatggctattcttcgatgtccaatgagggagggcttgttatgggacagattggcggtccacatggctacccgaattcttcaccaagtgctcaagatgcgctatacgaggagctgtggcatgcctgtgctggacctcttgttacgctgcccaggatcggggagcgggtgttttatttcccacaaggtcatatggagcaggttgaagcatccacaaaccagggggctgatcagcacatgccattgtttaacctgccctataagatcctttgccgcgtaatcaatgttcaactgaaggctgaacctgatacagatgaagtgttttctcaaattaccttgctcccagaggcagagcaggatgagtcgtctgttgagaaggagcctctaaccccactgcctccaaagcctttagtatactctttctgtaagaccctcactgcatcagataccagtacccatggagggttttctgttctcaggagacatgctgatgaatgtcttccacctctggatatgagtcagcaacctccatctcaagatctggtggccaaggacttgcatggagttgaatggcggttccgacatatctttcgcggtcagccaaggaggcatttgcttaccactggctggagtgtctttgttagttctaaaagacttgtggcaggagatgcatttatctttttgaggggtgaaaatggtgaactgcgtgtgggagttaggcgtgccatgcgccagcaaaacaatgttccatcatctgttatatccagtcacagcatgcatcttggtgtcattgcaactgcatcacatgcagttacaacgaagaccatgtttagtgtctattataaaccaaggacaagcccatcagagttcataattccttatgatcaatatatggagtcaatgaaaatcaatttctcggttggaatgagattcaagatgaagtttgagggggaagaagtcccagagcaaagatttactggaaccattgttggaataagtgatgctgatcctgtgaactggccgaattcaaagtggagatgcctcaaggtacaatgggatgaaatatcagcaattgcacgaccagagagagtttccccgtggaaattagaaccttcattaactccagtggcagtgaatcctctgccagtagccaggggcaagaggcctcggccaaatatattaccttcatcttccgatttatcagtgcatgacaaggccccagtggattctactcaggtgcacaggtttccaagggtcttgcaaggtcaagaagttatgaccttggggggatctttgggtgacggtgagttggagagtggtcaaaagatggttgcatggggcggatcaaaactggatgatgtcaaagcagaaggtatgggttgtcaaagaaggttggtttcagaaaattggatgccgccacttaggcatgactcactatattcagatactttctcaagttttcaacctgtgggggaagtgcaagaattccgtggttcattaacaaatagtatcctggaagatggccagcagccaaagctttcaagaaaacagtttcaggaccaagagggtaaaattgtggatggatcaggactgtggtcaatgagttttccaaacagcttacaattgtgcgagtcaaataggaagatgtctgcgacctctgctgcccaatcgcacaagcagagtggaaatgtaagatggaccggtggcttgaatggccacccacaattttcaaacattggaatggaagcatcggtgggaaactggccaatgcatatgatatcaccatgccaatcagaggtttcaggagcacatggtggtgtggataggaatgcagccagaaccatgcaagtcaataacatgggagcaactgagcagcagcctagttttgatctttgggaaatgtccaagggggctgaagttgtttcacgtcaaattgatagcaactgcaaattatttggttttcatttgattgacaattcaacagggggtggtgacccaaacccatcaaaaatcagagcttctgttaatgaggaagagttacatgttgctgctcatgcttcaacagaaactcatttactgtctgtagagcccgaccaacagtcagaacaaacaaaaacagccaaatctgatgcacctgctggaagctgtgaacaagagaaaacatctccaagatcatcccaagaaacacaatgtagggcttcagctcagagtaattctacaaggagctgtaccaaggtacataagcaaggtagtgctcttgggagagccgtggatcttacaaaatttgaaggctatacagagcttattcgtgaactggatttgatgttcaattttgaaggacaactgcaagatgcaaacaaaggttggcaggttgtctacacagatgatgaaggagacatgatgcttgtaggagatgatccatggcaagagttctgcagcatagtgcgcaagattttcatatatactcgcgaggaagttgaaaaaatgactcctaggacacccccaaacatgaagcttccagggcatgctgaagaggaaaaagttgcgagagaaacccctactcggtagccagtgcataaagaaattctgatgcccagcactttagtatttgatttataagtctatcctgcttaattgcagtcactagattgtgaattggcacataaagtgctcggtatgcattgtctatatttttgcttgttttggtctggttttaatttcaacttgaacgttgaaggaattgttgctccaacaaatttggtttctatatggacacaaacattgaaggtcttattgctgagttgacgatgaggcttatacgagctgtattagttttactgaagaactggaatgaggatgtgatccaatcccagtttaagaggtattttgtttagtgacagactattgactagctacagagacactatcaggcagcagctacctggcctgtgataaatagttttgatagctgatctccttatggaaattaacggaaattttagtaattttttttttgtctcaaaaaaaaaa

SEQ ID NO: 499 - DNA, 1289 bp, Pinus radiata
gaatcaataactccgtgtttgttacagagcaaagatcttttgcaagtattcttcctttttctcctcttttggggttgtttcaatcttgggctctgatatcttcagaggaaggactaggactttttcgttacaggttgtgcagaatcaacatgtcttgcagtgttggaaacatggccatggtcctggagaaatctggtgggaacgcgcagcatgagaagagagatagtttagatttcgcggagactgaactgaagcttggactcccaggagtagctgcaggggcacgccagaggatctgtggcaaaagaagcttctcggaggccatggaatccagaaattataccattccagatgaagacattacaaataccagcacacatgaggaccttgataaattcaagggacccatagtcaaagaaaaacaaatggccctttcagccaatgaccctccaagaatgggacctccacctccttccaaggcacaggttgttggatggccacctgtcagagatttcaggaaagtgagaacagttgctgcatccaattctctgtatgtgaaggtgagcatggatggagctccttatctcagaaaggtggacctcaaattgtacagcacctaccacgaactcacctctgcactagagaagatgttcagctgcttaattatcatgggcaagtgtggatcccttgcgttgaacgagagcaatttaatggatttgcccaatggatcagaatatgtgcctacttatgaagataaggatggagattggatgcttataggcgatgtcccatggcagatgtttgttgattcctgccaaagaatgcggatcatgacggcttcggaagctattggtttagcgccaagggccatggaaaattgtaaaaacaggaatagagtccacccataatgttctttgttcagtgaatctggaacctgattattcatgatatttttttgacttttgaggagggcatattcaatcagcctctatctaacgcatgtgttagaaattacgatagtcgatccaataccctgcatgggatcggatggtcgctgactgttttaattggagaagttaccaggttgggggcgatcgcgcctccgtctacggagtcccgactaatctatcctatggatttatagaactggcattttcagaagctatgtgtagtaaacaaatatggtggtcaggcaaatacagtttggaggacccagaaatttcactgtaaatgattattagaatgattgattatttagaatctaatatgctttcaaactaaaaaaaaaa

SEQ ID NO: 500 - DNA, 1410 bp, Pinus radiata
gaacaaacagaattatcaatcaagtcttcttggtgaccggaccctccaatttcgcacaatcacaatcactctttttctctacccttctggtggtgtttcatcaagactctgatatctttcatctctctcattatttgagcaagaggattaagggctgggatatttttcataacaggttttgcagattcatcatgtcttgcagtgttgtcggaagcatgggcatggccttggagaaatctggtgggaacgcacagcatgagaagagagacagtttagatttcgcggagactgaactgaagcttggactcccaggagtagctgccgatgagtcacgagcacaccagaaaagctgtggcaaaagaagcttctcagaggccatggagtccagaagttataccattacagatgacgacattacaaggaccggcacacctgaggacgctgataaatttcatggacccatagtcaaagaaaagcaaatggcccttcctgccaatgaccctgcaacaacgggatctcgacctcctcctaaggcacagattgttggttggccacctgtcaaagatttcaggaaagtgagaacaatttctacatgcgattctctgtatgtgaaagtgagcatggatggagctccctatctcagaaaagtgaacctcaaaatatacagcacctaccatgacctttcctctgcactcgagaacatgttcagctgcttacttaccatgggcaagagtcgatcccatgggttgaacgagagcagtttgatggatatgccaaatgggtcaggatatgttccaacttatgaagacaaggatggagactggatgcttgtaggcgatgttccatggcagatgtttgttgattcctgccagagaatgaggatcatgaaggcttcagaagcaattggtttagctccaaggaccatggaaaaatgtaaaaagaggaattagagtgcacacattatgtgctcactggtcggtgtgtgcataatgttgttgttcagtgaagtaaaggtggaagctgacaattcatgatattcttttgaattttgtggttgggactgggcatatttgatatatgttttaaattacagtggtcatcagaggatatgggatcggttggtagtgttttgtctggaaaatattgcagtagggggaaatcgcgccccagtcacctaactaatctaatgtcgacataactatggaaaaataactatgttatctgcaaaatatataccgaattttcatggatgtaaggacatgggtttctattacgttctacgcaggatacaaagatgatggttagccgtggttccaggaatttcagtgtgtatattgattagaaggattgatttttgggaggctgatttgctctcatcctaattgtatttatttagcacgaaaaaaaaaa

SEQ ID NO: 501 - DNA, 1629 bp, Pinus radiata
ggttgggatgaataatgttgtagcagacggtattcacacagtccaataatccggatcagtccagggaaaccgggatctctaggatttctagctatacgccattggtattgttcagtgagtagtttttttcatcagaatctctgtggttgcaacttgcaacttgaattttgtgttttggagatatggagaggtttgccaacgatggggacgagcacagcctaaaggagactgaactcaggctagggttacctggtgtgtgtgagtcagacactggtctgggtcaaaccaggaatggcaaaagggcattttctgaagtcatggattccaccaaggcttcaagtttcaatgacaacaaatggatttttccttctgtcaaatgtcaacctccaacttctgccattactgaaacggctgaagcatgcaagggcagtcagccagggttgttttctgcaactcctggccagaaaataatgatgcaaggtggttgtggtgctccccagtcatgggcaggggacaatgggctttctaggtccactgctcccaaggatgaactacaccccaagaccccaagggatggaccaacagagaaaactaatgcgacttctcaatctcaggctgcaactgatcctgccaaggcccctgctcccaaggcacaggtggtaggttggccacccattagatccttcaggaaaaatactttggctgcaaattcaaagcctaacgatgaggggtcttctagtaatgctttatatgtgaaagtgagcatggatggagctccctatctcagaaaggttgacctcaaaatgtacagcacctaccatgagctttcctcagcactcgagaaaatgttcagctgcttcaccatggggcaatgtggatcccctggtctgagcgagagcaagctgatagatctgctgaatgggtcagaatatgtgcctacctatgaagataaagatggagattggatgcttgtaggcgatgttccatgggagatgtttgtagattcttgcaagaggttgcgcatcactaaggcctcagaagctattggtttagctcctagggccatggagaagtccaggtccaagaattagaggtggaggtggagcatgacctgctttctaggaactgtgccagtatctagcgttgtatttctcaaagtgggttggtagagatttaagcatatcttggggatttgcagaagtttctcagggtggatatggtgaaatacatggcgaaatattttgttggaagcaggtctggactctcctcaaacacaccttcccgccatggtggtgggacttgtaattttttttttagtggcagcaatgaacagagttcaagtgcctgggacagatcaataaactcagcaatattacgagaggacgtcatgaataggcattctgtgtaccatacttcacagccccgtgcacgcagtggaataattattactctttttctctggtttttttttgtagtttgaatgctttcaacctttattttattttgaaccttgcgataatgaacgtttaaacacaagcaatcgagtggcaaatcttcttgatttggtctcgatcgtgtggggggtacctttattattattattattattgcggtttgagaaaaaaaaaa

SEQ ID NO: 502 - DNA, 1480 bp, Pinus radiata
cttctgatgcctgcaaccaatgccaaaagtgaagtggactccaaggtttcaagccaacaacctcaacatcagaatcagcatcatcatcagcatcagcccccccttcctctcatgtatccctgggctaatgctgtgcaagtgcccaacacttggcaggtgagcctagagcagcaacaacagcagcacagagggagttatggggcatttcctactcaggcagcagccagagttatggtgggcaacgtgatggcagcagcggcagggagcattaccctcaacgaggctccacatggaatcccatccgaatctcgtgcaaaatcttcgcaggagagcgtctcagcttcagccatgaggccaccaatgccacctcctgccccctctgaacggcagcagaagaatcccactggcaacgaagctctaactcctccatctaacggcaacggcaactctgctgcatcaagagtttccccagtggtaggatggcctcccattcggtcattcaggaagaatttggcacctcagcccaagcctgatattgaagacccaactgatgcttctggcaactcttatgcttctaccgatcctggacagtccttcggagattccatgtttgtgaaggtgaacatggatggtgtgcccattgggagaaagatcgatcttaaagcctatgatagctacgataaattgtcccaagctcttgaagaaatgttcaaacgtttcatcaatgtgcaggacagtgggcagagacaacctaccaatccatcgtctaaaaatgatcagcctactctattaagtggaaccgattatgttctcacttatgaagataatgaaggggatcgtatgctggttggagatgtaccttgggacatgtttgtgagtacagtgaagaggctgcgtatcatgaagagctcagaagcacggggattagcaccgaggcatcctctgaagccacagggtcaagtgacccagtgactaatgattgaaagctccagtaaagggatcccaaatggaggagatcccattagcagcagtgaaggttggggtgggttaaagtgtgcgggaaggtaggcaagttttcatcaggaattgaagagttttttcttgatggtggggtgtaaaatacgatttgaatataatgtcagtaagagtatccagagaggtattctcttgcatgcatcatgacttaatggttgtgttgtattatttcggcagttttcttcaaaggcatacaagaaatgcctgtcttctcccttgggatgtgctggaggcattgccttgtgactccaagcacattccggatattgcgtggcttctttctctgaaacatgaacatagactaggtttttttcttcctttttctcttttgttaactgacatggggaatgtttcccatctctgtactttgaggaactgacctcatgttgtttgtatatttatttgtatgaactattaaaatatggtttgaagttcaaaaaaaaaa

SEQ ID NO: 503 - DNA, 1562 bp, Pinus radiata
gcacaacggcatcactattttggaacaaagtggcttttgttgcagcagatacgagagagagaaatctgtggttagctatggggtgtttgagagaggatgacgatgagcacagcttcaaggagacggagctcaagctggggctccctggagtgacagaaggttcagatgagcacaggactggcaaaaggactttctcaaaagctttcatggagtccaggaatgatgagaaatggatgtcatcttcttctgtaaaatcaacagctactgcgtttgaaatgtctaaatccaatgaacaggggatgttagctgccacacctcctctatctcagctgcagcgctcatttcctccactctcttggaaaacaggtatccagaccgatccctcccgggttgctgtgcctgccaaggaaaaacaatcaggaaactctgctaatggctcagaaatgcctcctcccaaggcacaggtaattggttggccacctgttagatcgtttatgaaaaacagtttgacctttaattcaaagactactgaagaaggctcttccagtagttctggtctgtatgccaaacccacacaaacccaaactacaccagataccaccatggctcctgctcccaaggcacaagtagtgggttggccacctgttagatctttcaggaaaaacactttggctgttaattcaaagcctaccgaaaatgggccttctggtagcgctctgtatgtgaaagtgagcatggatggagccccctatctcagaaaggtggacctcaaaatgtacagcacctaccatcacctctcctttgcactcgacaacatgttcggctgcttcagcatggggaagtgtggatcccagggtttgaacgagaagaaagtgatggatctgctgaatgggtcagaatatgttcctacctatgaagataaagatggagattggatgcttcttggtgatgtcccatgggagatgtttgttgattcctgcaaaagaatgcgtatcatgaaggtctcggaagctattggtttagctaggtccatggagaaatgtaaaaacaagatttagggttcacgtatgacccattctctggaagctgctttgcatttcgattgattcaaatagaacgtcgtctgacaagattggagcattagggaaaatcacggcgtccaaaatttttatcttgtgactttgaaaacctcagaaattggtgatttcgctgaaacgaaggcaatataagcaggacacaatggatctgctattgaactggaagatttgggaaccatcctggcaatctttctgtttctgatacattcttagctaggattcacttgttgatttattaatctcaaaccaaaaatctggatttctgtctcaacaagtattgaataatggaagaccagcctcatcccagtgcaggcttatgacagtgggttaaggattcaacatgttaacttctcttaaattccaacgttctgaaaggcaacgttagcccttgaactgtaaaactgtaatttgctatttggcataatgacacttgggtatattcacttctgtagctcaaaaaaaaaa

SEQ ID NO: 504 - skipped

SEQ ID NO: 505 - DNA, 1791 bp, Pinus radiata
cagaaatctgctgaatcaggcatctggatcgctttgtagtttcatggtctcgggttcgatctcggacagggttacttgaaccaggaaatcatcgacagcagcggactggctggctctgaaatgaagtccggcgtgggatctagtcgttctaatgcttccagcgtcacggcatcgactctaacagaacatgattacattgggctctcagaggtatcctcatcctcccacacctctgagtatactaatactaataataatggtagtaatgagaagcagactcaggagtccgatggaagcctgggagatgcagagctcaacttgggcttgagtctttcttacaagaaagagccccttaatgccgcagcaggcttcaatggctcagagaaagcctttcagaaatgggtttctcacgaggagtatcagaggcctcgtagcacaagtgtgtctcagcagggtgtgtgggcgaaggcgggattcgaacatcggatctctcaggagaaaggggcttcttcttcctctatgtttgcaggggttcaggtgttgaggagctgggaaggtgcaaggattcttactgcagaagatctgcaggctcctcctgctccccacactgctgttgttcatgacgttggtgagcgtgtcaggcctggttatgggttctctaactctggtagagttatcatgcctcctccaactgctgcccctgctgctatttctggaacaaagagaatacacaatgagtccgatggctctgatggaatccaggacagctctgaggtttcaaaaggtcaagcagtagtggggtggccaccgattgggacatacagatcaaaaacccgtgctactactcagcctcggtcccccttgtatgtcaaggtgaacatggatggtgtgcctattggtagaaaagtcgatctgaatgctcatgacagttatgaaactcttgctctggccttggaagatatgtttcaacggcccaacaatggcaacggccaaagtggatctcacataccgatggaaagagggcatgttggtgccaatgatcccaagcatccaaggcttttggacagctcttcggactttgtattgacctacgaggacaaggagcgagattggatgcttgttggtgatgtcccatggaggatgtttgtcaatactgtcaaaaggctaaggattatgaaaacctcagatgccaatggtctagctccaagttgtccagagaagatagacgggcagaagagtaaagctgtttgacagaacgcactataagatctgaactagattttgtatctagcttacaatatactgcattggagtgggatggattcgagctttctatctttatcctctcgcacagagtgattttttttggcacatccagatttctgacctagaggctagccatattctatgtttttgtccatgcaatgtgatataataccaactgatatatctgtatcaaccttcatatgtttatgcggataaagtatactatgtattcagttttgtcttttcactagattagagatccaggccatggggagataccatttatgcccagtttttgggtctggatatgggggatcagtccagatttatggtgggactaagttgttgttagcggctttcatgccgactttttcctcatctacttttgtacagtcaaattttccaacatgcaagtgttctgacttgttatattatgtttattttggaaactgccaatcaaattgtacattcaaggatgcagaggaacaatttgattatcttaattttttggttgtaaaaaaaaaa

SEQ ID NO: 506 - DNA, 2232 bp, Pinus radiata
ttaaattgggaaagtccaagtcagtctgtgtcgagcgatcgtgtgtgtatttgtgtgtacagaaagtggtggctaccgctgctctttactttgttttcatggaggggccttgattgtctcattgtctttctgtctcttactggtggcgctccggtggtttgtcgttggtgataagcctcaagtctcccataggttctgatttcttttaaagagaagcttcttggcttctgttattctatgtcttctagtgctggtgtcggatcatctttgaaagttgttgattcttcatcttcttcgtcaacagaacggaaataccagagcaaatttgggtctgagggaacagggatttacaaagaagtttctcattctgtttcttgtagcactgagtcgcaggttcgaatggagatcgagcagaatctgaaagaaacagagcttcgcctgggtctcccaggggtgctttcccccgttcgtgaacataccaaatgcccggcaagtaacgaagaaagctccagctccagcgagctcggagctctgcctgctgagtcctcggcgcccggcgacggaaaagaagctgtttccagaggaaaagtcggagagcatggcagcggagaaatacccttattggcactcgccgcccctgctgcagagtggatatcagttcggcgtgatgtgaagagcagcggcggggccaagagggggttcgccgaggccatggaaggcaggaaggtattttccggcgggaaatgggtgtttcctgtggtgacccctggatcctccgaggtggaggccagtaaggccaagtttttgcagcagcagggacagctggcgtcccccaaggccagtgttgtgcagggggcgggttctatgtggcagcagcagcagggggatcagtacctcactaattctactggtgtgagtaatctgaatggaaattgcaagtctattgttatgaatgatgggggttgttcctcatcaattgggaaagaagcagcggggcagtccaaggtagcagtgcaggagagatcctcccagcatggatccagcaagaatcagggttcggcagcagctgaggtgcctcctgcatccaaagctcaggtggtaggatggccaccaatccgatctttcaggaagaatactttagctgcaaattcaaaatcttcagatgagagtgagggaaagcctggctcaaatgccttgtacgttaaagtcagcatggatggagctccatatttgagaaaggttgacttaaaactgtacaataggtaccaggagctttcctctgcattagaaaaaatgtttagcggttttactattggtcaatatggctctcatggcctacctggaagggatggtttgagtgagagcaagctgatggacctgctgcatgggtcagaatatgtgcttacttatgaggacaaggatggtgattggatgcttgttggagatgttccctgggagatgtttgttgattcatgtaagagacttcgaataatgaaggggtcagatgcaattggccttgctcccagggccatggaaaaatgtaaaagtaggagctaaagctcaagacatgacctgttctctggactctgtgggcatatggattgggtacgagttggtggatgtggagttagatgaagtcgagtatgtttctcattcaattgcagcagaaacagggccaacagaaaggctaattaatttcttatcagcattcagacttgctcacttcatggttataattaccatattcacttcagctggattatagtcactggtcctttgttattagaatcgatttttattttctggaaatgattggaagatggcacatgtaatgagacgatatgcacaggtcagaagcaggtctcgtgtacttgggaaggcagtattatgggagaggataccatccggaacagtgagagtccttctatgatgctttcttttaagttttaattaaactttgtgaaaactgaattccgtcagtctaaaaaagtgacttggaagcacagacctgttctctataataactacattgtgttggatctgagcattcttacagcttaggagccatgtcttcatcaacagtgaggaaggtggtaattgtaaattttattttgaatcttttacaaggggcaaatgtctctcaagactttgaaagtaggtttgtggacttcagttaactgctaaaaggaacgagtcacattttgtgaaacttctcgcagcaaaaaaaaaaaa

SEQ ID NO: 507 - DNA, 2355 bp, Pinus radiata
gggagattctcattctgatgcatgtagcgaaccagccagtgaagtttacagcgcgcagtatcctgatttcgtgaagtaagaggggtgtaatgtcgtctaatattaatgtttatatcgaggagggcttgagcaaagcccccactccagcttcttcaactatagcagatggcagcagtcagaataacccagggggactgaaggagcacgattacatcggtctgtcggaagtttcctcgtcgatagagagctctgtggtctcttgtgatggtgaagagaacaatatgaacctcaaggaaactgagttgagattgggccttcctggttcactttctcctgcaagggactcatctgagctgaatttgttaagccctctgaacattaggacagaagtggaagagaagaatctgttccctgttgagaaacaacaacattcaacgaaggatggggtggcagaagagaagaatggacaagacaagtatattattcagccatctggaatgggaaggaacatgatgactgtatcacccaagaatattgtaactggttcaaagagaggcttttctgaagcgatggagtcgaggaactgtttcccggattctcgaaataatggattttcagcagagggtaagtgggtgtttcctgcacaggttggaggagttattgtggctggatccgaggttgaattgcccaagacaaccacacaaggaaagtttttgccgcaaggactagcatctgctccaggagcttctaccatgatgcaagggcctacatcctggcatacagggggcctggatcactcagggagctctttcatgtgttctaggagttccaatggaacaaacctcaatggaaaatccattaaggatggagttgcttcaactggtgtcaaagatattgcacagtctaagatgccgcaggagaggtctcgtactgaatcacagcatgggactaatcaaaaacaggtgccttctgcaaataaccctggaatggctcctgctgccaaggctcaggtggtaggttggccaccaattcgttctttcaggaagaacagtttggccgctccaaaatcaaatgatgaggatgatgtaaagtctggatcaagtgctttgtacgttaaagtcagcatggatggggctccttatctgcggaagatagacttgaaattatacaactgttaccttgaattatcgtctgcattagagaagatgttcagctgctttactatcggtcagtgtggatctcatggagtaccaggcagggacggtttgagtgagagcaaattgatggatctcctgcatggctcagaatatgtgcttacatatgaggacagggatggagattggatgcttgttggagacgttccatgggagatgttcaccgactcttgcaagaggttacgtatcatgaagggttctgaagcaattggcctagctcccagggccatggagaaatgtaaaaacaggaactagatgtgtagcatgacctgctcccaagtcactgtgggggttgacataggtccagatatggagggacgtggagtagccagcgaatgaagtagattatgtttcttgtttcgttcttagacttccttatttgtcttgggcatcaaggttttcccagccagtcagcaacaatgttgctgagcttatcatacatcttcttaagtgggcttggaaattcattgttggtactaagtctttggtggactgaagtgagagggacttggattttgtgacattggtatgcacaggtcaagaagcaggtcatgtatatctggaaggaaattaacagggagataattaaaattagaacagtgtctgttgtgttgttttattaggagttgaaatgcttgggaccaaaaataggcttatggtttggtgagacattatgtagactgaaatctatcactgaaaatctctggagcatatagatctagctctttcagcaagggaaatggacttattgaaggtcagaatcatcaaaattccagttgagcaattcaggagctatttacttttgaaatctggagggatgaagtgtaaaatcctttttaagattacgagagagacatttgctctcgatgtctttgcaatgcttatattggctactttattatggtttgggatgaatctattttcatccaccaaacggcatctgtcctgttttgtggaacttgttgctgcattgccgtttaggctgggtgaactctaaagactttggtatttttatttgactgaactatgagtttgataaaactcaatatgtcaatatgcagcttgaagtgtgacttaatatattattgtatagctttcaatgtttctatataaccaatgctggtttttctgaaaaaaaaaa

SEQ ID NO: 508 - DNA, 1053 bp, Pinus radiata
tgtcagtctgtgaatcccggagattgctggttgtgggttcgattccgaacgtgtgcataaggaattacagactgctttcaattggctgttacaattgggtatgatgggatcgcttcagtgcaataagtggatgtcctttttggaggataatttgctggaggacgtgggccaaccggcaaattcgttcgtctggcctggtcaggccatcaatgttcatccagattgcaggccacgagaagagtcgtgtgataaacatggcctaaaagcttgccgagaaaagatgcgaagggacagactaaatgacaggttcatggagctaagtatcttgttggaacctgggcggcctccaaaaatggataaatctgcaatattaagtgatgctctttctcttgtgaatcaactacgagaaaaggcaggcgagctgaaagactccaatgaacgacttcggcaatccaataaagaattgaagacagagaaaaatgagcttcgtgatgaaaagacaaggttgaaagcagagaaggaaagattggatcaacaaatgaaggttatgatgacttcatctccagggttcatgccgcatctggctgtagcgcatgcattctcagctcaaagtcaagcagcaaataacaagacactacctattccaggttttcctggcatggcaatgtggcaatggatgccaccagctgcagttgatacatctcaggatcatgcgctacggcctcctgttgcctaagcacattcttaccatatctattgacttgttgtcagtgtcgattatgaccagaaagactaggacattttttcaggtgttatgtttttgttggtgttattgcttgcatcatcttggtagtctctcatttctacagttatgtcttctttctgttgtggggtcaaactcattgctgcagtactgaaacatgagtaattgaattgaatcttaaaagaatgattcgtgagctttgggtggccactgggtacttatcccaacaggcatataaacaagaatacggctgagaataatctagtcttcttgtggtttcaaaaaaaaaa

SEQ ID NO: 509 - DNA, 1363 bp, Pinus radiata
gttgcgatataaatggcaaaattgcatatcatggtgccgtgaatcaaagaacagtcgttgcagcagcaagttcaatgtcaacttgtggggctctcagcatacacggaacggacaaaacatttgtattgtcactatgcacgagctcgggtttttagttccagtatttgattgatgcattcagatcgatgaattgtcagtctgtgaatcccggagattgctggttgtgggttcgattccgaacgtgtgcataaggaattacagactgctttcaattggctgttacaattgggtatgatgggatcgcttcagtgcaataagtggatgtcctttttggaggataatttgctggaggacgtgggccaaccggcaaattcgttcgtctggcctggtcaggccatcaatgttcatccagattgcagtgattctaaaaatgataaggaggatcgagaaaaaatgtgccctagaaagaggccacgagaagagtcgtgtgataaacatggcctaaaagcttgccgagaaaagatgcgaagggacagactaaatgacaggttcatggagctaagtatcttgttggaacctgggcggcctccaaaaatggataaatctgcaatattaagtgatgctctttctcttgtgaatcaactacgagaaaaggcaggcgagctgaaagactccaatgaacgacttcggcaatccaataaagaattgaagacagagaaaaatgagcttcgtgatgaaaagacaaggttgaaagcagagaaggaaagattggatcaacaaatgaaggttatgatgacttcatctccagggttcatgccgcatctggctgtagcgcatgcattctcagctcaaagtcaagcagcaaataacaagacactacctattccaggttttcctggcatggcaatgtggcaatggatgccaccagctgcagttgatacatctcaggatcatgcgctacggcctcctgttgcctaagcacattcttaccatatctattgacttgttgtcagtgtcgattatgaccagaaagactaggacattttttcaggtgttatgtttttgttggtgttattgcttgcatcatcttggtagtctctcatttctacagttatgtcttctttctgttgtggggtcgaactcattgctgcagtactgaaacatgagtaattgaattgaatcttaaaagaatgattcgtgagctttgggtggccactgggtacttatcccaacaggcatataaacaagaatacggctgagaataatctagtcttcttgtggtttcaatttctgttccgggaagatgtcaaattcattgcatatttggataagtgttcctttccctaagttggagttaataaga

SEQ ID NO: 510 - DNA, 1375 bp, Pinus radiata
gtgaaaacagccggggagatctgaaattttccactaaagtttgtttttttgctggttctcgcttgggcctccataggacctagctggacacctcgaatctcctccggtcattttttgttttgacagggccggtttggtgattagggtttcggataacaggaggacaagtgttcgaattcgagagaagccagaatgagctctccgcaaagcaataagtggctgtcatatttcgacgagccattgttggatgatgtaggcgtggggcagccggccaatccattcttctggtgcggtcagggcataaatgatcagcccgacgtaagtgtagaaattgatggccccaataaggacatggacgagcaagataaattatgtcctagaaagaggtcacgggaagaatctagtggtggacctgggtcaaaagcttgccgtgagaagatgcggagggacagacttaatgatagattcatggagctaagctctgtgttagaaccgggtaggcctcccaagacggcagacaaagccacaattttgtctgatgctgcacgtgttatgacccagctacgaactgaggcgcagaacctgaaagctgagaatgaacgactgcaggaagccattaaagatctgaaggcagagaaaaatgaacttcgtgatgaaaagctgagaatgaaagcagaaaaggaaaaattggagcaacaagtaaaagcaatggctttgcctacaggctttgtgccgcatcctgcagcatttcatgcggctgctgcttttgcagcccaaagtcaagcagcagcaaacaaaactatgcctgttccaggatatcctggaatggcaatgtggcaatggatgcctccagctgtggttgatacttcccaggatcacgtgctaaggcctcctgttgcttgaagcaggctcttattttatattccaaactggtgctactatttctttggccctcgaaacgaccttagtttctttggtatccaagttttagatgctaggtgccattgcatcagttcaatattctaattttttttatattgtgccatagagataattgaggataattacaattcatcctgatgatgaaatggattaactgctgtattatgaaaaattacactggagctttgcagaacaattattaatcctttgttcatggtcatgacatgtcttgaactggagatcgctcgaacacttacagttggtataaacatcttgacatttcgttcaaaaaatcaattgtaaattgtgataagtaacttttgttatccaagattggtttcagtgccttggggcctttggaatgtttgggcacttccctggtgataaatcctaaatctatctagaaggaatcttgatttctttaaaaaaaaaa

SEQ ID NO: 511 - DNA, 1769 bp, Pinus radiata
gtgattctgcctttatgatacccccacgtttcccgatcagcatgcaactcagtatgtgtcaaaaaaaggcacaggcagtgtcgagaataacagctcccatgactttcagcaggcacgaatctgccatcaccagcagctttttgaaccagaaagctgcattacacatgtttctgaatcgtgttctccaattaagactgaagcctgcaaggaccattccagctccgagatattagaagagggtgttagctctgcggccctggaccccaattcctgcataactacaaattcctcgtcagaaaatggcacaggtgggggatttgtaacctcgtccatgatgccgagcagtactgctccttcttctcaattgagtaccaggatggaagttcgcgacagaaggaagaggaagcgctccaaggcctgcaagaacagtgaagaagtcgaaagccaacgcatgactcatattgcagtggaacgcaatcgccgaaagcaaatgaatgagcacctctctgttcttcgttctctcatgccaggatcctatattcaaagaggagatcaagcttctatcattggaggggccatcgatttcgttaaggagctagaacagctcttgcagtcgcttcaagcacagaaacgcaaacgagaatgcgaagaatttgggtgtagtcccaattctcctactcctttcaatggcttcttcctctctccacagtatacatcatactccgcacagtggaacgcgagatatggtatggaaaatacttcatttaacgatacgggcaacgaattgattgcagagaacaagtctgcagtggcagacatagaagtgactatgattgaaacacatgctagcattaaaatcctatcacaaaagaggacaggacagctaatgaaaaccattgaggcgcttcaaagtcttcacatgacgattctacacctaaatatcaccactatcgatcagactgttctctactctttcaatgtcaagattgaagatgagtgccagttaacgtctgctgatgaaattgcaacagcagtacacgatatcttcaatatcatccattccaacgccatcaactaaacgtgcccacttagtcaacattgtctccatatgcttgctcttcatactcagtttaggtctccagtacagattttctctgtcatatttatttcagttgcagaatgaggcagtgcgacgggttagtacagtgtgatcattctcttcttcttcaaagtaatgaacgccactgcaagcacaattaaaggccgatcaagctccgaattgtactatctccatactcctggttaattcaatgcatcatcctgaatcactgtgcatgattggcttctagctgtgtacatgacagtcatggccactctgagaaagagtaaacgtagaatatctgtttgtacgtgccctaccctattctttgactgtaaaactcgcaactcaatggcgtactgtatctactgcaaaacctattggttttatacaatacatagctatgagattctccacatttacctgctatgacagttaaatcagactcatccaacacttttgagctttggtctgtggagacacctatttacatttggttacttcgttctcttcttcttacgtgcatatatggatgtccctctcggactgggttggattgaatagaatagaatgctaggggtttcctttttcttcacatggaaatgttagtgcgttcatgctctctgaagaaatagaaatggaccatcgttggcaatgggcaaaaaaaaaa

SEQ ID NO: 512 - DNA, 1059 bp, Pinus radiata
gctccaaggtatgagcactggatctgtggggcttgataataactaagcagttattctgagacgaaaacagcagagggccgaagagatcaatttgcccccgatctgttggaatggatacgcgattgcaatatgctggtgaaattttcaagtctgattattatgaggatcaaaataataagcagtggctggacaatatagatgaaattgcagggcagttggattgggacgacagcgacccagagatgatgggtgggtcgaagccggcaggcaaaattaattatcttcaggctgcatccaagaatttgtatactgaaagaaagcgaaggaagaaattgaacgacactctttatacactgcgttctgtggttcctaagatcagcaagatggacaaacagtctataataggggacgctatcagttacgtgttagatctgcaaaagacgatccgagagattgagagtgaaatcgaaggtctgcgcagctcaagcaagggtgaccatactcaaacgattccacagactgtcaaccatctagcaaatgctgagttggtaaaacggtcggtcgaatccagtgataccaagaaatcgatggataaattgaaacatgcaaaagtactgcaagttgaaatttgcaacggaggggaaggtggaatatatcatgtgcgaatagagggcaaaaaagagactggtggtttggtgaagctcacgcgcgccctagaatctctacctctgcagatcatgaattcaaacatctgctgcttcgatgaagccattcactactccctcactgtcaacgtgaagtcattgggaaatgtaaacacggccaaattggaggacatgattcgaaaaacgacaaccagtgattgcttcgaataaatcaagtcaaattcgtgttgtatgggaggatcgggagattagggtttatgataatttttagtatagagtcctgtgtttccagatgtgccgacccgtatcgcaatatagctttttgacatgaaaatactttttgtaaagttcccacgagtttctcgctgtgcagagtttttttccaaaaaaaaaa

SEQ ID NO: 513 - DNA, 2855 bp, Pinus radiata
gcaaggcaaggtagaaggatttaccttgaaagaagaaattgttcaaggtgacgggcacattttgggcaaaaggtctcactctgaagacaaaatgctagccagagaaaatagatctggagatactgagcatgatgatcttcaagggacccttttgacatcttatacaggaccacaaggaggtcagacagtgctacctagaactccaggggcacaatcccatcaacagaatcttagcacacaaactatacaatcaggtgaaggaacttctctacagcagtatggaaaccattcagctgtttctcagctgcagtctggggctggtggtggcaatgctgcaaatggagctgcaaggccacgtgtcagggcacgtcgaggtcaagctaccgatccacacagtattgctgagcggcttcgcagggagaggattgcagaaaggatgaaatctttacaagaacttgttccaaactctaacaagacagacaaagcatccatgcttgatgagatcatagagtatgtcaagtttttgcagctgcaagtgaaggttttgagcatgagtaggcttgggggtgctggtgcagttgcacctctgattgctgatgttccatctcagggatcaggtggcgtcatgtcaacagctttgggccaagcaagtgggcccttgactctgtcacaggatggtcttgcttttgaacaggaagttgcaagactcatggaatcgaacatgacctcagctatgcaatatttacaaaataaaggactttgtttgatgcccattgcacttgcaacagctatatcaagttcaagtggaaagcctgtactggctactgtgccaggaacaggcgttgatagtagtgagaagcaaaattctgacatgcaatccattgtcttaccttttagtagcagttcaacaaccatgggactcagagctactgcatctggcagtgacgcccctataaatgagaattcaatgaataaagctagcatagaaaaagttgtggcagaaaaatcaaatggcatttcacctgggctatcatctgatgtgcccaaggttggatcacagagcagggaagaactcttgaagcgagcacaatgatttctatctgcaagtgtgtctgatttcggtattcaggagtgagcctcaatgctaaggcggttggtgagattttctagtacgcaattttttaagagataggttatggctgatgatatataccactgattatggttcacacatctgggatcgtgtgagatttcaataggagcaaaatgtgtaatgtataagtgaacccctgttttaatgagaaatattggtggaactctgttggtgcaaggttgccaacctttttatttccactttccttttaggcaaatttaaggttaccaagtatttattctaacttgaacatgactggtgctgaccatactagggtcctgctactgagataccaagatggctcaggcatccattttcctgtttcccttagttttgatttgtggataagtggatatttatccaaactttaaacaattggatgatcttatttcaatttgcttcaacaaatgttaaatgcaatgttctcaataaaaaaaaaagttgcctagtcctatctgatgatccgcatgtcctcaaagagggatgtggaaaatcttttgctccttttccccgaggttgttttttctctacatcaggtggcttgcagagttttgaacatcctctgaataagctgatgccaatgcctcgtgttgatagtaaggggcagatgtgtggggcgaacttcaaagtagatgtgtttgcgaagaggcagactagcatgcctagagtgggtagtgaggccaattgggccaaggaattttgatatgaaccaggccaattgggctaatgaatcctgataagaacaattggatatttagaaatatcattttgttttttatttgatatatattattttcataatcaaaagcaggttccagcttcgaggttcgatctctttggaggctctgaaactctgaaaaaccttcgaagttctagggagaatctcgtcccagatctcagttaaaatggtggacgtattcagcggcgatgagactgctccattcttcggcttccttggggccgccgcagcgctcgtgttctcctgcatgggagctgcatatggaactgcgaagagtggcgtgggcgtggcctccatgggtgtgatgaggccggagcttgtgatgaaatcgattgttccagtcgtcatggctggagtgttgggtatttatggtttgattattgctgtgattatcagcacaggaattaaccccaaggcaaagtcctattatctatttgatggttacgcgcatctgtcatcgggactggcttgcgggctctcgggtcttgctgcgggaatggctattggtattgttggtgatgcaggtgtcagagcaaatgcacagcagccaaagctatttgttggtatgatcctcatattgatctttgcagaagcacttgcactctatggccttatagttggtattatactttcttctcgagctggccagtcacgagcagattaaagaagttgcagttggtcttctgtttacttggttcatttgtaagctttttagcaaagactgctgtcttctgcagtggaaatgtgattgttgtttccagtaggagataatattttgctcaagattcattattattctcttggtttggaattttagacttaagaatttagtgatcaatttgaaagctcattacaatgtggaaattgaaccagttaacaagtgcacgttactgctggtgtcatttggcacgttatgaatttgaaatcaatcgtatgattctacttttttagctaaaaaaaaaa

SEQ ID NO: 514 - DNA, 1933 bp, Pinus radiata
gccaatatgtttttggaaatttctacttttcagttttctgcatcggaataggtcagtcttctcacagtcaaataaataaagaaaacgctgagaatttcgattatggcgtggcttgcttcctttcaattttatatttttttggggttcccaggtttgaaatcggggaagaatgagtggagaaccgaattcgataaatttctttctcgactgtctcgcaacagtttgactgctctgtgaaagaaaaacccatatcataatatagaatacaattgttctgccgagtcctttttgagttgggtagtttccaggctcgtggctatagagagcttcagcagcagagagaagaaaaattgaagcgaaagtcccggctaactcgaatcagattatgagctgccctgatcgccccaacaaagcgtttgagctttaggaagccatggaaataatggaagaaatgatagaaattccccgcttgaatgacaacatcggcctgaacattccgtggcttcatggaggcctttttcgaaagcgcttgacatcttctcccctccacaatgagccggccggcaagcaagcaaatatgatgcctaatatggaaaactacttcacgcgactagtccagggattcgaacccggggagagctgtgtaacagctctttctgacctgaaacccggtggcaacaatattgatactttcaatgctgttcagtcgcactcggagacggctgaagatggtataagcgacaccacacaggaggatcaacaaaatgcaatttccatggccgtccctgctgccgacgccgggaaggggagaaagaggaaacgccagaaggtttccaagaacagtgaagaagtactgagccaaaggattactcatattgaagtggagcgcaaccgcaggaagcagatgaatgctcatttggacgtcttgcgttccctcattcctcaatcctatattcaaagaggagatcaagcatctattataggaggggctattgatttagtgaaagaattggagcaggtcttgcagtcgcttcaatttcagaagattaaaagggaaaacgtagacagaactgatccaacaaactgtctatcaatcctcccgcctcaccagtcctctgcgcggtgcaattcaaaatgcgttgtagacaccagcagcagccaggtcagagcattggaagacaaatcctcgatagcagacatagaggtgacattgatcgaaacacatggcagcctcaaaattctctctaagaagaagcacgggcagctcttgaagatcatcactgctctcgaaagctttcatatgacaatcctgcatctcaatatcacctcaatggacgagactgtggtcttctctttcaacgtcaaggtagaagatgaatgccaacttacatcagcggatgagatagcaagctcccttcaccgaattctgagaatagtgcatgcgtgctaatgatccatggctctcatcgaaaatgcccatcttcttgctcgcaggtgtacatacatccattctctgcttttgtatcaaccatatacagtgaagaagtttgtgtgttctccgtaatatggttagttcttttgttttaatactggttctggctttcaatagatatctgtatcagtctatcgaacttgctgcctcctctcgttttatagcactcaactacaaactacaaaatatcgatagaaaggaaattgatcaaagtatcgatagagcggaaattgatcgactgctcaaatagcataccaattcaaagttaagattggataaaggcaatgctaatgggcttaaatactcccataatgttgtttaaaaaatattgccctaacgactgaaatcaaccatggtatatggtagatcttccctcatagagatgtatctttccatgatcgatatatataaaatattggaaagtaaactgcaaaaaaaaaa

SEQ ID NO: 515 - DNA, 1696 bp, Pinus radiata
gtaaggaccatgcaaacgcacagtcattcatcccatcggcattgccagcaactggccgcagacttggaattctaaggataaaatctgatcttcttgacaatgccggccaattcaaacgaaacccatctgtcattttgccaacctctcagtgaaaattttctcgccgatttcaatgggattcctgagttttgcccctgtgaaagcactgaccaaattctggactttgatgccgagttctgcaatgccaatggtgctaacagagtattttcaagaaaatcacacaaggcagacagggagaaactgagaagagagaaaataaacgagcaatttgctgagctggcttctgcgttggatcctgatcggccaaaaaatgacaaggcatcgatattgatagagagtgtgcaagtcgtcaaagagcttagagttgagttaaagcagctacaagatgagcatgctttgcttatggatgaatctcgggaattgactgaagaaaaaaacgagcttaaagaggagaaagcagctttaaagagtgaggtggatcagctacaagatcagttccagcaacacttgcgaattatttcaccatggatgatgatggaccctactgtcataatgagcactgcatcttttccttattctatggctgttcctcaagcagcacctttgccttcatcaaactttcagcaatcattcgcatcaaaccaggctcaaaggccaattgttgcaccttctccatatattcctcttgcaaccataggtgcttttccacttcatcctggactgcatacatatgctacctttggaaacagccatgcagatgggagtggcccctatctacagtttccaaattatggtccacccttgaatggccattgccatgttgaaaggccatatatccaacactcttcacaattgcatccaatgcctccatatcttgcccagatgcaactccaccaaggctgtcaagctccagtttcttcatctggtccaggtgtagaaatatgtaaaccctgtgcatctgttgcatcttgtgctgcagtcaaagctcaagataagtccagtcctgcaagctcccaaaatctggatgatgaacgtggtgggaagtatgcaatctcaccatctccagtagataatgcttttgtggagcatatagaatcttgcagaagtgcagttgcctgtggttctgatactttgccaaatgatatgaacaaggaactttaatcattctcttcttccacttcagaagccccttatggatccaatgtacaggctgctgatgtgaaactagaagataaaacaactgttgagcaaggaactattggacgtgtacatgaaataacatctgaacagggaatattattagctagagtggataaaccaaaagcagatagtaggaatgatattcaatcagggaatatggaatagaaaatatgggacgagttagcatatcccatcatttttgccaaatcaagtctcagaataaaagaactctctgcaagttcgagaacagttctatttgcagattatgatatttgatcaagttgggtttttagcctcattgtacttacgtttatggtaaaagccaattcatctctagattcaaaagggttggaaacattttatttatttataaatacttttaagaactaaatttcaaagtgaagaaatcagttaaaaacaatttttaaaaaaaaaa

SEQ ID NO: 516 - DNA, 1853 bp, Pinus radiata
gttgcaaagcaatacccagaaattattcacaatgtcattgctgcctcccgggataggaggccagggcttgaactctcaggagaacgacccgtatccgtacgacgattcccagttcctagctaacaggctaaggcagcatcaactgagcggtaattcttcgatgaatcagacgccaaaccaggcctcgcaagggattaatgaaaccaatacgtctccgggccgatccatggttttgcagctaagcacaggaagtgcaagcgcttcacagctgctggcctccatgggaaattcgcctcgcggcaccgcggtaatgacgcagtcgcccagtacaggaggcagctgtaatggcagcgacggaggaatgcttcctcttcctctcagtctcggccaggcgggtaaatcaggcgacatcaacgagtcccgctcgcgggatgaaattgaagcttccttcaagtcggcaaatcatgcccgagattcgaacctcggagggctatttccgccgttcgccgcatcaccacggggcgttcgaccgacaggccaaaacttccatacgcagtccggacaagtgccaatgcaagtgtatggtggaatgccccaacctcagcatcagaatccatctccgaccggagttggtgctgcaccacctgttcgacctcgagtaagggcacgccgtggacaggctacagatccccacagtattgcagaaagattgcgtcgggagaggattgcagagagaatgaaggctctgcaagaactggttcctaattccaataagacggataaggcttcgatgctggatgagataattgattacgtcaagtttcttcagctgcaagttaaggttctaagcatgagtcgactgggaggtgcaggagcagttgctccccttgtggctgatatacctgctgagggtgccaacgccccacaaggtacaagaaccaacagtagccagaactcttctccagacggtctagcattaacagaacgccaagtagcaaagctaatggaggaagacatgggatcagccatgcagtatcttcaaggcaaaggtctctgtctgatgcccatatctctggcctcagccattaataactccggtgcgagaccccaggcaccatccaccccttctcttcaagggctattgccacctaatgccaacgacaggcagatactggaaccctcgaactcggcactctctgccctcacgtccacctccatgaccatacagtcttccatcagctcgcctgggagcggaataacggagcaaggtgataatgcacacaaggcagtgaacggaacaaggaatccaaaggattccagagaagccaattccgttacgaagtccaacgggataggaggcccagctctttccaagaacgccgttaaaggagaggacgaacctcaaaggaggacgggccagtaaacagcaccaccttgctaacggaaactgtaccatacttctattaacgccagattgcatgaaattgttcaagcatacgaaatttacttttcacatgcttcaacaatttctaaatagtcgtagtcgcagtcgcagtcgctctatgggagagcattcattcaaaaatcccaaaaacacacttcaaattttcctttctcctgaagtttggtgtttatttttattgaatgggtaaaagaatcgagcaagtctatcaaaataaggcacgcgccccactttgatgatgccttatttaaatagacttgcataaatatgacattatgtatggttgacccaagcgctttgttaatcactacgtaagttatatcttaagttggataataattattgctcatgtcagctacactacgaaattcttgtttatttaaaaaaaaaa

SEQ ID NO: 517 - DNA, 2373 bp, Pinus radiata
gcaattgcttgcttggtgtgctgagaggggaggaggacgaggaggaggaaacagagcaacaagcagcccgacagacacacatctcaacaggtggatctttctcgcccgccattctatcaggtgtattattgtgcaacatatagctgaaatatggtttgggggatcttgtagtaggagcatacgatcaattttaggaaccaaggctcattttaactatgggtacaggagagatggggacaccagcgaaaacaactaaggcatccacaccacaggaacagcctccaacaagcactgccatgctttatcctgactgggctgcagcattccaggcttattataactctggaaccacaccaccacctcctcctgcgtactttcattcaagcgttgcatctagtccacagcctcatccatatatgtggggggggcagcctctaatgcctccatatggaactcttcctcccccatatgcggcaatgtatcatcatggcagcatgtatgctcatccatccatgcctccgggtgcacatccatttgctccttatgtgatgacatcatcgttaagtacaactgaaggtgcacctgtaggcacaacttctggtgcagatgcagaaggaaagccatctgaaccaaaggaccaaactctattgaagaggtccaaaggaagcttaggcagtcttaatatgcttactggcaagattaatgaggctgacaaaggaacaggaggtggtgggaatggtgctttatctataagtggtgagagtgggagtgaaggttcaagtgaaaggagcgatgagacttctcaaaatggatcagaagccacacaaaagaagggatttgagctgaattctacaaaagctgctgaggcacaaaatacaactacaacttcatacaatgcccatggtgggagtgcatttggtgcatctggagtgcaaacagtaaatgcgactgtaaatttagccatagcagctgtcccaatctctgtagcaggcaaatctgccacagttgcagggtcaaagaccaacttaaatatgggcatggattactggagtggatcaaccactgcgacttcgaccatgcgtggaaagcgtcctgcagtgcccagaaccacagcaatggttcctgctcctcagagcatctctcttatggttccttgtgatggtgttcctacagaactttgggatgagagagaacttaaaagacaaagacgaaaacagtcaaacagggaatctgcaagacggtcaaggttgcgtaaacaggctgagtgtgaggacctagctaagcgagtcgacattctcaaagcagagaatgcttccttgaggaaagagctgaaccgattgggagaggaatgcaaaaagctctctactgagaatgcttttctccataaaaaactgtgcaaggctccagaggaagaaactagggacactagatcagaaaaggatggggaggctggaactggcgagcagcatgagcagcagaatgaggacacagacagcggagcagtggaatctatgcaaagggatggtagaagagaagaaacatcctttaatttagacggaaaaaaccaacctcttgataacaggaaccaagcagtgtctgtttctgctggttagcttgacgtaatctatccttctcatttctacggatgcctgatgccgctagtcattttctgttagacacggcttcaaatgccttggactggttgtcagtacagactaatcatgtatatgtatgtaagtgtggagacttttacccaattaatttaacattcgcagattgattgtataggaaaatatttacaggaagggaggacagcgaattacatggttcccttagtttcaatcaatatgatcaaagaggctaacaggagatagatttgaagtatataatccacaagcaagggattttaatttagattttcgtttggttgatgaacgtaatttgggtcagcggtcaactttgagctgttgttgctttgctgaattacctatactgcctgtatgaatattggcatgtgcttcaatcgcaaactttttgatgagtaagccagagaaattcacatggccactcactacacttactgacaacgaacaaactgtcaatagttattgacttagtttatagtcaagtggtggaaactgctttttaacttgaggtgattggagtcatgaaattgtgaatgtaattgtatagactgacaattttcaccattggcagcctcttgtaataagcaaattgatactaaagttgctcttatttacaaacaattgagatcttttgggatgcttccctgaaagctcaagctggacattatacttctttgttgaccatattcaggaaaattatatcttacttttatttgaaaaaaaaaaa

SEQ ID NO: 518 - DNA, 2684 bp, Pinus radiata
gcccgtcccgcggcgattgttttcctgtagcaggatgtgccgtacagggagggaatttctttcgttgtttaaatgcttaaacgatgcacaagcgccctcattcggatccgtccgcggaagcctgacgtgatctgccatttctcggcttctgaacgcgtcaagatctgcgagctaattcgatgtgcattgctgtcaattgctgtcaatcggctctgtttcttttgtccggtatctgaatatccagtgccatcacggatcgaatccggtgcactgtaaagaattgttctctgatttgagcacattcccaaaaatctttattttccgcaagttttttgcaggggacgtagtgaaatattttgagagaaatactgaaattgaacaagcgttgagaaatttagtcgaatgctgagttatggactctgatttcggcgtggaacggcagacttttgaagctgttcctgattctaagtcgttggctagccttcactcttcgttaagttgttcattaaacactatggacaccattttttgtgacgaatctcgctattctcagaaatacgctggagaatttggagaaattgctacccagaatgcctttggaggagctaccgacagtattattagtaatgtggatggagctttttacgccgatccgtcatttgcagctaaatatttacggaagtcaagtttttcacccgtaatggctaaagaaagctccaatgccgatggttccggaggcatcggagtgcacaatgttccgattttggcaaattctgttcaatttcatacggcaggcgttaaaaatggcgtgaatgcaacgggatggagaaatttggacgcttcgcatcttggctccgaggtttccaaatttagcattggaagtgtaccagtaccgagtgccttggtgcaatttccttcggacccaggctttgtggagcaggcgccgaaattttcttctttcaacaacatggatcgcaattcttcggaaaacgtcggttgcggggcttcgaacctgcgaccagttgttggagcagtccaacaaggaggggaaaccatgagcgtgttttctgaaccgaacaaacgcgtagatgatggcatcgggaagaaaagaagagctaaatctttgacttcagtagacaatggcaaggaacaagaggaggctaaagccaaaaggtgcagacttggcgagaatagtgaaattgatgacgatgataacaatgaggagacctctgactccaactcaaagaagggaaaggagaagaatccaaaggttgctcagaaggacgataattatattcatgttagggcaaggagaggccaggctactgacagccatagcttagctgaaagggtgagaagagaaaagatcaatcaaagaatgaaattcttgcaggacctggtacctacgtgtaacaaggtaactggtaaagcagtaatgcttgacgagatcatcaactatgttcaatctcttcaacaccaagtagagttcttgtccatgaaattggctacagtcaatccaaaacttgactttaacatcgacaatttctttgccaaagagatgtctggaagcttctcgagcaagggcatgtctcctacatacttccatttggaccaactgaagcaggcttctctgcaaacggtaccaagtcccggatcggatataccttccactatgagttcagtagattctgcagaaatgtttgacggtgcaaattttcagaggcaggaaggttgggacagcgagctgcaaaatatgtataacatggggttgctgcaaagcagattgcagcagcatcatcagcgaccactctaatacgccaatacactgacactgatatcctcacggcaaaacttatcacactttgactgtgtgacttttagcaatgtttggttgcagttgcaacatacctgctactacttaacctagctaccgggaatgtaaatatatcatgaattcccggttatctgagtccctcaaattctttgcagttttcataccatctacagatagattcccctactagatggaaccgcggtttttctctaatttggaaatggtgctaagtcatcaatacttttgactaaatcttattcgaagtgtcttgcaataatagcgaggccttccatagctactttccatttttctgttaacaagcatgggcatgaatataaactgtgtgcgcagggttgacatttgtcgtgtttctatgcttctgtaacgttataaatgcacatgagttcgctgatcctggggcggctaatactaaacgagtttcagtcaacgaaggatataggattttgggcattctctagaagcattcacatttttaagcagggttggtagctggaattcaaacacagcagacaagcaagttactgtgcccaacgcattccccgcaaacaagcgacacagtgaaaattcaaagtaaaaggcataacctgtcacattcattactatttctgtagtattttaaataatagtgttacctatctttatgctccaataagctaggagctacagggtttaaaaagctttcaactttttcagtttaatagtggctatggaattcttagaacctggacttttatatgatcaaaaagtaatttatatagttgtcctcaactctgtaactaacgacatactcggcctcccaatatatatatttttttcaacaaaaaaaaaa

SEQ ID NO: 519 - DNA, 3149 bp, Pinus radiata
gttgagtacggatgacccgggtcagaagcaggaatttgggaggttgaagcagaggacgcggaatgaaagaccgagcggcgtcgggtgggactggcgtggctgggatatttggatcgggaaaatggcggagcaagtagcaatcgggcaccggatcgaattcttaaagaggccttttctttaaagagagtttttagtgtttgtttcttcttaaagaagcttttcggtgctccaaaccctggcgtgacgatagagtttcggcttccgttgaagcgttcaaagattttgcttttcctccgaattttagcagaagcgtggattcgcggtgagtaaaaagctgttttaagtgtttttgaacggtggacaccatctttttcgccggttaaggcacgatattttgtgaatttattggcgtcgtggtttgaatcggtccgtaaggttgcattgccggtcgcggatggatgattttgtgaaaattgaggaatctttgcggcggtcggaaggttaagattcgtcgccgttggaaggagacctggtttaatgaaatgcggaggaggtcggggcattcttgctgatttccgagggcgtggttttgtgttaggaggtgttgtgatgtgtgcgagctttttgtggtccggcgttaaagattttggtgaagctttgtaaattactgtgttcgttctgttttatttgcttgtttttcaatctgattgctaaggagaaacgaaaatgtgttcgatatgaagaaaagggaagggttccggcggcaaatttcgaggttttgcttaaatctggaggctgaatttgacagagatttttatcagtcatccgcttttgtgcgcggtggtgaatgggcttaaagctggagaagttgttaaattttgataaacattcgtgagaattggtggaatttggtccctgctttggtttctttaattgaggaaaaaaaatggggagcgacgcagtctctgcatcgaggttctggaatgaggaagataaagccacggtgaattcgcttttaggccctaatgctttcgagcacttgatggtgagctatgtctcttccgaggggcttgtttccgggatcaatgattgtgcattacaacagaagttacaaaacctagtggaatcttcatcctttaactggacttatgctatcttttggcaactctccagatccaaaactggagaagtggttctcggatggggtgacggttccttcaaagggcctcgggaaggtcaagaagcagatcaagcacgcggtttcgatcacagattcgctgaaacagaccagcaactgaagaaaaaggtattacaaaaacttcaaagcttctttgggggtgggggtgaagaggaaaataatttcgtgtcgggattagacaatgtttctgatacggagatgttttatttggcatccatgtactactcgttccctcggggcatcggcgttcctggccaagcccttgccagcggaaaatgtatctggctgaatgagccaagcaaattgccaagcaatctttgctctagagcatacctggccaaaacaggtggcattcagacgcttgtttgtttgccaatggaacatggggttgtggaagttgggtcggtcgagatgatcagggaaagtaaacatgccatagataaagttagatctagtttcaatgaaaatgcctgtgatggaaatcgaggccaacaagcagtgaagggttctctagttgtccccttccccccaaatccaatgagggtgaatgctgtgaatgccaaggctgctccacctctaaagccttcccatgattggaaaatatttggccaagaactcagcaaatctaccgaagctgttgtcaccaaagtggaagacagagatcgtcattatcagcccgttttccgtccaccttacgcccatgctgcttcctatgtaacaaacgaacagaggataccttattcaactgtcaatcagaatgggttgcaaccaccgaactggagccatatcagtaatggtgaggctggggagatttataatacgcgtgatctgataaaacctagcacaattttgccgcttggtgttgccggcccttcgcttaatgcagtaactgctcgaccgtccattatggaatctgaggaacactcggatgtggaagcctcggagcgtaggcccgtggtggttgaagagcgtagaccaaggaaaaggggaaggaaaccagccaatggaagagaagagcccctcaatcacgtggaagcagaacgccaaagacgtgagaagcttaaccaacgattttatgcattgcgagcagtggtgccaaacatctcaaagatggacaaagcttcattattaggggacgcaatttcctacattcaagaactccagagtaaagtcaaggatatggaaaccgaaagagagaaacagcagcagccacagccgcagcaggctaagtccaacatacaggatggcagaatcgttgatcctatttctgatattgatgttcaaatgacgactggggaggccactgtcagagtaagctgtgcaaaggaaagccatcccgttggtagagtaatgcttgcattgcaaagactacaattagatgttcatcatgcaaatatatctgctgcaaatgaaaatatcctccatacatttgtgattaagctgggcggaacccagacattaactaaggaccaattacttgaggctatttctggatggagtcccagataaaaacaatgagatatacctaaagttttaatctaataacatgcaccaaccatctgtactttgtcccacccctgaatggcactaaaggcttttcagatgtgaaaagttttctatctttttgttcaaggtcaaattgctgagggtcggttgtaaccggatgtctgaaattttagagtgcagagcaaatgccgacatcagaaattttggagtagggtatgagtcgtttttcccatagttgagaaaaggtatattagtgcactcactgaacctctgttgaatgaccaagcctttcgcttgggcagccaagcaggtttaggttgtaactgtgtacctttaatcagaattgggtgcaacaaaatggggcggcaaaaaaatcaggtaattaggagaaaatgtgtttgtttattttttagagttagactccattaatgttccaaaaaaaaaa

SEQ ID NO: 520 - DNA, 2738 bp, Pinus radiata
gaatttatctcgttgatgatgcaagtatgggttggtttgagttgtaactgatggaaataatgcagctttttgaccgtgtcaatggtgacactcccttatgtcttttaaacaatgagagccagggagccattctcagtgttctgagttgcatataagagttcttctaatgaaaattatattactgagtctcctaagtattgatcgattggtacacctctgctgagagatcagattaattggttatactgacttgggcttttgtgtctagctatcatgggttctgatggtaaagaagaatttgggttctcaatgaactataaaacatctggatctcctccatcttcgaattggcaatcagctgttgcaaatgcagccatgaataatgtacaagagagttcactgagagtgcccacttcctcagaatctctatcaagttcttttttcagtctaaactgggaaccccttatagagcagagcattcccttccagtcgtcattgagtcccatggtgtccccatctccgcctgccactagtttgccctctgatagcattgctatcagagaacttattgggaggcttggtggaaatctctgcggtgtctcagggccattgggatcaacaatggatactgttctcaacatgggtacagcttggaatcctctgaattcttcgccaaatctcaaccttgcggtggatccatcaaaagggggcctctccattcaaggtgcaaaacatacccctccaaacagtttagcacagttctcttctgatcctggctttgcagaaagagctgccagattttcttgtttcgggaaccgaaactatcctgaacttgctactccattcaactttccagaaggcgaaccatcgtacagatctgcagcagctgataatagtaagatcccaagagtgcaaagtaatcagtctctgaaatccgggcttcccatcaatctgcctaacttggcagaaacgaaggaatcaaatgcatctgagactcccaatgaggggtcagaagctgacccaagattcactgacaggaaaattagcaggctatcaagatcttctacgccagtttcaacagatgacatgaaacagagacttgcaacatctggcaacgagtcagatgaggcagaattaagtaccggccgtgaagaatcttcatgttccgaccagattgctggcagggaaccaggttcaaaaacctcgaatgaaatcaatggaagaaaaaggagagtgctttcgaaagccaaagcaaaggatacaccttctgttgttgcttgttctggtgcaagagagacaaagagcctagaggcggatgaatctccaacaaagcgatataaagttgcagaagctggctcaaatgagaaggacgatgcaaaatccaaggccgaacagagtactattgtgagcactggggaaagtagtccaaagcaaaccaaagatatcgtcaaaacgccggaaccaccaaaagattacattcatgtgagagcaaggcgaggccaagctactgacagccacagtcttgcagagagggtgagaagagaaaaaatcagcgaacgcatgaagtttttgcaagatcttgttcctggctgtagtaaggtaacaggcaaagcagtaatgcttgatgagataataaactatgtacagtcattgcaacgacaagtcgagtttctatctatgaagcttgcaactgtcaaccccaggctggatttcaatatggatggaatcattgctaaagatatgctgcaatcacacagttcttcaccaaggatgctgtttgccacagaccctactgcagcatttcctcagcttcttccgccacaacagggtcctgttcaagttggtgtgacctgtggaacagagggacatcgaatggggcaccctgtagaaggagcactcagaaggacaatgaatccccagccaccctgtatcgatgggtatggagattccattcctcaggttgcaaatgtttgggatgaagatctgcagagtgttgttcagatgggatttgggcaaaatcgacaaagtcctttcacatctcaaggatttcatggttctgtaccaacaaaccacatgaaaattgagctctgagtctattgcctcttttacccggtttaatctgagagagatatattcagcgattctaagaatctctggtaacttataatcacaatgggaagaagttatattcctaaaatattcacttggcgctgaagaattaatctgggtgctctgagctttacgtaaatatgggtagagttcactgcttttcccatgcctctgtaattcattggcattagtattctgaaattctattgcaatcaatcggaaggatgattgcactcgtgttgtggcagcaagtttatgatggtatggggccctgagggtatgctccacaatccccatgtgaatagtttagattaattgtgttccagtggtgaaaattaaagtaacaccacatgtaccatggtagaaacctgaggcagtttgttaacttgtgctgaagcgagaaattcatggacattcatgaccatatcgtttgtaatcatcaatttatcgagatctgattgtgccatggattcatatacaaaatgggaactgtttttgtgaagatactgttgaaattgttgtaaaagtggctgatgtgatatatgaatggcagtaatttggagtactaaagatattaacttgcattttacataataaagttatcagagagaagttaatcaaaaaaaaaa

SEQ ID NO: 521 - DNA, 3243 bp, Pinus radiata
ctggaatcttgatgtcggaacccaaatcgccgaatgacgccgaaaatgaaatagaaattcggtgcaaattcaggcgaaatgcaaatgacagtgaagctcgacacattatcagccatggcgaactgaatctgaaagtctctgttttatctggaatctccacacgcgccgcgaagaaatctgaatcgtcgcgttcgtggtcgacaggaagccacagtgggcggcctgagaaactggttgtggtggtcgggagtgtcaagattgtgacggtgggcggaccagcgtctagtttgtgttggtggtcggcattagaaggggcagagggggcttttcagtgcatgggattatgggcaacgaaggcgcggcatcgatgcggctatggggcgacgataataattccatgatcgaggctttcatggggaacctcgattactcttactccaccttctggaatggcatcgatgccaatccctcttcgctaccctcgcccgcccacttcccgtcgtctgccgccagtgttgctatcgccacgcccttcaatcaggacacgctgcagcaacgcttgctggcgtttgtggagggagcggctgagtgctggacttatgccatattctggcagttgtcgagcgatgccagcggcggctcggagctcgtctggggcgacgggtactacaagggtccccgcgaaatgactgaagaggagcgggagacgaagaaggccgccagtgtggccgccacggctgccgaccaggagctcaggaagaaagtgctgcgggatctgcacgctctgattaatcccaacgcgactggagaggcggatccggcggagtttccaggggatgatgctactgtagatggggaagtcacggacgccgagtggttttacttggtgtccatgatgaagtcatttggaaatggcttgggggtgccgggacaggcattttgcggtggcatgcctatttggatcattgggtcagaaaagcttcagagctacaactgtgagcgggctcgtcaggctcagcaattcggcattcagaccatggtatgtattccaacacctaatggagttgttgagttgggttccacggatttaaatccgcagaactgggatttgatacagaaggctagaaattctttcacttttacttttccggacaatttgtgggaagaaaatcatacccaaaatgatcctgatccggcactttggttgactgaaccccctgctgaccctaaaacagagcctgaaaagaaacagcagcagatacccaatgtggaaactgaagctcttcacagctttttccctcatgaattgggattttctgacctggggtttctgaatggcgagggggaaaacacggcacagaaggttggaattgaggagtttgggcagaaagaggataaatcatcatctcagggcttcactggttctcaggttctgtaccaacaggactggcaggctcagacgacctgcaagacagaagttgtggaaattccggcgtttcaacctgggaaaaggggtaatacaaatgggattactctgagctttgaaaacccctatggtactcagggtttagtgtcttggggggatgagaagatgaagaggcctgtgaggaatgggaatgaagatggtagcgcggttttgtgtttttcgtctgaagttgctgctgcttctgcttctgcttctggtactgctgttgctgcgtctttgccagtgaacggtgctgctggggtcagatctagtgttgattcggagcattcggatatagaggcgtcttttaaagaggccgaatgcagtcaggccattgttgaaaggaggcctcggaaacggggcaggaagcctgccaatggtagagaagaacctctgaatcatgtagaagctgaaaggcagaggcgagagaagttgaaccagaggttttacgcactccgcgctgtggttcccaatgtgtccaagatggataaggcctctctgttgggtgatgccatttcttacattaatgagctccgaagcaaggtgcaggattctgaatctcataaaaaggacatgcaggctcaacttgaggccttgaagaaggaattggtagccagagaatcggctgcttctggattttctggcagtaattttggtttactaaaaaacccggctgctgatccttcgaacctagatgtcaaaggctttggttctaaaaatcagtgtcctaatattgagcttgaagttcgaatcctcggtcgagaggccatggtcagagttcagtgtcctaagcagaaccatcctgttgcaagaatgatggttgcatttaaagagcttgaacttgaagttcatcatgccagtgtatccacagtgaaagagttgatgattcaaacggttattctgaatatgacaggtattgtatatgcgcaagaacagctacatgctgcattattaaggaaagtagcagatcctggccttagatagcatgccatgagcaatcttgactggtatttatctagaaagctgaagttcccttagaagctttaggaacttcaagatcagattactttaccagcccagaaggaattgtgcactgtaaaataatccaacttaatttactttgtaaattttttcacaagtaatgaagaactgctatagcagttacttgtaagcatggctgccctgttccataaaaatgaaatctgatggaaccacaaaaaccaattagtgaaaatggttctatctcaaaggactgcaaggaaaaggctaaaaacagcatatagtattgtcaatggagacccgctgccattgtcagtgaaggatggactgtaagtgaagctactcaaatttaggcctgcaaaatagtgttttttaaaactgaaatgggtctccgttcttcactgaaagagctatggctgaaattcattgagaaaaattcaacgaatgtaccaagaggaatgtaaattagcaaattcatcaagctgatctacaaagtaactgtgaattaatatattacagcctgaatgagttattagattgctacaatgtggtccaggcttgaattgtaagcctcagtggggcgagatctagggtgtaagcttgattgaaacccttcttgtaaagttttggggtcgtggtgaatgttggccatgttcccgaaaagggattctgcttaagatgtgctagccaacgaccattgctctagattaaagctttgcaaggccctcaagggatatatactaagataaagaaacccttgttcaaatggaaaaaaaaaa

SEQ ID NO: 522 - DNA, 3434 bp, Pinus radiata
aaataatttagctgttttgggagatatatattggtgcttaaatcctgctgaggatcttgtttttagtgttcacactctgtctctatgatccagcagccatggaaaataacagaaaccatactcagactgggagtggagtgagaaataacataggatcggtaatgggtttgggctggcgagagtttgttttggttttttttaccaggtatggattctagttgaagagcccaggagtttcgatctcggggttgaaaaattgggtacttgctatttttcccatatgtgcctgaaggctatctatggcggtcatggcttctgcaaacaatagtgttattaggaagcagctggaatcagttgtccaaagcatacagtggacttatgccatcttctggcagttatcaaatcagcagggagtgctggaatggagcgaggggtattacaatggcgatatcaagacgaggaagactgtccagcctatggaactgagcaacgaggagctctgcctgcagagaactctgcaattgagagagctctatgagagtttatctgccggggagagcaatcagcccgccagaaggccttgtgctgctttgtcccctgaagatctgacagacaccgagtggtattacttggtctgcatgtcttacacctttgcccctggagttggattgcctggacggacacttgccaatggacgtctcatatggctgtgccaggccaacgaagcggacagcaaagtcttcccacgtgctcttcttgctaagagcgcctctattcagactgttgtatgcatccctctcgcggacggtgtcttggagtttggaactactgaagtggagcgagaagaccctggtctagtccaacgcaccataagcttttttttggagtaccccaaaccgatatgttcagagcaatctacatccagcccacagtgctcagacagagacgaaaaggatcaagtgggcatggtcacaataatgtcctccgacagcattgcatgcctagctcggaatcagattggagcttctactattacagattgtggacagtacctgccaacttctcatgaagacctggacatccccattcaaacttttgagctcaaggataaaatatcagttacagaagacccacaacaacatggattaaatgaatcaatgcaagtggacatctgtgaagattacaaggctagtggatcccctgaggatcagtgttgtaatggtgatcctggctctcatgaatttcctctgttaagcgccgagaatgattgcttgccgaatggccatgtgaacataaattcggccgggtttgagggctggccatacatggaagataacaccagccatggacttcaagcatctggtgagtgtgtaactcagtccattgtagacccttctcctcagctatgcacttattcagagagggatatgaatatgaatatgaatatgaatatgaatatgagcgtgctcttgggcttggaacaaggctccaatgccttagaaaccatcctggaatcagcacctcagacattggacgaggatggtcactattccaggactttgtccaccatattagagcggcaacaggccagcaatttgacagagtccacgggctttatcagtacaaaacttggaaaggattggcgctcacgacattcaaaacaaggtagtggtttcatacattggaagaacaatggtaattgtgttgttggcatcaaagcagtggcatccccgcagaggatattgaagaaggtcttgtttaaccttgctcgcctccacaacaaatacaaagaagacccaggttactcccctaaactgggagaagaagaaattggcagcaagttggtgggtcgcaaaattgggcaggaagatctcagtgttagccatgtactggcagagcgcaagcgaagggaaaaattgaatgagaagtttatcgtgcttcgttctctcgttccttttgttaccaagatggacaaggcatcaatcctgggagacgccatagagtatctcaagcaacttcagaggcgcgtagaggagttagaagcatccagcaaactcatggaggcggaaattaagaagacccagaatcgaaacttaccaaagcgatcaggctctacagaaaacatgagaatgacaagacatggagtaaatcacgtggatagttgcctgcagtcttcttgtcttgatggggaactcggttggacgttgacagacacgaaacagccaccctcgaaaatgcccaggttggaatctaagcgaaagctgaacgacttccataagaaaggatcatgcacactggcagcagcagcggcagatttggatgtttcagtttcagtcatcgaagacgatgctgttttggtagaaatacaatgcccctgcaaacatggcgtgcttctcgatataatgcagagactgagcagcctccatctggacacttattctgttcagtcttccacagcagataaaatctttgctgctgtactcaaagctaaagttcaggaaaagtttcgtggtaaaagacccagcattgctgaagtgaaagaggctgttgagcttgttgcctccaaatgctgaactgatagaataagttgtatgtatgagtaaagttccacagattacatatatgtgcagctggatctagtgggtcatgcaaagattgttggttttgccatatctaatcttgtgatgtattgtcccattgatctaatctgatctgctcatttgtggatattaatataatttttttttcactcaattgattggggcagtggtgtcaaattctaaagcatgttaaagtgaatacttttttttccagagtagcagtgccctcttggacctggaaaacgaggatttgatttagttccatttctgtaacttgtttgttatgcagtgaagttgtcaaattgatgcaacaagagaactaatgggcatggtggacatctttaacgctgtattctgttaagcagagtctatttcaatatgctcagggcttcaatttgggctgcgtggcagaattataggattggtttggcacagagcatctgcacttttgtcttatatcgtggcatgcgcatagaatacagaaaattgttgtgtattgtcattctcgggagtggcgttgtactcagaaaagacaaagtaagtgattgaggaactgaaggttttgaatggtgacaatctattcagttgtccatccaaccctgtgacatcttgaaatgtgcaggctgggcccattttcatggcatatgggtgcaaaattccaccaaaccttattgtgaactccataagctccgtgcatgtgtacatttttgcatgcctgtttcataatcatggcacatgctttagagctggacaacactacatatgtcatttcttttgggggtccaaatcatgactaaataattgcaagttgatcttttagtttcaaaaaaaaaa

SEQ ID NO: 523 - DNA, 1126 bp, Pinus radiata
gaaagtgctgctgacaagaacatgaacctataacaataactgcaatggatatattatattattctgtatttcaatcctctgatctgtgaatagtaagaaggattacgttgtatgagggtttactgtcttcactggttgcaagaggaggaacagtaaacgctcttagatctctgtaggtactatttgagatctgttctaggagcaattatttagttgaaaagaaaaaaaacacagatgttccaggctcaatacctttggttgaaagaaaagaaagagtaaactagttgagaggggatttgcaagaaattttcttgaagatctgtgcgctatgatacggagatttctgagaaagctataaaatgcaaggaacagctcctgatctttctggatccgcaaccggtgataagttctttacatccagttcgggcgacctacacgaggaagcgaggaacgaatgcgtgaacgagagtgatgatgatatccggagagtgccagagatgggagtacagacaggtgtggttgtgaactctgatttggttgtgaagactgatagtgagcgtggtttgtctggtagtggcagtcagaggagaaggggcagaacgcctgctgataaagaacacaagcgtctgaaaagattgctgaggaatagagtgtctgctcagcaagcgagggagaggaagaaggcttatttgaacgagctggagaccaaggccaaggagcttcaacagaggaattccgagttggaagagagggtttcaactctccagaatgaaaattacatgcttagacaggttctgaagaacatgacagccaagaataaaggcggtggagttggtgaggtagaagggtagttatattgtttcaaagatgttgtaacgattcggacattattgtatggtattgcgttttcaattgtcaagatgttcctatcttctgtgaacgtcccctgctcgacattttcgagttttgttggaagccattggaatgagaaaagagtaaagaaattccatgaatatgttattcccaccaagttcagggagcagggttctcacaatatcatagccatgattggcaaaatattgaaatattgagatcggttgctgtgtacacagttttttaaaaaaaa

SEQ ID NO: 524 - DNA, 908 bp, Pinus radiata
cttcctggtgttgttgctgtgatttctctgccattctgtgttgggtttatggttttagcttcactacaagcctttagcaagcctcacaaataagctttgcagtaggatgtctcctcccccgtcatattccatgtttcccaattcaggaatgggcttaaatccctcagtgacatcttcagaaccctctagtcaggtctccggatcgatcccccatcaatattcaggctccgaggaagaccctaaactgacgatcgatgaaagaaagcagaagagaatgctttctaacagagaatctgcaaggaggtccaggatgagaaagcaacagcatttggatgaattgagagccgaagcagctcatctcagagcagagaacagtcatatgctaacaaaattcaacattgcttcacagaaatacatgcagctggaagaagagaattctcttctgaggtcctatgccatggatttaagcctcaagctgcagtccctgactatggcaatgcagtgggcaggagtgctgaatgatgtggatctgggtagtagcactggctttattgatacaacggatatcaagtcttgttacttgccctccatttcacatcccctggcatcaacagaaatttatcattagctattcatgcgtctccaacatatcaattagcacattactcttatctgtcaatctgtatagttttagaatttattgttacaagcaaagaatggatgtgagaaagtgaggactgatcttatctgggaaagtgagcaccacattgcttgcttgtgaggttgctgtgatgtaaattagtgtaggatggatggagaaagcactacttatactccattccttggattatattgagccctgcacagatttatttctttgtttgatgtaataacctgcaaaaaaaaaa

SEQ ID NO: 525 - DNA, 1219 bp, Pinus radiata
ggctaatatggtctttgccctctttgttatcattgcaagatccccctgccatcagagcctggtgggtaccttgatctgatttgtgtgtctttgtcttccatgctgtattgatttccttcccagctagttcccgatattttgattgaattttgcccttttcatagcttggtagagatgcagtcagaacaggtcctgctgccctccggtcccatggtctccaatggcagcttccacatgggtactgttgatacaagagggggccaggattttctaagcagagaatgctatgaatccctcctgaatttcaataatttcatgctgtatcctcctcccactctcaataccaatagcagccctgaggtctgcaaaccctccccgaaggggcgttacattcgtcaagattccattgcctccaccagccaatctgctcagacggcctgcaattctgcctctgacgaagccgaggagcagcagactgggatgatagacgagcggaagaagaggcgcatgttgtccaatagggaatccgcccggcgctcccgcatgagaaaacagaaacacctggacgagctccgcgctcaggttgcgcacatgaggtctgagaacaggcaaattctcagcagtttcgacatcctgactcagcgctatagccaggccttggaagataatcgcctcttgaaggtccaggccatggaattatcccaacagcttcaccagttccagcaagccatagcagcatctcagtcatcggcagctccaaactttgcactcaacgccttgcaggcttctcatcgtcataataataacaataacattattagcatagatgatgcagtggataacaacacaaacagtttaactcagtgccctgacatcctgctctgacaactctactatcagtgcccatttcccataagttagttacatatattcatagattgctgcttcctccattgtttaggtcagttaaatacatataccatatatatttcatccgtcgtttgcgcctctactgtaaaaaatgcaacagtctgctctgctcatatagtgtaggcaggaaaagccaccatagctagccagcacagctccatctagaacttcactcagactaaagtttgtctgtgtgattagggattccatttttctaagtggagagcagagcatgttcaatccatctaaaatgaagcaattagagaatcagtttgccataaaaaaaaaa

SEQ ID NO: 526 - DNA, 1722 bp, Pinus radiata
atcggatagacccttgggaagattcgcttatggctgacacaagcccccggactgatgacacttctacggatgtcgatactgatgagaaaatgaatcagcagatggaccttgttcggcatgggggtgactcttctgatagaacaaaggacaaaaatggggatcagaagacacttcgcaggcttgctcagaatcgtgaggcagcaagaaaaagtcgtttgagaaaaaaagcatatgttcaacagctggaaagtagtcgattaaagctgactcagctggagcaggagcttcaacgtgcaaggcaacagggaattttcattggaggaagttgtgttggtggggatcaaagtcattcaatgagtggaaatggagccctagcatttgatatggagtatgctcgttggttggatgagcatcatcgacagataaatgaactgaggtcggcagtgaactcacatgtgggggacaatgagctgcgtgttctggttgaaggtgtcatgggacattacgatgaaatttttcgtctgaagactgtagcttcaaaagctgatgtctttcatctggtctctggcatgtggaagacgcctgcagaaagatgcttcatgtggatgggaggattccgtccttctgaacttctgaagatacttgtcactcatctggaaccattaacagagcaccagtttatgggcattaacaatttgcaacattcatcacaacaggcagaagatgccttatcacagggaatggatgccctgcaacaatctctagcagaaactcttgcttctgggtcccttggtccacctggcacttctggaaatgtagcgaactatatgggacaaatggcaatggcaatgggaaaattaggtacccttgaaggttttgttcaccaggctgacaatttgcggcaacagacactacagcaaatgcataggattttgacaactcgccaagcagcgcgtgcgcttcttgctatcagtgattacttttctcgtctacgtgcccttagctctctatggcttgcacgccccagagattaaatggttaggaatcacatgctttgatctgtaccacgttgcagccctaggcaatgggcatagccacatctatgagcaatcctgaaagagcttctccatctctgacaggatggagttgatgaggggttgtgagggtggatgtattgaagatgaaatacagaatacatgcttcgaaccatgcagaggtttggctttgccccttggtattttgaaataactcttgtacaatgattgaaatcttgttaaatcattgttgtgggaggaagtctgaaatcaccctttgagaatccagttgtgtccgggataattctcagcctttcatattgaagaaattaagctaactattcccttgacatccaagataggattttcaaagctgagtaggctttatttctttgaattagctagataggaatgtaaagtatttagaagtaattatccagtataatcacacaaggttggatctcagtgaacaagaaacttttttctgtggtttcaaatgtaacataataactaggtcgacagtttttggtctattagcataaatcatttgtttggctgcagtgatcaagtaatctttcgatctcttatgcagggaagccatacttcccttgtttgtgagatgtgagaaaaatctcgatccccccttgttcaatgatgaatacgacttgatattgagctaaaaaaaaaa

SEQ ID NO: 527 - DNA, 1657 bp, Pinus radiata
attctgtcttgagctcgtggggggtgagggagagggagacgtctccagctcgagtcgtcatctgggtccgcgtcttctcttcccttcttccaatggtttgatcctaggacagagagagaaagagagagatataccgaaagagaggtacagagagatagagggagagggagagggagactcgtggcgctgtttcgagctttctagcttccggaggaggagggctggtgttgagcgaaacttggagaggtcatgaattcgacaaccactcagtttgtgtcctctagaaggatggggatgtatgacccgattcaccaaattggaatgtgggacgagaacttcaagcagaatggaaatcctaatgcgccgccagctctgatcatacctatgcacgcgaatttggacaaccagtcggaggatacttctcatggatcacaggatactgctggcaagtatgagcaagaaacatcgaaaccttatgataaggtgcaaagacgtcttgcccaaaaccgtgaggctgcgcgcaaaagccgtctgcggaaaaaggcttatgttcagcagctagaagcaagtcgtttgaagcttatgcagttagaacaagaggttgaccgagctaggcaacagggtgtgtacatggcttcaggagtagattcagcttatccaggatatggtggatgtttaaattcaggaatcgttgcatttgagatggagtacgggcactggattgatgaacagaatagacaaatatgtgagctgagggctgctttgaatgatcatagaactgacgtagagcttcgcatcctcgtggaaagtggcatgaaccactatttggaactttttcgcatgaaagcggttgcctcaaaggccgatgttttctatgtgatgtccggaatgtggaggacatcgtcggagcgattcttcctgtggatcgggggatttcgtccttcagaacttcttaaggttctcatgcctcagctcgaccccttgtcagaccaacaatgggcgtttgtttccaacctcaggcaagcttgtcaacaggctgaagatgccctaaagcaaggtctggataagctccagctcaacctggccgaggctgtggccagtggtcatctcggcgaagggaattacatcccgcaggtggctactgctctggagaaattggaagctctggtcagttttgtgaatcaggcagaccatctacgacaggaaacgctgctgcagatgtccaaccacctaacaacacggcaagccgctcggggcctgctagccttgggggagtacttccaacgcctccgagctttaagtaccctttgggctacacgtccccgcgaacccgcttaaattcacttggtcaagtcgacatggatatttacaggatgaaatctctcgtggagccataataagtggggccaaaggtgctgttttgcatgtcagctgtagacatcgtgtagaaagttgctactcccgataatttttttctaggcggcgtctgaaagatgaagatgtgaataccaacatttatcttggagtcgtaatctcttttaccctctttcgggcgtgctgcagttaatgtatcgggtagttcttgagttaggtttacgacgattgcttggtgaaccgggtttactgtactcgataagtttgacagaacacagttgtg

SEQ ID NO: 528 - DNA, 2514 bp, Pinus radiata
gaatttccaaaaccccaggcccccacgtcaaagtgatgtgaagggacaaatcccttgaacaaattttcaaatgctatttatatatgaaatgacggtggagcgagagccacgggaagtagcgggtagaaggcaggggtataggctttttgggctgtgtctgtcgcttcgagacgacttctcattggagcgaaacgcctctcggcatttgggtcagtgaaccaacgaacgctggcttcaaggttttcgttttatctttcttatttcacttccttggatttagtttcctttcgatcctgaaaccgattcattgtgtgagttttccgcgaattaactgatcagggtttcggcctctgtatcaaatgttttggggagcttttctggtttgaaatgacgaggcccacatggcgaaatcactgttttccctaagctgaatgactacaacccatcttcagggcatctacaactgtaaatttcgatacctgggtcgatccgtgtgcgaccctcgtccgagaaaagagagcacagcagcattggtaggtctcgggttcaatacacagctggggaagaatttcaaaataaaacgtaagcctcgggtttgggctccagaggcacacacgacaataatacatcataggagtagcgccgtaggtcgtgtgttcaaaccccatccagggaaaataccgtgaagctcgcttattgcaagttcgactgacatcgactgaattgcatttcttagtcggcaaaaatattaaagagtcaagacaaagagggggttacgggagcaggctgcgggttcgatcccaagataaggaaaaaagaaagaaaatttcatgaattgggcctgtagattccagtcacgaaattaaaacctatcggtctcgtcttcgagctaaagttggggaaaaagctaagctctcagggaatgggttcccgcacaatgctgtcctctaatggtggccggacacctcagttccaaccactcgttcgtcagaattctttatacaatttaacgctggaggaggtccagaaccagctcggggacgccagcaagccgcttagcagcatgaacatggacgagctcctgaagaacatttggacacaagaagaaagccaggctatatccatggcgatcggcaatgggcccatgaacggcgttcctcccaactctgcccctgccagcggtggtttgcagcgtcaggggagccttacaattcccagaactctcagccgcaagactgtggacgaggtgtggagagatattcagcagagccagggaaagagtaacgaagagaagaagccgcagcagaggcaatccacctttggtgaaatgaccctggaggatttcttagtgaaagccggggtagtcagggaggacaacaatggcaatagtaataataataacggtagtgctgttactgtcggtattgcagagagtccccaaccagtctcggtttgcggcgtgcccactgctgggatagggatggatgcaatggcagcagcacaaaatttgcagcaacaggcagagtggtaccagtatcaactcaacactgcccagcagcaacaacagcagcagcagcagcagcaacaacaacaacaaaatatgatggtagcttacggcaacaagcgtcccgttccaccgaatggtccattagggatccctggcaatcccctcttggaaggtgggtatggggacaatcaactcgctctatcatcgcctttgatgggctgcacgtcgtctgattctcagacgccgggcagaaagcggggagcaccagagagcattattgagaaaaccgttgagcggcgtcagaaaaggatgattaagaaccgtgagtcagctgcacgatccagggcaagaaagcaggcatacacaaatgagctagagaatgaagtgatgcagcttaaagaggagaatgagaggctaaaaaaacagcagttcttggagaaattgctgccttctgtacctccaccacaaccaaagcacacccttcgaaggactggttcagctcctttttgaagtggagttgtagacaatcatgcttctaattttgaagaggttttgtggcacagtttcgctaatctatctgtaattttgtatctctattccaaaatcataagctagatagtttagtgtattggaagatgaggtttttaacttatgatcacttaggaggggcgtagctgcttctatattgaagacaattgtggagacatacagtttaggatagcacatccaaagaaagctatacgttgtcagttttcatcaagtaagaggagcctttggttttgaagccatgaagtatatagctacgaaggccttgcgtgacactgtaaatttgttttcgggtctgctgtggtccagaatgacctacattggggtaattaagcgtgacgtttcaggaaattttgtggccacaaattgatcagtcatggctctttttatgtttttatgaaaactaaataaagttgtttgtaagcacacattattgtgtgtactttgtagcaaaaaaaaaa

SEQ ID NO: 529 - DNA, 1758 bp, Pinus radiata
gagtgcgctaccttcatccaatccccttcaacaaacctccacgtcggttttgtcctcgtccacctcatcaacggattctctcggcccctgcatgcttcaggtttcctcggtcgtcccgcagcaatccagcagaagagatggacacaccgacaaaaacaacaaagacgcctacatcacaggaacaaacttccacaagcactcccgtggcttatcctgagtgggctgcaccaatacaggctctatataattctggaaagacaccactccctcctggttacttccattctgctgtagcatctagtccacaggctcacccatatatgtggggactccagcatatgatgccgccatatgggacaccacctcctccatatgttgctatgtattctcatggagcaatgtatactcatccatccatgcctgcgggtgcacatctgtatggctcttatgggatgtcatcttcaggagtttctaatgaagttacagctggtgcagtaactgcaagtgtagaaggagaaacaaagtcttctcaggccaaggatcgaagtcctctgaaaagtaccaaaggaagcttaggcagccttagtatgcttactggcaagactaatgaaactggaaaagaaacaactgcaaatggtgttttctcacaaagtggtgagagtgggagcgaaggatcaagtgaaggaagcgatgggaattctccaaatggttcacaatcaggacagaaaacacgctttgaacaaggatctacggaagctgatgagtctcaaaatggtaatgcaacatctcgcaatggacaaattgcaaacacagatagggcatctggaggacaagtaacaactattaattcaagcccagccatgggagcagtgccaatgtctctgccgggtacatctggcactgctacagctcctatgaccaacttaaacattgggatggactactggtgtgtgacagctcctacacctctttccaatatgcgtggacagcttcctttatcaccaacaacatcaacaatcattcctgctcagaacatgccagctatgggaacagagctatccctacaggatgagagagagcttaaaaggcaaagaagaaaacaatcaaatagagaatctgcacggagatcaaggatgcgtaaacaggctgagtgtgaagaactagcacgccgggttgaagagcttaaaagtgaaaatttggcactaaggacagagttgactcggttgcaggaagaatgtgaaaagctaactgccaaaaataattctctcacagaaaagcttaagaatgttcatgacaatgaatctagagaaaccagagtgaaggatgagctggaaaatgctgatacagaacagtgagaacagcaaaataatattgcagaagcaagcatcagaggatctgtaaagagatcattaggaggagccatcacttaatataggtggacgatcttgactaatcttcagtggaaaatcaatgtcaagtagattgtatgtctgcaaattagtttaatatagatttcatctgatcttcaaagtgttctggagccccagaaatttctggctattaacagccatgcatgatttgaactcccgagttccatgtgatacatctcgttataggaattcagctacctctgtaggcttttttccatttacaggggggtgtatttaagaaatgaattttctacgggattggaacatcacttgattgaatgacttgaactgtttgcaagcagttatgcggattctcaaaatgagaaaa

SEQ ID NO: 530 - DNA, 2126 bp, Pinus radiata
catttgtctctgagatcagtgcgctaccttcatccaatccccttcaacaaacctccacgtcggttttgtcctcgtccacctcatcaacggattctctcggcccctgcatgcttcaggtttcctcggtcgtcccgcagcaatccagcaggtttgttatctagattctagagtatctggattctcaacatctagtccaacattttagggttctgcacaaagcaatttgaacaatgaaagaataacctcagtgtgctcttaaattatggacacagaagagatggacacaccgacaaaaacaacaaagacgcctacatcacaggaacaaacttccacaagcactcccgtggcttatcctgagtgggctgcaccaatacaggctctatataattctggaaagacaccactccctcctggttacttccattctgctgtagcatctagtccacaggctcacccatatatgtggggactccagcatatgatgccgccatatgggacaccacctcctccatatgttgctatgtattctcatggagcaatgtatactcatccatccatgcctgcgggtgcacatctgtatggctcttatgggatgtcatcttcaggagtttctaatgaagttacagctggtgcagtaactgcaagtgtagaaggagaaacaaagtcttctcaggccaaggatcgaagtcctctgaaaagtaccaaaggaagcttaggcagccttagtatgcttactggcaagactaatgaaactggaaaagaaacaactgcaaatggtgttttctcacaaagtggtgagagtgggagcgaaggatcaagtgaaggaagcgatgggaattctccaaatggttcacaatcaggacagaaaacacgctttgaacaaggatctacggaagctgatgagtctcaaaatggtaatgcaacatctcgcaatggacaaattgcaaacacagatagggcatctggaggacaagtaacaactattaattcaagcccagccatgggagcagtgccaatgtctctgccgggtacatctggcactgctacagctcctatgaccaacttaaacattgggatggactactggtgtgtgacagctcctacacctctttccaatatgcgtggacagcttcctttatcaccaacaacatcaacaatcattcctgctcagaacatgccagctatgggaacagagctatccctacaggatgagagagagcttaaaaggcaaagaagaaaacaatcaaatagagaatctgcacggagatcaaggatgcgtaaacaggctgagtgtgaagaactagcacgccgggttgaagagcttaaaagtgaaaatttggcactaaggacagagttgactcggttgcaggaagaatgtgaaaagctaactgccaaaaataattctctcacagaaaagcttaagaatgttcatgacaatgaatctagagaaaccagagtgaaggatgagctggaaaatgctgatacagaacagtgagaacagcaaaataatattgcagaagcaagcatcagaggatctgtaaagagatcattaggaggagccatcacttaatataggtggacgatcttgactaatcttcagtggaaaatcaatgtcaagtagattgtatgtctgcaaattagtttaatatagatttcatctgatcttcaaagtgttctggagccccagaaatttctggctattaacagccatgcatgatttgaactcccgagtcccatgtgatacatctcgttataggaattcagctacctctgtaggcttttttccatttacaggggggtgtatttaagaaatgaattttctacgggattggaacatcacttgattgaatgacttgaactgtttgcaagcagttatacggattctcaaaatgagaaaatcttcttgggcactcatttaaattagctttagtgtgctctcacctactgcttactgattgcaggcagtaaaggtagggcctgaaataaacatttttgaagtaagagttgaataaacatgtttggacatcaatgaacacatggcgaaagcttaaagggtacatcttgtaatactgtaaacattctcatctttaatggtgaatgacctactccatctatcaaaaaaaaaa

SEQ ID NO: 531 - DNA, 1605 bp, Pinus radiata
caggcactgctgcactttatcttctctatctttagctgaacagagcaaagcaaaagaagaagacaatggaccaccaattctcattctctcctgcagacgatgtcgaagggaactccatggctgtaattaccgaagaagaagaagaagaaagccccgtggtttcagggcgaatgagccgtagcgcctcagaatgggccttccagaagtttctcagttttgatggttccaagattccgtcagaagatggagaaggcgaacagaagcctctcggtgttaaagatcctctgcttcacggtcatatggacaacgtccctgcggcgctcagtcctctctttgccgaagtcaaggatgaggttcttcttcctactgaccctcgagattacgaggccttcctcaagcggaggcttaaccttgcctgcgcggcagtcgccttcactcgggttacaggaattagctctccaggccctggtccctcaacagtggatgcaaaccaatctcagaacactttaggatcagaaagagctgcatcattggtatcccaatcttccgccacagatgccagagctttatacgttggagctgcgagcagcactgcttcgggaccaattggtattccagcacttcctccgcagcctaaaagcggaaatattcaagtgagaacaactagtggatcctcaagagagcagtcagatgatgatgaccaagaagtgggacccagtgaacaaagcatggatcccagtcatgtgaaacgggagagaagaatgctgtcaaatagagagtcagcaaggcgatcaaggagaagaaaacaagcacacttgactgatcttgagatacaagttgcccagttaagagtagaaaactcctctttatttaatcgctttacggagatcaatcaaaagtacaatgaagcttctgttgataatagggtactgaagtctgatgtggaagcactgagagcaaaggtgaagatggctgaatctatggtgcccaaggcagttgctgcagcaactgcagggtttccgcctcaaaattcatcacaggttcaatcagctgtcggcctacgatacagaactggaatttttgactcgcctgcaaccaatgtcttgcaaggagaggatggtctttacatgaatatagcacaatccactggaaccggaggttcatcactgacttgtgctatatctgacatgaatcaacagaccaaggaattgcagattcaaccccctggaagtaaaatggggcgtacaccctcaatgcagcgggttgcaagcttggaacatttacaaaaacgtatccgtgggggaatgacttgtggatccatcccatggggtggagcttgggatgttgatggctcacaagtgattgagcccagtgaacactaacatgaattttgtatgcccatgaacctcaaacttccaacaagtcttttttcggtgtttaaagtgtattgtttcccaacctctgaattgcccctataaatcgatatcccatgctagcataaacgggctataatattttgaatggtacatagatgtgacatattcaatggattgggttcaggcgtacggaatatatatgctgtttgcttgtcttgcaaaaaaaaaa

SEQ ID NO: 532 - DNA, 2088 bp, Pinus radiata
ggtgggttctgtcaaattgtgagttcaaggcgtaacccatcaggagttctcttctgtccaacccccctaactctccacttcacagatctcatgagacttaacctgttctaacgttgcagggcaataaccctctttgtctcttgttctgtattttttgctttttgaccacagagcaggttcaacaagcttgtacaaaggacgcactgaaaatgaaggatttttactgcagcttatgttaagctggtatgatatggcgggcttccagtgaaaacacaagcatattttgttcttcttggttgtcctgactcaaagttggattcaggtttattttatataaacgatgggaactggggaagaagcaacgccaactaagcctgctgccaaaccatcttcctcctcccaggagacaccgacaacacctgtttatccagattgggcagctgctttccaggcatattatggtccaggtgctaccccacctcctcctgccttttttgcttcaacagtgggatctgcaccaactccacatccatacatgtggggtggacagccgttgatgccaccttatgggactccactaccatatcctgcaatgtatccacatggaggaatctatgcacatccttccatgcctccgggtgcacttccgtatggtcactatggaatgccatcacctggcaatgctgaagttacaacgactttagcacttccaaatgctgaagcagaagccaagtcctcggaaggcaaagagcggaatacaatgaagagatcaaaaggaagtttaggaagccttggaatgattactggcaaaggaggagaaggtggcaaggcaacatcgggatctgcaaatgaggccatgtcacaaagtggggacagtggcagtgacggttcaagcgaaggaagcgaggaagataacactcaaactgagtcacaagtggcgagaaagagaagttttgatcaaatgatagtagatggagccaatgctcagagtaccaatattcaatcatataattcccaggctggagaaccctatgtgacttccggcgggcatgcaatgggtaatcccattagtcaagctgttgctgcagttccactgggctcagtgacaggaaaaccagcaaccagtgggcctatcactaatttgaatattggtatggactactggaatgccactccacctggagctataacaactgtaaaaggaaggggtagtacagctggtatttcaacagcaatagttccagcaactgctcaacttatgccgtctggtcgcgatggtgttcctcccgagctatggatccaggatgagagggagctgaaacgacagaggcgaaagcaatctaatagggagtcagctagacgttcaaggttgcggaaacaggctgagtgtgaagaattggcaacaaaagttgagaccttgactgtagaaaacatggcacttagaaatgaactaaaccgaatggcagaggaatgcaaaaaactaaccgcagagaatgcttccataatggagcaactgaagttgaatggacaagatatgacgactattactgaagaaaatggttcaactaagatatcattgcagtcggtaaaacctgaaggcaatgggcattttcatgatatatctaggggaatcaattcgaattctactgaaagaaatgaacaaaggcagagtgagacctgtgattcaaacgggaaggttcatacgttactagatgcgaatgctcgttctgatacaggttaaaatatgcctctaatgtgttttgatttaagttagttggcagatggaagttcgggagtccataccgttttgcttgttttgggctttctccaaacttttcatgcactaatatagtgaccgatgcttgttaatctagaaatttaattagcctggattatgaccaagaccatttctgtaaaaaaaaaataacccccgataaacattagaagaggtgggttcagccataactacgatcatatcattatttggtacagctaacctgctatgagtagtttcttactcgggtcatgtaattcttctcaatggcccaattcagttctagttttctcagttacgagacaaaaaaaaaa

SEQ ID NO: 533 - skipped

SEQ ID NO: 534 - DNA, 1979 bp, Pinus radiata
ggtctgctctcctagcaagttgcgtgtttacccacgaaaccagacgtacggacacgaccaatgcgctgcgtttgcgttgttggaaaggatttcagatctgctttgttcaatctcaacctcaacctccacaatacagattcgattcttgtccagaagtgtgtattagatagagaagctgcagcagagcaatggagcgagtgttttctgtggacgatattctagggacgttctggaagctggatacgcagggggaaggagtaggggagacggctccctctggagacatggccaccaatcgcaccaccacgaggacgagcatgaatcgtagcgcttcggaatgggctttccagcgtttcatcacagggtccgcccccattcccccaacatccccatccggatcctcttcccctcacattcctaatcaccaggacctcgatcataagatgaagaagaattcctcttcttcgtcggccccgactccgacccctcccgcccttgttaatgtggaggaggaagaggaggaggaggagatgagagaggatgtcaaggtagagaaagagggaaaggacgagaagcagggcagcaaggacaagaaggaggaggttgcagccaaaggtgttgtgggcaatgaaccatcaccatcctcgtcgtcatcagtggcggtgaatgtcaatcctttgtctcctctattgaagggaacggggtctgtaatagagaaaggcgtcgttacccacactaatcctcaggagtacgagtctttccttaagcagcgcctcgatctcgcatgcgccgctgttgccctgactcgggcttcagggattgatttccatggtgctcctcccttgacttttggtgcacaacattctcaaaaccttggtatggagtcacaagcaggctctactatatcggtcgctcaatcttctgggtctagacctatccacaatggggcgctggggcacaatgtttctcagccaataggtatacctgcattgccccctcagccacaaagtggaactgctcaaatcaagactacaaccagtggatcgtcacgagagcaaacagatgatgatgatttagaggcggaaatagaagctaatcaatcaagcatggatccaagtgatttgaaaagaatgcgaagaatgttatcaaacagagagtctgcaaggcgttccagaagaagaaaacaagcacatttgagtgaccttgagatgcaggttgcacagttaagagtagaaaatgcttctttattcaaacgcctcactgagatgagtcagaagtatagtgaagctgctgttgataatcgagtactcagagcagacgtggaggcattgagagcaaaggtgaagatggcggaagatatggtagccagggcaactggtgtaaatcattcaattcaaaacccaacccagatttcacaagcttctggcatgcgatatatgggtggtccagtagaatcacctgtaacttctggtccgcaggattcgagtcgatactcacatcctggacagccagtctcaactcaaggaatgacttgcgatgcatcaaatataaatgatcggagtaaagaggtattgccacataatgttggaaccaaaatggggcggacaccctccatgcaacgggttgcgagtttagaacatttacagaagcgaattcgcgggggagttgcctgtggatccacgccatggagtggaggctgggatattgaaggctcacctcggattgagaatggtggacagtaagctactggtcaatctaatctttcattagcagtagatgttcccagaattatatttgtattgccatccaatgtggagtgtaaaggtcaacgtgccatccgggtacaaactattgtaggaaaaaatggcaaagttaggtctgaaaatatccatttggcctgctctagttgtacagtacatgattttgcactcgcacaacaatggactataattatttttttggcaagtttaaaaaaaaaa

SEQ ID NO: 535 - DNA, 2962 bp, Pinus radiata
gtttgatggtcttttgtggatgtgatgaagataatttgttgtagtctgggtcagtttgaagggcttcaggttgtggcttagatgtaggcatagtacagattattttgagcatttagcaaaaagaaacgcgcaaaatagccagcgaagggtagaaattttggtccttttcttgtgccaaatggaagaaatggacagtagttatggcgatcttatgcagaggcttcagtcttctattgggacttcatcttccttcattcctaaacagcaattaaataaatctgaaccttcgtctccggctgttagtcaaactcggccccctttcacttcaaacattcagaattttaaccccggaagcaaaaggcaggggattcctccttcacaccctcactttcctcccacttcgcctcactcacaagcattctacagtcaaatgcccgttctacagtcatcggtacaacagaattctcagaatcagcagcattccaatgctagtcctaattctttgcatactcgatcgatgtcccagcctcacatttttaacttggacaacctgcctcctctcaatccctgttcatatcgtgacccttcatccccatctttatcggaccctgtatctggcgatgtttctatggaagatcaagaaggcagctccgcagtcccatcaatttctccacataatcccccttccctcttctccgggagtagaagatctcaaaatcatatgagtgatggcctaccccctagaaaaggacatagacgagcacgcagcgataatccttttacatttatgtccggatcccagtccctctctggagatatccaacaaggttttgggagctcattggagacggcctctgttaaaggaactgctcaaatggatcatctaaatcaatacgtttcctctttggaacgtgaaaaacctaaggcccaagcggtgaaaacagagttgaatcaggaaaggaatagtattcagaatgtagaaggcaccggagaaggagaaacgggcaaaggaggtggtgaagatatggtttctgcttgcattgatgtggaaaaaataaacaacttgaacaaatcgaggccggcaagtggggagttgccggacaatttgaatggagctcaggaagacagtggtggaagtagtgttaaacagaagaacttgaaggatggggaccaattcaccagtagtgatgaagctgacagtgaggtcaatgaattcaacattatgaaaagaagcaattcaggggttggatatgaagataacaaaagaagtggggggcaaggtgatggcaatcagtacaggtcacgtcactctcggagcatctccatggatagcattatgagtaagatgcataacttcagtgaagacttggaacaggaaccgtctcaaggtcggaatgtcagacactcccatagcaattcgatggatggaagtacaaatttcaatgtggaattcgggaatggggaattcagtgcatctgagatgaagaagatcatggccagtgagaaactggcagagcttgcaacggtggatccaaaacgtgtcaaaaggatattggctaatcgccagtcggctgcacgctccaaggaaagaaagatgcgctatatctcagagctggaacgcaaagtccagaccttgcaaactgaggcaacaactttgtccgcacagctgactcttttgcagagggattcagctggactgggcagtcagaaccacgagctcaagttacgcctacaggccatggaacaacaagcgcaacttcgtgatgcattgaatgaggcacttggggaggaggtccaacggttgaaattggccacaggacagctaggtgctggtcaatctggcagtctggctcagcaaatgtccatgaattcatcattatttcaacttcaacagcagggtccacatcatcctctttatcaaatgcagcaacagcagcaacagcagcaacagcaccaagtccaatacagtcaacaacctccagggaaacaaactaatcgaaatgaaattctccaaacctcatacacttctcttcctggtcccgttggatcctcaagcaagccagataattcaaatatgagtgctagccaagggagtgattgttctttctgaacaggttatggtattttgttaccggttatcttattcaccttctttttctcgtcaaagggatgaggactgcgagtggaaggattgtgtatattttattattcagctttcaacaaagctaaacatggtagatttctaggggaagtaatttccgtgaagatctgttttgacaatatgtttcaaattttaaaatcatatttttgttaggccatatattgctctgcttactgattgtagcggctggtggtgcatattaatggaatacataggtcttttaacaatgaaaatcagaaaggaaggtgtggaattttcctgtttattcttccaacttatcatacacgagacctgttgaccagacatgtctgtcaggggtatagaaccaaggctgagaagactatgttacaggtatcaagtggaaattattgacctgtagggaattttgaacaagcttgaggtttcacaacaatcaacacatacaatgagttgccgccctatgagttgcaactgcaaggtataatgttgtctctcaggtgaagatattagttaaataacgtaacggtgtaatttgagagcccgtgtggttcacatagcagacatagtagccatagcagataagatgaaatatatagaatcatatctaaatatggggagtgttgttgcaggactgtcctgagttctttaatatttggaatgtctgaaagttgtctgttttggacagtccattgatttgttcgtacctattattttatgtctatgctttttggaaagcaaaataatgaagagcaattagtctgttgcaatggttgaaagacctaagggaaaaaaaaaaaaaaaaaaaaaaaaaaaaaaaaaaaa

SEQ ID NO: 536 - DNA, 1279 bp, Pinus radiata
ggttcttacccttttcctgagccaccgagaatttcctctccggaatacccacttctcagagattcttgctgcgaactctgttttcttcagcgagatttgtcagtgaattgtgaggagtattgagtcttatcatgcggatccagtgcgatgcctgcgagcaggcaactgcttcagtgatatgttgtgcagacgaggctgctctgtgcagggaatgtgatataaaagtccacaaggccaacaagcttgccagcaaacacaagagattatctctcctcgaaacttctcgaaagctctctcgctgcgacatttgccaggatagggcagccatcgttttctgtctcgaagatcgtgctatgctgtgccaagactgcgatgagtccgttcattctcgcgacacattagcagcaaaacaccaaaggttcctggccactggcattagggtaggtctcaatgccctgtcatcagaatctccgggctcaagcgaatttgacaaacagccgtcctctatttctaaccctactgctcctactcatgccaccccacggatgggttcgacccactcatcatcggccaaatcgatacccttgggagagccgtgttggtccatggacgaactgttgccaatttctgactttgaatcaaagggagatcctgaagggttgggagagttcgactgggaggtagatggtctcgatcatttgggactgttcgagcaacagcaagaacaagaggaagctcttgcctgcagggttccggagctttgtcccaccggacctgcaggagggaggcccaactttactgtcaaagggaaatccaaggcagaaattccaaccgttcccgatttcgatgaagcgtgtattgttccagacattgggtcgctggatactcacgaattctacccaacccctcagcttaagcgcgcgaggcgttcatcctttgaggcatggtagatagcagtgtacttttccgaaaaatcaacgtgaaggcctaccttagcagtttaatccgtagattatatctgtcgtatagcataaagcgattctggtttattctcactgtaagttgtgtggagggccggtaagtcgcccaggaaaatagttgggatttgtattgtcaaataagatctttcatgtttgttcatagttctgtctgtttaatatgaatggcaaggacttatatctgaaacttgaaagtgaaatgttgctgtggacgggcttctgcttgtattcatggttaaaagatcttcacattatgagaagtttgtcatctaaaaaaaaaa

SEQ ID NO: 537 - DNA, 1406 bp, Pinus radiata
tggtgaaggaggaggattgtaaggtgccccaagaggccggaatcgtgaaggaatttcaagcctggactatgcccaagccctgcaacgtgtgcaggatcgcgagcgcttcgctctattgcagggccgacgctgcttatctctgctccggctgcgacgtcaaagttcacggcgccaacaagctggcgtcgcgccacgagagggtgtggctctgcgaggtctgcgaacaggcgcccgctgccgttacctgcaaggccgacgcggcctcgctctgcgtttcttgcgacgccgacattcattcggcaaaccccttggcgcgcaggcacgagagggttcccatcgtgcctttctacgagtgcgtttccgtggccaaagcgttcctcccgccactgccgcaaacttcgtcgcttcaggactccgacgcgccgggtaccctggactacgatgatgacgaggaggacgacgagatctacgctgcggaggccgcatcgtggctgttgcccaatcctaaagcgtcggccgagggtaccaagaattgtgacgacggggtaagctgtttcggcgtcgacgccggtcctaacaaggcagccgggggctatttcagcgttgtcgatttgttctctgacgtggatccctacttggatctggactacgcctcgtcgtttgaggccaccggcgggaccgacagcgttgttcccgtgcagagcaacggtagcagccacgatggcgcggtgtctacaccctcggattgctttgaaaccgataaggccgtttacagctataccaccaccacgtccttcagccacagcgtatcttcgtcctcgctggatgtcggtgtggttcccgacgccatgcttagcgacatctcgaggcctcttaacggaggggcggcgctcgagctggccaaccccggcgctgtccacgtaggcgtccagtacgtccaggcggaccgcgaagccagggtcctgagatacaaggagaaaagaaagaaccgcaggtttgagaagacgatcaggtatgcttccaggaaggcctacgcagagaccaggccgcggatcaaaggtcgctttgccaagcggaccaatgctgacgtggttcagatgtacacatcggctgagttcggctacggcctcgtcccgtcgttctgaatgtgaaaacaccgcctgagggatcttgccactggtctctgacgtgttgttgactcggggttgcgtgtggcagaaggcaggtatctgattcgctgtaactattattgcccttggttaattgccacgtaatttttgcaatatttaccggcctcttcctgaggtggtctggtttgtaaaatttgtaccctgtaattagaatctgttttccttgtactttaatgaaatcttaatcaaaatatgcagctttacagaaaaaaaaaa

SEQ ID NO: 538 - DNA, 990 bp, Pinus radiata
ttcgaccacctgtccatcctgtggatcttctttgcggaaacgtctcatttcaagactttataatcaccacctgagcgtgagcgtggctagaggaaggttcgatccatggaatagcacaagtctgcgcggcacagggcttcgttttatttcctttagagataataataattggaaaacaggagaaatatgcgaactctttgtgatagctgtgaagcagcggcggcgcagtttttttgtgcagcagacgaggccgctctctgtgctaaatgtgatgaaaaggttcatggttgcaataagttggcaagtaggcatgtaaggctgcaactgagggaatcatggtctataccacgctgtgacatatgtgaaactgcagcagcttttctacactgtagcattgatggctcatcactatgccttcagtgtgatatggatgtccatgtaggtggcaagagaacccacgtaagatatctattgctggggcaaagagttgagcttccaaatggaaataacatgcagcttacaaatggaagtcacatacgagatgaacacgggaatcctaaaactatggaaacggcaagagcttggcagaaaaagtattgtcaagagcactaccgcaatggggatccttctcataacaacatatcgaatggtaacatccataatgttgcatcctgtaataaagaaaatgttcaatccaatgggcaaaaggactgaaatatcatttagttcctcctctgataaaaacttgtcagaaggatgtgttaatgatagtgttgcaatcatgttcagggcattcactgggcacttgttctcaatatttgctctcatttgtatcttaccctccaagcaatttttgaatgcatttacgaattgtgaaaacaacccttcatgttaatgcctcttttacagccatagttacatgactgtttttattcatatggtgttagtaataatatctttgaaaggcaggattgttttttaaaaaaaaaa

SEQ ID NO: 539 - DNA, 1013 bp, Pinus radiata
ggaaatctggtgttggtttatcctaggtgatttgcggatctctcagggatctgaaaatggctaaaacaatgaaggaatgtgagctctgtgaattgtctgccagattgtattgcgagtcggacgaagcgagtctctgttgggactgcgatgccaaagttcacagcgcaaattttctcgtggcgcggcattgtcgaagcttgctgtgccagatttgtcaatctgtgaccgcatggcgggcctccggtgcgaagcccggtccgaccgtctccgtctgcgagagatgcgctggcggaggccgctcaaagagtgatggtgacgacgatgaggaaaataatgacgaaaaccaggtagtaccgctcgcctccggctactcgggaccgcctctcagttgttcttctacagatgaagaagaggaatcgtccggcgacgaccggcactccgctgaaagccccctttcgaatgcccctctcaatgccgccccccacaaacgtctccatgaaagcttggctctgaacacttccgagggcgattgtggttgctcttcttcttctggggttaacaacagcaataacaatatgagtggaggtgaagacgaagcaacctcctcggccattcgcggtttgaagaaaagaaaagtgaatcagggtttcaaagatgatttggtcaaaactctcgaggtaatccggcgggaggatcatgatgattcggctatattggccatttgtaaactttgcagagattctcatcccagggagcttgtttctgtagattgtcctagctataactccccttacgctgggtagtattttaccgtggacctcattactgtttgatataacacctagatgacatataggctgacatttgccttattgattgtaaggttggggcttctggattttgggcagaactgatgaacggcaagtcaagattttcactcttgcattttcccattgtaaatagaaattatctgaggacgtttgaattccaagggtttctgattaaaaaaaaaa

SEQ ID NO: 540 - DNA, 1452 bp, Pinus radiata
gcttgagacttctaacaccgatggctgtcttttacatgtctttatctccaagaaattttgttctccgtctccgtaacatttttcagatccgcccagattttcggctccaggaaccgctgtatctgcccaattctccgtagttgctgttttgtgaactgagcgacatttgtcaacgagaattgccacgatgggttaatgtggatttaggtctgggaagctttaggataagttaatgtaccgaagtgtgcttaattttagtaaagaggattgtgttttatcatgcggatccagtgcgatgcctgcgagcaggcagctgcttcagtgatatgttgtgcagacgaggctgctttgtgcagggagtgtgatataaaagtccacaaggccaacaagcttgccagcaaacacaagagattgcctcttgtcggaacttccccaaagctctctcgctgcgacatttgccaggatagggcagccatcgttttctgtctcgaagatcgtgctatgctgtgccaagactgcgatgagtccgttcattctcgcgacacattagcagcaaaacaccaaaggttcctggccactggcattagggtaggtctcaatgccctgtcatcagaatctccgggctcaagcgaatttgacaaacagccgtcctctatttctaaccctactgctcctactcatgccaccccacggatgggttcgacccactcatcatcggccaaatcgatacccttgggagagccgtgttggtccatggacgaactgttgccaatttctgactttgaatcaaagggagatcctgaagggttgggagagttcgactgggaggtagatggtctcgatcatttgggactgttcgagcaacagcaagaacaagaggaagctcttgcctgcagggttccggagcttgtcccaccggacctgcaggagggaggcccaactttcactgtcaaagggaaatccaaggcagaaattccaaccgttcccgatttcgatgaagcgtgtattgttccagacattgggtcgctggatactcacgaattctacccaacccctcagcttaagcgcgcgaggcgttcatcctttgaggcatggtagatagcagtgtacttttccgaaaaatcaacgtgaaggcctaccttagcagtttaatccgtagattatatctgtcgtatagcataaagcgattctggtttattctcactgtaagttgtgtggagggccggtaagtcgcccaggaaaatagttgggatttgtattgtcatataagatctttcatgtttgttcatagttctgtctgtttaatatgaatggcaaggacttatatctgaaacttgaaagtgaaatgttgctgtggacgggcttctgcttgtattcatggttaaaagatcttcacattatgagaagtttgtcatctaaaatattctccaaattttcaaaaaaaaaaaaaaa

SEQ ID NO: 541 - DNA, 1582 bp, Pinus radiata
gtagtatcaaaacatagtagaacagataccagggtctagctatagcaaacagatatcagggtctagctatagcaaacagatatcagggtgttgtacagaaatagatgaagatgaaggtccagtgtgatgtctgtgaaaaagcagaggccactttcctgtgttgtgctgatgaggctgctctctgttcagcctgtgacaataatgtccacgctgccaacaaattagctagcaaacatcagagagtatccctcatcaacccttcttctcagtcgcccaaatgtgacatttgccaggagaagacgggaatatttttctgtctggaagaccgagctcttctttgccggcaatgcgatgtttcaatacattctcttaacaatcttgtagctgcccatcagagatttctagtgacaggggttaaggttggccttgaaccctcgaacaccatttctccttccacaaaaacttctacacagtcgtctgatatcaccaacaaaaaatcacaaaccttgagaaatggtccaacggaagtctctgcatcgttgcatcaaggagtacagaagggaataggaggaggaggcatatcccgaagaggtactgtttctgagtatttttcggatttgctaccgctctggagaatggatgaatttctcaatttgcctgaattggacaatggttatggctttggcgaggcaggttcttccagggcagataatgccaactttgtagaagaatggcctgcaaattcctttagcacggaggaagataattctgaaaactgtcttgcacaggtgcctgaaatggcatctccaccaacagcatctgggctttattggcctcgaaaaattatttgtcaaccaaaggaaggcaagcgaagagaggacttgacgatctttggatttgatgatgcttccttggttcctgacatcggatgccgatcttctccacctgattctcctctttctaagagaagaagattgcatgcttaacttcgtttggtcttacctcgagagtctaaatttttacccacttagataatgattctgttctttcgatctccggacctgttatagttgatgattgatcagataaatgcagcacatataagttatatgcttatttccagtgagagtgagcccctaaggtgcgggtacccaatcattggaatctgtgtttttgtgtatgcctttgagagtcctatagatgcaactgttttctaaatatcctcgagtagaattgctcgccaaaggggatgcttgtatcattcctcagcattctagattatttgtaagtcaatagttcactttcttgtcgagctttggatttaaggatgatcttgattaggatgacaggctaacttgctgaagagtttttcccatattttgagtttattattatgctgaattcttcatatgttttcatgtaaaatactgatattatcatgggctagttcaactgcctttgtacttttcattaaatgatttgcttcaagcaaggcccatttaaatttgtctactgcgatgcttgtaggctgtgaaaccctgaaaaccagtagcttgcctacaattttctgttaaaaaaaaaa

SEQ ID NO: 542 - DNA, 1315 bp, Pinus radiata
gcaatcccatcacgcggccacggccctcgttagcgctctgcccgcccctcttctagctctttgaccatgatttaataccagtggctagtggcttctgcagatttgcaggagattcagcgcccctagaaagataatactgaaatatactgttgtgggaaggctggatcagtaatcctgaatttgttgtggattcggaaaaaagatgaaggttcagtgcgacgcgtgccagagcgcggaggcatctgtgttttgctgcgcagacgaagctgccctttgtatgaaatgtgattccaaagtccatgatgccaacaagctcgccagcaagcaccgcagactctctctcctcgagcccagttcatcatcctcctcggattcgcttatatgtgatatatgtcaggaacgaagggcgttcttcttctgtcaagcagatcgggccgtcttatgcagagattgcgacttgtctatccattctgccaacgaattgactgcaaaacacaacagatttctggttcccggcaccagagtttctctgaaaccaatagagactttggctgcccctgaaaaagctgtggccacggccactgtcaccaaggcacttatcccgcctgtccaaaagatgccggatcatgcccagccatcaatggatctgcctgtagaaaccgtgactgcaagtaccagtaacagcgagttctcacagtacttgagcgaggttgagcaattcctaacctcggcttcccctgagcgtctagactggggtggatcagctgaggctcacgctattggaaagtacatggagtcggcttgggcacccaatctgggcctcctgcctgaaggtttctacggagactcactggcagaagtccctcacctgccatcgccgacgacggattctggattctgtatgtatggccaatttggcatcaccatgaaaccaaaggcaaagcagcaggtgcagaatgtgccatattttcttgctggtttcgagacgggggacgataatttcactgttccggacatcgtattgcccccttctgcaaagcgaatgaggatgtccaacaccactctccatgaccagcagttttttattttgtaaaaacgctgcaaggaatcatctaatcatatgaatgaatgtactgtatctgtatgaacacatgaactgtcctggaacaattttcattatggaaaatgcttttttgaactattttggattactggaactttttttttccatgaacaaactgtaacaaaatcttcaaatgcagtgatctgattaatgtttaatatcacttattatgaaatttcttcaaaaaaaaaa

SEQ ID NO: 543 - DNA, 1548 bp, Pinus radiata
gattttgatccaatccagctccagctgcaagttgggtgtttcagtttggatttcctgtgagaatttttgctcgagcaagaaattgggtgttcagcttggatttcctgtgagaattagtagtggggaattttgcctgaggagttggagttgtgttgtggggaaataatttggtgatggggaaggggaagggacccaagtgtgagctttgctgcaacgatgcagcattgcactgcgaagcagattctgcaagtctgtgttacaaatgcgatgccaatgtccatggagttaatttcttggtggcaagacatgttagggttgttttgtgctctggatgttatcatcacactgaaagaaatgtgtctggggcgaccccaaatgctgatcagtccttgtgctgtgcctgttgcaagtcacaggacatcgaacagaccgctctctgtaattccacagcagaatctgcctttgctgggcctctttctgctgtatcttctgagcagagtaagggacttgatgtgggtattgattgtagccttttccatggttccagatttggagaaggaaacctgaaggcttgttccagggaaggggataatcagaggactggggctcctgagaggtctgaggtttctatcaatgcctggtcttacaatgatggggtaagcactaccagcagcttgggtaatagccagacagttgacaacaaaccccaagtggaaagccacaacaaagaaacgggcttactccatagaagatctggaccgcgcgtgttgaatgcagagatgaaagtggaaatagttttcagaaaatggttcagacatctgaatctcagaaacccttctacggtgcccttggccatggacttgatggaaaagggtttgcaaaagctgggtgccttatctagacaaaaaattaagatctgtctggctgcatccttctggttagctgcaacactttgtgaaaagcaaaaccatttgccacctgtgaaaaggcttgaggagtgctctggaataccatctaaattgatacttttggctgaatccagactgggaaggattctcaggttgaagatgcaggaggaaggttcggcagagtgctctagttgagggcttcttcttgttttccttcacaacttttgaaggatctcttgatctcgggtttacgttgtgggaaaagccaacaaacactattcttgtttgcagctggtgtgatctaccagaggcctacaagagaggtaggacatgtctctagggataagaaccttggtgggaggaggggtatttcacacctctgtttctttcgtgtagccaaggtccctttgacactgctctacaatattatcaagacaagctcgctgtatgaaacacatgtataaatataggtagctaggatggatgccatttgttgcagcatatggtatagaagatttacttgagattcagaatgatttgtttgtagcttctaaccagtagatttttcccatgtaaaaccctaactgttatctaacggttccctctttaatatgacttgagcttcagatgaaaaaaaaaa

SEQ ID NO: 544 - DNA, 1751 bp, Pinus radiata
gttgcagaggagaatggtgaaggaagaagacaaggattggcacaatgttgaagggtgggatagagggtctcatgttgatcacaaagagtttctcagagggattggagggtggagaatgagtatgccaaagctctgtgatgtttgtcaggtatcaagctctgtaatatattgcagagctcatactgcacagctttgcttagtctgtgatgctaaaattcatggtggtagcaaggcttcgttgtgtcatgaaagagtttgggtttgtgaagtatgtgagcaggccccagctgtggttacatgcaaggcagatgcagcagctttatgtgtagcctgtgatactgatattcattctgccaatcctcttgcaagtaggcatgaaagagcacctgtgattccattttatgagtgccctaatatgcccactaataatacagttacacatgccaataatgataacttggactgcaatgttttgctgaatgaagatggtggtggggatgatcctctgaaacatgattatgttgatgatgactatgatgattatgatgatgatgagaatgatcagaacaatttgttgaacaatcaggaagataataatgatgctgaaatatgttgtgcagaagaggctgcaacagcatcatggttgattcctgaggccaacagaaataatttgacaattatcaatggaggtaattcagaaggagaagataagatggtgaaggataaactcaagttcaaggcctatatgcagagcatggattttttacaagatgtggataattacgccgatctggagtacttgggaacaactactattacaacgccaataaaccccactgccaatatgggggcagatagtatggttcctgttcacactcctgaagttattgagcattcttctacaaaagtttctattgatacagctgggtcaatggatgtggatgcagcatccaagtgcaatcacgtttacagaactacatctctcaaccactgtgtctcttcctcccccatagatgttggaattgtacctgacagcaacattacatctgatatttcaacaccttaccatgacccaagaggagtattcgagattcctcctcgggttgttcatcctggaggccaaggtgaggtcatgggaagagaagcaagagttctcagatacagagaaaaaagaaagaacagaaggtttgagaagacaatacgatatgcttctagaaaagcctatgcagagactcggcccaggataaaaggccgatttgccaagagaacagaggtagaagtggaacagatatactcatcttctttgcttcctgatcaaggatatggagttgttccatcttattgaaccagtcaatataaataattaactcttctctagtatctatccttgttattctaattgtaactgccatcacaatcataatgccttataacttcaatttattcatgcctatgagattgggctggtatgtaaaactcatggcaggtctattcacatttgggttgttcgcatactcaaagcctcctccttactcattctgccttgctcattgatgtgggtcagactgcagtaagatgaagtcggtgtgactcacactttgaagaacagccatacatactattagtgtttcaagtcgatcgaagtttgtttattcagcttcctgcaatcttctctgttcatgaataaatcttttcccagtctcctactatcttgtgaatgttgcaaggattatattttttcaaaaaaaaaa

SEQ ID NO: 545 - DNA, 2222 bp, Pinus radiata
tgcaaatgctgttctggatagctgaacccaccaactcatcagcataaatttctccagcagaaatccagcctcccactcgcgcgcataaatttcttcaacggaaatccagccggccgctaaattctctgcactgacaaaagcccacaggctaacagattccgacatggatcgccccattccctggccatctgcatacacagaaatctagactttgaaaatctttctaaattctgtatggagccctgaactgtaggtgcagggttcgattaccgctatggatgaggccgcgcctgccaaggctcctctcccctgtgactactgtggcgaagcgaatgcagttctctactgccgagctgactccgccaagctctgcctgccatgtgaccaccacgtccattctgccaatgccctgtccaagaagcatgtccgatcccagctctgcgatagctgcaaagacgagcccgttattgtttactgtgcggccgatgacgcggttctttgccaagaatgcgactgggacacccatggaggagcctccactggccaccaccagcgccactccatcgaaggtttcacgggctgcccctccgctgaaattctggccaccaagtggggtttcgatctcagcgacaaatctctcaataactctgcttcgcccctcgggctcaccgatccccaatgcgggaattccctcgtatggggcacgcttgatgattctctcgactgcatcgtatcaggtcgtatgaaagctgatcctgtggattcctggctctgcacgccgtcctcagctcttcaggacgtcctcgtccccaatccaaacttggggtccgtcgtattcccgaccccaggcaagcaacaaaatcatcctctgtgcggtaagcagaagcaattaatatttgaacagctgcttgagctgatgaagcgggaaggaagtacagaaaaccccgaggatgatgaagaagaaggaaagcctatttccagaccaggcactcctaatcaacatcagccaattcatccagccctagaggtaaatgatgcgggaaaccagaatccatcacagggcgaacaacgctctgtagaggcaattcgtcctattccttcctcgtcattgctgatacttcaacagaacggatcagatcgtgctactgagcaagatattatctggaatcgcagctctgggaaccaagcatcccagggttgggatttgaatgcacataatgccacaaattgtgagggtcacaacgtagatagatacaatgtagctgatatagactttagcaattttaagagttacagtgacctacttgaaaatgcttgcaatgactctgtgatatctttggagaacattagcactatgaaatgctcaccaaaacatgctactggaccgagtctccagtactttgcttcacatgatgcttgcgccatacagccaaccgggaaatggcttagcaatcttccgggctcagttggtcaagttcctggatcacctcgtgttccaatagaaactgcttgtttgggaagatctgcaggggaattgaatggaaatgatgcaaaaccccctacaaaggtagatgactcaggtttggcatcaactacagcaaagcttggaaaagacactattagccctgattgcgatcacaatgtctcctcattgttcaagggggatcctggacgaaacacaaccaagcttgacagtgaagcattagcccaagcacgaggcaacgcaatgttgcggtacaaggaaaagaaaaagacaagaagatatgagaagcacattcgttatgaatctcgcaaagctcgagccgatgtaaggaagcgtgtgaagggtcgctttgtaaaagcagacaaagaatgtgatcaagatgcccttggaagtagcaattaaaggtttacctctgtagtaggaaatgttcaacctgcaaattattttgaatattttcaaatttggattgcctttaacatcaagggaaatgttctttgaaaacaacataccttgtttgtttggcagaatgtgtgcataatgctaaacaggaaatgatgctgtgaaggacagtaagttgaatctggtccataattggtggccagggcagcgtttgatgtaatcaatctaggtccatccatttcatcactcagggttgtctgttatctttgtattgtaataagtcgtcaatataactttcctgatgaatgaagtcatgacattttggtttttaaaaaaaaaa

SEQ ID NO: 546 - DNA, 2185 bp, Pinus radiata
gctccaaaatatttagactttcatcgcaaattcggccatttctgctgtcgaatcggtcccggagcgagacggttttgtggtagtcgacgtttcctggttcatatttggcggaagttcgtacatttttggttggtttggtcctaagtaaggtaaagattggttctacaatccgtcgaataggctgtttttaccggtaaacataattttacagtcatatcttctggtaggtccttcagtgacggattatggacggtatatatgtacatagaggttagtgtcaggggaatttgaggtttacaggtaaaaatggggacaatgtgtgatttctgcggcgaaattaggtcaacagtatattgtaaagcagatgctgcctctctgtgtttaccgtgtgacgggcagatccatggcgccaatgccctctcgaaacggcatcttcgcacccttctctgcgatggatgcagcgtcgagcccgcggcattcagttgtaataaccacaaattgtcattctgtcataattgtgataggcaaagccattccaacgcgccgcagcataagaggaagtcgattagttattacacgggttgcccgtctccggcagagcttgcagagctatggaattgtgagttggatagacagggtggtgatgataaacaagggtccagtgttccaggtacaaggtggggcaattcagggaaggaggacgtttcattggagactctcttagcctccggcatcgatgtgggatttacacagaaattcggtccgtggatggaaccttctgtttcttcgaaagttggtttgcctccgtcgtcacagcgcaattccaatgtgaatacaaggatctttgattcagagggttccgaaggtaccatgaagacatgtgaagagcagcaacaacagtcgaaacaaaagcatgcggttgttcagcaattacttgatttgcaaaagtcacagcatctggctttaactgaagtacaaaatcatcaagaagtgcaagcttatgttccaccacaggtgcagggggaggtgcaatccatggaaagttctctttccagatcattggaggatgattttcaaatacaaagtcagcatttacagaggcagcagaaagaccagcaacaaatgaaacagaatttccaagagcagaagatgcagggtgtttctttagttatacccgagtcagagcctcttaagtcagatacaaacatggaaatggccatccaaggggattctttctggcgctgtagtgctgcaagtcaaacaaaccagctatgggatcaaaacatgcaagatcttggaatatgtgccgatgatgattgttgtgatgccttaaatatgtctgatgtcaatcttatctttgaaaactatgaagatatatttggtggcccccaagttgaatcatcatctatgtttgaggatctagaagctgcctgctcttccatggataaagttgtttctgttgctgatccaagtgaatgtaataaccacaacctcaaggcatcttctgcacctgcaggttgctatgcagttttatcatcccagggagctggaaaagagggagaaacttcacgtcctataactggaagaacagtccaaggtgcaccaggtccaaatgtacctagcaatattagacattatgtgcagccagcgcctgcttgtttgccacattctctctcaagctatagtggggatggcgatgttgctgattatcatgactgtggtgtatccactatgtttctgaagggagagcctccatggggatctacaaacaccgattctgcatttttgaatgctaggggtaatgcaatgatcagatacaaggagaaaaagaaggcccgcatgtatgataaaaagatacgctatgcttctcgtaaggctagggcagatgtacgaaagcgcgtaaaaggtcgttttgtgaaggcaggagaagcatatgattacgatcccttagctacaaccgggttttattaaactttcagcaatttctagtgccgtctatatttaattttcatgactgtttcagtctcaattagtttccaacttggcagcataaaaaagtgccatttggattctaagatatctacctgttttgataaacctgagcaacatctatgtaaatggattattgtattgtcaaatagcatctagcatggctgggtaaaccagcttcagttcaaaaaaaaaa

SEQ ID NO: 547 - DNA, 1882 bp, Pinus radiata
agataggctctgagaaacaaaaacatggagaaccaggatgctctagaatgtgcggaatgcgagagtgaaagagcgaaggtggtctgctgcactgaatccctcgcgtattgcaatccctgttctctcaaaatacattccaaaagagctcgttctcaccatactgtccttcccattcctccatgctctcaatgtctccttcgtcctgcaaaactccaatgctttcaatgttccaagtccaatcacaatctcagctcaaaggcaaatcctattgttctgtgtactcattgctcaacttcaatacaccattctccttcaacccctgttcacaaagtcactgttcttgctattctgagcagcatcatcaaaattgaaaaccagtttcccagccatgtaaaacaggaaaaattggattcagaagatgaatgtttaattaaaaaggggaaaaagagaaaatcaactgcaagctatgattccaatcctgacaacaaatgctcctcttcaaacaagcttcgtaggagtattaaagatgaaacccaaataaaggaggaacctgtatctcctcgcgaaggccaaaagggtcctcgccgaaacacccccagagcagctactaagcgcgtgtttgggcccacggagaccgacagttcttcttctgagagcgaatctgatggaggctggagtgattttgaagaggagaccggggtccggcgcatgcaccgcggaagtgtttccgttgaggcatttgttgtgaatgcagaggatgatgatgatgatggcggcggcgatggaggaggaagcaatgcacggaacggtgagcagcatagtacggtggtggggataaaggaaagaataaggaagatgcttgaattggggttgcaccctgacactcccgatattgaagcacagcaggccttaaagaatgcacagcgccttctcactaagcacaatcttcaacaggtggaggtgatggaaggggcactcaaggattcaagtgctcttgctggggggatgcgagtagttgagctaagatacaaaggaaggattggaagactaggaagaattgaagagtgggttattgacctcgtccatgtgattgcagacaattttgatacacaatatttcacgagaaaatatgacagacaggatcgtcctctgcaggttgttttctatggcattaaacaaaatgcagattgttctggttatgcctttgctgctacttttaatagaatcacaataatgtcagccaactactatccttcaaaaagcttggttgacaaagataacaaggaacgtgctctccaaagaacatataccaggattgcaagaaacaattacaaattaggtattgttgcgggattgaaaaaaatagtaagtggtcgtgaagatgcagcagattcagaagaataccaggataaaaatggaataaaaggtgaaacaagaggaaaaggcagaagtcaaagaatgcaagatgaggacaaggaaagggagagaaaggcaattcaagcacttgtgcttcattccaaagaagttggacaagcctacatcaaagctaaaggcatcaaaatcaagacttccaaagctagaatgagagaaactgcatggaacatagaggcatttactcaaggagagattgattcaaagcaaattgacatcaaccagaaagctcttccaactagtcagaaggggaaatcctccaaaaggcaatgattgcagtgaaattcaacgatgatccataggaatactttcactttctccgttctccattaaatacattgcacttttgtaagtagtaattattgtgttaattttgaattgttgtcgaaggcctgaacattggagaaattacagttattataacaacgaaatatttattttaaaaaaaaaa

SEQ ID NO: 548 - DNA, 1517 bp, Pinus radiata
gagagaacgcctcccgtgttttttttttttttttcagaacaccttcggctccgcccccgccatagattggatttcatgaattatagttccgaattccatcggatttggggagtttggttgctcaggaaacgagtgaattccgggcggatttactggtgggttttatctccatcctctcacaggaggacgggacgttttatttgaaggcttctttcgcctgtagacgttttgtcgccctgctgccatgatgaaggatcaggaagagatggggggcatggagggaacagcagatatgatggattcttatcctccaaggcagttgctggatcgtcggctgaaaccacaggcagatcaggagattctcaagtgccctcgctgtgagtccaccaacaccaagttctgctactacaacaactacagcctcactcagcctcgccatttctgcaagacctgcaggcgctactggaccaaaggaggctctctgcgcagtgttcccgttggtggaggctgcagaaagaacagcaagcgcaacaatagcaacaacaacaatggcaagagatccagtggcgaagcatgcagctcagcaacagggagcgatcagctgtctccttccctggctggagtctccaatgattgcaagtactacaatggtgatggcgaggagctaattggcattaactacgtgaactcgttgaggcaggtggatcatgaggcagcgtttgcaggttgcagtattaactccggtgtctacgggattcaggcaaatgaccaccagtcctctcagagtttccagccctaccaccttccaacagctcttcaatctctgcaaggaagtttaattctgggctcagatcaggcacccaatggtttcaatcaggctgccaacagaggagatctaggtctagtgcagcaacaagcagcgggtgctgttccctatgacagagaagcataccatccttacataaatatgtcacttgatcaatcagatgggcactctcgagcccctcagcagcacaagggcaataatattatcgaacacccaccacagggaatagtgtacgaaggtgggtattggaacagtggggtttggccagatctctcagcttatgggctttccaacataaaccctaattcaatgtagagagaggcctgacttgttgtgaagttaaccccaggatttggctaaaccataacacatttctcatctcgttaagtgtatattccacaacacagtttgctaaaggatttcaccgaaggtcatatcagaatttcaagtcttcatataacagcaggtcaactgacagattttctggttatctcctattaatagactgttggaatagaatatcagctgtttagtgtgttcataacaatacttcaataggattcaactcatgtattggaaggatggctttgcaaatatggcaagtattgtccaggtttgtgcatgtcatttcctttccttcatcttctagcagcataagattgatatttttttctgagatttgctgtcgaat

SEQ ID NO: 549 - DNA, 1587 bp, Pinus radiata
cctcaacggtcacgggttccaccccagccgcctgcatcatcatttcttttgttttttctgctgtaaattctctgttgtgtgtggtatttatatgtgattgtaaggccagtagttgttggtcatactttgtggttagagtggctgtggagaagtaggtggtttttgagtacttggtttacagaacaatgatgctcagccctgttcaggtctgcatggattccactgattggtcacagggcatgatgcaggagagagggtttaggccaagtggcgaagacctgctttcatgttcacgtccattgcttgagagaaggctgaaacctcagcctgaacaagccctgaaatgcccaagatgcgagtccaccaacaccaagttctgctactacaacaactacagtttatcacaacctcgtcatttctgcaagacctgcagaaggtactggaccaaaggagggactctcaggactgtacctgttggtgggggttgcagaaagaacaagagggctaagagaagtgtagctgcagatcagcccgtgtttagcacacaaagtgagccatccacctcaggtgcaccctctgcaagtgcccttccaattggcttggaccatcaagctgaccttaatcctgctactaattcaagctcttatttcaatcttgctgcaaataatactcctgcatcgactgaggctaatctagcatttgccagaatgcaacaagctgcaaggcaagggggtcggtctgttctacccaactgcagtaactctgattttttgggtctctcctgtggcagcagtacccaatcctcctttggtccccagaatagtctaaataaccttaaccccatatcctcactgaccaatctttcagcactgagtgccctgaattcattgaagtttagttttgcaggtctggaggatttccatgggaactcaaatagaagtgatcaaggatccctagcagttccctcagaatggcagcttccatcagagaccacactctttgagcaggctggagactcaacaaattactggtctggtggagcatggggtgatctcacaagctatggctcatctgtaagcccacaaatctaaaaaccatgtcccagttgggtacttgacatgaaaaagaatgttctcaagtagcaagtttttatggcatagacttttatgttttggcccttgatgacagttcccagcatggtgtaggcatggttgtcaaatttattgaagacaaacatgacatctctgctatttttttgtgctgctgattatactgcagttggcaccgtacatggaacataaatacagtagatgatggatgatgataagaaggaatcacttcaatggaactcaatatttgaagcttctttttgttcagcttcaagattaagctccttggtgaatcccctaaacaacatgtgaccttgaaaggagttacgtctaattctatgttctgcctgggttgactgattctgcaagtctgtgaagcaaatacagcttgtagtcaggctgcccatgaatgttcttttcatttggttagtttcgtatgtgtaaatagatggtgttctcttttcagacaaaaaaaaaa

SEQ ID NO: 550 - DNA, 1944 bp, Pinus radiata
gcagaggggaggcacggatttcgtgactgttaatagtagacggcagactgacggtaaatagcgaacattacagctcggttcttgctgtgaattttggctctcacgtgctatctgctgttccttaatgctgcttcgattcctgttctctggaatctagaatgaattagtctcattcttccgccattgcttctgtcaaataacagatttccaagcaaaagatcatcgattctgttgccttgcgataataataatagtcgttaatggcgttccatgggtctgtgaatccgtattaataatgcaggcgcaatgtgcgttagtcagacgtttttcacgatgaattggacttcttcttcttgtttctgttctgcacatggctagctagggaggatattgtgctgttctgtgctgtctgcgctgtgccgtgctgtgtgtggccacagaattcacaatagggaattttattaatgctgagaggaataggtatttgaaggatgaactgagggcgattttgggcttgtgaatgaacttagccttagctccagagatgcaggtctcgagttcgagtttcgaaggcatcccagatatggctgtagcggttcagaatcttggcgggaggcgctctaagccgcatcccacacaggtacagaaatgcccgcgctgcgattcgctcaacaccaagttctgttattataacaactataatctgtcgcagcctcgctatttctgcaagaattgcaggcggtattggaccaaaggcggtgccttgcgcaacgttcctgttgggggagggtgtaggaagaacaagcggtccaacaagcggaattccgataaaaggcccgccgcctcctctgcgccaccggctagcgccgccgataatcaggcggcgggcggagcctcggccgcgtcttcaagctcttcgctggttaatggatcggacaggagcagcatcggctttgaatcagactgcaataacaccacaaccagcaccaccaccaccaacaccggcggcgctactggcacccccgccggtgttagctccggccaactgttcgacggtatgaatccaatcaatccgcctccgccgtcgttggatcctcaagctcgcggcgcgcttctgaattctggtaacaatctgagctccatcttagaccccagtgcttacgaaaatgctcagtttagctgcatggatcctgtaatcagcagtactccagattggagcagaggcttaagcatgccatggaagcagcagcagacattgacgtcattattaaccgatggcatcagaacgtcactggatgggtttctgagccagcctccgccattattagaggacattaacagtttagcggaagctgctaccaggtctgtatttggggtaaagacttcagcggccacggtcccgtggccatctttacaggacgacgacaacattaaagctcagtcgcttcagggtctcgaatggcagacggcgaacggtaatagtaccagtgacgcagggcttcttgaaatacagagcgatcttgggccatggggtgctggaagttggccagatcttggaaattatggtccagggagcagtttgccatgatttttctcagatctttaatcttgactccattaaaccagatgttttcccttttctttttcattttctctttctttactgataacaacctacaggttctaaactccgttttgcttcattcctgaagactccggtttgatctttttggttaatgattcatatgtataagaggttttgagttggggagcgtttttgtttttaaatctctggtaagtaacagcaggaggcattgttattattattattctttgtatagtttgctgtagggaagaagaacaagaaagaactatagatatgtgtatctgtgtgcttatctatgtattctgctgcctcattcttttgtgtgtgcaaaaaaaaaa

SEQ ID NO: 551 - DNA, 2312 bp, Pinus radiata
gtgcttcttcttcttctgatctgatgcgcatatccattttgctttaattcattcctcctgcaacttttttgccttcggcttcggttttacagcaacctctgtggccctcaaatgagagattcttacaactctgagaaaagaagacacggcaatcttttattgatttacatgtgtctgctgattaacgccagaacctgacctgtgaagaattgggggcagatctgagatcggtgttggaaattatttagggtgtttttccactagcaaaatggtgctcagttccgttgaagtttgcatggattccgccgactggacccagagtttcctgcaaaacagtgcactaaagcttccagaggacctcatgccatgcccaagggcaccacctatgatggaacggagaatcaaaccacagactgaacaggcgttgaaatgccccagatgtgattctacaaacacaaaattctgttactataacaactacaatctttcacaacctcgccatttctgcaagacctgcaggcgatactggaccaaaggaggtgccttacgtaacgttcctgttggtgggggttgcagaaagaataaacgagccaagcgagcagtagaccatcctgtctctgctcagaatgaagcatccacctctgcagccccaggcaacgaagtacctgaccggtctccctttgagccaccatcttcaaaatccatttactatgggggagaaaacatgaacttaaccggtctcccctttagcagaattcagcaggaccgagctgcattggcccactgcaactcttcttcctttctaggaatgtcatgtggcacccaatcggcctctctggaaccacatctttcggctttaaatacatttaattcattcaagtctaacaatcctggtctggattttcctagcttaagcacagaccagaattcactgtttgagaccagccagccacaactgtcaagagcaatggcatctgcccttttttctatgccaatggctcctggactggaggacccagctgacttccactggaaattgcagcagcagcagcagaagctgtcttttccctttggagatggacagatagagaatggtccaggaagtgaaggacatgactttctaacttatgaagattcctctaaggatgatcagaagcctgaagtggtcacaaagttaccatcttcatcagtaaaggtagaggaggatcaaaatgcattggcaacagattggcaagtacctgcatcagagccactttttgctggagattcaaacagttattggaatggaggatcatggccagatattgcaagttatggattatctgtatgcccactgatatagaagaaaaggtgttgtttgatatcaatttacagaaaagagatcacttccaagtcccctccaagtctgtagagtattctatttagttttactgtatacacgtatataattgttttaggtagaagataatttcagaacagtcgtaggtatttcttcttttatggggttttcggaatggctgtttgcagcagagttgagcagcatatgtcacctctgtcggtttattggagacggtgcagtgccattcctgctctattacctgctgctggagcaccagtttgttgtttcagagtcggtgcatgacaatctgactataatcagctaaatgcttgaagggatatagaatattttgaagcttcttttttgtttggcttcaaatgttcacaaaagggaaagcttgtgctgccttgccaattatttttgcatggaccagtacagaacatagacattgacagcttattattggaaggacggttttctgcaaactatgtaaggctgtggtgattgagattgtgagctgaggcaaacttgacctaccttggttttgatcttacccatgggatttcattttcaccactgcagttccagttctgtaaatatacagcatacactgttgatgctgacacgttggcccacgttgtttgtttctttattttaggtgggaggtgggaaggggaatggaagagtagcttccacagccgtatgtgattggatttgagatttatacttatgtgaatggctgcaggagcattatagtcctataaataagctccatttctgtggagtgctgagcagaaacaagaaggtttctgcaataaaacctaagtaactctatataatattgtgtgcaagtaacaagttttaaagtagattgtgtgagtaacatgtcctttgtgtgacagtatatgtactacttatattttgaaaataaaagatgaaaaaataaagttggtatttgttaccaaaaaaaaaa

SEQ ID NO: 552 - DNA, 1961 bp, Pinus radiata
gagaggattcaggatttccgggcttttgaaaagaaagttagatttattgatggaagtggggagattgagtttcggaattccgtgtagaacggggtgagttgcgaggagatttgcagtttggggattgggtttttttcgagaggggcgatttgattttcccatttacgatgtcgaaggattgcgtggtggtttgtttgagtggcaacgacagaattcatggtcatgcggacgagaaggggttcgatcccgggttcaagctcttcgggaagactatcccggtgcgcgcagcggaggaaataaagcaggaggaacctgtttctgggcagcagcctggatctcacaaggaacagagcctggaaggcgaggaggaagttcagcaggagactggtagcagcagcgaggatgggaaggacgagagtatgaacgagggaaaaagtgaggggcagaagacggtgttgaagaaaccagacaagcttctgccgtgcccaagatgccagagcatggataccaaattttgttattacaataactataacgtgaatcagccgcgtcatttctgcaagaattgccagagatattggacggccggggggacgctcaggaacgtgccggtgggtgccgggcgccggaagaacaagcattccgtagcggcgtccacggtatcctcgcattaccgtcaggtaatctcggcggcttccgagtgtggccttggggttcgaaccgatgaccaggactctggcgtcgaccaggttatgatcccctgtgccgcgctgcctgcatcctgtgtgcggccgctcaaggtcgcgggttcgaggattcaagtcgtacctgtggatgtattggagtccggtgcctccaccgggactgtgctcaattttgggtctgaagctcggaataaaacacaacgtggaggggataacgatccgagcattgagaaatcgacaatggagtcttcttctgggtttggaaaagaggcgactgctcatatcaatcaagcagcccctcggccacagatggatccgtcacccaattgggcgaatggggctgctggggctgcgttttttggaggtgcctggtcatatgggtggaattttccaaacccagcatggaatgccgctgctgctgctcttacccctggttggcccggtttgtcttggcccatggttcctggatcctactttcctccgcctcctcctcctcctgccggatgggggcctgcaccatgggtttctggaccctgggccgccgccgctgccaccactgcttctaatagtcccgctgttgcggattctgggtctccaactctgggtaagaggccacagtctgaagatgggtgtttgtgggttcccaagacactgaggattgatgatccaggggaggccgcaaagagctcaatttggacaacattaggcctaggggacaagccggagtctgccatcactagtggggggatttttaaggccttccaacccaagacacagggcgctaaagattcaagaaaggcttcgcaagctctgcaagcaaatcctgctgccttttcaagatcgttatccttccatgagagcagctaatttcattcaaacagcccaatccagcaaaatgatgagtttgtgcagaaatactggttttgattataagagcagggttcagatatatatccatgttcttaccgtggcttgggaggtccatactcggacttataattgagagagccctaatagattgcctctccctccctttcatgctccggggaaggtgttagcagaacaaaatcatagagagagcctatatgaagagagattgcctgttaatgctgttcaatctaccctttacagtattttcttcctgattgctcacaagagttgattgggagatatacaatctgtatatgattacaatttttgcttccttttgggagtctatgcttaacttttctatttttggggagtctaaaaaaaaaa

SEQ ID NO: 553 - DNA, 2343 bp, Pinus radiata
attttgggcctccctttccctcctctcttcttttctgcacgtcctcgcccttaccaaacgcgttcatctctacctgtccccattcgccttaaaattcgagtttctcaagtttaaaccacttgtattccgtttccccatctccccaaaaagctgtaaaacggtatatatagagcgctctccagtctaacatcttggattgattgttttctgttagaaattcccatcatccctctgtgtcttcctccttttgaatccagagactgtttttatggtggctgtaaatgctgaaataatgcccaaattcgaagggaagtctgcgaaatccctggattcaacattcaagctgttcggcagaacgattgctgtgaaaaatccctgtgatagcagcagcaatggtattcatgtcgatgggattccagctgaagcagtgaattcagcagtccccaaggcttctgaaacgcatcatcatgatgagaaacagaagcagaatgaggattcagaaaaggtgggtaaaaagcccacaaagcttgtgccctgccctcgctgcgagagcatggataccaaattttgctatttcaataactataatgtcaaccagcctcggcattattgcaggagatgccagagatactggactgctggtggatctctgaggaatgtgccggttggggctggtagaaggaaaaacaagccctgcttcggaattaatcacaggcagatcatggatgacactgaaactggttggaatgatgtgcagggccaggcttctcgtgggaattctgataaattggtcaaggttgagccattttatcctgaattcgagaaatttagagagggcttgaatgaagcggcaacgccgaaagaaggtaactctaaaccccaatccataatccaatcccaatttgacgattattcacatcctagtacagtgaatttggctagagaaaaagtgggtaaggaggtcttgtttggttctgggaatcaagtgggtgccatgggatggcctgggaattctacccatttggccaaagagcctgagaattctacgcatgtggccaacgagcctgggaattttacccatatggctaaagagctagaaagtgttcagaaacccagctgttcaagtgagaaaacccagacaagtgccaccaaggcagattcggctgagcccgtggatgacctgacctctgattcaaatctcaaatcagaacccaaaaatatgagtccagacgggtcttcttcgtcttcttcttctatgaattatacagggagtccttggcctgtgtattacaatggatgctggggaagctttcctccaggtgtcgagggctctgagaaaaatagggtgccctggtacacaccaagtacaggatttttgccaacaggtttgaactggcctgtgccttctggagtaatgtggggcttgccttggatggcagggaatgataattctgaatcaaaaacattaggcaagcaccagagggaggaaacaccacaggcagtacctgaaaacaagaatagatctctttgggcgcctaaaactttgaggatggatgaccctgaagaggctgcaagaagttcgtttttgacaaacttggggttggaaaataagaaggaaggatccatcaagtctggggaaattctcaaaggatttcaattgaagatggacaacaaagatgacaaaaggacgacttctgtgcaggttttgtgtgcaaatcctgcagcactctcaatatcgtcttcttttcttgaaagcagttgatgtatgcttaaactgctttccaatatgatttggatatgttgttcgtagatgggaaaacgttgttcaacgcatttaagatcatacgatactttgttcctgagactgcctagttagatcactgcatctacagctttgttgcattctgcttaccttctccaaatgacctcccctgctcagactagtttatgtttgttaggttatctttcacagttgttctttgcaggtcatctatttcaaaagggttgctaagttatggaggaataactccatatgcagatggttctgatgtatatctatctcattctttggattctcaatgttaggatgcagcaatgcttgaagtcactggaacacttgaaaatcatgctttgttaatcaatcatttctcctccaaaaatgaggacaatggatgataacagaggagattctgatccctctgatttatatttttgctggcagtatggatttccccaaggttttttttaagatagaactcagttttaacaaaagtggcatgttgccattggtttgtacatataattcagagtggaacattacaacctgagttttcaaaaaaaaaa

SEQ ID NO: 554 - DNA, 1635 bp, Pinus radiata
gcattcgcacgtccaggggtctcctgtaaccattccagattatccgcgcactgtgcgacggtggctaattttgctgcttagtagttcaattttctgttttgggtattagttacagtaagagttcacttcagagcactggaatgtttatatgggtttcatttgagaatcccctaaatttgagtttcgattctgctctaggcaagaatagggtgtaaatttgagtttcgattctgctctaggcaagaatagtgtgtatttgtgaaaagagaaagaaatccttatagaaataggatttaggattcatgctctcggacatgggcatggacattgccagaaataattccagttttgtaggattccctggtctggaatgtcccatagagtggggcgaagcagccaagtccttcgacttcagttccattggagacgttttccgcattgaggacttgtctgagttctccaatgaggacattgccggacccatacccagtggctcgctttcttctctttcttctcccgggtcttctcagaacatggccaagcacactgtctgcgcctcttttctcaacgaaggagacttcatttgccctccttacgaagatggaattggtctagaatggctgtcggacttcgtggaggattcctttgcagctacaggaagttcgaattctggttccttggctgacttgtctaaggacaaaatcgacgacaacagggagaagaagaagcagaacccaaccgatgaagcgataatccctgaaataccgcctataaaggagactcccaggtcacagagggcggtgcccgggcgggctcgcagcaagcggcgcagaagctcaggagccccaattcgcggttggtctacttctgaagattacgcattgcagaatgagggcggcatgaaaactgtaacaggagcggacgctataaatcattaccagtcctcggcgccccagcagcagccaaggcgctgcactcattgtctcagccagcgaaccccgcagtggcgattgggcccgttgggtcccaagaccctgtgcaatgcctgcggtgtgaggttcaagtctggcaggctcttccccgaatacaggcctgccaagagccccactttcattcgatacattcattcaaattcccataagaaggtattggagatgcgaaatgaggaaaccaacgatctagaaggtctcgtgttcgatccccatctctcagattccaaacatcaagaccagggactgttgaaggttaaaattaaactcgctggcctagataacttgtcgtctcagagcaactaatgctagtcactcttgtgttacatagctgctacctagaggaaatgacaacacgaaatacgtctgtagcatattagaattgtttttacaactataatctctcttctataataaaatcttctctcttctataataaaatctcccctactatcaaaatgttacagagttcaaaaccattaatacttcatttctgtctaccaaattaatggttttatcttttaaattgctccttgtaattgctggacaggccctcgttctcatttattcttgtgacagtgcagtgtgactgtattcttatatatatagatattatatagtcatttgttttgtcataaaaaaaaaa

SEQ ID NO: 555 - DNA, 1575 bp, Pinus radiata
gctttctttaactctgcctcgctgccgacctgactctccattgctcaatacttccatccctcctcacattcttacccacgcgtgacttcgaatcaaagcaaacccaccagaggtccggcgttcgaaacccgggagaagaggttcgttcggcttgttctcatttttccgcccaaaggcctttttctatggatttccagactgccccgctctactgtccggatacctccgaggcttggggtgccgtcggggaggcgtttcacatagacgaccgcctcgacttttcaaatgacgacattggggcccctattcagaacgacgaggagaatagctcagagtctacagaggtctcggctggttctgccgaagcgaattattcttcggtaacccaagttacagaggagcttcctgctgccgagctctgcgttcctatggacacccttgcggacctggaatggctctcgacctttgtagaggattcttttatgccggaattgccttccgcctgcgggcctaccagcgagcaggttccgttaacagacggaaacaagacagcctctgatgataatgatgaaccgaagccacggagctgccaagccagctttcttgcggcatgcaacaaatggattccggtgaaggcacggagcaagaggtcccgtaccggcggccgcgtttggtctttcaacggcccgccggtacgccgcgtttcgtctttcaacggcccgcttctacccccaaatcccagtgtcgaatccgacggcgtggtttttacacagtcttcggactcttcttgctcggagtcttcccaaccacggccggcaaagaaatacaaaaaaacccatagcaagaaagcccaagacggctctcagccacgaaggtgcagccattgtcttgtacagaagactcctcagtggagagccggacccttgggaccgaagacgctctgtaatgcttgtggtgttaggttcaaatccggcagactcgtaccagagtaccgcccggcaataagccccacttttttgagcgaggttcactccaatagccacagaaaaatcctcgaaatgagacgccaaaaagaagaagaacaacagaggccagagctaacgtcccagacgtgttcaagcggcgccaacgagtcattttcagacaattctttaccgtctgaagagtcccttctagtttaacccacaggcgtgaaatgacgggaaaaaacgcggtgtaccattcgagagaaccagggcgacaaaaaagttgcagagcaactagcgcacacaatacgggcacttttagggaagaacattaaatttctccgtcatgtgacggcgaattcatttaaatgattacctagctcacctgtgtgtacgtagaggctcagtgcgtgagttttctcattgtattctgtacaatctttagaccattttgcaggttagatggatttagcttagattgagaaaagacttatttgggtttggttagtgttggattgaattatttcagggaatgtgaaggaaaaggtggattttattttacatttattttatttatttattggttccatttttcaatttaaaaaaaaaa

SEQ ID NO: 556 - DNA, 2138 bp, Pinus radiata
ggcgatgcccctgccaaaagtcgagtagctttactccttttctgtgtattttcgtaaggccagtgattaatacagagattatacgcgtgatcacaggattggagcacgaagctattcgacatccacaaaaatcgaaatgcctaaataaaggtaatgaagtttctatccaaagccatattcatagcttgggggaatggttagtgaagcaaaatcctgcagatcgtcatcagtgaaaggctcaacgagttcttcttccaatgcaggcgtaaatcggaatcctcttgagattggaaaccagaagtttgagtgctgtagagcctctattcaatttgggattcatcattctctctcattgctgacctaaatttgcccaatatttaaatggtctgattaccaggacaaatgcataaactcaaagatatttgtgaacgaccacatccactattttgaaattaacttgtacactgcattttctctgaaagctatgacttgcaccttcagccgccattaacagatgcaacttactagattattctagctgaactgtgcatagctatgcgagaaacatgtcggatacagacaatcttgatccagagtctcgagttattcataacaaccaccagcatcatagtttctatcctgatcggcaagcgccgatccacgctgttaatgcacatgctcatgtagctgcacaccatgcccctatgcatgggatactgatgcaaggccaaaatgagggagatcctcacagacatcaaggagcccaatttcaaggagtcgatagtgggcatatgcatatacattacatgcacagtgatgagcatggacatccattgcaccatagcaatgacaatggtgctggagaagaacaggatgaaggagatggagacaataattgcatggaggaagcagatattcaatcagatggcgacaatctcgcagaaccccagtcggttgtccctgtacgcagtcagggaacaaatcaacttacactctcatatcaaggcgaggtctatgtctttgatatggtggcaccagagaaggtacagcaagtgcttttattgttggggggtcgggaaataccaaatagcatggctggcatgcccattgccactcttcatcatcagaagggcttgtcagatgtttcacatcgtttaaatcaaccacaaagacttgcatctcttacaagatttcgagaaaagcgtaaggaacgttgttttgataaaaagatccgttacactgtacgcaaagaggttgctcaaaggatgcaacgcaacaaaggtcaatttacatcatacaagtctgattctaaggatttagtctctgccggacataagtgggattcagctgagggttgggctccaaacactaatgggacacaacaagaagctgtatgccttcattgtggcactggggagagatctactccaatgatgcggcgtgggccagttggaccaaggacactttgcaatgcctgtggactagtgtgggccaacaagggagtgctgagggacctttcaaaaagttccacatctttgggaagccaagagcaatctcagagctcacatgaacagaatgatgggggaccaggaagccaggagactgagctgggtgaataattgagttacatttcctccaccttttgtccatagtctgtcatgacatacatgacagaatcacttctctgtcggttctgttcttatagaaaattgaagaagcactttaatacacttctgttcataaggtgctgctttaaaattttccagcaagtgctggtgatgatcttctgacatcggttattctgtacaactagttttgtaaacagtagaataatttttcagtaagaaagagagcatatcatatatgggaacaaatataattattttataagcttccatgtggccaaatgtggtccctgcgactctaatacagacattaacaattagaaatacccaattgggagatgatcacacaaggcattattccttatatgttataccgttttagaaaaacagaagtagcagatcaaggaaaatgtgatgaagggatataaataatgatgtaggtttttaaaatttccacatgagaaaatctggtcggtgaccaaaatacaaaatgattaaccattaaaaaaaaaa

SEQ ID NO: 557 - DNA, 1812 bp, Pinus radiata
cattagtctagttttgggcttcctctgtgtcttggtatcaatttcctggaatgggctgatggctttttaattttgagtcagcattgcagccaacagctctaaacttaagatatctaaagactccacggacttgactttgtattgtgagtacaagtggataaggaatggaagctgctgattacctttatggtacaaactatggcactcccttcttagacgggaagaagtccagtgggaaattcacagagctcaagaatggtgtgcagttacaagattttttccacattgatgacctcttggacttctccaatgaagagatagctggacccattggagacgatgacaataattgggcaagctgcactactaccactgctgcagcagcagtagcaacagattcctctaccataaccttggcggagactgtcagctgcaattcctctctggacggaaagagcttcagagcgtacaatgttctggaaactgatgcaaacaataatggtcatctctgtgttccgtgcgatgatctggcagagctagaatggctttccaatttcgtggaggactcattttcaaccgaacaagcgcccaagccaatctttcctccgaactttggagatgtcagaacagacaaagaagaagagaagccccatatagcaaacccaattcggagcaccagtccattgtctgggttggacactagttctagttcgtggaaaaccccaagcttcagtccagaaactccagtgccagggcgtgcacgaagcaaaaggtcaagagctcctgcttgtaactggtcttcccgcatagtctcacctgcttcatcagccagtgcattagagaatggacccacttcttctgtgctatcttcagattcagaattctttgcagaatcctacttccctgcaaagaaacctgccaagatgagccaaggaaacaagaagagagagcaagaccagcagactcaaatcaggaaatgtatgcactgtgacacaacaaagacacctcaatggagaacaggccccatgggacccaaaacattgtgcaatgcatgtggtgtgaggtacaaatcaggcaggcttgtgcctgaatacaggcctgctgcaagtccaacatttgtggtctctaaacactctaattctcacagaaaggtcattgagatgagaaggcagaaggaaatgcaggacgccctacagcaggcctccaaactgtacccaaatgacaaggaagggaatgaagatggggatgaatatgaggaggatgaggatggatcagatggtcaataccctcattttggctcggatgatgatacttacttagtccatacaaatcaggattacaggcatttcatatgatgcaacaattcaacagtaaattccctaccatctgtacaatttttaatactaacaaagcagcagggagggaggcaagcactcaagggggtcttattcccccatcacagcagtacattccagtgtgttcactgggggtaattggtagcacaaatatctgtctttcaagtatacaggatgatgatcaacaagcgagggaaatgatgactggcttgttgctggaaggaaggaagaggggatttcagaaccaatgcatttgcatttattctttaattttgtagattattggatcatctgtttcttcttcttctatgaaacgttgattatcttttgaaattagagacatttccaatggctgaattagggtgagatcattaaacttaaaacatacatgaagtccagttagtttatatatctattaatggcgaggcctgctagcctttactgatcaaaaaaaaaa

SEQ ID NO: 558 - DNA, 3278 bp, Pinus radiata
gaacactttggacccggaaatgtttgcgtaaatcccggacaggcgcctctcataatatttccgcagcatcctcagctcacgagctttcattcggcttttgaattgtgatatttcatggactgtgctattttctatgattttttgaagccatctgttctgtgtggggtagtggactctggttttctttctacaaagggtttgccgtggccatgtaacctaccagcaaatataatccattagtgttatttttggtaacttcgtgaatgaattggcaaacattttgacctcagaaaaccctcgagtccgtactctttcatatcgacgttttactgatatttttttttttggttatattgttataaataattcaaatacttgtttttgcaatccaagcatttactggtttcttgttttttcatctctgttcttgttcgtacacaatttttttttttgttttcaatttttttattctctccatttattgtggggttttgtttcttaattggtcttttccaaattcatcgtaataatagattgtgtgccctgatagttatacgttttgtcactcaagaagcctgtctcaagtgaaacccatttcagagtctggattacccatgcaagcatatagtgctaaaagtgaacccttagcattttccccgttgttaggtttttattattgctccaatagtggctttattctcgttccattttgactaatgtttctgtacatataggcagtttatataacttctctggcttatttgctatcggattagaggcacgtgcattgaggacagtagtttgcgtttttcttttgaggacagtagtttgtgttttcttttcctttccaatgaatgagttctgcactagaaaataattttgcagtgcttaggttctttttgcaatttctccacctggcccatgaattgttgctcaaacgtatgttgacacagtgaggaattggtactcttgtcactagtttgtttcgtttcctggtcccatcccatccagtgcttgatttgaaattttgaacaaaccaacagtgtttatagggatattttgttatttgcatattacgtatatactggggcagactgagacattctcgaagggatctccaggaagtttgaaggaagtatacatgggcaagcagggcccttgctgccattgtgggatatctactacgccgttatggcgtaatgggccaccagagaagccagtgctatgcaatgcctgtggatcgagatggaggaccaaaggaactcttgcaaattacatgccaatgcactctggagggtgtggagccaatggttctttggattacaaatggcctaggggaaagaaagtatcacagaaattcaaagagcaaagatcacacaaaagaaaggaaccatgtgatattcatcaagacatggaatttacagtggcaaactccaaccaacatcatggaatttttttggacgaggatgctagtacgaggtcaagttcagtatcaggattgtcatattcagagggatgtatgcagcatcctggtgcatttgaaaagtatagcacagttgcatgggattctcctgtaccctcaaagaaacgcacttctatgtttcgccagcggccatcatctcttgaaaatcttactaaaagtgtgcaagtttcacatgggcaagatttgtcatacctatcaagttcctcagaacatgatctgctttatgaatgcaaggatcagataattactcctgagataggtcttggtggtgtatttattaggcaaccacattcagctacaagagaagaagagtcagaagccagttcacttttaatagacaataaaggatacagtaaatttgatgtttcaaatcaggcttattctggggtaggggacactcgtgtacagatatggggtgatgatataacaagatctgaaagatggatggaaatgaaagagctgaaaaaacttcttcaaagttgccattcgcctttaatatctattgaactagaggatgttgtaaactttgatacatttatggagctcttaaaggaagacgagcaaaggcatctggtgaaatatctttcttctgtcgatcattctggacttccagaaagcttgaaatgcatgtttaacagtggccaattcaagggggctttatccaactttcagcacttactttctgaaggcatgtttgggacttatgggtctaggttgagccctcaggtagaacgcctttttcaacaactcttaatagtaacagatttgacaaattctcaatggatagagagatattcgaaactccataaagatgttgacagcaagtgtgtcaacttttcagagattccagaatataaggaatccacaaaaacaaaggattttggtttgcctgcatattctgtttctaagccctggaaacatgccactcacaaggcattcatgagctctccaggtcaactgtccagccaagttattacaggatcagaaaagtctacaagaaacactgacaacatgcaaataggtgggcctaatacagtgaatcctgtcacgcctgcttgggcaagttgtaacatggaaggcatatgccatgaaagcatagacacagggagtacttccaaggatgctgccggatttgaaataaaaccaaagggtagtccttcacttggtgctagcagcctgttttcttcaccctcaaaaagatgctcgtcatttgtatttgactctctaggagattttgcagatgaagactctgattcagttttgctttttgatgtcccttcaaacctgtcctttccacaggcagaacttttgcacacccctgttttgaaatgtaaagcccccaaggacattgttagtgatgccagcaaccttgagaattcaaacagtggtggaccagttgtcaactcagaggaaagtcccgattggggtagccttctatggaactcttcatttattggatctggccaaacactatctggtggaactgtactgaacccggataaaacacacctctgaatagttcgatcaatcggtgttgcaagtgatatgctatagtgtctattttgaagttcttgtttctttttgagagagccctcaaaccccaatttggctatatagaggggtaaatgtttcatcgagttgtggtcaagagtgtatgatagctagttcggatccttgtgcaactgtgtttgttgagttgaaagtatacctgtgatgtaatcagacagagcagccttgctttgatatttctatgtagaaaatacaaaaataaaagagcttccctgtaaaaaaaaaa

SEQ ID NO: 559 - DNA, 741 bp, Pinus radiata
caaattgcttgaaaacgtgattcagacatgtcgaccagcggatttgaagtcggctcggatcacctctgctacgttcactgcgactattgcaacacaatcctcgcggtaaacgttccatgcaacagcttatacaggactgttacagtccgatgcggtcattgcaataacctcctgtcggtaaacatggcgcccttgttgcagtcgctcgcacaagacccgcagcagcaagggcagaacactggtacgtacgattacaatcgagatccggcatcttcatctactgtcattagggatgcatcttatttagaaaacgaagaagcgaggatgtcatcttacagacaacccgagaaaaaacagcgcgttccgtctgcatataatcgtttcattagagatgaaatccagaggatcaaagcccacaatccaaaaataactcacaaggaagctttcagcgccgctgccaagaactgggcacattatcctcatattcactttgggatgatgatggacagccgcaggcaagctaactcagaggatggaggtgatgttctgaacgcggaagtatgcaacaactgattactacgagtaaactttgcgctagcttgatcaatgtacctgcttcagagagacgtcattatgtattgtatgataatgtgcttctaccataggagtttaaaaaccatgttttattaaaaatgctttaatgatcagtttgatcattcatccatctccataaaaaaaaaa

SEQ ID NO: 560 - DNA, 1124 bp, Pinus radiata
gagaacagccgtctttccccgtacccaaataggttatatgaacgccctgatagcaatagcctgttagctgcatctctatctttaaccctaagtagctagacccgttttctatcgacatgtctgctgcttctcctgactgctctaacatagattctgcgtcaattcattctggatctgtcatcactgagggcgctggttcgattcccccagagacaagctagctacttggttattttatttcctgtgcagggttaatctcatctggggcttttttttttggtgcttcagcgatgtctggctgtattgattctgcttctgctactgagcagctgtgctacgtgcactgtaacttttgcagcaccattctagcggtgagtgttccttccagtagcttgttcaaaatagtcacagttcgttgcgggcattgcaatcatcttctatcagttaacatgatgggagcttcacctccacttgaagcgggacagatccaaaatgactattccagagattcagcatcgtcttcggcctcttcaacagttagcgaaaggacagcgaattcatatgctggcaacgaagcagcaaagatgttttccagcatgccaactgaaaagagacaacgagtaccatcagtgtacaatcgtttcataaaagaggaaattcaaagaatcaaagccaagaatcctgacataaggcacaaggaggctttcagtgcagctgcaaaaaattgggctcattttcctcatatacatttcggattgatgctagagaacaacaaacaagcaacaatggagaaaggaaacctcagggaaggtactcagattggaacagtaaaagatggaaggatgacaacaaacctatgttgaacctgcaaattccgttgatgtaatccctcaaaattcagagaagacatctacaggctgtaatttattactcaatagcttcttaagcattggcagtgcagtagaaaatttgatgaagggcatattatgtgaactttgtaatattttatttatatggcagcagacacttattgcggatgagatgtctgtttctgatgttgagtttcgcttgacgttgagtttttattttcatgaaatgcggatatctttctcataaaaaaaaaa

SEQ ID NO: 561 - DNA, 2470 bp, Pinus radiata
gcagcagcaacaattctgtcagcagcaggagcagattccaaacagagggcacgatcaggttcatcacccagttgggctgcaccctttacaggtcagacatacagtacaccaaccacaaccccatcatcaactccattttcaactgcctcaatttaatcagccacagccttcagatgaggaatacagagaacccatttcagaaaaacatcaagatgaaagtcatcaaggcccggaagaaggcaatgcaggcactagcagcaatgagaaaaacagagacgggtctcacatctcatacaccgattcttcttcaggagacttttctgaaaagaggctcttagctcccattgcggccggtcttggagaccccagttttgggggtgctttggcctccattaagagttctgtcacaaaccaggctattcaaaatcagcccacctcaatagacgttccttctgtggagcaaaatatttatgacccaaaatctgatggctctcaagggagtccccaatctcatgaagaaggagctgtacaggaaggtgctctgagggaatactcatgctctgcttttgttgataatttggaacaaccaaaggagaagaagaaaaggaaaaagctgaagcggttacacctccagttagactcgcttgtgcatcaaaaattgatgagaattgcatgtgatcaacacaatggcagtgttgaacaatttatcgttgccactttgaatgattcagaagtagctggaatgccggggaagaaaacagtgataaaaaaacccacactctcaaagtggaagcggattagatgaaaggaagtgaaacccaggaactggcaatgacattcagattgcttgctgcatcaacacctggatcaggagtaacatctgatttcctgtcaattccgtggcaggagctgacaatgtcacaaatagagaagatgctggaagaaacaaagaagatgctttttctgaatgaaaaagtgcatgattgttcagagtgcgggaaaaggtttgccacaccaagcagcttgaaggaccatctaaatgagcatagcggggacaagccatacaattgcaaatttgaagattgtgctatgcgattcaagagcaaacaattgctttgtcgacacttgaaaaaacatgagtgtgctcacaagtgtatgtttgaaggttgtggcaaacgttttgctttcagggaacgcttgattgtacaccagaaaatacatagcaatgaaaggccactagtttgtccttgggagggttgtggaaagagattcaaatggacaaattctcttcaaggacataagcgtacacacacaggcgaaaaaccttttcaatgcacgtatcagggttgtggccggcattttggctacaaagttgatttgacaagacatcttcgaactcataatggtcagccagctcgtggtagtcattaacctaagaaatggataaatgtttgcattatccgtgggttcattgtgctagagattgaccgccatctagtggtgtaactgatgactttaattgtcagtcattgatcatatttctgcaggtttaaaacacccaattctatggtgcatttgctacaaggaatgacctgcgttctatgtgaaaggatcacaatgtttaacattaacatcagagggcacaccaactagttctagtcttcttcacatggaagaaaccagattgtgcagagcaatcttaacttcatcaattcagtctttttggtaaagtggtctacatcaatttcttctctgcatgattgtggaagaatttattggttgtgggcagctgcacaagtccaagtcaagctgttcttataaaaaagggattagtggtggacatgcggtttttattcaaaacatagcacgatgatctctgacacagttcctcagaacattgtgattctacttgagcaaataagttgattgctattcactgtttcttcatattattgttaagtattacatgtctagatatgcatgccggggcagttatcttgttttctgtccagtgatgttgtgcccatggcgagaactgcctgttttactcatggaagaaaatcccgcccaaaatttcattcgacggagcctgtttgtacattttcacatgtacacacttacatgtgtccacatgaggttggatctcagcccaaaggcttgctgtctgctggaagaactgtgttttatgtggatatcgttctgaatcatacaaactaaatagaataatgtcatttgatttgtactatagcgaatgttacagaggctagaagcactgtttttttaaaataagcttcgagcttctcactggaattgatggatcggatatcacatgttctcgtgttgagatgtggtattccattttacacatgcaaactgttcacacattggctagttctgagtcctaatgcttgctttgcattgcaagaaagaacgttcataatatgtcaattttttacttgtaaaaaaaaaa

SEQ ID NO: 562 - DNA, 1632 bp, Pinus radiata
gctgcgcggcatctatctatctatagtttgtcatcgccaccgcccaagcactaggcttccctgattgctgcagctcatattattttttttcctcccgtgtttgtcagtcgtcagaaacctgcagcaggcggcccaattgacagagaacgcctgttgcctgcttcggcctctgcagatgcaagtgaccatcggcatttcttgcctgttcgcccttctctgccatgggaccatcttcctcaaagttcaagggtgggttgcaaccgtaagagatatgggagggactgcacgctaaagtacctgcctagtttgatttcagcctttattttgtgagggctagagctttttgatgggaaaatgtagatgcaagcacgcataagcatatgatgaatattatgaaaaattgtagcattgatttggaaggaagtgagagttatttctcagaggagtcggttatcagccagcaattatcagcctccaatgtttctgctggtctcgaatcatcattgttttcccagcagcagcaccaaccccactatatgttccaggtccaggagaacgtacccaaatctggggagaagtcttctacagaggacttcaaattggaggaaacttcagaggtttcgctaaatctgactatcggatatgatgatgaaggaggaggtactgttcgagaaggaaaggatctgcaaacctcaaatttcatcgattattttggtcaaagtaatcatacagaagaagcagaaaatgagcatgatgcatcagtggataccaaagggcccctggaatccagcaatgaagtcggccatcctaccacataccccgaatcttcttcattgtcagcgcaaggctctgagcctcgagttttttcctgtaattactgccagagaaaattctacagctcgcaggccttaggaggccatcagaatgctcacaagcgagaacgcaccttggcaaagagggggcaaagaattggggcttttcaacacaggtacataagcatggcatccctgcctctccatggctctacagaatcagctacaggccaaatgaaccgatccttaggaataaaagcacattcattgattcacaagccaccttatgcggagcccagtttgcctctgagccaccatggatggtcaaggcctcctatagaacagcacccagcggttgggaaatatgttatggaagatatgggtagcagcaggatgatagtgggtaacaggggtggagtagctagatttgaaaataataattttggtgcaggtagaattttgggagctaaccctttcctccacgaggaaccagctagtttttgttggccaggaagcttcagacggatgcaacaacagagtcaagaaggagggtcataccatactcagaatcatgagacttcttcaaatgcgttttatttaaaaccgcaggatgatatttccaagctggatttatctcttcgcctttgatttggaaaattttgggtttagatgtctaatatcatcttttgatgttcattccaaatccatatggcacattttggaacattttggtccaagctctggtcagtatgctaattttacactgtaaatgcttgaataattggaatcccgtcgttcaatttctgctttaaaaaaaaaa

SEQ ID NO: 563 - DNA, 1885 bp, Pinus radiata
gctttggctgtgtttacaccagtcttggtcatttctcgaagtgccagaaatggtgagaatacgtagaatcaactactttaggtcctctgcgcggatcaatccaagcttatcgttttaggtcatggtagggttttgtaacagttttgtgtcgttgttttgttctttggccggtagagaaaggcatgaagcaaccatggtgaattatgggtctgcaattcaatcattttactacagaatagaatagaatattttatttttacgtcctccataggatctacagcgagagatcattttttcatggtgaatgcgaataggtatctagcggcacggggtttcaagtcagccaacaaaatgaatacaaagtcagacaatcttcatcagtatacaagccttggaactgtggcagcagcagcaggagcagcgaattctgtttcatttactgagagtaataagccattagaggccccaataaattcgatatctagcccttcttgtgttcccctagcaattccttgcacagattcgtttgtgggtcatcaagtgcctcgttctcatgccgcaaatgatgtgaatattaatgatcagaatcgtgtttttttccaacagttacagcaaccgcctaaggagtacggtgggtcaccgccactgagagaagaactgcctttgctgctcagtctcagtcccccaagagaaaagcggagtggggaggagaggtttaggtcagatccagaagaaaccgcaatggtatctctgcatataggacctcctaacagcttatgtgagaagtctgaacccagcttgaagagtactgattccagcgatgcagacaaggagagtgtaatagtacagggcagatcagaaggcagaacaaggttttcagaaagccagtattggatacctacaccttcacaaattctcattggggctactcagttctcctgcccagtctgtgctaagacattcaatcgctataacaacatgcagatgcatatgtggggacatggatcgcaatacaggaaagggccagaatcattgcgaggcacgcagcctacagcaatattgctgaggctaccgtgctactgctgtacgcaaggttgcagaaataacatagatcatccccgggccaaacccttgaaggacttccgcactctacaaacacattacaaacgcaagcacggaatcaagcctttcatgtgctgcaagtgcaacaaaagctttgctgtcaggggggactggcgtacccatgagaagaactgcgggaagctctggtattgcagctgtggctcagatttcaagcacaagcgttccctcaaagatcatataagggcattcggccaagggcatgcccccatcgccccagattctttcgaagacgaggaagatttggggtctgaggacgaagtctcagtcctatctcattgattctatataccctaagaattatgcagctaagctccttgattgattgctgtcaagatctgctgtaagaattatccagctaagcttcttgatttattgctgccaaaatctgctgtaagaatcatgcagctaagcttcttgattcattgctaccaagatctgctgtaagaattatccagctaagcttcttgattgattgcggtttcttctttttctagaaacacatggttgctgactatacctttacacacacactcttacctgtgtagtgcaacactgtgggaacggttttctatgtagcagggtaagatgcacactggcagcaggagtcagtacagctgttttatgttatattatgtgcacgtactattattattatgtaacaactgtgaagtatgagctcccttggataatgtgagatctctgtgatctcaatgaaagggttacattctcactaaaaaaaaaa

SEQ ID NO: 564 - DNA, 1635 bp, Pinus radiata
agggggatcagtcaaagccacgaggctgccgtgtagctgatacaacagattttaataaacacatctttactgacttcttcgtgccccttgcctatgcctattccgtgtctcttcgcttaccagaccacatcagaagtcgttggacgaactcgcgttcgaatcccactgcactcacctatatttatgtgttctctgccattctgcttccatcacacgtctcccctgcttacttctgcttcaagctttagcctatcttcggctttacttgtgcttccagtttccccccatctggtgcttccaatttcgccccttctaggcatcgagctaaagcgtaagtgtagttgcagttgcagtaaacatggcagcgaccacgtatcttgcagaggaagaagaaggagaagattatttcttccaatttagatctccagacatggacagggagcctccccattttgtctcaagcatttcctctgccatcaagggcaagagatcgaaacgctcaagacatggacttcctcccctgcccaaatcagaattcactgcgcagcaagaacaagaacaagaacaagaaccagatcaagatcaagatcaggatcagtatcaagatcaagaagaagaggatgaacaggagatggcggcgcgatgtctgatgatgcttctggccgatggcagcgaccgccactcgcactcgctgaccactacatcttcctccgagtcccctgccccttccacactccacccgatcagacggaggatcaagaagccaaagaggtatgatgctgggaatgcagattttccatacagtcaggaatgggatgacggattcaaaccagagatgatgatcaggtcatacgcatgcaagtcctgcaacaagaagtttccttcattccaagctctcggtggccacagggcaagctgccaattaaaggattctaagtccagctttcccaagctgcttgttcataaccagagcgatgagggctttaaggaagcagcctcagcttcagcttctctccccaggcctcctgttgagacttataagcagagtttgtccaatgagattaagaaagttcgggtgcatgaatgccctgtgtgtcacaggaattttccatctggccaagctttgggcggtcacaagaggactcactccagtccccctgctactagtacaaataattcttcaagcctttccatcacggagcagcagcacctttcagccatgagaagtacccccgagttggatctgaacaggcctgctgaagatgaaaatgactgcacccaagtgcagcccagttctgcagtttcagtcagtttaggtggggacttcttgaattctaccgattggcctccttatggctacaaattcatgtcttataaatcccctcaaccttggtggatggagagccatcagcctggtgtggttaaagaggatgaagcagacagtcaattcatgagcaacactggatttgctagggggcgagatctgggctgcaaacaaaccggtttgcccttgattactactgtaaattagacttgtgcctgagcaaggatttagttggttctttcccattcatgtagttcaatggatgtaaacaggttctagatataccagttgcattcattctaaaaaaaaaa

SEQ ID NO: 565 - DNA, 1909 bp, Pinus radiata
gcagccacatctgtcggtcttgcagtttactattcctgtattaaaattcatttctctgcaaaaagcatggggtttggcaggggagaaaaagaggggggagaatgttgactgtcattccccaggcttaggataatgtgttgcaagtacgttttgtgggattcaatgacggttttgacctagttaggtcggcccagtcccattccacaatgcagaagccagaggaatatggtttagctgtgttgtctcagagagaatttagttatctggaaactatgaatatgaggagatatcatgctgatattggtgggtctccagctccaatgacagcccatcctagtatttccttcacagaatggctgaaacccaaaccctcttcagggatgctagctgcctctgatcttcccatggccattccctgcatggagacctttgatcccagatccaatttgaccacatatattccccccagtgccttgtattctgctcattcttatactccacagactttggaccagtgccctccacagctgcctgagaggtgtgattcccctcccttgagggaagccctgccacttctcacccttagcccttccaggaacccaactgaccataacctggaaaggcacgacagaaaagacgaggaggatcatcatgaccatgatgaggagcttaatgataatgtgacggtggccttgcatattggtcctcctagcactaatagttacaattatgataataactctggggctgctgtgagtttcaaggctgatcatcaatccgggagtaattatagctatgatcatgcagcagataaagagaaattacgagcaggaagggtccccgaggggcagtactggataccaacttcagcacagattctcataggacctactcagttctcatgtccagtctgtggcaagaccttcaatagatataataacatgcagatgcatatgtggggacatggatctcagtacagaaaaggtccggagtctctgagaggtacgcagcccacagcaatgctgaggcttccatgctattgctgtgcacaagggtgcaagaacaacatagatcatcctcgtgcaaagccactgaaggattttcgtaccctccaaacccattacaagcgcaagcatggcatgaagcctttcatgtgcagaaagtgcagcaaatcgtttgcagtgagaggggactggcgaacgcacgagaagaactgtggaaagctttggttctgcacatgtggatcagacttcaagcacaaacgctctctcaaggaccatatcagggcatttggccatggccatgctcctcaaggggaagctgacaattattcctttgaagatgaagaggaccagggttctgaagatgatgaactctctggaggttcccagtgatcagtacatcagcaagctcaacagatcatcataaattgaattactagtagatttatgctgatctgttgcaggaataaaacactgtttttaggttttttttagtgttttctcttcaagttttaagactgcatgtatgtatatgggaagtgtgctgactaacaaaacactcttatgtattgagagtggtttgttaataagcacaccgggggatctatccacaccaagaaaatggaaaatggcataccagtacaaaatgtgtatgcatgaggtcttacaacctgttcactaggttctgtgaagtagaagaatttccactatatacatgtcaactatactatatacagggattttcttttcctataaggcagtatacggccttagtgcaactggcaattcatgtatggactctggccaacccagtccatgtagtcgatttagcaccttgttctttgactgcagtattattgcaaaaagctgcattgaagtacaacagtactgaggattaaaaaaaaaaa

SEQ ID NO: 566 - DNA, 2838 bp, Pinus radiata
gttttatattttcaaaaacacagaaagggtaagcggagaaaataatatctacgcggctgcagcaaaaccttactatagggtagacgaagaacagaacatcaatccaactgcagcaaagcgttgcgaatttagcggaacgtttcttcagtaattcattcgaaatattggagggattgattgatttctcataaacaatcatgccaggcttgacctgtaacgcctgcaatgccgaattcaacgaggaggcggcccagaaatttcattacaagtccgaatggcaccgctacaatcttaggagaaaggttgctggtgttcctggagtgacagaagccttatttcaagcaagacagcaagctttggctgaggaacagaagaggctggagagcaaccggatgttgtatagctgctcactttgtggaaaagaatacagaagtgtcgaggcacatgctcaacatcttaagtcaaaggctcacattcagcgtgcttctgaaacgccagcttctcgaagtgctggcattactgtcattaagccactaccagaacgtgcagcaaacaggtcctcttttgtcagcaaaccttcttcttctctgaatgaagataaatcggaagaatctgaaggcagtgaagaatgggaagaggtcgagacctatgacatggttagtgtagcatcagaatctatgaagagtttggatgttaatgaatcaagtttaggaaatgctggaggcagttttcagtcgatagcagagaagttagagtgggatgccagctgctgcttcatatgtgatttcaggccagatgggaccattgagagttgtgtagagcatatgcacaagatgcatggattttttgttcctgatgctgaatatttgaaagatctccgtggattactaagctatcttggcctcaaggtgaccaacgattttatgtgtttgtattgcaatgagaaacgaaaaccatttccaagtctagaagctgttaggaagcatatgatttctaaaaaccactgcaaattacactacggagatggagatgaagaagaagatagtgatttagacgacttttatgactacagcagcagttacgcggatgaaagtgggatgcaaatagtgcccacagaagaaaatctcaatgtcaatattgaacttggctttggaggggctgaactggtaatccaaagaaagtctgaaaatggaacaacatgcaagatgcttggttctcgtgaatttcttcgttattaccgtcagaggccacgcccaacggttgagagagatgttgctctttctcgtgcattagtctcaaggtatagaagcatgggtttggcgactgtgcaatcaaaagagaagatattgaggcgcaatgcattaaagaaaatacaacgttctggagtggaggcaatgcggacaaaagtaggtcttaagaataatgtaattaggaaccttcccaacaatgttccatattgagacagtcctttcaattcttgtgattgtaaacaagcacatgaattttctgtatcttatcaaatataatccagtggatttttagatgacatttaaagtcttccatttgaagttgcgagtttgaacagttgctagatgcaaatatgatgatatgtaaccatccgacatgcctttatcttagtaaggcaagtgacatggataattttccagttgaagtgtaccaggtttagaaaattactatagttttcatggtaatcttatgatctatagccacctcacatgactttattcattattgtgtgagatggtaagacgagcgagaaagccgaaggcaaaagttgttgcattgtacatgcatggctgagcggagacccttataactagcatcatctgtttaatctataattcatataaaatgtatgagacacccgtgaggctttgttcaattgtaaaagcaatttttttttctccgcctcgtgccgaattcggcacgagggtcgtttctcagttgatcgagtttaaaagctgcgagggatttcatcatacgccacagtctcctctctggtatttttgcgaagctaatagatttgcgtttgcccgtttcgatccaactatccagtgcaaatggcggagcagttgaccgaggatcagatcgcagagttcaaggaggctttcagtctgtttgacaaagatggcgatggctgcattactaccaaagaattgggtactgttatgcgttctttaggacagaatccaactgaagctgaacttcaggacatgatcagtgaagttgatgctgatggaaatgggacaattgattttccagagttcctcaatcttatggctcgaaagatgaaggatactgactcagaggaagagttgaaagaggccttcaaggtttttgataaggatcaaaatggtttcatatctgcagcagagctgcggcatgtgatgaccaacttgggagaaaaactaactgacgaagaagttgatgagatgatccgtgaggctgacgttgatggagatggtcaagtcaactatgaggagtttgtcaggatgatgttggcaaaatgagatgaatgtaaaccttagtatattttaaacataatcggggtacattatatagctagctaccttcctgtttataatgtttgtccgcggggagtatcaataaggacattcggaggatgccctcttttgtttccatgttctttgggcaaccctcttttgttttgttagaatgctaagcgcggtagcaatagggaatggatggcatcgctttgattctatatgaatgatgtagtggtggagatgtaatgtttgcgggacacaagaagtgtttcaattattcgaacttgcctaactttatgtaaaaaaaaaa

SEQ ID NO: 567 - DNA, 1909 bp, Pinus radiata
caaagacacccaattttggaattattaacaccttctcctttttgggctattcctcctcggcttccatgccgtccaagcgacaaaggcctgaaggagaagcattgatccactgcaacaaggctgcttctgcttctgcatctgcttctccactgtacaccgatgcatgtcaggatagagatgcaggcacaagcacaagggcctgcatcttgaaagaaggagagaagaaagagaatattggtgctgctctgtttctcaatagtggctacccaaatgagaatttggcttctctgcagtaccccactgagacctcaatgggagaggaggtggcccaagaagaatgcagcaatcaccttggatccacttccatggaaatcaagaacaagaaagagacagtgacagtgacaaatcctaaaccgttgcagcggagtttcagtaccacgcaaagagattatcaccagcagaaagatcagtgtagcgaagaggtcaccgatgaagctgcagaggggcgctgtaagcgagagaaatccatgaaattgtttgggtttgaactgaggcaaaaaaaggttgaagccgagaaccgatcatcagggtcggcgcatcatgatgatgacaacaaggttaacgaagaggatgtggagggagaagacagatcgagtgcagcacaggctgcagaaagtggcagcaattcggcttccgacagcagaaagtacgaatgtcaatattgctgcagagaatttgcgaattctcaagcattgggtgggcatcaaaatgcgcacaagaaagaacggcagcaggcaaagcgagcacagattcaggccagcagaagcgctgctgtggccgctgctcatgccgcgtctgccaacagagcggggaacgctggcgctgctgctgttgctgtgcctggtttttatggcatgcatcgtcttgctgggtctgccctcttgacgcctcactcgggtcgaatgactgttttgggaggtgagattcccccgccttcacctgcacctcgattcccagcacctgtcattgcttctactgtgccacattatttggattatcagaaccaccagcagcccgctggtatgggattcggatcagcgctgcgccctgcaagtgttcggccttcatggttttacgttccacaaactggccagtatggtttttcttctatgtcttatggagacttcgggtgctcgaacatgtattcagtgaacccacaattcccaacagcaacagcaatgccatcaatccagtccagacactgtagcacagataacagatacttaatgctgcagcctcagcctcagcctcagcctcagcctcagcctcaacctcaacctcaacctgcaatatcagaatttgaagctcctggtagatcagtatccaggccgctttctcagattggtgttagcagaatcgaagctggaaactcaagctcagtgcaccatgaatcttccacaggagttgaagatagtagtttggatctcaagttaggtcttggtcctacaagatcctaattttttttgcaattttcgatgtccctgcatatctttcctctctgttatgatataacaaacgactttatatatcaatggcgatgaggtgggatgtacaggcatcgattttgttagatgaatattgcagcatgcaacaaagggatcagctcctagtccgcccttcttgaaaggtcatttgctttggctccctaatttttgaattctcctttttctgatgatcggctttacttaattagggttacgacaggctgttttaaaatgctagatgaagtgctccaacaattcatccatttgcagaacaactgtattgaatcattcgggttgctaatcatttcggctcattgcctgtttttaatataattatgatggctcttcaaccttcaaaaaaaaaa

SEQ ID NO: 568 - DNA, 2407 bp, Pinus radiata
tatttttgccacatcccggccagataagcccccctcatttctcctataaactacactcgggcaaacccttccctgactgtgtgtaacaatgtctagcttggcatctccgtctgtggatgccagcgcttcctctagtaacagaggggatggtaactcggtacagcagcaattggcttccaatgccgaccctaacagtggagtacaggcggttcctgtgaagagaaagagaaatttgccaggcaatccagacccggatgcggaagtgattgctctatcgccgaagacgctgatggctacgaacagatttgtctgcgaaatttgcaacaaaggatttcaacgagatcaaaatttgcagctccataggcgcggccacaatcttccctggaagctccgacaacgaacgagcaaggaaatcaggaagagagtctacatatgtccggaaaatacctgcgttcatcatgatcccaccagagctttgggtgacttaactggtatcaagaaacacttttgtcgaaagcacggagagaagaaatggaaatgtgagaaatgctccaaaaaatatgctgttcagtcggattggaaagcgcattccaagacttgtggtacgcgggagtatagatgcgactgtgggactctcttctccaggagggacagcttcataacccaccgagcattctgcgatgccttggctgaggagagcgcaagagtttcgggtggaataacattaggtggccatggccagctgctgggcgttcacagtagcgattctctaggccaacgaggtgctcctctgcctgtgatggggacatctaattcgtctcatcatttggtcaaagaattgccacagagcttgcacagcacaatctcttctcgtttggctttttcagagagttctgaaccagcgagcagcaatgcagctggagcattaaaaccaaggctgccgttgtggttggccccaggccggggtcctccaggcggtcattcccaagtgaacacaatggaagcagctgcctctgagtttcttgatgcgcagtcgccgaaaagcatgcttcaagttatgccgcctccgccgaaatatgattactctcaaggacagaaacctttgtctggcttgttgccattgacatcgtcaaataccgggagcggcaacctttattccatgcttttcgcaacaggatcgggtcaggaccaagctatgagttcttctggaaatatagagcgaagttctgtgactggcgctacggattttggaccaaggggcacggactggaccgatcgaggatccgctgggttgacaagcaattcatcaggaaacaccaatggcaataaagttgacagtcttcccagcctgccttacttgtatggccaacatagcaacagtggcactggcactgctcaaatgtcagctacggctttgcttcagaaagcagcgcaaatgggtgcaacggtcagtagttcatcattgctaagagggtgtggttcagattcaaccccttttgggttaggattatgctggcaaggatcatcacaagaaaagcaacgagaagatcaaatgtcagggatggcatcaagttttgtcaactctcatgctctattgaaaggtcatccggatgttaccgcacagagcaactcattcgcagcgggaaacaccagattttctgaaaatgcagcccttcaacaggtgataagctctttatctgaagggtttatgggatccctatatgaaagagacttcaacaccattcaccactccacatttggggaaaatatcggaaccattcgacgcagcccacaacaatcagttatgcaaggaacccatccattaatctcagcaaccatgagaaatctcaacgcgcgaacagaagatggcagtgatggattaacaagggattttctaggcgtgggcggtgtaaatcccatgatcactgcagctactgaaggaagctgcatgggaaggtctagtcttctcaatatctgttcggggatggacagttacagcaatcatggcgaaaatcttacatctattagaacggacgttagtcaatcgccagcgaaatcatgggatgcctcatgaagccgcgcagacgatacaatgttgcagtactccatcgaacgggaagtggttttggccgggcagcgcgccttcaccttccgggataaaatattgtacgctaaaattcgtaggtaagctctttaaacctattattggattcatcttatcgacagtcagtttaaattcacaaaacaaatgcaatggtaatgaaaagccaggaaggcctgaatatctcaattatgtctatgtctacttgtagctgatgactgttcaatgtgcaacattaaattgcagacactattttttctctaatatttttatacgcacttcccttccttataagcaaaaaaaaaa

SEQ ID NO: 569 - DNA, 2372 bp, Pinus radiata
gcaggatacaatccagctgggtgggagcttcctcgtctacggctttcaggtgcagctggggagtgcgagctgatacgataggacaggatagatgggcactgaaaatagccagaagaagaaggattccattttcgatctaccggcacattatttcgactccgcctcgcttctccgcttaccccatgatactgccaactcagcaactgcctcccacaaggtgtccctagatttagatttaggcgtgtccagtctggacaccccaattccaaatgaaactgaatatggagaaaatgaagaggagaaacagagcatgggcacgggcatgggcgtgagcatgaacagatggagttgtaagacgtgcacagctgaattctcatcgctagaagagcaacgctctcatttcaagtcggatttccatcgtttcaatgtgaagcggagaattattggaagaggtcctctcaatgaagatgaatttgaggaagtagcacagggaacatttttgaaagatgatgacatttctagtatttctggatcagatgaagagttggatgatcctatcacgtgtggctggcaacctcgaactgagtctgtgaatagatccatgagcatgaaaaaccagattttaatatccctacagtctggagaaattgtctcaatttggaaaagtttgcttttgggtgacagagaggatctacttcctgaacataacaactctatggtcaaagagaatgatgctaagagtttagctttggctgacaaggaggtgattgggaggttgcaatccttggttaaagaatctcgagatcagaaaaacttgagggttgtgttgcttgcaagtggaggacattttgctggttgtgtttttgatggaaataatattttatctcacaaaacttaccacaggtatgtagtaagggcaaaagcaggtggcaggcaatcaagcaaagattcaacggggagaatgccaaagtctggcggggcttctctgcggcgttacaatgaaatggctctgaaaaaggagattctagagttactagctgcttggaaatgccacttggactcagctttgtgtatttatatctattctccttcaataaatggtcaggtattttttggtggtgaaaatccaccattggtttatcatgataatcgtgtgagacgtatgtcatttaccgtacgcagacccacactgaaggaagcaaagcggatttaccatcaactgacatctgtatatactgctgtgagaccagagatccactttccaaatgaactaggagaaccacctttaaactcaaaaaaagggaaagaggatgccacagaggtcaataaaacaaaaattaaaagcaagaacaaaacagaaaaggcaagtgttcctgaaacttgttctgatttggaccatcaggagagttcagtgactgaaactagtgatattggtaacaaagcaacggtaaatcagtcaagccctctccatgaggcagcaagatctggaaatgcagcacgtattttggaacttctggagcaggaaagtaacccctgtgtcaaagatgataagggtcgaaccccatatgtattggcagctgacagagaaacaaggaatgtctttcggcgtttcatggctgcaaatcccaataagtgggattggcatgcagctaatgtacccagtccactaacggaagaaatggaggcttcccaagcagcaaaacaggcggagaaagatgccaaacgaaaagctaaagcaaaggagatgaaaaagatacggaaatcaaagcaaaaagcgcaggctcaatccaccagtttagaagtagcttccgttgcagtttgttatggacagaatgctgtctcagagctacttgaaaaaggcaaagcattacccaacatgcaatcacatgcatttcaagaggatttaaagaaggtgcaagccatggagagagaaaaacgagcagctgctgctgagaagaggatgctagctctcagcaaaaattttgggaatgttttttctgcagtatcaagcaatgtaggatttagggacatgaattttgatacccattgctcttgctgtgcagcctttctggctggaaaggtgccattccccagatataactataaatattgtagtacatcctgtatgcatccccatagagaaatgctcgaggatgaatagacttttaggcattcctgctgttccaagaatattgcccaggaatgtatatttttacagttcaaatcaaaattttgagtgggaaaaagtttgagggccaaaacctgcaaagctatttagcatatggttatttttttacaacttatgtgatgactactttagcatcattcatacctttttattttgaaatttagtcttttcttgaaaaaaaaaa

SEQ ID NO: 570 - DNA, 3080 bp, Pinus radiata
agatcataaaaacttatattatattttcatatattttcataagagaacacccgtatatccatttgctcatacattcattcaatagctcgtctcactgcaatgcattacagatcagagctctgcgctgatttatagttttgacggtgcttttaccctgcatcataaagaccatttagcgagatttgaactcgagacgtcactttggtagaggtttcagctaccaggctcttgcatttcgatggcggaggtgctggacatacccccagaaaccctagatcggcgcagggaccgcccatctgaccgcaaggagaaggaaaagccatcggaagaacgcagtaagcgggacagggattcgagagaacgaagagacgagagagacgaccggccacctcgcaggggaggagactatcacgaaagaacacggtcacctgcaataggcagcgggggaggaggcccctcgagggattacaagcgtcgccatagccccagcccgcctccctacatcccacgtgatcgtcgccactctccgccttcgaggcgttctcctccttacaaaaggtcccgcagagatgatgtctatgacagtcgccgcggcagccccagggcaggctttaatcccgacgatagaaggtttggttatgataacatgggaggatacgatagaagtggaatgggaggaagatctggatatgttgatgaaagaccccacagtcggcacttaggacgtgcatctggtggcttccaaggtggatctccggactggccaggctctggacgtgctggctttggtgagatgggcacccctcagcgggaagggttaatgacctataaacaatttattgctgaacttgaggatgacatatcgccagctgaagcagagcgcaggtaccaggaatacagaactgaatatatcagcacccagaagcgtgcattttttgaagctcacaaagatgaggattggctgaaggataaatatgacccatcacacctagaagctgttatacaaaggagaaatgaaaacgcaaaagcaacagcaaaggagttccttttagacttacagaatggaaccctagacataggtccaagttcaactggttctacaccattaactgcaaaaggtggtcaagggagtgaccacaattcagatgatgatgctgaagttagtggcaaaaggaggagacatggtaggggccctgcaaaagaaaatgaccctgtttctagtgctcccaaggctcctcctgtgagttctgaaccaaggcgagtgaaaaaggatatagaactaggacaggctcttattcgcaaactagattcagagaaaggtatagaagaaaacattcttggtagttcagagcaagacaagtttgaaggagacaaatctattagtggttcaattggtgttgtaattgtgaggggcacaaatactgttaagggccttgaaggtctggagcttttggatgtcgttgctacttatctgtggcgagttcatggattggattactatggaatgattgaattgaaagaacctcccaaaggtctgcgtcatgtgagagcagaaagcaagaacaatcatgatgaacaatccacagctgcagctgaatgggagaagaaattggattctacctggcaagctaggttgcagggtcaagatccattagagatcatggcagcgaaggataagttagaggctgcaactactgaagccttagatccttttgtgagaaaaataagagatgataaatatggatggaaatatggttgtggagccaagggttgtgccaagatgtttcatgcaacagaatttgtgcataagcacttgaggttgaagcatccagatcttattggggagctaacatccaaagtatgcgaggaagtctattttcagaactacatgaacgatccagatgcgcctggtgtgacattgactactcaacaggctggacagagagacaaggcacgaagacgtaaggctgggcataatctttctggtgatggtggccaaattggtggaacaagccgagctagagatgttgaccatcctgatcgggcaagtcgaagggaaaatgagagaacagacagatctcatgaagatgatcgttatgataggaatgatgattcatcacctcgggattatcaatccatccctggtgggcaagatgttggccaccatgatccttcaatgtttgatccctttgctggaccaggaatgcgtggaccgcctccttttggttcagatatgccacctcacctacctgttttcatgcctctgccaggagctgggcctctgggcccttttgttcctgctccgcctgaagttgcaatgcgtatgctaagggagcaaggtggacctgcaccatttcatcccaatgatagtaatggtggtctgcgtgggaggaaaggtcggtcaggtggtgggccttccatgggaggaattacagatccaccaatgatgcttccgatatcaccaggattccgtcaggatcctcgtcgtatccgcagttatcatgaccttgatgcaccagaagatgaagttactgtaattgattatcggactttgtagatcatcttggtaaaaaatggtgttcagctgcgatgaactgcttagtgagcaagttgatttcagcaatatttttgagcttattttgcgaacacagttgtcttggttctcatatgcttgttttggagcgtattatttgatatagcatggaacataagagccatttacttcgtattggttaatgctgatgcatcgttattatatacagcctcaaaagtcgttgaggaagtttcaatttattactctaggtgtactatatctttggtgcaagtaatagccatagctagagtatgctataagcttttacagggagtcttgttgccgcagctagctaggataatgctgcaattgactttatcactgtttcgtacactgatgaaatctaaagttactggcttgcatttcaatttgtacttcttagctatcacttgtacttgtgataagactaaactgttgctatattagatagtataatgcatccagcactggagttcaacaagacttcagtttgaaacgaaaaaaaaaa

SEQ ID NO: 571 - DNA, 1969 bp, Pinus radiata
tcaaatcttttgtaatgaaaagctacatcccctggcttttaatgaaccagcaggcattagagattacagcctccagctgcaggaacagcagcttcagttgtttgataatgatagttacttcaattacccagagatgcaggttggctctttgaatgggaccaaattaggcatggagtttttgaattttgggactgggaaacgacctacgcagatggctgatgtcaagccatgcctgtatttcgcccgtggattctgcaaacacggcagcaattgccgtttttcccatgctgaaaactatctttcagttccagtctcggcgagcagcagcccttctggatccgtgagcgatgagccaatctccagtggatcgcttgagaggctagagttggaattgcaggaattgctgagagccaaaaggactcccatttccatcgcctcattgcctcagttgtactatgagagatatgggaggactctgcaggcagaaggctacttgactgaatctcaaaggcatggcaaagcgggttacagtctcaccaagctcttggcacgcttgaagaacacagttagactgattgatagaccacatggccaacacgcagttgttttagcagaggatgctcccaggttcacagaatacaggagtgaacgaagcgacataacagcaggattgattgcaggatctcgtcagatttatttgacattccctgccgagagcacttttacagaggaagatgtatccaattatttcaggacatatgggcctgttcaggacgtgagaataccctaccaacagaagagaatgtttggatttgtaacgtttgtatactcggagactgtaaaaataatcctggcaaaaggaaatccacattatgtttgtggtgctcgtgttcttgtcaagccttacagagaaaaaggaaagcatggagacagaaagagtaccgagaaacttgaccattcaaaatacatggcagcggcctacaatctcgatctggactacgatttacaacttgggcccagaatcgatacctccgaggtaatgagaagacagcttctggccgaggagcaggagcaagccatcgagatggaaagaacacggttagcagagttacatttattcaaccaagtctccaaaatcacaacggtcaataacgccattgtgactcacgagcaacataacgattttgatgatgccaaagcaacagatcaagatctcaatgacttctcgctgacagatcacttcagctatctgctggaagtgttgaacagcgattccatgagtggagaaaagccaaagaataacaacaccagtgaccaagacagcagccatgggcacaaccttccggacagtccgttcacaacaccacgtgcatcatatacagccaacaacatatcggcagccacatagcaactcgctgttgggtacccaccattaaaaaaattgatcatacacagcgtattataatcgttatcattattgtcattatactctgaagccggcactgcatttaaaaaaagtcgttgcagttggagagacgacagtgtactcattctgctccaacacattcaagtggacacgttgatccccacctggggttgggacacacagctcctagggggaccgagcaaaaaaaatccactatcaattaatttctccactccaaattattattactatatagaaacaaggacccacttgaatattttaaatctgaaacgaaatatctgggatcccatccccatcctgtaacagaagcagcaacaacagcttccccccttccctcctataagtacagtatcatccatcaagcttcaaaagattgtaccagacatgatataagtatcatgaataaacatcatgaatgaataagataacaaatacagtatacaggaatattaatggagccctcagcatttctggctccctttcatttgatcaaaaaattctccttttcatagtcaatgcaac

SEQ ID NO: 572 - DNA, 1407 bp, Pinus radiata
attcgccatcgccttcctttatcgacagaagatggtttgaatttcctctcccccgaatatcaaagaaaagcaactggacttggaagaaccagctttgatttgcaatggcggagccgaacgaaactggaccttcccaacagcagacgtgcaattttttcaaaaaacccacaaggaataaaaacataagaaaacgcgaagcagaggaagtaacagaggaagagaacaaggatggctccgctgttgttcacaagcccaaggctgcgaagaaacctgataataagttgcacttttcatctggaccttcgaaaaaatctaatattgaagataatgattctgaaacagcggggttacctgcttctacctttttttacgaatcctcaaaggaaattcaggttcagaatgacagcagggcaacggcaaccctagagacagagacagagtttaccaaagatgcgagggctatccgagagcgggtgcttaagcaaggcgaggagtcactcaagggtaataatccgggcgatgaaaaactttataaaggtattcacggttataccgatcacaaagcaggttttagaagagaacacacagtttccggagaaaaagctggcggtgcgcatgggcctcttagggcttctgctcatatcaggtcttctataagatttgattatcagcccgacatctgtaaggactacaaggagactggttattgtggctatggggatgcttgcaagttcatgcatgatagaggggattataagtctggttggcagatggagagagaatggcaggaagctgagaagaagcgaaaaaataatctggcactgggattgcttgaagaggaagaggaggaacctgacagcgacgaagatgcattgcctttcgcgtgctatatatgtaggcagcctttcgaggaccctgttgttactagatgcaagcattatttctgcgagcactgtgccctgaagcatcatgccagaaacaaaaattgctatgtttgcaacaagcctacaaatggtgtctttaacactgcccatgagatccggcgaaagatggggaaagacaatgttggtgcaaaaaataaataaataaatggcattgatgaaagcagtaagcactttacttgtaatgatgcaatgctttaaattatgtgagtgattcatcatcgtgactcacaattatagctacactatttctccctctagctatctggctcatcaagctgtactctacaattcctgaatttcattcagttcactaaaccttttacttatgttctaatttgattttagtttattctatttggatgttgctgttctggaactaggttggtgataaggcatgcactgtactatgctgttcttagttatgatataaatggcagttccattgaatgctttaaaaaaaaaa

SEQ ID NO: 573 - DNA, 1518 bp, Pinus radiata
ctctatcgctgtctcacccccgaaacctaggtctacattgcgagagttacgcgacagcttgtttctacactgtaactggcattgatattgggcagtcatctgtaagatttttttttgagttgtttgtgtctttctgggttttgttttaagggtttttcgtgcggtttgagctattgggttggagatatcgagcttagacaagggttctgagaagatttattgtttagttgggtcgtatcatataggagggtttagctcgaagatctcatggacccatttgggcacgcccgcaagaaggcgaggtccgagaccattttgaacgaaaatggtggtctgttcaatccccatgagagtaacatttttggggatggcaacagattcaaggccggtggtatgaaattcgctttacagccagaaaaggagtcgttaccaacaggtttaggaagcaaatcaaaggcatgcaccaagtttttcagtctttctggatgcccttatggagaaggctgccatttccagcattatgttccaggtggagtgaatcctgttactcagattggaactttggggactgcattgggtgcagcttcaaagaaacctactggacttttgccagcagagccaacattaaatgcatcaaattacaagacacggctttgtagtaattttggtactgatattggatgtcgatttggggacaagtgccattttgcccatggtgaaaaggagcttgggaaggtaaatgcagtggcacacaatctcaaagatgatctggcaacaggaccttttggcagtaggttcccagttggtggcttagatggaaagcctggaggtcgtcctggctatcatgaggctactcctcctggtatggcagctgcagctacatttggtgcttcagcaactgcaaaaataagtgtcgatgctgcacttgctggtgctataattgggaaaggtggtgtaaactctaagcaaatttgtcgttcaactggtgcaaaattggctataagagatcatgagtctgatactaacctgaagaatattgagttggaaggtagttttgatcagataaaggaagctagtgccttggttcgtcagctgatcatgcacacgagtgctacactgcctgcaaagcagccttcatttactacaaacaattttaaaaccaagctctgtgaaaactatgcacaaggcacatgtacatttggggatcgttgccactttgcgcatggtgccagtgagttgcgagacaactctaaataattctgattttctttatactcttcatttatgggtatattctagaaaggtactgtatcacaagttttgagccagggattgtagatggtgaggattagtagttattgcatgtttattttactgctatgggcttgcttgaacttgggcatggcctattgtagggtgaagtgcgcacattatatttcccaatttatttgatgaaaacatttctgtataactgaaagatgtttgaagtagatgggcttttcttttttaaaaaaaaaa

SEQ ID NO: 574 - DNA, 1529 bp, Pinus radiata
gcttaccagagagctatgcgtagcttcatcgctgattagcgtatctgaaatcaaggccaaattactcttgttttcttctcacaagcgtgaagaaatctgttattgttgcactctgttcgtaccttttttgagctcgtttcgactttatcagagtttcttttgtccttttaccctcggagagattgggacgcgggtttgtgcggttttattgaggccttgtgctgcgtttacaggggcttcctgtgtgtttgggtttgaagctgggactgtttgtgggttctgcccgatttatctgctcagagagagggagagatggacccatttggacctccgcgcaagaagttgagacctgaggttgagtttgtgaatggtaatggtgggatccacacgcatacacatgcacttacagatgtgggtactcgacggttcaacccttctgacatcgtatatggagatcccaccagattcaagcagccaacctttgtttctcctgaaatggagtcgttaccaacaggtttaggaagcaaatcaaaggcatgcaccaaatttttcagtacatctggttgcccatttggagagaactgtcatttcatgcactatagccccggtggtgtgaatttgatttctcaggtgtcaaatttgggaagtggtctgcgcacagcttcaaggaattcaacaggtcccccaactagcattttgcctcctgatcaggcagctgctgtacagccatacaagacacggatgtgtaatcgccatgggactgcagaaggatgccggtttggagataagtgtcattttgcccacagtgaaaatgaactgaagaaaggaaatacacttgctcctgtagagagggaatggacaagctcttatggcaggccagttcctggtggaggtagacttgtgcagcatgaggctacaacacctggaatggcagctgcagcttcatttggttcttcagcgacagcaaaaatcagtgtcgatgcttctctctctggtgccattattggaaaaggtggtgtaaactccaagcaaatttgtcgtgtaactggagtaaaactagccatcaaagatcatgaatctgattccaatctaaagaacattgagctggaaggtagctttgatcagataaaacaagcaagtaccatggttcacgagctgataatgcaaactagggctgtagctgcaaaaccatctgggtttgtttccaacaatttcaaaacaaagctgtgtgagaatttttcaaagggtacctgcacatttggggatcgttgccactttgcacatggtgccagtgaacttcggtaatcctcatttttagtcctgtctgctagactttgttcggctgtttgataatatttcagtataccatttgacaatttttgaagcatagggctgtgcattgacgagattgatgataacatgctatgttaaatgccactggacttaacgaacttaattatcgcatgttgtattgtagtatgccatttctttgagtctcaaaatctggtatttcttttgtaaaaaaaaaa

SEQ ID NO: 575 - DNA, 1900 bp, Pinus radiata
cagacacccatgtcgatgtgcggagcaataaccctagtcctctaaagactcatgctcctcgtaacctcggtctctctaccgctaattcatttgttcggcagtcagttggaattgttgccgttttagcggttttctgctttttacctcatttggctatcaattgagaaaccctctatcccttcccttatcatcataatatgtgggtatctgctttcctctgatgctcgttttcactcaaactcagttagtgtctgtttgtggaacggcggcattcgcgactcaggtttgaatctcgcctcgcttcggcagcttgtaagcatggagtccttcgagcccacgttgaagaaatcccgcggttacgacacagatggtgcaaatggtatgccctggacctcatcctcgtccgctggaaacatgaatatgaatcctggcatgaatctcagttctggcgttaattatcactctggacctaaccccaaccagggtcatgggttcaatcccaatgcagcgggggctaatcctaaccctaaccccaccctcaaccctaactccggggttaacgaggttatgcaagggccgccccagggaggatacccacctgcgatgggcggagggcaatacgcaggaggctcaggagcgtcatacggaggaggttcatatggagggggttcatatgaaaatgggaaccattccacccattttgaagtgttagggtttcaacagcaacatcagcagggaagtaatgttaatgtgggggatctcgagtgcaggcgttataaacttgacgagggctgtccttatggccttacctgccgctacaagcacggcccaacagatgaaagggattttaatattcacgtcccttcttctggaggcaagtcaaaaccttgtatgaagttcttcagtacatctggatgtccctatggtgaaggctgccacttctcgcattatgttgtgggaggcattgctgcccttggtttggcgcctgttcaaactatgcctgctgccactatggcaccaccaaggaaacagcccggaccaattggtgatcccagtgctactgtcagtggttacaaaactagactttgcaatcggttcaacactgacccgggttgccgttttggagataaatgtcactttgctcatggggagagtgatttgcgttcatctaataatattagcgcttccaatcgtaatggagttccaatgcaatcagcaccagcaatatatgataatggtccactggcaacagtatccaacccagcaggttttgtagatacaactgcatatggaaactcagcgtcaacagctacatatggaaactcagcgtcaacagctgcatatggaaactcagtagtctattctgctaacacattcccaagttcacagagttatgctgagcccactccaccaggtgtggcagctaatacaccttttgttccaaattataatatgcccgtagagaattcttctcagttgccaggcgttgagggaacaatgcagggaggtcctgttacagggactaataatgtacaagtatattgatagtgcatcattttccttggggagtatcatttttaaatgcatggtcatgcatttgtatggacaatattttgtacaagatagtggcactgaaaaggaaatctccaacataaatcttctgtggggaactttagaaaacctaatcattaggaatgtagtcatagaatacttggttcccagtaggtcgagggtctatgtccgtatattttggtgttgcttatttctggtcaataacatgattttgggaatctacatctttgattgtttaattagctctgatttgttacttttcaatcagtattttattttaataatgtaagccttcaagtgatggtttgtttctgactcaaaaaaaaaa

SEQ ID NO: 576 - DNA, 2172 bp, Pinus radiata
ggcagagctcctctgtggagaggacgccattgtttgattattttttaacgatttttttttaatcagatcgatctgtgggatgaggcaaaacccatctgcagaagcctgtgaagagtgagatttcgttttcaaggagcctttttgatcccgaattggaggagaaccagagaaacatggtgtttgtggtatagcggttttgcttttttcggtttacaattgtacagggtttgatggattacaatgcggcaatgcaaggcggttttgcgaggcagcggggtttggtgatcgatcctgatggctggcagcagcatgggaggccaagagcagagattactggagttgaagaggctatgtggcaaatgaatctgcaaccacagcatgagagtttggagccagaaattggttcttatccagaaaggcccggtgaacctgactgcacatattacatgcggactggactttgtggctttggcatgagctgtcggtttaaccatcctccaaacaggaagcaggctgcagcagctgcaagaaataaaggcgagtatcctgaaagattaggtcaacctgaatgccagtattatttgaagacgggaacttgcaaatttggtgctacatgcaagttccatcatccaagagataaagcaggaagcacaggacgggcagcaataaatgtcttaggctacccattacgcccgaatgaaaaggagtgtgcatactatttgagaacgggacagtgcaagtatggtgctacttgtaaattccatcatccaccaccagttggtccattagttccagtgcgtgggtcttcacttttcacacctgtacaatctccaacaactcctggccctcaagcctatccaggaagtctgcaaacatggccaatgcaaagggcgtcttttatccagagtccccgctggcaaggcccttctagttatgcaccattgatccttcctcaaggaatagtgccagttcctagctggagtacatatcctcaaggacaggtgggttcaatttcatcttcagatggtcagcaacaagcaataggagcaggtttggtctatgggcccacatcccaaacagatccaatggcctctggaattcagggcaccttttcttcttttccacctggatctccaggcatggggcctccaacgttacaattgccatcgagcagtgcccagagggaaagtatgttccctgaaaggcctggtcagcaagaatgtcagttctacatgaagacaggcgactgtaaatttggcatgacctgtagataccatcatcctaaagagaggatcattcccattccaaactgtgtcctcaattctgttggcttacctctgcgacctggggccccagcatgcacattcttctctcgttatggtatctgcaagtttggaccaacctgtaaatttgatcatcccatggtacactctagttacagtcagtcaatctcttcaccaattgatattccggttggtcgtcatcagataggatctgcatcagctacacttgcttcagttcctttgtcttcagacttggttgtggattctggtggaggaaagtctatagaacacacttctacagcagaagctcgtcagcagtcatctggtgttgaaaatttagggccagatgcataatgtttccacttcaagaagaaaagttggctttacttttttgcaaggttgacaggcaccactggtttaaactttaaacgtggaccagctgtgtattctgtcaactgggtgcataagccacactaacattgtctgttcaggttcttgaccaataagcagcagataatttcttcatgatagttgtgaccagagctgtttggaatatgatgaacataatgaagctcttcataattgtcaaagtcaccagtttgcgttggacaaggctggatgaatttcattgtaactagaaatttcattagcctttgtttcctcctatgaaaagaaagatgcttttttccgtgttgatcaaggcacacatttctcttcctcttttgggtggtcttcttaagtcccttgactttcataaacattgcttctgccaggtccttctgtagtctcaatcaataacttccttccttgtgaggcttgcctctgtttactgttcagcattgtagctttcagcctatgtgctagatttctccagtttctaaaaaaaaaa

SEQ ID NO: 577 - DNA, 2317 bp, Pinus radiata
gggagatacgatgtgtgtggttggggagggaacagaccggaggctgtggaaaaagaaagaagcctgtagtgtttgtctgatattacagaataagtaactcaaaaaccagtgtttagatcgacacatttcagcttttttctaagctaattttatgcattgtaccgtttcagatcaccttctgagctttcacagcacccgaattggaataccataggccattcatttcatcaattttgtttggtgggtagttgtggaatgcacaggggaatagtgggttgctttcagaatgattgattgattgatttgattggattatttgattggctattgatggaatattataggcaggaggagaattgggccatgcacagtaataagaacaatgtattgacatttacatcttctacagacatgaaaagcatagagaaatccatggggaagatgacactgaaatcaccagtggatccagtggaatcagggtcataccctgagagagtggatgagcctgactgtgcctattacatgcgcacaggcctctgtgggtatggccccaattgccgcttcaaccatcctcctaacttgaaacaggcaattgctagcaaaggcgaatttcctgaaagagttgggcagccagattgccagtattacctgaagacaggaacttgcaagtttggtgcaacatgcaagtaccatcatccacgtgacagaaatggattaggaggacaagtacagatgaattttttaggccttcctatgcgtcagggagagaaagaatgtgcttattacatgcgtactggatcctgcaaatatggagttcactgcaagtttcatcatccccaacctacaacaataatgcctgtttcaggttatgcaagttcaggatctcctacaacacctgcatcatcatatccacctgggattttgtcttggcctttgccaagatcaccctatgttcctggtcatcgactgcaaggatctccaacttacgtgccaatgcccataattttttcacctacccaaggcgtgatgccaatgccatggaacaattaccaaggtcctctaagtcccttgctatcacccgaaaggcatcaacagcctctgggaacaggggttgcgtataagtcatttcaacagagtgactcatctgccagtggtgttcaaagtgctgttactccacttatacaggctggttctgcagctatggtacttccaacagtacaagctcagacttctgttggacagaaagaatcatttcctgaaagatatggccagccagactgtcaatattacatgaaaacaggggactgcaaatttggaactacctgcaaatatcatcatccaaaagagagagttgcacaatcaccaacatgtgtgcttagtccaattgggcttcccttgagacctgatcaaccagcgtgcacattctacagccgttatggtatttgtaagtttggtcctgcttgcaagtttgatcatccattgggtggtgtaagttacagcccatccgcttcttcactttctgagcaaccagtagccccatatccaagaggtagctcccccccaaggatgcttgttcgatccagttcttcagaaaattcacaggcagcattggcggtgaaaggtcaatcttcaagattagaagaatcagctagcttcaagcaccattcacctactgatggtccagtgggtgaaaaagaagcagatacatcaaactctgttgctgctgttttatctgagtctgcttgagatttcctcaggctaacaattttttttaggtttgtgatgattgcggagactgctagttggagctggaatttccggcctttgagtgaaaaaattatagtttgcaaggctgaattgcttgcagttttcaagtacccaaaaatttgtagatcccaatgattcctgtctttcattatttgctcatcacatggtgcacggtcaaataaggctggaacacaagccatgaagacccccgtggttttgctaaaaatttacaggtctgcctggcctgtgaatttataccatgtggaataataccaagaccagatgaatgaatgctttaacatttactttgtgaagtatcccaatctggattagtttgtttctccgttaaatccgcttctcatttttgctgccctcttttctgcaagcatcacacagctgatttgaatgaacctttattggggtgtgatccaattttttgaaacaaaatttccagggccagagcatcattcaagaacaggacagtagtttagcttatgatatttaattttcttctcaattagagctgatttctcaaaaaaaaaaaaaaaaa

SEQ ID NO: 578 - DNA, 2074 bp, Pinus radiata
gggacaatttgaccggagagcagtcgtccagccttgatatcgtggacaggggagttggcgttacgctgcgaagccggggaattggatgcacagacgagaattttgtgtgtaaaatcgtcgaattttatgcatttcgacggtgcattagtgggatttcattcggcgacgcacgatcggacggtggattcctggattctggttctgagacggacagtttgaaggggtattttaattggaattcgactgcgctatataatctgcattgctttctgcggtctgccggagctttggaacatgattgatggaatatatcgtgccagtgtaccacagcagaggcttgcttctggtactcgaagccgtcgggtcacggatgttagagccgataattggttgccgtctcttgccgggcttaattcgggcaaatctgccgcagaaagcatgaaagagtcattgtggcgaatgacattgcagccccaggatttgcgtagcagaatgaatgggtattccgagtcttacccacagaggcctggtcaggctgactgttctcattacatgcgcactggcttttgcgggtatggaatgaattgccgtttcaatcatcccaccaacgttaagcagcaggctgctggaaacagaggtgaacttcctgaaagagtgggacacaatgcatgccagttttatatgaagactggaacctgtaaatttggtgccacatgcaaatatcatcacccacgtgacaggttgcgggctggacagattcaactgaacatgttagggcttcctatgcgcatgggtgaaaaagaatgcacatattacattcgcactgggttttgcaaatatggagctacatgtaaatatgatcatccacagcctcctgccttgggagcattggttcctgtgtcaggctcttcaatgtatgcaacagttcgacctcctatttctccagcatctgcaactcagtattcccctgctcttccaacatggccttcaccaaggactccatataggcagagtctgcacatgccaggggcattgccttatatgcctgttatgtattcaccacaccaaggcatgctcacagcatccggttggggcacataccaaagcactgcaagtcccttgacatctcctgaaattcaacaacagctacggcgtatgaacatcatctataattcaacacagccaaatggcttatctgtcggtggagtgcaaggttcaattactccatttacacagggatcttctccaacagtgggacatcaaccagggatctttcagcctaatcgtactcagacagagacataccctgaaaggcctggccaaccagaatgtcaatattacataaaaacaggggactgtaaatttggttttgcttgtagatatcatcaccctcgggaaagagtttcacagtcatcttcctgtgtgcttagtccaattggacttcccctgcgacctatgcaaccaacatgcacctattacagccactatggtatatgtaagtttggaccgacatgcaagtttaatcatccattgacaggtctttcttatagtccatcagcttcttccctttcagagatcccagtggctccatatcctagaggtagttccccaacaacaacacatgttcagtccccttcagaacccacacaggaaattgcaaagagtagagatcaaccctcaagagagcctactagctccaaacaggattcagaagctgttgtttcaggaaatacaaaggaaaatgcttctacatattctgatgctgctatttcatccaggtctgcacaaattgcattgtgctaaatgtagctggtccacggcatagtttgtgaaaattgtaatttctatttcgagacacaacatagtttgcaaggctgaattccttaaagtatccaaaatatgtaaagatgttgaaatttcatccatttcattcttttgctcctatccagggtgaacaggtgtagtcaaataaggctgaaactctagccatgagacctttttttaaagtctagaattcttgttaatgtaaattgttgtcactggatataatcctgattcaaatggaaaaaaaaaa

SEQ ID NO: 579 - DNA, 2443 bp, Pinus radiata
cgatcccctcccagatgatcttcaccgagctcacagaacctgcaattctgtgttcgatttctatgaattaatggaatattatggcaatagttctgcaatgccaagatatctaggttccgcggttgatcctcctcctaccgattggaattcgcaacatgttgctgcggatttgggcatggaggaggcaatgcggcaaatgaacctgcaatctcatgatgttgcagaaaggggactctttggaccctttccagagagaccaggagagattgattgcgcacattacatgaggacaggaatttgcggttttggcatgacctgccggtttaatcatccccctagaaggaatattgctgcagcagttgcaagaaacagaggcgagtaccctgagcgtcctggtgatcctgaatgtcagcattttgtaaagacaggaacttgcaaatttggtgctacctgcaaataccatcacccaaaatacaaggctggaacatcagactggcagcaactgaatgctcttggctacccattgcgcctgaatgagaaggaatgctctcactatgttaaaacaggacagtgcaagtttggtgtcacttgtaaatatcatcatccacagccagttggaccatcagttgcaattgctggaccttcatattatccaactggaccttctttgtcaatacccagtcctcaacaatatgcgggagggctaacgacatggccaatttcaagaacgccactaatggccaacccctatctgcaagccccctctacttatgtaccttttgtgattccccatggaatgatgccagttcctggctggaactcttttcatggacaagtgggctctataacttctcgtgatgtggggcaacaagcacctggaactggtttattctatggccctaggtaccaaacagatggaatgaaccctagtattcagggggcactggcttcatattcatctcgatcaggttcaatggggattccatcaaccaatacacaaatggagcatatgtttccagagagacatggtcaaccagaatgtcaattttacatgagaacagggtactgtaaatatggttcaacatgtaaatatcatcatccaagggacaggactgttccattgacaagctgtactctcagccctctcggcttaccactgcgttcgggggcccaaacatgttctttctatgttcgtcaaggattttgcaaatatggaccaacttgcaaatatgaccaccctatggggactttgagttacagtccatctgcatcttcactagcggatatgccagttgctccttatccagtaggatcggcaccagctactcttgctccatcattttcatctacagaattaaggacagaaactactgcagggccgttcaaagaatcaattcttactccagaaactcctttgtcatcttctgctggcgaatctctagatttaggagcacaaggtccactattaagcacctcaacaggtttgacttcctctgaaagcgaggaaaatcctctggttaagaagtcaaatcaggtttctgtccttgcaaatgggattgcaaaggagggggacattcccatttcaaattgaagacatcatgtaagcagatcctaatggttgtgactggagtcttctgaaaagtggtcattctgttctatatctttcatgactgtcacatccccaatgtgctgagaaagctgatggaaattcactgagaaaatacatctggtttgggaccaagccttcttcctttggtttctgtgtgaatttctggaactccaagtttgaagccggtttttcgatttcacttccacgggtccaacgctgtgatccagttccacgaggcttgccccaaattaatgtgatatattttctctggtcttatgcttaaccgcactttatttaatttcattcacaattttttgttgttgttgttaaatttacccatgcattttccttatcattgagttgacattggacaagccttgtttagattctatttgatggttctgtaatttattcattgagctaccctgccctgatattttgatgcacattactgggttgtggctcttgggcatgctgtgacattgatgagttctttttcgagttggaagcagagctctaccagacctcatgtgccctctttgattccatctaattttttgaagcatgctccatccatagttcattaagaattggcagtggctttcaaggaatgtatatatctcatgcagaaagccagagaattatgtttggcgatgttttattctttttctttgaggggagagcatgctttagtctcaaccactaggttttggcatttgtaatacaacaagcgctggtctttttggaacgagttatccttatgtagacatgaaatgtgccaaatttctttatgagaataaaagaaatgatatatttttaattttaaaaaaaaaa

SEQ ID NO: 580 - DNA, 2224 bp, Pinus radiata
gattgatggaatgctatttgtgcagggacagagagagggagagagccccttttctttcaccacaaccacgcacggaggccttcagggctcctacactgatggtgagcgaacaatgcatgataattgtccccttagttccagttccagtccaagagtgcctggagacgctctcgaagaaacagtgttacaaatttcaattcagacactcgataccctggaggagatcggattttattcaggtccttatccagagcgtccgggtgaacaagactgtgcatactatcgcacaggtctttgtggttatgggaggcattgtcatttcaaccatcccccgaacgtaaaactggatactcaatatatgagtgaacttccagagagattcgggcaacctgaatgtaagtattttatgaagacaggagcatgtaaatatggtgcaacatgcaaatatcatcatccacatgacagagatggaccaagagtacagctaaactatctaggacttcccatgcgacagggagagaaagaatgtccatattatacacgcacaggatcttgcaaatttggagctacctgcaaatttcatcattcagagcccactgcattgctgtctgattcaggttctcctgtatatgcggcagcagaattgcctttgtcacctgcatcaggatcatcatatccagcaggactcacatcgtggttcttacagggagctccttatgtctctgatcctcacctgcaaggatctccaacatacatgcctgtcattctttcatctcaacaaagcacaccttcagtccagccaggctggaatacttgccatggtcctacaagccccttgtcatctccagaaggaaagcaacaacttggagctggtactgtgtatagttcgtcatacctgactgattcatcttcatctccagaaggaaagcaacaacttggagctggtactgtgtatagttcgtcatacatgactgattcatcttcaagtagtcatatgcatggtgctctttcttcccctgtacagggatcatctacagccatggaacacccaggagtccaatgtcaggttgctgctccaaaaagggaggcattccctaaaaggcttgatcagccacaatgtcaacattacatgaaaacagggtgttgtaaatatggcacaacttgcagatatcacaaccctcaggagagagttgcattatctccttgttgcatgcttagttcacaagggcttcctttacgacctggccagccaacctgcccattttacagcaggtatggcatatgcaagtttggaccaatatgcaagtttgatcatccgctgacaggtcccaactgtaatcctgcagctttttcgtcatctgaacagcagacaacttcatatccaaaagggggttcttctggggcacattgtcagtccacttctgaagaattttcaaagcaagatttgaaagcaacagatcagtattcaaaagctgaggaggcatccagcttaaagcagaaatcaactgaagagggtgcaggggatagattggcagcaaaatctccatctacttctggtgctgcaatttaatctgtccgtacaaaatcattcaggctaacattcaattcgatcttggtgttgattgcttagaatgttagttggatctggtatttactcctcgcagctttctaggtcgaaggatgtcagaatttatagacagcaacaattcatgcatttcattcttttctccttttcagtgtcagcaggtggactccgacaaggttgggacttgagccgtgaagcctttgtggtttgcttacagtcttctccctgtacgtgttaccatgtgtttttgtcttaatgtcaaaaaaatgagagtttgacattttggtgtgggaatgctgctttgtggtttagttgtatctcctgtcatattttttccttgtcttccatctttcctttttttcggcgggcatcttactgtcctttaggtggtctctgtactccaacaacgtggaacatttttttgtctgaaacgcagcatcttccaaggacaagcatgaactatttttacaccaaagttgagtaaggttgtcatctaggaaaattcctttactgtctacaataaacatagttaatgagctagacagtccagtatcatggcaaccatttgatttcgaatgtaatacactgtaaagcattaccgtaatggtacagtgtttaataatctgttcaaaaaaaaaa

SEQ ID NO: 581 - DNA, 2605 bp, Pinus radiata
ggcgcgcgcgcccacagttaaaatcggagggactggatttgttaattttaaatagaattagaaataattaagccaaccccagtggccttatatggttcaatgggcagttcttgccatcgctgtagccgtttcacatcattgcttttttgctttcgtttcggatcgtccgtctgtctctctgtaaattgattgattgcaatgcaatgacatttttccatgggcatataattcctctcatatatccagccatggctattgtgtgactgcgataatttgttctttctttttttcttttctttaatttgcagcctagccttagtacccctgcaaaaatgccaggcgtatcagccgagcagcacctgttttctggttctggttctcctgttgtattcggcaaccgttgttgtcctgtaagtcgcgccttcgagtcccaggacctgccaaagtctttctatgctgaaccccctgagctttccccttatgccttgacaaacatggaatatttgcaaagcctgaatttattttctgagacttcccccaattctgaaaaatcaagatacagtaaagattctgcttcagtccagaagctcttcaacaagagcctctccttcggcagcaatggcctcggtgtcgacttcggtgggatggagtctgagaattttttggtgagtccgaggactgtgatcgaatccccggacggcatttcttctctgcataaattcttgccctccaacaacgaagaagaggcttcttggcccgctgtggacgcgtattcgtgcgacgaattccgaatgtatgagttcaaagttcgccgatgcatgcgcggccggtcacatgactggacagagtgtccgttcgcgcatcccggagaaaaggctcgtcgcagagaccctaggcgttttcattattctggcactggctgtcctgatttcagaaaaggaagctgcaggcgtggagatgcctgcgagtatgctcacggagtctttgaatgctggcttcatccggcgcgttatcgcacgcagccttgcaaagatggacgcaattgcagaaggcgcgtctgtttctttgcgcatacgcctgagcaattgcgcctgctgcccggagcatcgcaggctcagtctcatgcttcatccaattttggcaacagaaattcttttcagatgaggaataccgttagcggatcctatgacggatcccctttgcgttatgcggtcactgcagcagcatcgctcgacggggcttttggttacgatggctttgacgggaatgcttcaccgcgcggacccttgaattacctctgcaaggcaaaggtgaaggccaaggcatcacagatttcatctccgacttctactttagtcggccattcttattcctcaccacccttgtctccgcctttgtcaccctctgcttctcctcccatatcgcccggtagttgcctcgattcccctgtgaattacgctaattctgctgtcaaatctttcccaaagtctgaaactaacactgctcctggttcttttactccccgtggtcatttagaaaggctaatttcgatccctcagccaaatctcgacccaagccccttgtcaccagccgtgcattctccggccccgtcctcaaagctgatcatggagggtctcataaacactctgcagcgcatggagataaacggagacactcttccgtggcgtcaacagcaacagcaatttaatctgccgggtcgttcttgtctcagttttcctggcgcacctcgcttggacgacgatgcctgggaagtcgaagcggctgaggacggatcaatacagcgggtcgaatctggtaaacatttgagagccaagatttacggtagattgaccagggaatccaccctgcaagataataacaatactaatactgaatattctcccgatttgggttgggtgaatgagctcgtgatgtagaaattccatatattttgcaggctactgaaacaagcctgcataagacgatcaagtctcaagaattcttacagtaattgtaaatacgtatattaacatattcagcatgcaggttttagagtatttggggttctgaggtcgattgctgctgcttacagttctgagaaattttaagggttcgattcgggattttgatatttgtttgtgttcttgcggggtggagacagtatttgttcagggtattccccgactagtgagcatggtctctgcttccatgatgtctgcagttgcaaagacaatttttggccgaaaacggtcacataccgtcaaatgctgctcctctaattaattgctgatattctcagtaccttgtacgcagtattagcaagcgagcttactttctctggacaattacccgggaaaagctgttgaattgtttttgcatataattttattttgagtgctagatttgcccttccacaggcgggggctgtaggatccttgtaccaagtctagattactgttaattgatgtcttatcgtaagatctggatgacatcaattgtctaatttcttatgtaactgaactggatatagcctgtattagactcagtcattagcagacgttgcatattattcaataatcacttgctgctctgtacaaaaaaaaaa

SEQ ID NO: 582 - DNA, 3024 bp, Pinus radiata
aagctttactgattcagtttctttgttcccagtatctgatagcagagagtttcaatttctgtgtgtttctatgaatttcatggagaaggattgttagaccagattagttaggttgagtggccttatggtgagcttttgaaaatgcattgtgtggttttttcagaagttaagttagttgtaggaaatgtaatgtaatgtaatcgtaatagattgtgttgcagtgtacattatggatttgatgtttccaggtgtagaaggcaaaatggatacatatgaagcaacaaggattgtgttcacaaggattcagagcatagaaccagagaatgtgtccaagatcattgggtatttgcttcttcaagacctgggagatcaagaaatgattcgcctggcatttgggcctaatacactcttacagtccatgatttccaaggccaagacagagcttggtttatcatctccgtcccctcttcagtcacctctgcgctacactcagttttctaatttgttgtctcgctcattctcttctccagcacccaatggctttgatgattgtcagctccaagatcatctcttctatcccactgagaatcttgattcctacagcctaccaaatgatagtcatgtctatacagagatgctctctttcttgaatggaagcaagacaggattgaatcacaggcgatcttactccatgacagacgtttctgtaagctgtgagccagtttcttggaaaccatgcctgtattttgccaggggatattgcaagcatggatccagctgccgttttactcacagttattcacgctctgacaacgtttcgagttcaattcccttggatccccgcttcgaagaagctttctctgtggaatcattggaaagattagagttagaacttcaagaattattgagaggaagacgggcccctgtttccattgcttccctacctcaactctattacgagagatttgggaaaaccctgcaagccgagggatacttgactgagagtcagaggcatgggaaagcaggatacagcttgacaaatctactagcacgcttgaagaatacagtaagcctcattgataggcctcatggtcagcacgccattgttttggcagaggatgctaacaggttcacaacttataggccaagtgaacgagatccctactatttgagtggtgtcagctctggatcccgtcaaatttacatgacatttcctgctgaaagcaccttcacggaggaggatgtttccaactatttcaggatatacggacctgtagaggatgtgagaattccataccaacagaagcgtatgtttggatttgtaacatatgttttcccagagactgtcaaattgatactggctaaaggaaatcctcactatgtctgcggtgctcgtgttctggttaagccatacaaggagagaaacaagcatggagacaggaaaaatggcgatagaggagaacaatatgcaagatacttgctgccatcttacaatgtagattcaaaggactatgatctatgtccagctcctaggatgtttcagaattccgaactgatcagaaggcatatagaagagcaagagcaagccatcgaattggaaagactacgcctgacagagttgcatctggctgaccgtgcgcagagaactcaaaataatgccatcactctgcaacaacaaaattctcattctaatgggctactcaatgtagaggaagaagaaactcaggtttcagaagagctaaacagctttgatccgcccacggatcactttggttatctgctggatgtgctggatagtgagcagaaccctgaagaagagcctaaacaacagaaagccgacaatgacgaagaatgcaacgggcacaaccttcctgatagcccttttgggttttctcattccattaaaacaacattgccccatcccgagaaaacgaacaacttttcctttttcgacaccagcccagcacaagaatcatccacttccatcatgacaaaggaagggacttgttccatgtgcctcgattccattgtggagcaggtgcggttagagtgcaagcatgtgaggtgacacattgctaaatttcattagaatttgaagcatttgggcatgcggtttcaggtgcctggaggcaaaatatcataactaatctgctgctgagaacacagagctccacagtgaatatgactcagcaaaacagagccagcggtacgaacagacaagtttgaaatttaatacaagaatcatcatgaaaaatgattagcataaagttatacacaattggatgtaattataccccatacccacccatagagcagatgctttggacattattatgcaatttcttaacaaatgtgaatagcaaaaatacaattagacacagtggtagctgctactggcgcaatatagcttgctgtaacagtctattatttattaaaataacaaccttggaatatggtgcaatgaatggaacatgtttttatggattttaggtcccttctctttaatatatgtagatatcttttcatgtggcaatagcagcagagcagacatgtcagacattgtgtgtggtcagaggcaggggagcagaaggtgatgtgatggattccctccctatggcaatgatttggccccacccttgtcatatctattgtgctgcagcagctgcctcacatgcctgcagtgcttactgactttaaggggtcagtctagacaaaagtgtctctgtttcatttgtaagcctatgaggagccctctttggtacgcacggcacagcttttagtactttctggtatattgcgcgagggcccacagcagagagtgcttgattgaatctcagcactaatattcaacaccattggtgaaggccacaaagcctgaactccatttttactggttcaactctgtattgaaaagaatatacatgcggactttcggcttcacgcccacatggccctcctgggcaaacaccccaccagatatatttatttatagaaaaaaagggatattctgactcaaaaaaaaaa

SEQ ID NO: 583 - DNA, 2679 bp, Pinus radiata
gttgcagtttttggtgatctctgccttttatggtctagagcaagtgagatggatgcctatgaagctacaaggattgtgttctccaggatccagagcttagagccagaaaatgtgtctaaaattattgggtacttgttattacaagaccatggtgaacaggaaatgattaggttggctttcagtcctgattccttgattcagtccatgatcatcaaggttaagaaagatctaggtttgatgcaacagcaaggtactccagctccaactgtttcatcttacctatccagaatcaatcgtctccccaacttgccactgcagtctgctcagatttctcaatccagagctttctcttctccaaccgccctttcacctcatgcagctccatggggatctcatatttctcaacagactaggcctttatccaacaattttaactcgatcttgaatgagatacagactaacactagtacttctagtactataaattctactagcaatggctatcttaatttcagtctgccatccatgccagatcaagctaatagccttccttacagcgagcatcctggccttgtagatgaatttcaattgcaagatcagcttccctttctcaatgattctccagagtctgcccaatctcatgctaattatctcaactatcctgagatgttgcaggcatattgcaatggcaatcagccattgactatagaccatgtaagcccaacagcagctaataatagctatcctggtactactcatatacccaagcagcctagttcaatttcagatatttacaatctaacttcagaatctgcacctgggtcagccttggcctggaagccatgcatgtactttgctaggggttactgcaagaatgggagcaattgcaggtttcttcatggtaactatggtggtcatgtaaggtcagagagcaataatgaccacagtgaaaagttcatgggatccagtagtggcccattggaaaaactggagttagaattgaaggaattgctcagaggaagagggtctccagtttcagttgcttctctacctcagttctatagtgagaggcttgggaaggctcttcaggccgagaggtttacaaggtatagaagtgaacgagattcatctgatcacttggccagttctgcttccaattctggatctcgccaaatatacttgacttttcctgcagagagtactttcagggaggaggacgtatcaaattatttcagcatttttggacccgtgcaggatgtaaggattccttatcagcagaagaggatgtttgggtttgtgacatttgtatatcaagagactgttaagattattttggcaaaaggcaatcctcattatgtctgtgatgcccgtgttcttgtcaaaccatacaaagaaaaaggatccaaacccgcagagagaatgaagtataccgactgtaggggcgattattcaggatatgtgacaactcacaatcttgatatcaaggacagcaatttgcaacttggccctcccagatttgttgaaaacagcttagacctggtgacaagaaggcagttggaggaggagcaggatcatgtagagcaagccgttgagcttcaaacaaaacgacttgcagagctgcagcttggtgacagaaagagaccacagcttgtaccttcagatcctcaagtttctatggcttcaacaaactccggcccggctcagcattatcaaaatcagttctcaaatggacccaataatcattcagaagaggacgcaacaacctcagaagattttagcagttctacattagcagaacattttggttatgtgctacaggttttagatagtgaatctgtctatgaggaacacccaaaacctgtcaaccatcaccatgacaggcttcctattactaatggtgcaatgagactgtaaacacttgaatgctattcaagttgatcttgaagcagctgggtagcaaagctgagataagaacctgagtttccagataatagtaggcagctttcaacgaacttcatatatattcaattcttatatatttacgaccgttatgatatactcagcaccaccaggagaaactaaggcaaaaaggtacaaaggtgcaacaacattttaaatttactggaaatacgaatatacagacaggaaaggagtgggagacccacttcagcctgccagccattgaatacaaaactttcaagtctagctgctctccaaagtagtgcgaacattttcaagaaaaagttattatataatacaaagcttttgtgatgaaaaaaaaaatatcaggaatcattagagaaaaaaggagggctctttctgatacaggaaaaaaatgtcacagacagcaagtaaatttacagaaagtgtacagcaaaggcagcagagacagagaccgagaatctatagcagacatgtacccattaatgaaattctgcatttctggctacagtcgcacagtacagaggagaaaaaacactcaatacttctattcattctgttattatgcatggaattgtcgattgttttctatacttaatgaaaattcaatttctgaccaaatccgtgacatgctagtctgtgacaaactaaaggtaccttccacatggggtctgacatgtagctggcccacgagcagcaattatttgcattaaattaagttttttctgaaaaaaaaaa

SEQ ID NO: 584 - DNA, 2956 bp, Pinus radiata
aaatatgtgatattcaagttttacaaatcggaaatcgactgtttaaagggttattatatgaccagttattatttgaccaatctgctgccttggagtcctcttgtttctgttttttttttaaaactagggttggcgacaaaatatatttgattcaagggtttagggtttacgcgttgtctgaggccctgctaaatgaggtcactacttattggcagagggtaggcggacatacttttccgacattcagatttagcatttgtcgcatttcgtttttctgaagtgcatagcgggagatcgaaggttcaaaagtttgtgagaaaacccgaagtcgtaaaagggaaaaaaatgtcgctgtaaatactttaagatcgaagatctttggtgtctcctttcttctgacgggcttttgctggggctttggttttctgttctacgaaggagagattctggtttctcttggcttcggcgcccaaggttagggttagggttttgtcagacagctgccgaagtcagggacacttcattcatccgtttaagcgttttgaaagtttgtatcagtattctgtagcttacgagtgtggttgggtgttgtagttattgaatatgggacaccagatttatagctctagccagtctctaggttcggcttctcgtggtaaccctgtactcggttataacggcggcagagctcttgagccgcccatgtttccagccagaccctatgatctgccagccgagtctcggtatttctctggagatcagatgtcaaactcaatgcagcttgacaaaccaggagggcgctacatgttcggcgaacgtgttcccagtgagcgcactcctgctgaaactgggagccgacctggctcatttagtttggagaggtacatgccctcagaagcaacacagagggctgattcctccaggtactatcccggtcataacagctcaatgtttctgaatggcagcgatacggccctctacaagggtggagatgccgtgggtttcgggtcgacgagtgcttattttcctagtaggcattcagcaggccttgtttctcctccactgcagcagacacagtggcctggagcagaatctcgcggttcaatgcctggaggagtgactggtgtgaagcgtccaaatgaagaagtttcacaaactcttttgggaactcataacgcatttgggcaaaatgaagctctttcgtctgtgaatgcattgcccaagcgccctaggttggacggttcaagcgatttgcccatttatcctcagcgacccggagaaaaggattgtactcactatatgatgacaagaacctgtaaatttggagctgactgcaagtttgatcatccctcttgggttccagctggtggaattccaaactggaaagaggtgccatctgttgccacaagcagtgagtccccaccggagaggccaggcgagcctgagtgtccttactatatgaaaactggcatatgcaagtttggtgcaaaatgcaagttccaccacccaaaagataggttggcaaccttaaactcagatgagaattttgatggaaatgaggtcaaacttgctactggttcactaccagagaggcctggcgagcctgagtgtgctttttttgtcaagacaggtatttgcaagtatggagccaagtgcaagtttgaccatccaaaagacaaaggaggatctttaaaaatatcagagcacaaagggaatggggatgctgctgtaactgtcggaacagaggaacaaggggtttctggagatataaatgggaaaacagatgtcatacctataaagccggccaccatgcacaattccaagggcttgccaattagacctggtgagacagattgcccattttatgtcaaaactgggagctgcaaatttggaccaaattgccgattcagtcatcctgataggatattaaatatgccaccagctgttatgccattttccgtccatgatcaacctttagttggctattcagggatgcttccccaacatagtttaggagctcctattcctccacagaggcctggagagcctgaatgtactttctacataaaaactggtgaatgcaaatttggaccttcatgcaagtttcaccatccacttaatagacctgatccatctgtgaagctgactcttgcaggccttccaaggagagagggtgaaactatttgcccattctatctgaaaactgggatttgcaagtatggtgtaaactgtaaatttgaccatcctcccccaggagaacttgacacagctcgtgctcagcaacctgtgaagttgactcttgcaggcttcccaagacgagagggtgaggctacatgcccattctatatgaaaactggaacttgcaagtatggtgcaacttgcaagtatgatcatccccctcctggagaagctgtagccaaagctgttgcaatggctgcaaccactgaagatatctcagcagattatgataagattgattcagggaatgttggagccaatgctacagatgaaaatatcaaagattgatgaacattgcacaaagtggagtaaggtcttctgtttgaaggagacaggaagaaaagtagatctgttcggggttgtaagcattcaccatcaaactgctatttgggggatgcaggaaaatgtcaaattcagggttgtaaggttttcccgtgaagctgctatttgggagattctctgaacatgtcaaagtttccatgcatgcctaatattacgaggagcattgaaatctgtattttgattgtttcatctgttgtaagttgttgactgtatgacatagggtaaagaattttacagtgaagatgttattgtagctattgcaggaatgttcagaaattgactatgatttcgtagcattctgtgcagttcaagattatttagcagatatgattagcacaagtgtaactttaattatgcagtttgtttaaaaaaaaaa

SEQ ID NO: 585 - DNA, 3011 bp, Pinus radiata
ggcagccagacagcttcttcttggttctttccctttcttgatctacaaaagctgcaatcctacttctcttcttactgggcggtttcacgagaagaggccagcagtagcgtacgattcatctctgcaaccggtcttgggactgtatttcttaatatatcaatttaaagaaagcatgtgtggaacaccagagcattcaaaagtcagcgagaacaatgaagataatggaaaagttgtacttgctgagaaacaactgagcaaaatgaaggaaactcaaaaatgtttctcgattctccttgaactagctgcaaataatgacctgattggatttaagcaagctgttgaggaagatggctcagcgattgatgagattagtttttggtatgggcgtcaaaatggttccaaacagatgggtttggagcagaggactcctctgatgattgctgccctttttggtagcatggatgtattgtcttatatattatctgcttatgcgacttgtggaatagatgttaacttaaaatgtgggtccgacaggagcactgctctacattgtgctgcggcaggagggtctagttttgctgttgaagccgtgaggttattgcttcagtcagacgcagatgttaattgtttggatgctaatggaaggaggcctgtagatgtgattgtggtttccccgaagctctctaatgcgaaggtcatattgaacaatatgctaaaagcagaatatcatagcagggcaggggcttgtttaaaggttcttagtagagtttcagagtatgacaatactgacttgtctggacgagggtccaatagtctgagttcgttgccacatctctcgttaccttttgaaccacagagtccaaaagtgttgatgtcatctccgaagatttccgagacatcaaggaattgtgctgatggtattgaaaagagagagtatcctgtggatccttctcttccagacataaagaatggtgtgtatagcaccgatgagtttcgaatgtattctttcaaagtgagaccttgttctagagcttattctcatgattggactgagtgcccatttgtgcaccctggagaaaatgccagaagacgagatcctcgaaagtatcactatacttctgttccttgtccagagttcaggaaagggacttgtagacgtggtgatctgtgtgagtttgcacatggtgtttttgagtgttggttgcaccctgctcaatatcgaactcggttatgcaaagatgaaacaaattgtacaagaagggtgtgtttttttgcacacaaacctgaggagctccgtcctttgtctggatttactggatcagctgttccgtcaccccgagcttcatcttcattggatatgaattcaaccatgagccctcttacactaggctcaccgtctcctgttttcgtgatgtcttctctttcgccttcaaatcctcctcaggggggcttatccacccccccaaggtctccctcttcatcatcggcaaactcattatctcattcatcatttagtggaacctggccacaacctagtgtaccaacattgcatcttcccggtggcagtcttcaagttggtcttcaagctagtcgcctccgagcatcacttaatgccagagatgtacctcttgaggaattgaccttagattcggattgtgaagggcaacttataaatgattttgcttctctttcaggatctggaaacaccttgatgaggtctggaaaatacaagagtcatggctgtagtattgctccagttaatcttgaggatctatttgcttctgagatgtctcctaggggaccgtgccttgaaccttccgtgttttctcaaataagttctcaaattcagtcacataaggcagctcaagttcagcctcaggtgcaaacatcaattagtaatcagatttctcagatacatcaaatgcagcaaggtgcaataggtagtcaaggaaacagccatttgcactctccagttcagcagtcacaccgtctgccatctcttggtttggatttggagcgacagacttctaatgggtctgttttatcaccagctttgatggctggtatgaaatcaagatctgcttcatttgcacagagggatctccggagctatagttcccgtgatttaggcgctcatgcatctttaccatctttggcagattggggttctcctacgggcaaagcaaactggggggttcaaaagggagaacttaataaatttaggaaatcagcttcatttggcttccgaacctcaaatgagccagatttgtcttgggttcaaaccacggtgacagaaaatccagttgatgctgtggagggatgcactgtaggtttctctctagaagccttgagaaacagacagacagaaaacataaataatgcagtgctgggtgcttgggctgagcagcagatgcatttggatcagcaaatggtagcttaacatatccaaagatttagggactatactcattttttccattttcttattttttaagaaattgacattttgaacccataaatatctggtcttttatctgttagttatatatatatatatatatatatatagatataaccctcgaggatatctggtaaagaaccgtggggatatagaccctacttgatgggttgttttagaggatgcaagcgattggttgtcaagaaaagttgacaagacagggcaaaatttaatggtacgtgggcatcttaggcatatgaagtttgaaccaagggatttggtagtagaatggttaaagaatctcagagtttcaggtgtcagttttgactgcattcttgaaatgttataaaagtgagggactcttcctgtctctagtctatatacttggacaaacattgcagcggctaattttggctgtatccatatcttcatactgcatcaactaattattggatggagcaagatgttgtaacttgtaaaaattgccttcaatctaactggatttatgtattttgatttaatggcccgaagccaaaaaaaaaaaaaaaaaaaa

SEQ ID NO: 586 - DNA, 865 bp, Pinus radiata
gcacgaggcaaagatagctaggtgccgtaagtctcgcgcggttaaaagaagtcacgaactacaagcgatagtccactcgttttgatgtagtgccagagatcgactcagatagattccgatgttttgggtttctgtttttaaccttggaaggttcaattttacagtttctacgggaattctcatattcaatctgtttggcagattgaactaaagatttttgtccgggtgatttttggattaaattcaaggtcgacgaacgtgaggtgctagggcttttagagtttggatggaacccatggacatcgttggcaagtccaaggatgacgtctcgcttcccaaagcaaccatgtttaaaattataaaagagatgctgcctccagatgttcgtgttgcaagagatgctcaggacttactggtcgagtgttgtgtggagtttatcaatctaatatcttcagaatccaatgaagtttgtggcagagaggaaaaacgaacaattgcacctgagcatgtgctgagagccttggaggtgttgggctttggggattatattgaagaggtctatgctgcatatgaacaacacagacttgaaacattggactctccaaaatctggccggtgggctagtggggcagaaatgactgaagaggaagcactcgctgaacaacaaaggatgtttgctgaggcccgtgcacgtatgaataatggcaatgcaaatccgcctaggcagtcagactcagattaaatagtttcagaccttgtcttctaacatcagtgaatggctattatagtcattgttgtattatattttagtcttggaagcaccactgtattgtcatgcaatcaagattagttttactagcttttt

SEQ ID NO: 587 - DNA, 914 bp, Pinus radiata
cggccttgaacgcaaactgcaagcctcaccatctccacgggcatgtttaatcctaatcacttcacatgaaaaataatataaaacccatatgtacatttgtgctagcctaatgtgagaagttatctgtggattgttcagagggtaagtgaagattcgaaaaacaatggagattgtggggaaggccaaggaagatgtttcactgccaaaagcaactatgaccaagatcatcaaggagatgttaccagcacatgttcgtgtaaccagagatgctcaggatcttctagttgaatgctgtgtagagttcatcaatttaatctcgtcagagtccaatgacatatgctacaaagaggagaaaagaactattgcaccagaacatgttctggaatctctaaagattcttggctttgggagctatattagggaggttaaagctgcttatgagcaacacaggattgagaattgggattgtccaagagcaggaactagatggagtaaaaacagattggaaatgacagaagaggaagctttacttgaacagcagagaatgtttgcagaggctcgtgcacgcatgaatagtggaagtaacacttttcctgggcaatatcaatcccaatcccaatcgcaatcacaatcacagtcacaatcggagtgattaatattgaatttttttcatatcttcatatgaggatcatttataatatttttgattagttgtataaatgccatcatccgatagttaaatttatcagcaatacaaataaatcttaatttctggagattggcaaagcagcattttacttatcctgttcttttcttttaacttgttatccattcttttgtgcctttattgtctgggtaaactattttatcggcaattgcaattccaaatttcagccttttcagtaaaaaaaaaa

SEQ ID NO: 588 - DNA, 1001 bp, Pinus radiata
aaatacattgcaaatcagattctgattccaggcgacatgaaatcccactttttaataaatgctacgcgcacttacgtaaactttaggaagtctctgtgaaaaagaaggagcaagaaaagcaaatggatttgcatcaaataatattgtaattggggcagtaatattgaagtccaagggaccaggggcttattaagggcatcgagtagagcctctgaattttcaaccttgtagaacctaattgagtaaaacttcattcagttggattctcatcgttttcatggcttacaaccgcaaacatgccgccgccgccaccagcccggacagcagcctgggctcagacaacgagtccggcggcggaggaggaggcggcggaggagaagggcagtcgacgaagaatggcaatggcaactacattagagagcaggatcgcctgctccccatagcgaacgtggggcggataatgaagcgggcgctgccggggaatgcgaaaatctccaaagacgcgaaggagacggtgcaggaatgtgtgtcggagttcatcagcttcattaccggcgaggcctctgacaagtgccagagagagaagcggaaaaccgtcaacggcgatgatcttctctgggggatgaccaccctcggcttcgaagactacgtggagccgctcaagatatatttgaataagtacagggagctcgagggggagaagtcttccatggcggcgccgcccagacagagcgacctgcagcagcaccaccatgtgaacggaagcgatccgcatccatatggccattcgccccacggtcctatggcttaccacgtgcccggaggtggagctttcgggcatggaaggtgactgtggcgtgttcattttgttattgtaaagaagtgatagagatggaaatgggtcatggtaatggagactgtaaagtttaaactataaaatgtaaagttgaattcctctctgatgttcagtgtttacttttttgaattttaaaaaaaaaaaa

SEQ ID NO: 589 - DNA, 1057 bp, Pinus radiata
gttgtattgtattgcaagtgaggaaatttaggaggtgtggcgtaaaatgggagaccacagtggtggagagagcagtcctcattctgacatagagtctaccggcatccacaataatggatcttcttcttcctcacaatccatcatacgagagcaagaccggctgcttcccatagccaatgtggggcgcatcatgaagaaaaccctcccaaccaacgccaagatctccaaggaggccaaggaaatcatgcaagaatgcgtctccgagttcattagctttgttactggagaagcatccgacaagtgtcacaaggaaaagcgcaagaccatcaacggcgatgacatactatgggccatgaccactctcggattcgaagtctacgctgagcccctcaaggtttatctggacaagtatagagaactggagggcgagaaactttccatgagcaagcagcttcaagtagatcaacctcagccggacctgcaatatcaggcctgtaatcctagtgcccacaaccgcccactggtaatgacttacaagatgcccttgcctatgcctatgcatggcaagggaccttcgggggcagacccagcagcaacaggacatggtcgccgtcccttctaggtattataaagtgatctgatcaatctaataataatcaaagcctgctgatttttcttttagtctttccttctgttttaatcttctaaacatacctagaattcataagatgatcatcaaaaatcttattgttggtggcccttgtatattgaagcagcagctttaaggtcagttttgtcctaagttagtgagtaactttgttggataggttaagtcaatatgtaatgatatatggatgtaagtatttttattgctagcctctattctcatgctgtaatcatcctagataaggatgactgataacgtttgcctacatgctatttgctgtattagggttttggtattcatttcctttctctctctttgttacatgaatagatcactgatctatagtctcagtccagcactcagtggttggttctgttttagatcggcctc

SEQ ID NO: 590 - DNA, 2545 bp, Pinus radiata
tttttttttttgatgtaattgatgggattttatgaaccacggggtcgcacacctttttaaaacaaattaagcctgaacttccacacaaatcttgatatgccgcactaattattcttcaaatatttagagatacttctgactacatggcaattttattcgaggtattcgacgttgaactaatgttattctctcgtctgacccaattataaacctaatatctaactggcggcaatactatcactctgtgacacactgtatgcgcaagaaagtattatttagtaattcattttgttggcatctatatggagggatgtaatgccatgcaatgcgaaacctggaaattaactgaattcaactgatcaaccgagaacacgacgacaggttgaccctgatttcttccattggtgccctggagaggcttgatgttcgccaacctcgtgccgaattcggcacgagagtgagtctcctagccttggaatttggcaccatctcgtcccgcagccatttcagttcgatctcccgccgtcacaaaaaataatccccaattctccagctgtccctgccgtgtctgcacgcgacaggtctgcccgggctttggtctgtggaatttcatgccaatttatcacctataaactccacccgcatctgcccacaaaccccacaagtcacacccctcttcgtcttctttgaaatctcagatgggttctgccaattagctcggatccttgcctcttcagttggttttgtgagcacacacgaggccaggacccgggtatcaacgattcccctcaactgacgtaacccatggcgaccactcggcatcagcgcagtcccgatagcagcccgcgctcggaggatgaatcaggagcgcacacgtacagcaaccaggatggttccgtgaaggaacaggatcgatttctgcccattgctaatgtgagcagaatcatgaagaaagcccttccagctaatgccaagatatcgaaagatgccaaggagacggtgcaggaatgcgtttcagagttcatcagtttcatcactggggaagcctctgacaagtgtcagagggagaagaggaagaccatcaatggggacgacctgctgtgggcaatgggaactctagggtttgaaaactatgtggagcccctcaaggtctacctgcagaagtacagagaattggaaggtgaaaagacatcgatggccaaacagagtggcgatcagtctccttccaaggatgcatctagtggcagtactgttaatgggtctactgcaggcaatcccagtattagccctggcagcactgttaaatatagcggtggctactatccacagccctatgggagccaagctgcacagatgtatggacagcatcagatggtagctccttatcagatgcatatcaatactggcaaagctggtggtgcgggggctgctaacagtggagatcatcatcctagagggcagtggtagaagtagaagaatagacactgattttcttgtttattgtatagtgagtggttgttgcagagttctggatgtgtattgggatggagttatgaaaagaaaaattttgctttcgttttctctgcttcttcgcctatgtaatcagaatacatgggcttctcatgagggcttcatgggcatttagcataaattgaggtgagggctgtatttttctgtcaactttaaatttcaaaatcttgtacagtgcaatttggctgcctgtggttgtctaagcaaatagttgctctcctgtgaaatgggcacaactcaattattcggttattgtatatactgttttaagatttgttctttgtaagcatttgagcagctttctggatcgtataactgtccctgaacggctgtaatgctatagttatcagagtatgatgatggaattgaaggtcatcatctagtatgcataagatgatagtttaaacataagctttgcaccctcccattggttattcagttcagttttctgtcctcttggttggttcagcgaaataatcaatcaggctacaggaattcggcaaatcattataattcgctgtcatttgattcgtctgggcttcaggatcttcttttttcatctctcgtgtctatctgcgctaaatttctgtgctcttgcagatctgtcttccttcatgttttctgacaatatagttttggcttagtagcgaacaagtaccggccacatcagcacattaagagattatcccttttctaagaatcaggtagaacccaactgaacgggagaatgtatccttccagggcatggtccttttggttttcaagattaagatactgaatctgctgtttgctgccttcaatcttttacattctatgtttgcttatatccaggctagctactgctggaattctcgtgcttgggtgcctaccgtcagctactgagtattgttgtaacttgtaattgtacacaatgatgcttactggatttattgtgtaatggtacctattcaatatttcatcttttgctaatatcattctgggagggcagtagtagctatccaggctagctgccgtc

SEQ ID NO: 591 - DNA, 1181 bp, Pinus radiata
aaacgctttttgggtttggaaacaagattttgccatctgctgaagagcgcctggttttgatccagaattctcggattttgcttcattgggcttcgacttcagcaaaaatggacgagcaatccgcaatgcaacacatgcctatgcattacagggcaacgccttatccgaatgctcagcttcagcctaacattgctcatggagcgttccagcagccctccattcatggccatcctcatgctctatcttcccaccacaatcaattgccttatcagcagcaaattcatcagcaccaacgccagctgcatcatcaccagcagcagcagatcgaggttttctgggccaaccagatgcaggaaatcgagcaagctgttgatttcagaaatcacagtctccctctcgcgagaatcaagaagataatgaagtcagatgacgagaatgtcaggatgatatctgcggaggctcccgtggtgtttgccaaggcctgcgagatgttcatcaatgagcttactctcagggcctggattcacactgaagaaaacaagagacgaacccttcagaagaacgatatagctgcggccatagccaggaccgatatattcgatttcctgatcgatattgttcccagggatgagttgaaggaggatcaggttattaatcttggaaaccctagatctgtactctcagttggaagcagcagtaccaacgctgctgctgctgctgctgctgctaattcttttccttactattatttacccaaccagcattctgtgcctcatggtgtgtttgttgggaaacccatggatccgaccatttatatgcagcagccacagtctcccgtggcttacatgcctaatatatggcagtggggacatgtacaggcagaccaatccaggtcgcctaaccctgcaagttgaactctaacatgggctagcttctaaattcgtcatggtttgagggaatgcctgattgtgcgtgtgtgtttgtttctggctttttattagaaatgtcatttcgattgtaagcttggttgttctccaatggtttctcaagattagtatgcaattccaccatttgctctatgggtttcaattctgtgctgtaaatataaaacccctcgggaatcaaaggattttatagaattatcagctacttttccatactattccaccacaaaaaaaaaa

SEQ ID NO: 592 - DNA, 1181 bp, Pinus radiata; identical to SEQ ID NO: 591

SEQ ID NO: 593 - DNA, 978 bp, Pinus radiata
gctgcggcgcgcgtttggttcgttggatgacaaaaaacacattctaattgtatttattcatctcccctccaagagagcagcggcagccatggcagacttagcgagctccgtcaccagccaagaaagccctcactcagaagatacgaacaataacagccaaaaccagggttccaatgcccgggagcaggatcgattcctccccattgcgaacataagccgaattatgaagaaggcagttcctgccaacgccaagatcgcaaaggacgccaaggacactgtccaagaatgcgtttccgagttcatcagtttcattaccagcgaggcgagcgacaagtgccagcgtgaaaagcggaagacaatcaacggagacgacttgttatgggccatgggtactctagggtttgaggactacgtggagcctctcaagatttacttgcacaaatatagagaggcggagggtgacagcaaaggagctgctactagcagatctggtgtgggagatcctactaagaaagattcgagtaattttggagcattaccaaatattaggtgaataaattatgttcgataaaccagggattgaaccatattcaacaggtcagattttgcaggaagtggtcattagagaatctgtataagatgcttggaaggatgaaattgtgggattggaagctcctagtaataaaatacatgtttaatttttttgaaataataaaataacttgtgattaaagttttgccgagtaaccaatatgatcattgtacataagctaagtgcatgactgtagctctctcattttagttgcaatgtattgttcctttgccagatttttttggcacttattacccttttttgtgacctgcaaattatggcgtcattatgtcttggaagatgaaatgagactagttccacctgtattgcttcggtcaactgcatgtaattctagatggcttcttctgttgtgctttaaaaaaaaaa

SEQ ID NO: 594 - DNA, 1087 bp, Pinus radiata
gcttgattcggcagaagaagaaatattttagataatctaaaatcggcggaggggataaggcgagcggccataaaataaaggcagcgagagggtgggaggtgattggcaaaagcgaaaaattaaaaaaggggatttgagcgaacgaacgaacggtgaagatacacagaggatctctcaacggcttcatctccgtcgtcgtctctcctccttccatctccagcgtccgatctgatcttatcaaaggaagcccttaaatccctccagctttccaagcgcgggttctgttgctgtatcccaggtccctggtcatatggcggaagctggcagcccgggcagccaggaaagtcctcgttccggggaacaaagcccccagtccagcgtgcgggagcaggacaggttcctacccatcgccaacattagccgcatcatgaagaaggcgctgccggccaacggcaagatcgctaaagacgccaaggagaccgtgcaggagtgtgtctcggaatttatcagcttcatcaccagcgaggccagtgacaaatgccagcgagaaaagaggaagacaatcaacggcgatgacttgctctgggccatgagcacgctagggtttgaagattatatcgagcccttgaaggtttacttgctcatgtacagagaggcggagggtgacaataagggatcttcaaaatctggagtagaccaatatggaaagaaagagtcaaatgtacatcaagggattccaaatatgcagcagtctcagatgcagcatcatcatatggttacaatgcagggcaatgatctgtcatgatacatgagaggtcatgaattgctggttagtatgtagccaatcaaatttagatggctagttttgtgaggatcaaacgaaaacaattcatttaacttaattttatgttactcggcaaagcttttagcttgacctaaatgataggtagttgtgatagctagctttattgtacatggaagttgtgatttgtatgttgctgtacatgtgagttgttgtcactgtaagcaatgacatggagttatttttgtaaagtttctttaaaaaaatatttgtctaaaaaaaaaa

SEQ ID NO: 595 - DNA, 1024 bp, Pinus radiata
gcttttgataatatttgaattccataggcaaattgctctttttcttcttcttgtttctgtcgccactgagctccccggccccggtggccatggctgcatttcgcagggttctgttgctgtatcccaggtccctggtcatatggcggaagctggcagcccgggcagccaggaaagtcctcgttccggggaacaaagcccccagtccagcgtgcgggagcaggacaggttcctacccatcgccaacattagccgcatcatgaagaaggcgctgccggccaacggcaagatcgctaaagacgccaaggagaccgtgcaggagtgtgtctcggaatttatcagcttcatcaccagcgaggccagtgacaaatgccagcgagaaaagaggaagacaatcaacggcgatgacttgctctgggccatgagcacgctagggtttgaagattatatcgagcccttgaaggtttacttgctcatgtacagagaggcggagggtgacaataagggatcttcaaaatctggagtagaccaatatggaaagaaagagtcaaatgtacatcaagggattccaaatatgcagcagtctcagatgcagcatcatcatatggttacaatgcagggcaatgatctgtcatgatacatgagaggtcatgaattgctggttagtatgtagccaatcaaatttagatggctagttttgtgaggatcaaacgaaaacaattcatttaacttaattttatgttactcggcaaagcttttagcttgacctaaatgataggtagttgtgatagctagctttattgtacatggaagttgtgatttgtatgttgctgtacatgtgagttgttgtcactgtaagcaatgacatggagttatttttgtaaagtttctttaaaaaaatatttgtctatctaattccattaacggatttgtttcaaactggatagcatggtcaaattctgtccatgccacattttattagctttatcttacaagcaattttccgtttgtggttgcaaaaaaaaaa

SEQ ID NO: 596 - DNA, 831 bp, Pinus radiata
tattagcagagcgggccggggtttgaaggcatttgctacaatggcgagcaccagcgaggtagaggaccttccacgggccaacgttaggagagtggtgaaggggaagctgagccagctaatgaaggacaatccttcttcctccgccaaggacatcgccattcacaaggaggcccttttagcttgctccgaaagtgcccgcatcttcatacactacctctctgccacggcaaatgacatatgctgtgaatcaaagaggcaaacaataaatgcagacgatgttctcaaagctattgaggaaatggaatttcctgagcttctagatcctcttaaaacttccttggaagtttttcgaaaacagaatgcatcgaagaagtcagagagcaagacaaagagcacagatcggaagagaaaaagtgaaggtgatttggaaatggagaatggaaatggcagtcacacagaagatgcaaatgaagcacaagatgattttggcgaagaaaataaagaggatgagaatgatgacttagaagaagattagctgcttctcttgtcattgacgatagttgattccttcttagtttatctttttgtttttggcggcagcttggtagtttacaaaagtattgaatcaatgaagtttaaaccagctttttctctgtgttgagtggggacccgacatggtgtttgtatagcacatagttgcaattaatatatgcacaaatgcgtgaatatgtttatgttaatgagtgggcaatatatgcttgtagggaatttgcacaattctaacgaggcccaaataaaatacatgaatattagcatatgtcaaaaaaaaaa

SEQ ID NO: 597 - DNA, 2545 bp, Pinus radiata; identical to SEQ ID NO: 590

SEQ ID NO: 598 - skipped

SEQ ID NO: 599 - DNA, 1665 bp, Pinus radiata
aaaaccaagctttcatgcccaaaggccaaagatgctaatggtgctatctgtgcatttacgtgagtcaagagctagagcttctcccagtgctccaagatcattgaagattctatgaagccaccaaattttcggtctttactttctcgtgctaaacaaattttcacctccctcaattcagtcatttaacattggatccgatatcggagaaatatctgtaatattctccagttttaaaccaagatcccatgattcatgctgtaacctaatgcagtttaaagacccacaaaaaatccgtatgtgggatacaaagccctgttatttgctaaacccatctgaagtgcagaatttaacacccacaagaatccgtatgtgggatacaaatccctgttatttgctatacgctttctgtatgtatgaagttctgtaggcacctacgtatgcacatattccattgtcatcgggtataaaatactgtgttgctgcccaaaatcggtctcattcatctcgaggaagaggtactaaggttaactgcatctgtaaggagcttttagggttgtgatatctatcgtttcacttcaatggaaggcaactacccacatcttcaaagctcagcaacaccacctgtttctcatggaccatcaagcttgatgcacaattcgctcttccagcaacagcagccacagatgcctctgcaacatcatcagcagcagctacaggggttaatgcagcctcatctccattacatgcagatccagaaacagcagctgcagatgttttggcaacagcagatgcaagagatggaacaagttgcagagtttaagcagcatcaacttcctcttgccagaattaagaaaataatgaaatctgatgaagatgtgaagatgataagtgctgaagcccctgtcctattctcaaaggcatgcgagcttttcattttggagcttacattacgttcatggttacatactgaagagaacaaaagacgtactttgcagagaaacgatattgcaggagctataagtaggggtgatgttcttgattttcttcttgatattgttcctagagatgaagtcaaggatgaggaatatggaggacactggactgggattcctcaagcagaatctatatcttacggagggatacactttccactcatgcatgctcagccttaccatcacaattttaaccctgatgtgatggctgctcaacaaacaatgtctcagcaattaatgtcacagcagcctttaatgccagaccagccgttgatgtaccaacctccacagcaatgatcgtgaggttgagtggaggccagaaagtatcaatttagaatgatcaggctgattgctcaagagcctagatagcatcttcagaacagctagatcttctcagatacagtatttgctgatgagatacagctggggtgatatatttatattggttggtcccttatatattatcagatactaaggctgatcagtactctggtcttgttatgcctagctatattttgacaaaataagtgtttattaaaaatcttttcatggccaccagatgtattaatcatttatgctttttttggaaggatgaaaacgagggtttggctataaagcacagaaaatacaatcaagaatggaatataaacaagtttctgctttaaaaaaaaaa

SEQ ID NO: 600 - DNA, 1238 bp, Pinus radiata
gggagatattcattgaatatgtgaagggatttgttagaggagggagcgctttcattgtaaggacggtgttggggaaggacaggagagggcaggcagccatggaccaccacaaccaccaccaacatcatccatcttcttcttccggcggagcggcgccgcaaggcatgtctcagggctatccgggcggggtagctgcacagccctcgcctgtgggcatgcagggacaggccgggcagatagtgcagactggtcttcaccaaagcggagggcagcaggccttccaccaccatcacatgcagcaacaacagcagcagcaacagcagctccatatgttctgggcttttcaaatgcaagaaatcgagcaggtgagcgacttcaagaaccaccagctccccctcgcccgaatcaagaaaatcatgaaggccgacgaggatgttcgcatgatatcggcggaggcccccgttctgttcgccaaggcctgcgagatgttcattctggagctcaccatgcgctcatggatacacgccgaagaaaacaaacggagaacgttgcagaagaacgacattgcggctgccattaccagaactgacatattcgatttcctggtggacattgtgcccagggacgacctcaaggaggagggtttgggtttagggtttgccagaggtggcgtaacccccgagggttctttctattaccctcctccctccatgccccaatcgccacatcagcagggaatgatgggctcctcttccatcatgatgggcaggcctgttccacttcagatggacccatcggccatgtatatgcaccaacagcagcagccccgtccctatggaatgccaactcatcctcaccagcccatgtggcagcaccctcatcatcctcatcagcagcagcaacagcaacaaatgccggacggacaaagttatggacatccacatcagcagcagcagcagcacatgccggatggccagccttatgggcaacagcagatgacagatgaacattcttatggaacttcccctcgttctgccaactgagaagacaagtgtatttttcacccacgaattgatgtttcctttttaacactaggggctagagcttaacctaaattttgttttgtagctctcttgtcttgggaaagatgcatgtacttatttttggattctactattctgttactatgctgatataattttttcaattaattagaattgagttttgggaaaaaaaaa

SEQ ID NO: 601 - DNA, 3831 bp, Pinus radiata
ataaaagaaaattggaaatggattccccggataaaacaaaaatggaaatggattccccggatagaaacgtcaacactccttcttcaactgtccaggggtcaccatttttcaattacctttgtaatctttcaccaattaaacctgtgaagtcagtacacgttgcacagaccttttctgaactcaattttcctcctccaccagctgtcttcacctcacctcgcgttccttctcagaaggagtccaatttcttgaaaaggccctaccaaaaggacacgagagatgaagaaaacaaaagtgataacccgccgtgtgaaacagtcaaagactttgcagtgcccatgtctgattgtgatgtgccagcttcccttaatcctcttgcaaggaaaaatacaaattttgattcacttgcatcagaccaaacaaaatgtgaagataatacgatgtccacatttgctagctgcagtccttcaaagcttctggaagagtatttggccgatccagtggaggaagaaaactacacagttgattcgtccaaaattcatttaaagtcagcatcttctgcattagttaacactttagttgtggattcagataaaccacaagagacttctgatcagtgcagcaaaatgaaagacacggagatgattgaacagtcaaattttccagaggaatttctgggtactggtaaaattgcctctgaagctgagacatcacagggagatgaggaaggcaccttttctttgaactcagaaggaagcatgaaagcttcagttatcagaaagatgggacatgttggtcaaaatgatactgaggggttgtcaagtgtctggtcagatgtagatagtcaccattctaatacactattgtttgcaaacaactgtgaaacctcagagacaggtgtcagccatgatgaaaatttggtggatcaaacaacaggtagttttgccttcattctatccaaaggctcaacctgcgaaattgaagagtggcagaaggcatcatcatctgcagattgctcaggtgctttccttcagcaaggattaaaagacatagtgaatcactctgacagggcttgtagagaaagcgatcttgatagtactccacaactgatgtatgactctttcctggacacaaattcagctgctgatcccaatgtgaagttggacagtgaacaaaaatgcgtagtggaacagcagacctcttttggatgcaagcctggcaatcaatcacaacgtggcatacgcaggcgctgcctagattttgaggcctcagaagctcaaaggaaaaccatgagtaacagttcctggaagtctacaagtttaatgcctaaaacagatccattgttacattcaactcatgattcagagacaaatacttcatcatcagttgcatgtgaaaaaggtgtgacttctgactgcaagcaaattgttcctttaaagagagaaacaggtgcaggcattggaagaatttctcagtctacatctaacgtacggttctcctctttctcgtccaaaattactgaacttacgtcggataaatctgacagtaatgttcgaaataatggaaatactcctatatcagttaatattccctctggcattggtttacatttaaatagccttgccactaccatgtcacataattctggagttaatacgttaacgtcagcaaaggtatctgttagcacacaggggatgtcgccttcatctggtggaaaggaggtctcatctgatgttgtaggaagctctctaccttctgcaagctcaggaggaaatatctcagtaggatcaaactcaaacattgcttctgggatggttgtgtcaatggtggaaaagactagaatagaccagcaagaattgcagtcatctggaatgacgcagattggagtgacaagatcgactacctgttttcgatctgtaactgttggaataaagccattgcaaagtaggttacctttcaaatctgaagagagaaacttaagtcctcttggcaagaagaggccgccgctactagacatttctcaacaatcttcatttggtatgggggaggagttcagtcaaagtagtcccaggaagaagagaaagtctaccacaactggggataaagaaggctgcaagcgttgcaattgtaaaaaatcaaaatgtttgaaattatactgtgagtgttttgcagctggagtatattgcgttgagccttgcacgtgccaagaatgctttaacaaacctgaatatgaggacatggttcttggtacccgccagcagatagaatctcgcaacccccttgcttttgctcctaagattgttcgtggtgctgattctccaccagcaaatggggatgagtgtagtgagactccatcatctgcaaggcacaaaagaggatgcaactgcaagaaatcaatgtgcctgaaaaaatactgtgaatgttatcaggctggtgttggctgctcagatggctgcagatgtgaaggctgtaaaaatgtgtatggcaagaaagaaggaggatcagatgatatagaagagaatgaaactccaattgagggatgggacaaggattctttagaggagaagactgaagtgcatgatgttggaaatgatatcctgctttctgagcaacaacatgccaaggatctttcacctttaacaccatctttccaatattctggtcagggaaaatcgtctgccaaattgaattcttgtggaaagaagcattttacttcagaagacttagagtctccaacagtatctcagccttctgcaaagccaccaaggtcgccaggaaagattctaaggcccacaaaagggctacaaggaaatatttctgctatccataaccgtcaggccggatcaagaacctcagcttctccaatctttacttcaaagatggataaatcagggcaattctcacctcaatgggactgccttggtgatatttgcacactcactccaatgcttcatccacccatgagaccttctgcgacttctgcatctagtgtagacgggattgatgtttctcctttcagtggacaacagaatgaaactccaagcatgagcagtcgtccattagcttccagacattcttgtcatgtcggatcatcccttggctttcgccagccagcagcacgttctccaatttgtacctcggataatatccattggcggacacctgtaaatgcaaaagtaacccctgtgacacctgcactttctagtacggcttgcactgcaggaaataagctttcagatgcatcagattttgacatgcagtcacatgatgtatcttgttctctggaagatgacactccagacatcttgaagaacaattgttctcccacaaggggcttaaaggcaagctctcctaatcagaagagggtttccccaccacataattattgtccaaaagagatgatgaacaggcgaccaatctcatctcctggtattagaagtggcagaaagtacatcttgcagtcagtgccttcatttccacctcttactcctttgccaggcgaggggcaggcgaacgagtaaacaagaataagcagaaggtgctatgttgtcagatttttgaatttttatttaaaatagtttatattccagcagatgtattttagtcttcttgcaggacatactggtccatcattgagacgactgtttagaagttagttggtacggctcgaattttcttatttgtttcgattcggtgctttgggtagcttaaatagcctcgtgtcaagcttttatgagcagtcatttgcatggaatgcctcatattgtgaaccaacattcttgaacttttctggaatttcggaacactgatcttgctgccccaaaaaaaaaa

SEQ ID NO: 602 - DNA, 1995 bp, Pinus radiata
gttcattcccgtctcggttgttgcagagcgaagcaagcagtcagatcgatttttgttttcagtttttgttcaattcttcgtagatctgctgtatctgcgttttacaacgttgcatataaggttgttttagggcttagatccgactttgtcgggtatttttctacatttggggatttttgggctcaaatttggttgtctagaacctgatttggaaatctcaagtttgtgtggaaggcatgtggtctggctctctctgctgaaggtttgattgtgttttaggcaaggccgctcagaattcttgaggagtttctttttgttatgatagaaccttggcttcggcggggttttcgtcggtgtggggcgctagttgtggtttcggtattttcgattcactgcaagtctaaaagaaattgaaaccctggttctttgatattgaggcgtgggcttttcgattccctcagggtttgtcgtctaaatcatatgtcgcctaaatgattggagacgcaaagcatctttctttagcagaatcgcttcaatctggcgaagcataagtctaccatgaagaaaaaactcgatactcggtttcctgcgtctcggattaaaaagataatgcaagctgatgaggacattggcaagattgcacaggcagtgcctctcttagtatcaaaatctttggagctatttttacaagacctctgtgatcgaacatatgaaataacccttcagaggggtgctaagactgtgagtgcttcacatctgaaacaatgtgtgcacaggtacaatgtttttgatttcctacgagagatagtgaacaaggtcccagacatggggggttcagatgctgctactggtgaagagaggaatggtgggcggaggagaaaagctcaagaaggagacgaaaatgagagtgatgaggatgaagttaagagggctaggatgggtgcacaccatggaagcggaagaggacggggaagaagaggtagaggcagaggatcaagaggtggttcaagtgggagaaatggcattacagttgagaagtttgaggatgaagacctagatttgtcatctgagcacagtgaaaaacaggagaaagtttcagaaatatttactgatgttaacactgaaacaagagagaccaaggtagcagtgaatttggtgagcactcctgtggtaagagactttgatcttaacatggagctggatgagagtggggttgttgcaagcatgccaacgcagcctgttgtcaaactggaacaccatcccagtgacgctgcaaatgtgcctgttattgttaaagaggctgatgaatttcctagcgatgttccaattgtgcaacatcctattaaacaggaagagcaatatcctaattggtctcattctgatgttgataatgtagccatagattcgatgcagtttcatgtgcactcagatagaattgttgatcaggatgaagatgattatgacgaggatggataatgtgttattaagcagggatttgttttctgcaagagttttagcaaggttgcagtgtagaatttggcaatctttcacatgcagcatagattaacatcatagcctcactgactgtcagagaaagggcactaaaagatctcaccaactgtaatgggtttttgtacatactattttgcaaggagggtaagaaatccttattgatttgaacgcttatttttcaggcattgaagaattcagccaagtggagttctttcaatctttgttatctctctggatggttgtctcatgtgctcaaaggaaggatcttgtattcacctttcggtcactgaagaatttacaaccagctaggtggtccttttctctttatttcccttgtatggttgagtacatccacaggtgcccaaatagaaatattgctgtataaaaattatagttatatgcatatcatggataatttcttgtcaagtgtcttttgatgcttcccaattgcaatgtgatagaaattttcatccaaaaaaaaaa

SEQ ID NO: 603 - DNA, 2128 bp, Pinus radiata
tttttatctcgtgagctggttaactgtccggcacactctctcagtattggaatagctatgagtggtatactgtagagaatattgtgcgttgattcctcctttttctactgaaatcccaattgaaatggtgtctgctcatggggttttaggatgacccaagtgcagtttgatcttcaaacgatcttaatcttgtcaatgctctttgtgggtgcgtctcattctcagtcttccgccatgtttcctgcaggttcaatccagagtatgagcaacggagttgggctggtatcagctcctttcttaatttcaaatgtacccaacaacaagaattgtctgcagagggatcttataaatgagcttcatgaagctggcatctatgattatgctcagagtctgggaattattcagaatggggttattgttgtgcaaaatgagttatggccaggggctggcgcgtattcgttgcctatctctaatgggacacctaccacttatccacaatttaacccatgcccatcagtgccattggtttctgtggatactggaagtaatggttcttcatcaagaggtagtgacggggcgatggccagacttgcatcagacaatatcatggcgaggttgaaccatttggatgctgaaggcgacgaatttgagtctccagggacagtagggaggaagagaagacgaattcatcgatccagtattggtgtaactggtggcagaggactacggcatttcagcatgaaagtttgtaagaaagtggagagcaagggctggacaacatacaacgaggttgcatctgaattagtggccgaatttgtgaatccaaacagcacacatctttcacaagatcagcaacagtttgatgagaagaacattaggaggagggtgtatgatgcactgaacgtactgatggccatggacataatatcaaaggagaaaaaggagattagatggaaagggctacctacaacaaatctaagtgacattgaacggctaaagactgagcgaaagaggttgacaaacaggattgacaaaaagagggcttatttacaggaactcaaagaacagataacaggccttcaaaatctagtacagcggaatgaaagagtatatgagtcaggcaatagtccttctggaggtgtgacattaccattcatattggtgaagactcgtccccatgcaactgttgacattgagatctcagaagacatgcagctagttcacttcgacttcaatagtacaccatttgaattacatgacgatgcatttgtgctgaaagcaatgcgattttgcaaaacaccagatagtaatggtccagttgatgaaaagccagacaacgaatttatgaaaaattactcaattctatcaaccatgcacaggggtacctcatcccctcattcaacaaggacaagtgatacagattcctattctctctcaagtattcctgggaaaatctgctcttcctcccctgacccaggcataataaaaacacgtattaagaacgagaactttatatgatggtccatgagcttgttgccaagcagcttcagctttgtactagtaagtgctcctgctctgatgggagtcatactcagaccgagtttatatgtattgcttcttttcatttatacctgcttgtcattacttgtatagtatatatgtttcagcatgtgggctacctgttagcccaagcgggaagagttatatattgaattgagagagtgagaaatgtacattattgtgatataaagaggaattttctttatattccaaactgtcctattaggacattaagcagtcatttatagactttatgcagtctattcgtgtactgagttcttcagttaaaaccagaaatatgttcaatattgaacaacgaggatcatacagattgaccctctttttttcaggtctagaggatttccttgattcgagttttgatgtctgttaataagttaaagcaacttattttcatttgcatgcttgttaaaatttatactccgaggctaggctacttgagggatgagattggacttatatgtttctcagatttgggctaggtggccaggactttgtatattatttgttgtttcctatatatgaactgttacatgccctaaaaaaaaaa

SEQ ID NO: 604 - DNA, 618 bp, Pinus radiata
ggaaatttccgagatctcgttctgtatttctctgaatctttcaggctccaccttaattcagcccacggaagaagaagaggtagcagagggagggatggcagtttcacagatgcagcagcgttacattaatttcactaattctcttttccaggagggattcgtggatgaacaattcacacaacttcagcagctgcaagatgagagtaatcctgattttgttgcggaggttgtttttttgttctttgaggattctgataaactactggctgacttgtcaaagactctcaatcaggaaccagttgatttcaagagagttgatggctgtgtgcaccaattcaagggtagcagctcaagtataggagcgcggcgagtaatgaatacgtgtgtaacgtttcgtgcattttgtcaagataaaaatagagaaggggagtgttacctcgtgaaaaacaagctggagactctgtttcagcttgagaaacagattgtagaagctggtggaactgttcctatggcagagtaagcactgagacataatattccatttctgggataattaagaactggaggaaaaagtgagttacaatcctggagtggctggataacagctagaattaatgc

SEQ ID NO: 605 - DNA, 1167 bp, Pinus radiata
ggcgtttttggcgcagaggacagaggtgagcagggatgtgagaagggtacaaatgtcaagctctcttcttctatttcgtggcttcaacgcattgatcatttatcattaatattacggatctcacggctattggcagaaatttccgagatctcgttctgtatttctctgaatctttcaggctccaccttaattcagcccacgcgaagaagaagaggtagcagagggagggatggcagtttcacagatgcagcagcgttacattaatttcactaattctcttttccaggagggattcgtggatgaacaattcacacaacttcagcagctgcaagatgagagtaatcctgattttgttgcggaggttgtttttttgttctttgaggattctgataaactactggctgacttgtcaaagactctcaatcaggaaccagttgatttcaagagagttgatggctgtgtgcaccaattcaagggtagcagctcaagtataggagcgcggcgagtaatgaatacgtgtgtaacgtttcgtgcattttgtcaagataaaaatagagaaggatgcttatattgtttacaacaaatgaagcaggagtgttacctcgtgaaaaacaagctggagactctgtttcagcttgagaaacagattgtagaagctggtggaactgttcctatggcagagtaagcactgagacataatattccatttctgggataattaagaactggaggaaaaagtgagttacaatcctggagtggctggataacagctagaattaatgctaaaatttccacttttgtttctgtaaattataaatatgttagcatctatcctgaatagatcaacaaagcaagtgtgctatagcgaagaacagctggtggttgtgccagctggtaatgaattccatttctctaagttgtgccatacacacatggaagagtgaaattggcatcagtgatatgggccagtagatgagacctctattaccatgggaggttggttgtctttactctgatgcattatttgcaaggaatgttatgtaatagctgtcaactttactaaactgtgctagttcattttgatcaatgcatgagttcaagtcttaggaatgcttaacaaaattcacgtgggttgacaattattttgaagtttatagaaaaaaaaaa

SEQ ID NO: 606 - DNA, 864 bp, Pinus radiata
gcctgcgatattcattctttaccattcgcacattggaggattcaaccgcaaaaattcccaatccttcttgcgtctatcaagggcagatgcagcattaaaagctgagcggccagagttttgagtcgcagagaaccagaaaaaaaatggacgtcattcagttgcagcgcaggttcatcgattacacttcgtctctgtaccgggagggattcctggacgagcaattcacgcaactgcagcaactgcaggacgagagcaatcctgaattcgtggctgaagtggtctcgctcttctttgaagatgccgagaaacttctagcagatttatccaaaacgcttgctcaacagccgattgacttcaagaaagtagatgctcatgtccaccagttcaagggtagcagttccagcataggagcgcatcgagtgaaaaatgaatgtatatcattccgtgccttttgtgaacagagaaacagagaaggctgtctccaatgcttggagcaactgaaacaggagtattacaatgttaagaacaagcttgagactctatttcagctcgagcatcagattctggaggctggtggaactattcccatgtcagagtgagcctttagagattggtaaatctcgctggaccaccatcggctatctgtaaatgtctagacctaggagggaagctgtccaagatgtagttgcaagcatatgttatataaacccatgaaggttttttgacttcagtgcacgggcagctagtgtgttattctattccaactttcatagcatctctctatgatgcatttatagagaagatactcatgtaatcttttctttataattaacctagctggcattttccccgttaaaaaaaaaa

SEQ ID NO: 607 - DNA, 1040 bp, Pinus radiata
gctgaaacttgatagaagctgcagagttacacgagttgtatgattagtcagcattattgaaggaacggcaccttttggttcttgcttcgagattttggagcccggattcccgatgtacacaatagcgcatgaaagtaaatacgcaactgcataattttcccttcagcagccatggttacctcacgaatgtcttcggcgatgagaatgaagaaggaaaaaaatgctgcatgtggtgagcatggggatgaactggttcgatgcgacgaaatgcatgtattggcggttgatgattgcctgatagaacggaaggtcattgaaaagcttttgaagactaactttttcaaagttacctctgtagatagtgccgaaagagcgctagaagtcttggggtttcatgaagagcagtcgacatgtgcgaccactaacgcgttcaaggttaatatgatcattaccgattattgtatgccaggaatgacgggctatgatctgctgaagaaagtcaaggaaaccaaatgtctgaaggagattcctgttgtgatcatatcttcagaaaatgtgccgcagagaataacaagctgtctggcagaaggagcaaaagattttatcataaaaccgctaaagcttgcagacatcacgaagttaaaaggacacattaaacctccaaaagatgtagcgagtgtcagcgccagagccagtggtcctgtaagctctaagaggaaaatctcgtccggaagaggtaggggcaaaatgtctgagaggcgtccccgcgttgatggcctgacatcggtgtgacaccatcgatattattcctcgacttttaaggggcctgtgagctattcttcctatggccagaatactggatttctacttgccagacttctataagactacaacataacagccaatttctcgtattttccctatttctttccttgttgtctcttccacactcccatggattcgatcatgggtttcataaatgcaactttggtaattgagaaatggaaatcatgttttacttctaaacaccaaaaaaaaaa

SEQ ID NO: 608 - DNA, 2216 bp, Pinus radiata
cctatcagcaatctcggaccaattacagaagcaattataccagggacccgtgcttgtttttgaaaatgtcgatctgtgggaccatacccaggaaatctgcctcgtcactttcttttggatactcgagtcacatttggagccatctgtcacgcgatatctacttgaactgcaacaaagaatgctttgactccagtttgtggacttcatcagatgatgcactaacggactgtgaccaggatttggtttctgcctccttgtggtctgtccaagatgtataatgccaggaagtatcctgcagttagtttgatgcctcctaggtcgcaaggtcctgagcagcacatggctagcccagtcccgatggtttcaaacaacacaaataatagtcctgttgcatctgggatggcatcaaagcaacgtctccggtggactcctgatctccatcagcgctttgtggatgctgttacagaacttggtggaccagacagagcaacgccaaaaggtgttttaagggttatgggagtaacaggacttactatctatcatgtcaagagtcatttacagaagtatcgtttgtccaaataccttccagactccatgggtgatggcttgaagtcagaaaagaaagaatctactgatatcctctccaatttagaggctgcatcaggagtgcaaatctcagaagcactgcagatgcagatggaggtccaaaaacgtctgcacgagcagattgaggtacaaaggcaattgcagttgcgcattgaggcacaagggaagtatctgcagaagatcattgaagaacagcaaagactaagtggtgcattgaaggatggtacagcttcagcaagttttagtttgcctgctagcaaagggcaacctgaacaggcttctgatcttaaaccagacccatctaacctgattcttatgccagtggccgcccaagatggtggaggaactggaggagcttctagttcagtggcaaaacattctttgaattgcttgtctcatgatgaatctccatcattttcttcacagcagggtccaccgtcgccagagtcattaggagatgatgaatcgtccagcggggcaaattcacctctggaaagtccacaaagtaggcaaccaccccagaagaaacctagattggacatcatgtcagcatcttcagatcagcaggtttgtaggcagtctaagaaggagagggcagggtgtgatgcggagtccctttctggttcaagttttcagcagagggactcgttgccattaattttaaacttacatcatcaactgccagattctcatactgttctacatccattgcgaccttctcagacagcagtttcaggtgctgctttgtccacttcacctccctcacaaccccagaatcaacagttgtcacagaaaaaacatgctgtgagtagtgagatgtcagctagtgcacatatgcttcaagaatcatcaagggatgcatgctatccttttaactcttcctcgagcataacaggtcaaggattaactttaacagaaatccttataaaagaggagaccaaagattgtaggaaactcatacccaagaaaatttgatttctctccctttgtatttctattaaccttagcttagaaagttggattatgagaggttgaaattcagaagctttgatatgtttaaattttgggctttggctgcagatctacaggaggggagtgggcatgagagagagcatgcttcaggataagtgccttgtgaagcaggaaggttgtcatagtaaaagtgatttgcctccttgaatttgtacaaggaccaattggtgagttcagtgtaatatgcaagttagctgccttcagttacaaaattagctagagcctgttactgctcccggtattatttaaggctgtatatcaactctgatttagatgtctgtaaagtaaacctcaatttgattgattttggtgataaatggcctgcattccctaaatgggtacatccatccagcaaggtgattttctagccatgggaatggaagtagtgagatccagtctgtgacaccagatcaaatgcttctggcctggctctaatgatatttatgattaattgctggactttgttttcaaattgttgattaccttgatctccgggaatgcttatttcatgtggatttctgaaagcttgtttacaaatccaaacttgtactgctgccaactttactgttaatataaaa

SEQ ID NO: 609 - DNA, 1187 bp, Pinus radiata
cccaatacacacagccacaggcagaagttagttgttgttgttgtaaagaatggtagattggagatggaggacgccagtgagcaatggagaatggagataaagggcgccgggcctgcccccgccgctgcctctgcccccgcgtattgaaagtgggacattctctcaagagcaacaggagcagcagaaggcaggtaacagcaggagccaggtaggtatgcaatctgatcttggccagcagcaatcccgtggtgttcgtgagtgtgagagagggattttgcggtgtgtgtgaaaggtcaataatagatatagatatagatatgaaagaggaggattggttggcgaaatgggaagaggagctaccatcaccggaggagctgatgccgttgacgcagaatctgatcacccccgatctcgctgcggccttcaaaattcacacatcctctgcctctgcctctgctccaacggaatccgggtccgtctttccgggatccggtcagcagcagcaacgtccagggggcgagcccccgaagaggatcgaattggaggaggaggagtcatcggtgggaggtgtgacagagaacgtgggagaggagccagctcggacgctgaaacggccccgactggtctggacccctcaactccacaagcgattcgtggacgctgtcgcccatctgggcatcaagaacgccgtccccaagaccataatgcagctgatgaacgtggagggcctcacccgcgagaacgtagccagtcatctacaaaaatacaggctttacttgaagcgaatgcagggcttgtcgtccgagggtccctctgcatgtgaccagctcttcgcctccactcccgttccacccagtcatttcctgcatagggacgacatggtggtgcccctcgttcccatgggtatcggtgttccaggattgagccacggtcatatggtcgccgggccaccgcattacgggggttttgatcccaggtttcttactactctctccaggcagcagcagcagcagcagccgccccctcctcagagactagcaccttctgctgcaactcctcgaggcgagtatgtcatggtagaagacttatcctccacagccacgccccctcgccaggttcttaccctgttccccactggtgacaattaattattttattacttttccctttcagcggatccttacctt

SEQ ID NO: 610 - DNA, 1613 bp, Pinus radiata
gtattgtgattgattggctgctgagaattcgtcttagatcttcatagtattcttacataattatctgctttctgtcctgagcacttttgaggaggccttcaattacaggttttttttttctcacgcagaaatacatcaggtgttgggttgctgatcaatatagaagcatcatgtaccagatggagtaccccagcaatccagggatagtactgaatcatgggagagcgccatctcagcctgaaaggcagcaccagcagcctgtattgacaggttcttcccattatccatgtgaccccagtgttgttgtttctgcagaccccaagcctcgcctcagatggactccagagctccatgaacgatttgtagatgctgttagtcaactgggtggccctgataaagccacgccgaagtctgttctgagagagatgggtgtgaagggccttactctgtaccacttgaaaagccatcttcaggtttgctccgtccccacccttcccattctaagagagttctgctcattattacaatttttttcaggaggaagttctgatggtggacactgcctaagcaggatggcccgggatagcagcatcgcaccaaatcatgaagcaatgcagattgctgatgctctgagagctcagatagaagttcagagaagactccatgagcagctagaggttcaaaggcgcttgcagttgagaatagaggcgcagggtaaatatttgcagaccatattagagaaagcacagcagacattggcatcagaagcatcgacatcagcaggccttgaagccacaagagccaagcttgcagatttggcctccaagcttcctacaaacagcgtgaagccaaattactctccagtgaaagtggctccattgatggacattcatagacaagatcatggggatctagaggccaagccccaccttagagatcgttgctctcaaaatcagtttgcaggccatacaatggagcagagattgaatgaatccgagagtctaattgagaagaaaaggtgcagaaaacttttccatgagagaaatggagggaattcccctaccaagctgcgagaattgggccttaatgcctctgcctgtaaaacagaaaaagaacaagaagaagaggaagagttcataaagcccactactgttgaaaggcctgctgcaactagagcattagtggatgagagaatggccatgcttgtacagtctaatggcctctctttaatccaggctgatcatgaaccaggactgtaccatccacattccatgttaggcaattgtcggaaggtggcagaaggattggatttgaacaggaaaggggagggatcagttccccagcagggaagagagctggatctcaatgcatatggatggggcagatgaaacatctcaatctcaaagcagttgtttgtcatgctatttttgtagattttggtcttatcccacaactaatctatctatatgttaacctcttgtatggtatgggatatctaggctggtatcaagcacactcatttatttgagatatgtgatcagataatgttttggaagctactttgctacctgtatattttaatacattctgtactttgaccattaaaaaaaaaa

SEQ ID NO: 611 - DNA, 1794 bp, Pinus radiata
ggctcctcctatcacactgcttaaaaggtaacgagtcactgcttttgctactcttaatcagggaagaaaggaatattcagttacaaaattctcggcttcgcaataataagcgacccccgcttaccttctatcagattatgacctactttcaacttgcagtctcttcaagatgtatcatccaaaaagcatttccacgtctcatagtcatgaccaagacatcagtagtggtgctcctgtgggagcaaacgatgctttaaatagcttgtctacttcggcgatggcttcaaaacaaaggttgcgatggactcctgatctccatgagcgcttcgtgaatgctgtcacccaacttggtggagcagatagagcaacacccaagggtgttttgagaatgatgggcatacaatggctcactatctatcaggttaagagccatttacagaaatttcgcttggcccgatatattcccggttccatggatgatggtcaaaatatgggaaggaaagaggctccgggcatcctctcaaacctagatgccagatcgggcttacagatcacagatgcattgaagatgcaaatggaggtgcagacacggttgcatgaacagcttgaggtacagaggcaattacagcaacgcattgaggcacagggaaagtattttcagaagatcttagaagaacaccagagaattggaggtgttttgaaagactctgctaattcagtagaatgtctctcagttatgtctggggagcaatctgcacaggattctgatgtaaaattagacttgtctgctcatcctacacaagctacttcacaggacggttctggaccaggaagagcttgtaataaactagacattattttgcataataatgcatctgatgatgaatctaaatcattctcttcgcaacagaacccatcatccaatagtttgtctagtgcacttagtttgccattggaaagtacaaagccagctgagccagcccttaagaaactgagattggagaagccatcatcatcggagatacatatatgtaatcagtctgaccaaaagcatatcaataggttcagctcagatcagacagctgaggttaaatgtgatcctgatattggtggtcagacctctgtttctacaggacatgaatgtcaacagggccactctggctcaagtgttgaacagaggcagttacatgttccaattcaagattcacatctatctcttaatgtgcagcgatcagattcagtaactaatttgagcagtctacctgaatcccagccacagttggatgcagaacttcccaaatttcttcatttacatgagacaccaagtgatcacacatcatatggtgtgatgaaaagatcggatatccacagaaacttgcaccaggactcgtgatttgtcaatatcaaaggctgaggagcaacaatagtatttcagtgaagttagcgacaaaattgatgtggatggcaccctctcactgagacaaatatttacataggagttagatgctatgttggttcacatttcaattacaaatgacatgtactgaatcacatattgattctgttgatgatcttttccatcaaaatatatgttctactatagaatactaaaagttcattttatgctccaactctatcactggttcaccgtacttacctgaaagttaattgttcatccttactgaagtgggtttaactgtagtccaccttccatacatgagaaatgttctggaaaggccatgagaatgcaggacaactcatccaatctccacttttttcgtctttcttatctat

SEQ ID NO: 612 - DNA, 2249 bp, Pinus radiata
cttttttcttctgaaaccatccgaggatagtacgtctgtttagttaaagagagaaggacaatttggtagacagaatcgcgctgcaattcaaattttgcgaccggccgtctaaggtaaacctctggaaaaaatgatcggctttttgagcggaaaatgttatagatggcagacgtatcttccattccaataaaattaaaatctgggggtttgtgatcagtggagaaaacaggtctgaaaaaagatcatatgaattgctttgtgcatgaaatatacgcaattgtaacttttatattgaattgacttttgaatccaagttcagaagggcgccgaagttattttcaatgctgtgattattgcagtgtggaaataggtatgctgttcgttccgtccttgttttagtgagggttcaacataactccacgtcttttagatacctacgtcgtcaccttggcttgggaggtctgcacaatatatatttttttttaatcatcgcaaatcatatcgatttttttcatcatcgtcgtttaccctgtgatgagaaggcaaaagctaccgggattaagttattgcgaaggaaacaccatggtcagtctcaattcctttcccgcttctatggcttctggtgaatcatggaacccagcatgttcttcgcatctgctgccccaaaatctttctcccaattgctttatgccttcagattactctgtttttccatcctcatcttctaacaaggaactgtctaattccaccttcgttcagccaaatgccacttcgcatatgattatgccagggtcgacgaccttatgtaccaatcttcagtcttccaagcctattacttctcagcagcagcagcctccttttgacagtttgcctttaatatatccaccgtcgaagagtccagttcagtctcaacaatctggggtttgcgaagctgcattcttaagggattctactaagtccactagtcaagatgtaggaatgggggatctattccctgattttcttatctttcctccgaatgctttagaatgcagccaaccccttgagaatattgatgctactcgaattgcccctcaatatgatccaaatcaaagtgaatggcacacatgggcggatagacttgattcatcggatgatgcattgtgtcctggtttttggaaagagcccgcgaacgtcgacaacaatccaaaaactgggctgaacacaatcaatcagacatcaactgtttcaactacaaatgtgggatcgcaccagacacaactacagccgcagctttgccaacagatttttgcccccacagtaggtactcatctggctcccagtcccacagcatgtgcgactacaacatccagtaagacacgattaaagtggaccccagagctccatgagcgttttgtggaagctgttaatcaacttggtggtgccgagagagccacaccaaaaggggttttaaagtttatggactcagaagggttgacaatttatcatgtcaaaagtcaccttcagaagtatcggatggccaagtacattccaaagcacgcggacgggatggaagacaaaacgaggaactcttttgatacttctgcatcttttgacctaaaaacgggcatgcaaattacagaggcgttacgcttacagatggatgttcagaagaagttacacgagcagcttgagacccaaagaactttacaattacagatagaagagtatggcaaacgcctacagaagatgcttgaagagcagcaaaaaacaggcagaaaaatagaatgcgaccctaaggcggcggatgaccaaagtaagtcagatgctgtgggaggctcaactccagaatgagaagttggatgagaataacataagatgacattacattctggttcgaaaactttgatcaaccttatcagcaatacactgattcacaactgaaacctttctacatgctttgtaatttgttagcaacttattttctcaattattacctccgtggtactggtatgtcatgtagagtatcaatctgactggcagaagtccactgactagggattggtgagaatcgagactctgaaagtaatcatattgaccatgaaagtgagcattatttgaatgcctttggggaaaatctcaaatctgtaaaagtattgttattcatctcaaaatgctctgggaatatttggagaatgagaacagggttcgcatctaaaccgtagcgaggccaggatttatgttattccaggttttcttaaacaaattcc

SEQ ID NO: 613 - DNA, 1980 bp, Pinus radiata
gattttttgaaggagctgaaataatttctttagaacactcttgtgcttcaagacaatgacaaatggcagaatgtgacgacggtctacggcggtgaaattgtcaataaacagtatgttcggtttctttcttccttttaatggcagggtatttgaaccctgaatctttaagaagtgcataaagattcctcgaatgagctgaaagaatcatctctagggtaaattatgcttgtttacaggtagtcttgttaaacctcttatagaatcatagatcatgtttcaaaataagaagttttcaacagctggccttgttcctcaaagattccatggatctgagcaacggggtgcaggcccattaggggttacttctggttcatctggtagtccagttacatctggaggcagcggatcagcaaaacaacggcttcgttggacacctgacttgcatgaccggtttgtggaggcaatcaatcagcttggtggtgcagatagggcgactcccaagggagtacttaaggtgatgggtgttcaaggacttaccatctatcatgtgaaaagccatttgcagaaatatcgactagcaaagtacattcccgagtcattagaaggaggaaaatctgataagaaaaaggggaacgagataatttcaaatttagaggcgacatcgggaacccagattgcagaagctttacagatgcagatggaagttcaaaaacggctgcatgaacaactcgaggtccaaagacaattgcagctaaggattgaagcccagggtcggtatttgcagaagatcatagaggaacagcagaagatgggcactgccaaacatgaaacattgtcttcccctgaaacctcaccacctcggtatggagaacctggtgacatcacagataaggcttttcctgattctcaaagtccaggaaaaagtggcagacagaggcaagatggaaatgctgctatgccctcagttgatattgctcaaacggatcaatctgctgatgttgcttatggtagagatgggccgcagcttcaagcttcatcatatgcatacagggttggtgatggcatgacgtcttcagacagcccaaagtttggttcaccttcaaaaagaagtagactaaataatgatacgggacaaccaaaacaggagaatttatcaagtcatcctcgtgatcagcaacagacactaccaatgtcatactcaagccaggcctcccatctaaaagttggagaagtgcctggttcaatctatcagaacagggttgtaggtttggtaggtaagattgaaactaggccatcccagagtactgcagatttgcaggctgagcaatcaccaggaaagttgtcaagaaacaatttagactgtatatctcatgctcaggaatttcataggccattgtgtgcgaaaactgcttctgattctataagatttgtatctcctggatcccagattcaagttccagcttcaagtttgcctgcttcatctcatgatgaattttccagtgcattggatgggcatgatggttgccataatgtttcatcttcccaagtgagtttgtttgggccatgggcataagataataaactgtcatagctaaaggctaaatgaaatggccttagactttcaggacttagaacactggtgccaaccagagaatggcgttgagcagagaatagcatgcaatgtacagtgtttaacattgttgtttgtttcagggcatatggactagaccattattactctcaatattcgtgatgcacatagagacagcaaatccttgtcatttaatttctggaacatcagtgtcaatgatctctgcttcacatctcaaggttcagagtggatgtgagtttgtaagtatctcatcttttgtcatacagattatgagatcagttaagtaatgtatgtatggaggctatatcatgcattgttcacattttgtagttattgaaggcatggatttgtatttattaaaaaaaaaa

SEQ ID NO: 614 - DNA, 1382 bp, Pinus radiata
atggccacgaggatatttgctctgattgatgagttctgaagcatgaatagctttgttcccaattttaattcccaacctgagaaccgaaatcccacatcaaaattaattccccagacagagaaaatgtatcaggtgaagaagcccaccatggaatgtcactcggagaggcctgttatgttacaggaaatcaatgttccaactgaaacagggctagttctgtcaacagacccaaagcctcgattgaggtggactgcagagcttcatgagagattcgtagacgctgtgactaagcttggaggtccagataaggcgacgccgaaggctgtgaggacccgcatgggtgtcgaaggccttactctttatcacctaaagagccatcttcagaaatacaggcttggcaagcagcctcacaaggaagttaatgtggacactagccgggatggatcgtctcatggaggacctgttgcaggatatgggtcaacagcttgcagggttcctgaggttcaagttgcatgcaattctgtttctagcatcatcccagcaaatatgacagagaccttacaaatcacagaggctctgaggatgcaaatggaggtacagagaagattgcacgaacagctggaggttcaaagacacttgcaacttcgtatagaagcacagggaaagtacttgcagtcaattctagaaaaagcaagggaaactcttgcaggttacaacgtggggtcaattggattggaagctactcgtgcagaactttcggaattggcctcaaaagtgaaaagtgaatgttttaattctacattttctgctctgaccttctccacgatgcctgaaatccctggtctatttccagaatctcagattgcccatcagcaatcccaggccgcagactgttctgcatatagctgcctcacttcaaatgagagttctgagaagagtcctacagagaatttgcaggctggtggtagaaaacgcccaaggtctgcttatgataacaaagtgcagttttggcaggatgaaatcagagaagatatcaggctgcaagaactgacaggagaagaaaatctttcttcaccttcctctaggaccaaggattcgtcaattgtatttcatgagagggctaatagtgacatagtacaagcagaagaaaatggcaaccgtttatctgacaaaaaaggaaaagagtatgaaatgaatggagtgcttgttgatccacccataacaagaacattggccttttctagtgctttatctctgcaagaaaatagtcaaatgtatgagagttccaaagtttatacgaatcaagataaaacacgttccaaagggtataacaaattctctaaaatgacacagggatttggacttgaattccaacggtgata

SEQ ID NO: 615 - DNA, 1697 bp, Pinus radiata
gttttcagatgttgcattttaatggcgagaatttttgttggggttgcaggggattgaattgcagccaagaagtttatatccatattcatatatagagattgcagaattttcatcctaattacggcacttgtgttgagcaagcactcatgaacagcaaattctatcagcccatctgaattttcaacaaaaacagtaccctttggaaatggagaaaatgtatcaggtcaagaacactgtttcttcaaatggttccttaccttctcactccgagaggcccttgttgttgcaaggatctaatggtcctggagaaatggggttggtgctgtccacagatcctaaaccaaggttgaaatggactgcagagcttcacgaacgctttgtagatgcagtttctcaactgggaggtccggacaaggctacaccaaaatctgtaatgagagtgatgggtgtcaaaggacttactctgtaccacctaaagagccatcttcagaaatataggcttggtaagcatcttcacatggttgttaaccttgataataataagcatggttgctcggcagcagcttctaagacatctgagatgcaaggtgccagcagtgctgcttcaagcatgataggaaccaataagacagacgccttgcagatcaacgaggcagtccgaatgcagttcgaggtgcaaaggcgactgcatgaacaaatagaggtacaacaacatttgcagctccgaattgaagctcagggtaaatacttgcagtctgtgctggagaaggccagggaaactcttgctggccacaatttgggttctgttggactagaagctgcccgtgcagaaatctcagaactggcttcaaaagtgtctagtgaatgcctcaacaatgctttttctagtttacctgaaatgccatcattatacaagcagcagcaacatatggtacaggctatgcatagccttaatcagcaatctcaggtcccagattattcaatggagagctgcttgacatcaaatgagagttctgaaaagaatttagatcggaatatgcagaacgctgctaagaaaagattgagaacattacagaatagaaatgtacctttttggcagactgagaccagagaagatgccagtttgcgagaattgagtgccacgcaattgggctgggaagaaaatctgaaagaagatgaaaagtttttgtcctcttcaggtaatccaaaagattcagataggaattcaattccaaccaaaggaaatttacgggagaggacaacaagttttagggtacaaacagaagaaaatggctatggcatgcctgatgcaagggaaaaacagatggaagtaaatggatcatgtgtaggacaacaagcaattaaaccagacgtgcctaggagcttctctctgcaagaagtttgccgcaagagtgaattggcagggctgcatagggatgaagatgaaagtccttcagtaagctttaacaagctttccaagctcactgaagaattagacttgaatgctaatgatgacgccagtatagcgtccaattgcagggagtttgatttgaatggttttggatggagcatataagcattaatattagcaagtcatttgagaaatttgtagcttccatctttgacaaaaaccttcatcactcacagaattctaggttcatgaatcagaatcaggagtgtgattttatggttcttga

SEQ ID NO: 616 - DNA, 1802 bp, Pinus radiata
gctgcattgatcatcttctgaatacccatttgttcaaagaaactgtaatggaggattcatagtgtgggtttctttatgtacaatgtattctgccagcttctgatgagttcatttgcctttgtttcaacagacagatctgtgtatgacgatgggatcgccatcagagttgacattgggatgcagactctctgcaacttcatactccagcgtgttgaaagcaatcaaccttgcgagcgatcagtttgagcgaaccagaaggcttgatgaatatctaaaaggattggaagatgaacgaaggaaaattgaagctttcaagagagaacttccttattgcatgcatctcctcaatgatgcaattgctgcttccaaggaacagttagcagactgccaaccatcggtgcaagcacctaaaccgacgcaacaaactggtcttcaatttgaggaggagcagtacaacaggccagtactggaggaattcattcctataaagaaaagatgtgatgaatccggtgatgaatctcaagaaaacaaccaaaatgattcaaaaagaacgaaattcgccaatggtgagaagccaaactggatggtttctgctcagctgtggagtcaaaattccgagtctgtagaatgcaaaaaagagaagacatcttccccggaggaaccattgaagcagcatgattctcaactcagatctgaccaagaacagcttttccctacaaattcaaacctgttttccgattctaagcagagaactggaggagccttcctaccgttttcaagagaaagacaaagcaatccatctgtgtctgcgagatctaatactgtcaaagcccccccggacctcgctttgtcgtctgtagagcaggaggtgggttcgacattcagatgcagtgaaactgcgcccatgaataatgttacaatcactgctctgaatagatccaaagaaccaacagagacaactgtgcctaccccacagaaagaagctgcggcgaaacctaatggagctgttagcgtagtgcctactccagctgcatccaatgcaactcaatcaggtgggcaatctcagagaaaggctaggaggtgctggtcgcctgagctgcacaggcgctttgtgaatgctcttcaacagcttggtggctcacaagcaaccccaaagcaaatcagagaactcatgaaggtggatgggctcaccaacgacgaagtcaaaagtcatttgcagaaatatcgtctacacactagaaggcctagtccttctccaccaacgccagcttcccaagcacctcagttggtggttcttggaggcatttgggtccctcctgagtatgctgtggcaacccaccaaggtccaggactttatagcacagtatcaaacactaccagttctcattcacaatctcactattgccaatcaccaatgcctcaggagcattattctcagatgaatatgtcttcccaactgcaactcccacagcctggttactgtgaacagcagcagactccttcacagtctctaagctcaccccaaggccctttacaattaactggacagtcatctggagctagggggacctctgtggatggtggcagagaggaaagtgtaggagaagatggaaaatctgagagttctagttggaaaggagaagaaaatgccaaaaatgtggaggcaagaaatatgggaaggggtctgtctctcagaaaacagccactgcagtctgtagatggagatgaagaggacagcagaggtagtgaaactactctcaaattctaggtttttgatttacatatttccatccggggaaaac

SEQ ID NO: 617 - DNA, 3370 bp, Pinus radiata
atccgttcctccattatttgctattgttgttgcagctgcttttgattaccagctatgcatccattgcagccagtcagaggaaggatatagcagccaggcagtacctacccctaccaatggcatgtatgtcttgttgggtgacaatagcaggagtacttgttagatagattcagacacagacagatcctcctcctctggaactcgggcatgtgaggagggtgggtctgaaggaacaggacaagcgaaatggtgatgatggctgcacacgactctgtgaccagcaccatgggtaacagctatggaggagggaaaacagatcatcagttccctgcagggcttagagtactagtggttgatgacgaccctacatgcctgaagatccttgataaaatgctcaagaggtgcctctaccaagttacaacatgttgtcgtgctacagctgcattatcaatgcttcgagagaacaaaggtgcgtttgaccttgtcataagtgatgtttatatgccagatatggatggcttcaagctccttgagcaagttggactggagatggacttgccggtcatcatgatgtcagcagatggaggaacaagtacagttatgaaaggaatcaagcatggggcttgtgattacttgataaaacctatacgcctagaggaacttaaaaacatatggcagcatgtcattagaaaaaaaaggaatgagccaaaggattttgatctttctggtagttttgaagacaatgataggcatagaaaaggatctgatgatgttgattatgcttcctcagtaaatgaaggaacagatggtaattggaaacttctaaaaaagaggaaggaagccaaggaggaggaagatgatggggaagaggacaatgacgatccatctgcctcaaagaaaccacgggtggtctggtctgtagagctccatcaacaatttgtcaacgctgtgaatcagctgggaattgataaggctgttcccaagcggatacttgaattgatgcatgttcaagggcttacaagggagaatgttgcaagccacctgcagaaatataggctatatctgaaaaggttaagtggagtggcacaacagcaaagtggaatgaactcttcttttgggggaactacagaagcaggtgttggacctatgggtttacttggaaggctggatcttcaaaggcttgcggcatcaggtcaaatatcacctcaagcactggtgacattaccagctgaacttcttggacaagtgaatccaaacaatgggttgggcctgccaaacattgatcggacactgcttttacaagcagcatttcatggtgtaaactctaatcctttaaatagagggaaatttgggcaaccattgatgaacagtcagggaaatttacttcagggactcccgagaagcatagagctgaagcaattttcccagccacagcaacatattccttcctttggaaatttgggtttaccgaccaatgatgcatctgcaggattttctatgctgcaacagcaacacaatacaggtgcagaagttggcagtgtggattgtgggataaacaacaatggagcatctaatcctcaaaacaatgcgatggtgatgcaattgatacagcaacaacagcaacatcaaataaaccaacaacaacaacaactgcagagatctgcagcacaacagcaacctggcggacaacttcaaggttctcagcttcagagtggacaagtcctgaatttgccatctgccagtattgttgggccacaagtccttccaaatgaaattagggggagggctactttatcttctctagccaatggcaatagcagtcttggcaataatattattggtgctcctggttcagggcaattaaaccgtatgccaatgccagcatatggcctgggtgcaactgaatctaatgtaccagaaggaattggacggatgtcaactgtagactataagagccagaatgtgcacattctccaaggaaatgattattccctttccagtactgtttgtttatcttcccctttaacaacatctgatattgaaggtggaatgaacatttcaggaattaaaaggttgggtggcataagtgacatagttggttctccaactctaagttgttctggaataagttttggcacatcaaatggtattggtcagaatttaagccagagtggtaggcaaggttggcaaatgcaaaatgtgtctatgaatcaagatttaagtcaaacagctactgctatcttgagcccatgtcatggccaagcttctcatagaacccagggcttgaatgttcctgttgtgcaagatccaggacaggttaggagttttggatttgttgggaaaggaccaaatctttcaagcaggttggtacaaaatgctggatatcctgggatgctcagtaatgctcaaagtcagggtgaacttttaggaattgatagcgggctgaggctgaaggacaaaagtgcatcagattttggattgactccaaaaattgagtgtggcacactttctgaccattttccttcagaagatctcatgaatctcctctttaaacagcaacaggacgggatggggatttcagaaaatgaattcaatttagatggggtatcgattggataatgttcatgtcaattgaaaaatgtttgtactgttatccgaagagaaagccggccttcccaccctcaagtgagttgagtggcatatagccccatgctgctcattgctcaacacaaacgtgactttatgcttgcgcactacaaaacagtggtagcatttctggatgagtgtggggatcattgtggaaaggcttatgtgcaaatgtagatttagttgtatcatattgtcttgcacctagattgggttaaaagttaaaacttcttagatataatctcatgacacatttcagaggaatctcacgctcttatgtgattgcaagtcttattactatgacatttggatatgttagagcaaatgaaaaggccgaaacaaattgcaaatcccttatgggagtatgtccatgcaccattttattattctctcttaggggaagcttacttctagcccacattcaggaaaattcttgtgcttttctggactagtttagacactatgagaaataataattatttgctggaggcattaattgagattcatcctagtacttcctgagttgtgatacacttcaattacaacaggaatttcacttggttgaaacggtggagttgctctacacaagtgtaggcaactggaattatccagcactaaatagctggcttgcaaggggttgtacgtgcatctcagatatttaatttttccacactcagctagctattcatattaattatttagttgtctgttcataaaaaaaaaa

SEQ ID NO: 618 - DNA, 2817 bp, Pinus radiata
tggcatcacaggcatttctttggagtagagctttggtggggtggaacctggaactatataaaggaaaagggccgagggcgacctccagagcgattttatgtagattatggtgaaaatgatatagcacacagctaatgatgtagatgtttgcaagcagccctcaacagcatttcaaagaaatacagtggttaataaccaagcaggtagaaaatcttagctgggtatcgtgatttgatcctagagatctttcaggaaacaatgtccttagcatctccatgccaggaatcgatgaggggagatgacaacagttatcggactaattcttggtatcgtggaaacctctcaggtgttcccgaaatctccagaaacatggggatgcagtacatgcctggaggaatcggtctgaatctccaacgtggttgggggaactccttcagatcttgttcaacagatttaagcccaaaacagaatggcaactttgctattgatcacacatctacgactggtgagcgtagtgctggaaccctgaagatgattgatcagaggtctccaatttctcccctttctcctaaagggattggatctgacggtttgcctcaaaccagtcagagtcaaagactttattccagtgaaagaatccaaatgcatgatgatctaatccacagttcttcacacaatcatggttcttttaatgatcaagtatacattcatgaaagttttccatgtaacaatgaactttcacgcgagagctctatatgtattcaatcttctgatggaagtcctttgtcttcacagcattcacaatcgtattcttcggattctagatatttccattcagcagaggatgcagccgacctagtcggaaatgcttacagtggcaacgggcagccagcgaatttgaagattttagaggaaatagaaacagcactgttgggacctgatggcgacgatcctttagatatggactatgcctatggggatcatacacttaattctaattcagaatggagtttggaggcgttgagtgacttcaacgattttcttgaccaaacctccaaccccggttactcccaaataaataatgcagatagctccagggtgccagataacttgcagcagctaacaaatcacggggatcgaaatgttaaagaagaaacagtgaatgaagttaacttgaaaattgaacacttctcacccagcagttctgatatggaaaaactggagatcgaagagttggggagtccccagggtgatgtaaaatctttgcttattgaatgtgctaaagctattgcagacggtcgtaatgcagataatttgattgcagggctgagacaagttgtaaatatatatggggatccattgcataggttagctgcatatatggtagaaggtcttgtagcaaggttgcatttctcaggaggacatatttacaaaaccctaaaatgcaaggagcctaccagttccgaactcctttcttacatgcatattctatatgaagtttgtccttatttcaaatttggttatgtagctgcaaatggtgccatcgcggaagcatttaaagacaaagacagggtgcacattattgattttcagatcgctcaaggtagccagtgggtaacattaattcaagcatttgcagcaagacaaggtggttcgcctcatgttcgcatcacaggtgtggatgatcctcaatcagagtatgctcgaggtcaaggattaaatttagttggcgaaagattatcaaagcttgcagaaagctaccaagttcctttcgaatttcatggtttgtctgtttttgggtctgacgttcatgctgagatgcttaagattcggcctggggaagctttggctgtaaattttcctttgcagctccatcatatgcctgatgagagtgtgaatacaagtaatcatcgagaccggcttttaagaatggtcaaaaacttctctccaaatgtggtaacgttggtggagcaagaagccaacactaatactgcacctttctttcccaggttcatggagactttgagttattacactgctatgtttgaatctttggatgtaactctgccaagggatagcaaagagcgtgtaagcgtggagcagcactgcctagcacgtgatatagtgaatgttattgcctgtgaaggtgatgaaagagtagagaggcatgagctttttggtaagtggaggtcccgtctgactatggctggctttaaatcttacccgctgagtgcacatgttaactccactatcaaggttgtcttgaactcctataatgaaaattacagactgatagaaaaggatgaagctctttatctgggctggttagacagggacttgatcgtggcttcggcatggaagtaacaatgtgtaaacatagcctctcccagggaaagaaagcatttgattgtgatttgggcccaactttttagaaacatttagcagtacatgtccaatttcatcgatagtacttgtatgaatggagagagtatcttatccccaaggttatcaaagctgttagagctaactaaattcaagagctgaaaacaaggatattcccatttgtatttgggaatgaccagaactgaagggcaaaggactgggaacttcccttgtttattttgagttgtctttgcttctggctttaatgcacacgattttgttaataattaattgtttcattttgagaatctgtcttaaatatgtgttcgaggacacagattcccttaactaaatttagatgtcaaacaacaatattattggtgtatagaaaatgttattatttcaacatccttgttatttaaaaaaaaaaaaaaa

SEQ ID NO: 619 - DNA, 3144 bp, Pinus radiata
tggacggtctctactatctttctctgcaataagcgcagtagaggtcccccgagtattcattctgttgaatcactcgaactagagctcaatcccctccaatcccccatataacgctgctctcttgtgtttctagtaatggaggttctctgttcttagttccagttctctgagattttgctgctttagtgagactgtatttctgcttgcagtcgaccagtggtgctgggttgggttgggttctgtttgtggaaaaatggcatacatgtgcactgagaatggtaatttaatggcaatagcacagcagcttgtgcaacagcaacagcagcagcagcagcatatttatccgaatcctggtggctattttaatggaggaaatatgagtatgagcatgggtggtgtcaatatgaatatgaatatgagtccatggttgtctgctcctactgcctggcagcatgatggcctgatgagtttcccccctgggatctgcacggatgttgtgggtgacctctgttcaactaccaccaattcttatctcagtgagcctaactctgttctggacctttccagagcctccatgctgttttctcccatggaacagtttcaggactttacccagcatttgcacgatggcatcggcgccaagcagatgcctttgttggggggagtcgagccgccggcaccagccttcaaggacaatgctctgtatcaccatgaggcactggtaaagaaagagaggcctcccattaaggagcccggtgttggtgatggcagcagtgctgctctgaggtcctcggtgttcagatcgccagagctgcatacattcgggttcgagtctccagtgagcaacagaaatgattttgttagcccggatgtttgcaccgagtggatggactgcttaatgagcgacttgcagccagaggccattgccggcaatggtaacgcagccatagcttcgtgcttcgacagcagcaacccctgcgagtcgactgagagctccgagcttccgaacggcgggagcgggtaccgtcgtcattcttctgaggacgctgctgcatggcagagcgaatttgggatcttgggtgaggccttcaagcgctcttcccctacgtcgtggactcccgacacgaccacggagcagctgctatgctcgtcgccctcggccgacctgctgtctgcagcttcgtccgagcttctgtcgacgaactcgctaaagggcaaggcggccttgcaagagcagtatggtggagcagcgggaggaggtcatgagttccaaaccctgcatcataggatgcccaatgtgcaccagagcgtgtgcccgcctaagcagcagttgatacgagagccctccactccgcctcagaaacggcaacaggggcagcaagagcaggatcctctgaagggaaaacgagaagaggatccccctaagcccgaaatcgatgccctggatcggcatatgcaagggcaacggtctgatttattgcattcgctgctggattgtgcaaagattgtcgacacggagccagaaagagcaggccaatccgttgcctatttgcagagaatcgcatcgcaccacggggatcccacgcagagaatagcgtctcattttgctgatgctctggccaaacgtctctccaagggcattgagcagaaaccccagtttcaatctagtgatgaatgctctaaatcttttgaggatttaaccctggcctacaaggccttgaatgatgcatgcccatattcaaaatttgctcagttgactggcaatcaggcgatcctggaggcgatggacaaggcagagaaaattcacatagtcgacttcggcattgtgcagggtgtacagtgggcagccttattgcatgcattcgcaacgaggccaggcggcaaaccccacaaaataaagatcacaggtatccctgccccaacactagggcaaaaccctacttcctctttgctggccaccggcaagaggctcacagagtttgctaaattgcttgacctagagtttgagttctgtccagtgtcaaaacatatgagtgaggtggaattgtctaccctgaaaattgagcaagatgaatgcattgcagtaaattttatgttacagttatataatcttttaggagattcccctgaacccctagtgaaaatactcaaattagctcatgccttatcccccaaagtcgtaacacttggggaatatgaagctcacttaaatgcttgccaattccaagttcgatttcggaatgctttagaatatttctctgcattttttgaatctatggagcccaacatggcaagggatagtgcagagcggctgaacgtggagaagcacttcttcgcagagaaaataatggggattgtagcttttgagggagccgaaagaaaaatcagactggaaggaagagatcagtggcgtattgtgatggaatcagcgggattcaaatttaccaatttaagtcattatgcaaggagccaagctcgaattcttctctataattattgtgaagcgtattctctagatgaatcgtcggggtttctctctttggcatggcaaaatcggcccctcctcaccgtctcagcctggtgctgttgctagtctctaagaatctggcaatcccttgtatagtgccaattgattattcaggatacatagaacatttgctgcatctaggatggaaatcaaattatgctttgtgtacatacatacacattgtgactgtaaataaaggttatatcatgatcatgtgaatatgtctgtaatttttctattccctctttgcttcagtaattttagttctagcacatgtcatgcatcccttggcaaacaatttttagctgggtagaccaattatttcttgtaggcagcaggcaacggtgggataattgacctctaccattgccgggggtgcatgacaactctgtaaccctggattaaatcaagggcttaggaaaagaagggattgagaaaaagcctctcgtctcattcttgtttttcacccctctgggttcttcctagtttctcttcaattatatatgcagagcaagtgttgcaaagcctccattacctaaaaagcgaagtctctgttttatgcaatgtccctgaaaccccttatgtagccagaatttctattctaaataataacaact

SEQ ID NO: 620 - skipped

SEQ ID NO: 621 - DNA, 710 bp, Pinus radiata
tttagatatccgaagttttgagatttgttttttcttatcccgctcgctcttttctttgaccccctcctgttcttggtatatagagagttctttaactcgggcagaggcagcgagcaaaactttcaatatcagtgttacacgcctcggctactgtcttctcagatcttgttcatatattgtgaagatgaagggtacaaaggccaaggttgatcagaagcaagtggcagagaagaaagctgcaaagcggaagcctgcgaccgaggcccaagctaaacggcaaatgaagaaggacaagaaagcgaagaaggacccaaacaagccaaaaaggcctcccagtgctttctttgtattcttagatgagttccgaaaggaatacaagaaatcaaaccctaacgcgaattcagtttccgccgtcgggaaagcaggaggagaaaaatggagggcaatgagcgatggggataaggctccatatgtggctaaagctgaaaagaagaaggctgaatatgaaaagtcaatgtcttcatataataagcaaaaggatgccagccctgaagaagtagctgaagagtctgacaaatcaaagtcagaagtcaatgatgaagaagaggatgaaagtggagaggaggatgatgaacatgatgatgatgagtgataaaatggtgttgactaactcgcaactcgctagactagcatgtaatattatagaatga

SEQ ID NO: 622 - DNA, 946 bp, Pinus radiata
ggcgagatttgtgtagctgcgttttactctgttacagacgatcgtctgaggctccaaactcacgcgttgctaaagcaagtgctttcttcaatgaagggagctaaagcaaaaaacgaagcgtctagcacgctgaagaaaattgaagacaagcctattggaaagcggaaagcggcaaccaaggaagtgaagccaactagtaagaaggagaaaaaggggggcaaggctgccaaggatcccaacaagccaaagagacctgcgagtgccttcttcgtatttatggaagagtttaggaaaacctacaaggaaaagaatcctaatgtcaaatccgtatcagttgttggaaaagctggaggtgacaaatggaagtcaatgtcagaagccgataaggctccatttgttgccaaggctgcaaaaaggaaaacagagtatgaaaagaacatggcagcatataacaacaaacaaaccagcactgcaggtgacagtgctgaagagtcagataagtccaagtccgaggtaaatgacgaggacgatgatgaaagtggagaggatgacgatcaagagtagatatttcgaagccttggtttgcccgaaatggtcttgtatcagttctgggctgacttggaaaaaaaattgtaacctgactaattagctactggtagatgattttgttatttcctaccttcttttatagcgggcgtacatgaaagtgatttgatcacttttaagtgtatgccttgggtatctccatgtgtagttattcatgaacatgttattgacagctgtgatcatgttattgatgtctttaaaaacatgatcatgtaatcgtagataaagtgttttgttttgttaccttgtattgacatgtatcttgtattttgcattgtcattctgatcattttgctgttttattaattttctgttgttggaaaaaaaaaaaaaaaaaaaa

SEQ ID NO: 623 - DNA, 1099 bp, Pinus radiata
cccaggcatttcatcagcgcgatttccttccattgcttgattccattcacaagaagaatggccaccaattcatcttcaaaaactaatcctccgaggcagagaaaaagagtagatgttgatccggctaatttgaagcgagccagagatggcagtggttttattaaatgtgatgtctgcaacaaatccgttcctgtggcactttccgacatgcacgattgcaaacttgaagataagatatggtctaactttgatgcctccaaagaagccaaacatgcagatgcccagaaagcacctgaagcgaaaaaaacaaagaaaaagtcggaggagaagccaaagaaacgcacaaaggcaaagaaaactaaggaccctaaccagccaaagaagcccgctacagcattttttgtgttcatggatgattttaggaagacctataaggaagctaatcccgatgccaaaggtgctgcccaggttgggaaggaagggggcgtgaaatggaagtctatgtcagacgaggagaagaagccatacctcgaaaaggctgctgaactaaaggcagagtatgacaaagctatgtctaaatatcaacaagatctcaaggatgaagcagctaagtctagtggtgagtgtgaggatgaagggacaaaatctgatggtgacggtggtgatgatgacgagggggctaagtccagtggggatggtgaaactgaagaggagtaagtgtgtccataaattgctggactggattaatttaagaagattttgtgggggcttcatgagtgaaatattgtaatggacgccttggggtatgtacggagttttgataaaatgtcatgaggtatctaatctctaaaatcacatctaattggggtcacatgactaatgtatattgatgtggcatggggtgtcatggtctcaaatgttccacttcctatgtgggctatgggttgacattgcacataaatgatacattgaaatttcatgatctgaagtgcatgacacatggttgttggatatgctattttttggtattttttggggtaaactatgtaatattacatggaaattgatgtggtgtgcacattaggtcttaaaaaaaaaa

SEQ ID NO: 624 - DNA, 1457 bp, Pinus radiata
aaatgtatccgtccgtggtcacaagaatatcatgtaattgatcttcgtcgattaactgattcactggattagacttttgagctgtatgcagacaatacatgattagctgatcggggatcagaaggttcccatatctgtaggaaaggtcgaattctgagaacacaagcacatgccagagagtgagcggtaactgggagattagagttttgttatctctcaactgctaggttgctggaaggtgccgtttttgagtaagcaagtgaggaatgaagccgaagaagcgaagtgcaggtgcagttaaaggctcatggaagaaggatcccaaggatttgaaacccgttcagaaggagagagtactaagagtgaagaagaacgaagataagcagacatgcaaagggaaagggaaaatcaagggcaaaggcaaaggcaatgacaaaagcaaaggcaaaggcaggcagaagcagcagcataaagagagagagaagaaaaccaaaacggaaaaggaccccaatctacccaagaagccagccactgccttcttctattatatggaggaatttcggaaaacctaccaaaaggagaatcccggagtcacaggaatgagagaaattggtattgcttgtggcatcaaatggaaagaactgacatatgaggagaaggccccatattatgatatagcaacacaaaagcgagcagagtatgagaaaattctggcagcatacagaaagaagaaggaggctggtgaggaagttgaggcacatgaggcgccgggcaaaacaaattcagtgataaatgatggcaaggaaggtggagaggaggcaggcaaggaagttgaggctcatcagggaccagacaaaacaaattcagagataaatgatgacaaggaaggtggaaaggaagctggtgaggaggttgaggtacatcaagaggcagacgaaacaaatttgaagataaatgatgacaaggaaggtggagagcaggaggatatggaatgatactacatgcctgaggtgcacttttcatatggaacttgtagagtcagataggggcacataatcgatgctggagagagtcctggctaaaattctcgagaatacctttaatgaatagctacagtctgacttccgctgctcaaaacacaaaaggatgttgttgatccaatttagttcctttggagtctggacaatagctataaattagaaacaataaatctcaagattgtttgataccaattttgtcttgtgaaacttgaggtttgctttggattaattactgctcagtgaaattactgttgtgtcctttttcatttgtctattctaaggcagccttggtgtgatagctgcgtctatggtttttgtttgaatgccttgtgacttcaagaagttaaatttgtaatctacgcatcaaagcaaggacgttcgatgaataaaatgcaacttgttctgacaaaaaaaaaa

SEQ ID NO: 625 - DNA, 1731 bp, Pinus radiata
gaaacgcactatatagttatagttggtgaatggtataatttttactatgtcggagcagcatcaccaacaccaaactggtcatgctaaacctatccatcctccccctcctgttcaacggccgttgagtcagcagcgttcagcggagtcgcaatcagcgccgggtgagcccctgcccttgcccctgcccgcccctcagtcggcaggaggttgcaggttctatccctcacggcttttcaaacatgaggaagtcgttgccaatcgtgatctgttcttcgacactctcaacaagttccatttggctctggggaccaaattcatggtcccaactattggaggcaaggaactggatttgcatcttctctatattgaggttacagctcgtggtggccttgataaggtaatcaaagacagaaaatggaaggaaataacatgtgcattcaactttgctccaactaccaccagtgcatcatttggcttgcgaaaatactatatgaccctgcttcgttattatgaacatgtgtacttttttcaaaagaagggtcagcttcctgcagctcctctgtctactgtaagtcctgttcctcagtcatcagataatggatctgcccatcctggttcagatgaaaagcaaccagaagtcaagaagcgaaagaagagaagtttgccctcgccaattgttggagttgatcccacatcttcagtggatcaacctgtaacaggggttattgatgggaagtttgagtatggttaccttgtaactgtaaagctgggttcagatatattaagaggagtattatatcacaaaacatctgaaaatttaggggcacagtttgcaggcgtttcttgtttgcaagacagaaatgtttttgatactgcagcttcgggaaacagtacttgccagaagaagaaaaaggagcgaatcaaaaagagggatcctaatcatccaaaaccaaacaggagtggttataacttctttttcgctgagcaacatgcacgcctgaaggcgttgcatcctgataaggatagagagatcagcaaaatgattggggagttgtggaataaactcagtgaagaggaaagaggggtttatcaagattttggattgaaggacaaggaaaggtacaaaaaagaaatgcaggagtacaaagaaagattgaatgttcagtctgacacaaatgaagttttcaaacaacaattcagcagaattccagactctgatgttgatatgatgagactgtcaactcaatctggcagaagagacatcaatatttcagcagagcaaaaaatttctgaccaagaaaataattacaaggagcccatcgtgaaacaataagtttactgttgaggagcttcaaatctctccaacctgttgactatcaccatgttgtaggatcaaatatttttggcaacggattgcacaaaccgtgctagctatcctggctcagctgatttggcacagtttgttttcatttttgaatttttgtatagtatattgattcgtagctgacctggttgaaacaaccatataacatttgctcgattattgatttatgaccccattgaggggaaacataaattcatgattgtacatgtttgtggcctgttttttatggttaagtcaacattcacttgcggcatcttcaacattttcagtgctcagcacagcaattttccttcaagaaaatcgttttgtatcatttaattaacggactgcaattctcaaaaaaaaaa

SEQ ID NO: 626 - DNA, 2299 bp, Pinus radiata
gttagtaagggggctaaggcgaatatcatcgaaccctgaaaaatctccactaagttgcacgatcataaggatcagtaacttagaacagcaggcggccatggcagatggccaattatttaacaatattttactcggaggcagaggtggaacgaatccgggacaactgaggatccattcaggaggaatagtatggagaaagcagggtggagggaaggtggtagaaatgggcaaacctgaaatctcgagcctcagttggaccaggattcccaagggttaccagctgggggtcaaattaaaagctggtttgaatgtcaagtttaatggctttcgtgaacaggatgtcaacaatttgtccaattttatgacaaacaccttgggagtaactcctgaagaaaaacaactttccataagtggacggaactggggagaagtgaatctagaaggaaacatgctcacatttttggttggttcgaaaccagcttttgaggtatccttggcagatgtatctcaaacacagctccaaggaaagaatgatgttgtcctagaattccatgtggatgatacaactggagccaatgagaaagattctctgatggaactgagcttccacattccaaactccaatacaacatttgctggggatgaggcgagccctccagcacagatttttcgagagaaaatcatgtcaatggcagatgtggggtcatcgggtggagaagcagttgcattgtttgaggacattgctatccttactccaagaggtcgttacactattgagctccatctatctttcatgcggcttcaagggcaggccagtgattttaaaattcaatacagcagtgttcttcgcctttttgttcttccaaagtcacctcacacacttgtggtgatcacccttgatccaccaattcgcaaaggtcaaacattttacccacatattgtcttgcagtttgcaatggaagagctagctgagtgtgcactctcaatgaatgaagagctgctaaataccaagtacaaggacaagcttgaaccttcatataagggtttatcacacgaagtgtttacacaaatcttgcgtggtctatctgctgccaaagttacacggccaggaaagtttcgcagcagtcaagatggttatgcagtcagagcatctcttaaggctgaagatggaatcttatatcccctggaaaagagctttttcttcttgcctaaaccaccaactcttattcttcatgaagagattgaatatcttgaatttgagaggcatggcactggcggtgctagtagtatatcttctcactattttgatcttatcataagactgaaaagtgagcaagaacaccagttccgcaacattcaacgtaatgaatatcataatcttttcaacttcatcagttccaagggattgaaaataatgaacttaggagatgcacatggcaccagtggagttgctgccgttctcgagaattcggatgatgaagctgtggatccacatcttgaacgtatcaaaagtgcacgtgaaggcggtgctggagaagatagtgatgaagaggatgaggattttgttgcagaaaaggatgacgcaggatcaccgacagatgattcagaggaagagcagtcagatgctagtgaatctgaagaaaccaaggaaaaacctgcaaagaaggaagtgaagaaaaaggaggcacctgttgcaaaagcgacaggcacaaagaggaaaaagaaggacgaggaagaagatggtggaaagaagaggaagcagaagaaaaagaaaaaggatccaaatgcaccaaagagggccatgtctggctttatgttcttttctcaaattgaaagagagaatgtcaagaagagcaatccaggaataccgttcacagaagttgcaaaggcacttggagaacgatggaaaaaaatgtcagctgaggaaaaagagccctatgagtcaagggcgaaggctgatcaaaaaagatacaaggatgctatggcaggttacaaaagtggaccaacaaatattatagattctggaaatgaatctgacagcgagtagagaagcattctagaaatatgtaggtttggcattaatactgtacttgttcggcttctcacattacaatgtttgctggtgcacaaattctagttgtgatcttgctgtatcaattaagtggcatggattgctgggatgtttaattcaagtgtttgatattggtagaatgagttgtccaggagtttttcccacaaaatatctacattaaagcttcagaacacatacaggaatagttacgccctgaaaagtatccat

SEQ ID NO: 627 - DNA, 3882 bp, Pinus radiata
caggtttagtttcattacataaaatctgtacctagagcccagcaatatccttcgcaatggctgacggccaccagttcaacaatattttgcttgtaggtcgaggcggcacgaatccgggtcaactgaggatacattctggaggtatagtgtggagaaggcagggtggaggcaaggtggttgatgtggcgaaaaacgaagtcaagagtttgagttggactcgagttcccaggggttatcaactcggtgtcaagcttaaagctgggttgaacatcaagcttgcgggatttcgtgaacaggatgtcggcaatttgacaaatttcatgacaaacacaataggattagctccagaagataaacagctatctgtaagtgggcggaattggggagaagttgatttagatggaaatatgttatcatttttggtgggttcaaagcaggcttttgaagtatctttagcagatgtgtcacaagcacagcttcaaggtagaaatgatgtcctcctggaatttcatgtggatgacactactggagccaatgagaaggattcattaatagagctgagtttccacataccaaatacaaatacaacatttactggggatgaaagccgacctccagcacaaattcttcgagataaaatcatgcaaatggccgatgttggggtggggccatctggtgaatcagttgttgtgtttgaagatgttgctgtacttactccaaggggtcgctacacagttgagctccatctttcgttcttaagacttcaaggacaagctaatgattttaaaattcaatatagtagtgtggttcgtctttttcttctaccaaggtcaaatcaaccccatacgtttgttgtcatatctctggatccaccaattcgcaaaggtcaaacattttatccacatattgtcttgcagtttgcaacagaagaattggcagagcgtgaactgtcaataagtgaagaactcttaaattctaaattcaaggacaggctcgagccatcctataagggtctctcacatgaagtattcattcagatattacgtggtctctcaggggccaaagttacacggcctgggaaattccgtagttgtcaagatggttatgctgtgagggcttccctcaaggctgaagatggagtgttatatcctcttgaaaaaagctttttcttcttgcctaaacccccgacacttattcttcacgaggagattgaatatcttgagtttgagagacatggagctgctggtacgagtagtatgtcttcacactattttgatcttattataaagctgaagagtgagcaagagcatcagttccgaaatattcagaggaatgaatatcacaatcttttcagcttcataaacaccaagggtttaaaaatcatcaatttaggagctacagaaactattggtggagttgcagcggctcttcagaattctgacgatgaagctgtagatccacatcttgagcgaatcaaaaatctacgtgatggtggagctggtgctgaagacagcgacgaagaggatgaagactttgttgcagaaaacgatgatgctggatctccaacagatgagtcagaagaagagggatcagatgcaagtgagagtgcagaggtcaagcaacctgcaaagaaagaagtaaagaaaaaaaaggcggtggctcccaaggcaaccgagaccaagaagaagaagaaggatgacgaggaagagggaggaaagaaaaagcagcggcgaaagaagaaggatccaaatgcgccaaagaaagccatgactggatttatgttcttttctcaagttgaaagagagaatctgaaaaagagtgacccaggaatggcatttactgatgtgggaagaacacttggagaacggtggaaaaaaatgtcagctgaggagaaagctccttacgaatcaaaagccagggctgataaggaaaggtacaaggaagcaatggccgattacaaaagtggtccaacaaatgtggactccgggaatgaatctgatagtgaatagagcatcatacttacaagttcatattaacatggctagccgtgtaaagtaattgctttcatttaaatgctttcaccctctggtgcaatctttttacattcacttgagaatattgttggtgtacttcacattagcaaaaagcaagcttacaactgagtagtgtcgaggaatatatctacatgtattaatgttccttgtctcgttgattatctaaatcttttgtgacaaattactgtcactattgttctttatttactcgatcatttggattggtataaggatgagctgttcaggaaaaaaaaaaaaaaaaaaaatgcctctccaacgcactacatcctgctctgctcatcttcgattgcgtgctcgcttcatagcctttcattgattctccacagctttgttttcatggcacctctgcaaatgaaaatcaccagaaagccggctatccttgtcgctcctctcctgcctactcccaaagggttgctatacctttccaatctagatgaccaactgtctctcagatgtcagattcccgtccttcaattttatcggtttgatccgtcgaagaaaggtgaggatcccgccaaagttatcagagaagcgctggcgaaggttttggtgttttactatccttttgccggaagattgagagaagcgcccttcggcaagctcctcgtggactgcaccagcgagggcgtgctgtttgtggaagctgatgccgacgtttccatggaggaattcggagacctgcacccacccttcccctgcttggatgatctgctgtatgatgtgccgggctcggaaactattaccaattctccccccctcctcattcaggtaacgcggttgagatgccgagggttcattttcgcccttcgtttgaatcacaccatgagcgacgggcttggcctcgttcaattcttgacagctcttggcgaaatggcgaaggggtcggccaggccttccgttcatccagtctgggaaagagaaatcctccgaccccggatgaatcccacagttaaattcccccactacgaatatgatcaaatcgaagacaaagacgggcagatggcgaacatgaaagagatgagacagagtccattctttttcgggccgaaggagatcgagtcgctgaagaaacaagcagtagggcaaggcaagtgcccgacctttgaagttctatcggcgtgtttgtggcgttcgagaacgagggctctccaactgcccgctgagcaggaagttcggttcatattcgcccaggatggccgagcgagattcgacccaccgattcccgaaaacttctacggcaatgcgataattttgtcgtgcgcgaagacaaccgcaggagagctggcaaccaaaccgttttccttcgctgtgaagttgatccgccaagcgaaaatgagcgtgaatggcgagtacatgcgatcagtgatagatttgatggagttgagagggcaccctctcttgacagtggtgggcacctatgttgtctcggactgtactaagatcgggtttggagatgtggatttgggatggggaagagcagcctacggcgggccagcacgtggtggagtgggaccagcgtcagtggcggggttgtcaagcttcctcatcccctatcataacagaagtggcgtggaaggcatagtggttccagtatgtttgccgcccgctgctatgcaaatatttgaagcagaaatcaatgaagctatcgagaacgcagccccatatctacgatcctcgttataaaatagcaatctctaagcttaattatattaagttgctgttacttgaataaaatctagtatgatatgaataaaatgaggtgggtacctcgcccaagagtgcccttgtatttcggtgaaaaaaaaaa

SEQ ID NO: 628 - DNA, 1017 bp, Pinus radiata
gtaaggcagggattgggattgggattcgcctctgccaccatacggccaccattttttctgaaaccattcgtagaccaggttggacctcgcagcgcttacaggggcctcaactttgacttgcatcagccaaaccaatggttaaatcccggccttttttttttatagcttaaattcataataatacttcccaacatactggttttctcgttatttttatcgccgccccccgtgagtccatggtataggtgaagagaaattaggcgatcgatcgatcatgagttcgattcccggcggccgcgagacgcgaagatggagccccacacgagagcagctgagaatcctggaagctatctacaatggcggaaaccagactcctaagcccgagcagattcaggtcattgccgcggaactccgtcggcatgggaccgtggcgggaatcaacgtgttctactggttcaaaaatcgtaaagctcgagagagaaggaagagtcgcagcattcaggaagctcatgctgctgcaaattcctctgggttttcttcttttcaaccgaatgatcacttctcgtccgagatgaccgttggtgagacaaattatcttctcaactccaatagcgaagaggatgaatccaagttctccaactgcgttgaagtctatgattttcttctcaactccgactccgctgctgctgaggttggtgtcgaagtcgaatcctccctgcaaactctgcagttatttcctcccagttgcactgaatccatggcttataacaaccatcaacagtgaatatcgtatggaggaggaattattatatattgtagttaagttctaacctcatacttattttaacagatcatactgatcagaatccaatggacgatattggttagtttgtacattgatcgttcttttcacgttagctttacgatttaggtcgattctggctaaagttgtagcagttttgctgtttttgtttaataatgcagagacttgtgactgcctttctctcaaaaaaaaaa

SEQ ID NO: 629 - DNA, 1494 bp, Pinus radiata
aactagagttttcatggtgctctaggattgagttttgttttgtttttccatcagccctcctcctcaagaaagaaagtttcagttttggtgctgttatataggcctgttgtgttttgtgggttatttgtggaaatttggtagtaaactagaggatttgtgatgttttaacccggccatggtatggttttcctaagctgcggtttatttgagttttaaggcaggtggaatttgtcctgagatgaggctaattcgggtacctagattggcgttgttttactgaagtacaggatttggaggatagcgaagtgaaaaattaatggaattggggggccaggaagaggagatcggcatgccaatctcggttagctatggccccatacatgagtcttccaagctgaaaatattgacaccaggtggcaatggggctgctgcttcagatgagcagcagcaacaagtacagcaggcagcagcgaagaaatcggtgagatatagggaatgcatgaagaatcacgcagccagcattggagggcatgccattgatgggtgcggggaattcatgcccagtggggaggagggtactctagaggcactcaaatgtgcagcttgcaactgtcacaggaatttccacagacgagaagttgagggagaaccaccgtgctactattgctataatccaaggaaggatggcagaaagaggcctagtggtggtagtcccttgccactggcccttccctctactagtccttctggggtgatcaccaggccttctccgcagatgataatggccttcggctccgggcccactcatgaaaacgatcagcaggagcatgacttgggcagcctccatgggcttcatggagctcaaatggcgatgcccattatgaagaagaggttcagaaccaagttcacgcaggagcagaaggacaaaatgtgcagttttgcagagaagctcggctggaggatccagaaacatgacgaggcagcagttcagcagttttgcatggaattgggtgtcaaaaggcacgtactcaaggtgtggatgcataacaataagcatacactaggaaaaaagatttgaaattttttatgttctttctcttccttcttcccgtgctgatcaaacttgtaggacaacttcctttcaatgaatgtcacatgacagacttcttgtttcaatgttcatgagatttaggtatatcacgactctcactccccatgaacctttgtacactttcaagctctcctcagtccgcttatatctgattccctgtctgtgacccatatgaagcccagtgtagaaagtcaagtcaaatcaatggagctgcttctcggcttccaggagcccatccatctctaagttgttgcttgcatcatgaattcaagtagacgtagaaagtgtgtgaggaccttgtgttactactgggcctggcctggactagggctccactctactttgatcaacacagtgtaggctgcttacttttaaaaaaaaaa

SEQ ID NO: 630 - DNA, 1080 bp, Pinus radiata
cgcacgtggaaatgtgcgaaagagttcaggattgcagacggaaggaatcgataaatagcaggatttctgaaacgagcgacacacccacgagaaggtttccattacgacgctgataatgaagagcaaaaccccagatttgacagaggaacgggaagtctgagaagcggggcttgcagtatggacataccgggcggcgaagaggaagtgatttcgatgccgatatcgaccagtcttacggccgttagcgactcgtccaggctgagattgctcgcagccgcaagcacgccggatggaaaaccgcctgaaaaaggatcagaaggcagaaaaacggtgagatacagagaatgccagaagaaccacgctgcgaatctgggcggacacgtcatggacgggtgcggcgaattcatgcccagcggggaggaggggacgccggagtctctccgatgcgctgcatgtgaatgccaccgcaacttccacagacgggaagtggagggcgaggaggcccaaaccgcctgcgacgtttgctatcacaagggactcgtctcgggttcgaatctcatcccgctgtcgttcccaccgccggccataggcgttcttgggcgggctctccctcagatcattgcggccgcgcccgtcaataataataacatgaggagcagccccgcgtttgcgccctcaccggagtccgaggaacaggcggacggaaacttgccgtcggggaagaagcggttcagaacaaagttcacgcacgagcagaaggagcggatgctggcgtttgcgcagagagtggggtggagactgcagaaacacgaggaggctgccgtgcagagcttctgtcaagaagttggcgtgaagcgacacgttctcaaagtgtggatgcacaacaataaacacgccatggccaccaagccccacgctgacaacaacaaccacaataacgacaatacggccgcggctaatagcagcagcaataactcaaccccataaaaattttcagtaagctctgttatttcgctcccatcttctcaccagagttttgcttcttcaggcttccaaatattcgtcctgcaggcaataaat

SEQ ID NO: 631 - DNA, 1681 bp, Pinus radiata
ggcgtgtctctctctatctatcaatctgtgtcttgttatgcgtcaatcaatcagtgtttttccagactgagcccgctgtttgtgacacaattaggagaggagatggggtgcagagcctagacatgaagttattgtcctagactgcatttacaattttacaggccacagggtcgagtcctggtgaggccgagtaaatgatagatgtcagcgcgtatattcagcaactgaatatctttgataggatttgcagtgcattgtttcgcattatgtgtgtgtagcaggcaatggaatttaggattgggggtgcggacagctgaggaggcgagaaactagtttttgggttttggaattcattaatggagatgggagctgggggcaacgaagccgagatcgggatgcccatgtcagtgagctacggtcacatggcggcaatccacgaagcgaattcgaagccgaaccatagtaatatgggcgccgacaactgcagcacggcttcggatcaggagatccgcccgctgtcacacgaggcggcggcggcggcggctggggcgtccctggcaaagccacgcagtgtgaaatatcgagaatgcctgaagaatcatgcggccagcatcgggggccacgcaaacgatggctgtggcgagttcatgcctagcggtgacgaaggcactctggaggccctcaagtgcgctgcctgtggctgccaccgtaatttccacaggcgagacaccagcggcaacggaggcgccgacccctcggcagccgcttcctgctattactgctgctacggtagcaacggcaatggctcctcgaagaggcccggcggcgcgcttcacctcccgttgcccggtccccatgtacccctggcgttgccctccagtccgtccgggatcccgcgcacccatccgcagatgatcatggcgatccgcgacgtcggtggcgacgaccacgatcacatgatgggcggtgccggtgctcacgccatgtacatggctggccacgctatgaaaaaaaggttcaggaccaagttcacgcaggagcagaaagataagatgtgcgccttcgcagaaaagttgggctggaggattcagaaacacgatgacctggcagttcagcagttctgtatggatgtcggcgtcaagcgccacgttctcaaggtttggatgcacaacaacaagcataccttagccaagaaaccctaattattcatcaccaccatctctttacaaatgcccagccacaggtccaaggatcgaacctcgtcgtcactcaccctttttcaggcatgcgaacagaccctctatttttctctatgtttctgaacgcctgctgtagcagacgcccttgtaagtcccaacccagaaaagacaacgctgtgtttttttttcttttagccttgatgtcttagctggtagattttaagctgacttaaaaacacacagaactttctttacattctcacccatgatctacactactggatcatcctacatttttcatttaacccaaaaaaacctctcctagtttttcagatttctgtgctgatcatggactcttgtagctcactgctcataaatataaattcacctcttctaccaaggtcttacaccagtgctttcactgcttttcaaatggtattttaccaaaaattacagcgtcccatgagtggtgaatctctaaa

SEQ ID NO: 632 - DNA, 1586 bp, Pinus radiata
ggtggttttccttcgtagttgggtgatgatgagattcaaggacaaaggcagcagagcggaaatctagttgaaattcttggtctggatcccccatcttcatcaacggtgtctattggctgagccaaggtagacaggcctgtgctcattccctttccgcctcttctctgcaaacagcaagaaacgagagcaacaatgttcgacagttggagcatcgataacagtacacctgaatggccaatgctggactgaagcgaatttgcagaagacacccttctggaaaatgaaatcaaggcggagagtggtcgcgggttcgattcaagccggatgctgaaggcagcgtaagagacgaagcagcagttatgttttgcggcggcgacggtgagggtttgatgctcgaacagagggcactggggcacatgatggatctgggaaacacccagcatatgcctgtttcgatgtcggcaccttacggtgtgtatcccagtggcaacggcaatggaaatgccgccatcattatggtgctcccgcacgacgagagctcctccaatcccttaaatcctcaaaaccctataaaccctcgaaaccctatggaggcggcgtctgcaccgcttgctaccaaggttctgcgctacagagagtgccagcggaaccacgcggccaacatcggtggccacgccctcgatggttgcggggagttcatgcctgccgaagacgacacgttgaagtgtgcagcctgcgggtgccaccgcaacttccaccgccgagaggtagagggcgacgagcaaccgccctccaactgcgagtgctgcctccgcaagaagcgtggcggcggatcctcgtcagggccgggatcccctgctgccccttattaccccctccctttgccccacggttcctcggctccccatatgctcatggcgctaagctctggtcttaccgagtccgatgaccccgacggcaatacccacaacaacagtaataataacctcagtcaccatcatcatagaggcatgaagaagaggttcaggaccaagttctcgcaggatcagaaggaaaagatgcatttgttcgcagagaagatggggtggaggatgcaaaagcaggatgaggctattgtgcagcagttttgtaatgaaattggcgttgggaagggtgttttgaaggtctggatgcataacaacaagcatacactcggtaagaaatcttgaaaattatgtgatcgacacgggggttttatggaatttctatggatttcagccattctttcggggtttagggagcagctgttttctgcttaatcctttttatttcctgaatttatgaatagaaaaatatctctttcctttcgatctcatccctgaatccttccttcatcacgagaagggtatcagggtatcttctgttgagatcttgcactgcagagatcgaagtcagcataagtgtaaagtaatttattcccttcttttaggcagctttgtattcaattagggttatgtcggcagtgcctatatggtccgtggttctgccatttggcctcgagtaatttaatgggctggtaattacccttttcaaaaaaaaaaaaaaaa

SEQ ID NO: 633 - DNA, 1313 bp, Pinus radiata
gattgcaggtggtattggtatttagtttagtgcagccggtttgattaagatcgggattacgaggactgcagcgggatcaggattagggcgctctatggaaagaattggcagactaatggcctagatttggattttgatttggatttggatttaggtttagatttaggtttaggtttaggttttgaaaatatatgatggatcatcatcatcatcatgctcatcatcagatcccggtttcgatctcgcccgtgtctgttcatgacatttccaggcttcaacagcatcagatttttcacaaccccgccaatattgttcatgaggctgggactggtaataacaatatacatagtaatagcaataatgttcatgttacccagaatgggaatggcgatgatgggaagcctttggtggaaaagtcgaagaagggtgaaagtggtgagaagattgtgagatacagagaatgccagaaaaatcatgcggcgaatattgggagccacgcgcttgatggttgcggggaattcatggccagtgggttggatggcacggcggaggctctcaaatgccaggcctgcggttgccatcggaattttcacaggcaagaagttgagggcgagggcgggttggacgggtggtattccggtcctgcgggacggagccgagtcgataaaaaacggctgcttcccggtgttggaaatgtcggcgtcccgctgttttcttccccatctccgcctccctcggccacggcggtgaacgcgtcgggtcctcagatgttaatggccttgagctccgcctgcacgctcggagaccaggagttccacgaggggctcgtcggccggggcgtcgggtcgtcctcatcggctatgaagaaacgtttccggacgaaattttcgcaggagcaaaaggagaaaatgcacgcgtttgccgatcagttggggtggagaattcagaaacacgacgaggccgcggttcaccagttttgcaacgaggttggtgtcaggcgccatgttctcaaggtctggatgcacaacaacaagaacactgtgggaaaaaaattatagtaacttcgcctccaatcaaatcagttttttgttttttaatgtctggtacaaacctgtaaagtaaattgatttcttctccctaggttgctgctgctgctgccatttgagacctctgaaacacctaggttttctgttcatcaaactgatgttcagcggctcttaattcgttgttgctgctgaacggaggttagtttgataaactaccccaaatgaattaatctgagttccatctttctttaaaaaaaaaaaaaaaaa

SEQ ID NO: 634 - DNA, 2270 bp, Pinus radiata
gggcaactccataatcctctcctacatattgcctcttcctttcctctcttcttcatcatcagtcaattttcccttggagattttacattcttaagaaacagatgggtatggatatggaggactgcaatacagggcttggtctgggaatgagtattggccttgggatgaatctaatgagagaagaccttcaatctcacagacatcatgtcaatggccctcctgtgcagttggatctgctgcctttagctccagtactgccgtcccgtgacttgccatgggggaagacttcacccgggactgatggcgagagatcggccggggaatcgaaagcaaccgtgcccaggcgaatcgatgtgaacaaattgcccgcttcctgttactacaacgaagacacgggcaccattaatgtgtcgtccccaaacagtgccctatcgtcgtttcatgtggactccggtggcgcgatcaacgctgagagcagctgctacggcatgagcgtcaagagagagcgcgaagccaccgaggaattggaggcggagagagcttgctctagggttagcgatgaagaagctgatcaggagggcggcaccaggaagaaactcagattgtccaaggagcaatcggctcttttggaggaaagctttaaagagaacagctcccttaatcctaagcaaaagcaagccttggccaaaaggttgaatctccgcccgcggcaagttgaagtctggttccagaatagaagagcaaggacaaagctgaagcaaactgaagtggactgcgaatttctgaaaagatgctgcgaatcgctaacagacgagaacaggagattgcagaaagaattgcaggaattaagagctctgaaattggcgtctccgctgtatatgcagatgccagcggcaactctgaccatgtgcccctcctgtgaacgggttgttccggcggagaacagcaggccaccgcctttcactttggcgaaaccgcagttctattcttatacgcattcttcggcggcctgttaattaattaattgtatatcggtgttctgtactcaactcaggggccccctcaaggtttatttattgaggatctgccttgactgtaaactaaagtaaattaatccgcactcggacgtcgcgggatcgaagattacagagagatatatatagagagaaagagagcgctgtgtgtgttttagtgaagtatgtgtatatgcttatggatgggaatcatattaggagaaaaattgttatagctcatacggacggatctggtcgtctttttacagacctttttcccttgttatttctgtgggtttgttctcattgtaaaaaccagttgacgaaatcgataatacacaggggagccatgatgttatcaatggcctccttttttacttaaatctttaaaaaaaaaaaaaaaaaactcgagttttttttttttttttttgagaataataattgtccccatatagtagcatacagatgattataacaagtgcataaccagtaccacttttgaatctcggtgattacatatatcccatgttgaaagttggcgtttctttcataataaagaaaatacataaaaataagaaaacaaatagtagtgcttgtgttaatactgcgggtgataatatggtgggggtagtggcggtggtggggctgattgatatggtggatattgctgatatggtggcggaggtccataagaaggcccataatagtgatgatattgaccttcttgagactgttgtgatccctgaaggcagttatgctttagctttctccagcaaagcatgaccaaggaacatcggtggctgatggggatcatttgtagattaattgttaaactaaacttgtgaaataatatccaagatttgtttctgagctgaccttatttagtacactctgttgttgtagttcatattgggatgggtgcattgacaatatgattctctttgccataatgaaggagcgtatttgcatcacataagttccaagttttaatatatgtgactgcaagtcgattattttgtaatcagtgcacagacaatgcaagagacagaaaaaatgtatacttgaaggttctgtttggtaaaaatggagtttagttgacaaggcaacttttcttgtattagccatttgttttcttgtggccactactaagaaaagcttggagctgaaatataattgtccaaagtttggctgccaccagtggcacgatcaataggagtgttggctgggcctttattagttaaaaaaaaaaaaaaaaaa

SEQ ID NO: 635 - DNA, 2454 bp, Pinus radiata
aacctattggcctctaggcgttccagctaccgcaacagttattgtgtctcctagaggctactgggtactgctgctgacgatggcaatgatgccattgccagtactgtcgagtttttgatattgctattttgatggtccatccttctcctccttcgtttctttaaatcctctcaattaagcttcctagaatcctcaggtttttttaatggtggtatttgtactggttacagttgttttctgtacagtgtaacatggatatctgatgttcgccacagtgattcttatggatcatacatatatatatttcaaccaggtctgatatatatttgtgggaatcatatctaatactgaaagcatttgctttctgctgctgctgtgatctattcctatgttctgtattcgaatatgatagattacctttactcatatgaagcctctgctgctgctagttagtgtatttatgtttcagtatatatcttattctgctcatgccgggtattttatgctgtggatatggtctgggaattaagagtaaccgaggctcaagaggccgaagctcttagaatcttgatattttaatgtttatctttttaacgtcctttgagatttgacttggccttggctggattggcggatcatgtgtgaagaagattttgttattataaatcaagtttttttatacatgatcatgccaacagcaaattgtaatgagtcatggtcctaatggtggccattcttacagtttgtaggagccaggcatccttcttgtagactttgaggcagcagtcttgttgttcctgctattaagggatatggctatgagctaattagaattgagggcaacaatggaaacgaatctcttaacgcagcaacaatcaggttgccatgatgctgaagaggactatgatggtggttattgagtgttgattaaataacagaccccccaacaatagaaacagaacatcagttggatgctggttatagttgagacagttgggttatgactgtaaaactgaagacattggatggcaatggatttgagtcagaatggctgcatgacagtggttatactttgatttagctggggttgtggtgatggatatatggcagccgtggttttggattttcatgggagtggctgcttgatcaatatatggcagtttctacttatgtggactagtatttcacaaaggggaatgcctatatggaagtagttttataaccatggttatggatttaagtttgatcaattgtatgaaagtgtgtacatggctctagttaagggcacgaggataggaagctctggatatggacttcagcttggtggctgtatgacactgggtgcctttatatgcttaaggatttgagttgggttcattgatttcattttgttgcagataatttgagaagcaatccggggatgaatctaaacgatcatacttacaatttatcacctatggctaattcaggaaatcctgaagagcagattgatgaggatgcagtggatgactttatgaactaccaacccgagtctaaaaagagaagacttacagtagaacaggtgaggtctttagagaggagtttcgaaatcgagaccaagctggaaccagagaaaaagatacagttggctcaagagcttggacttcaaccccgtcaagtagctatttggttccagaacagaagggcgagatggaagaccaagcagcttgagagagattacagcgttctcaaagctagttatgatgctttaaaatctgattttgagagattgcagcaggaaaacaaaaatatccgtgccgagctggagagtttaaaagagaagctggaagaagcagattgctgcaaagaggacaaccatagtgacatggcaacatcaacaaaggtaacaagcaccattgaaaatagcaagaaacttgcagcagatgttgcaggcgaggaaaatgatattgacatcaagcctttcagtgatattacactgctcttcaaggagaaagatatgggtttggagaagatggatattaagccgttcagagtaatgctattgaatgagaaagagggatcttttagcccaggcagtgactgtagtgccaatacaaggaatgaagacaagaatccaccacatcaaattcttagtcatcttgcacaggcttcttcatctatgaaatacccgtctggtactaataatatagctggtatggataacatcaatgaccaaggtcttatgcatctggctgaggcactttgtggcatgggccttcctccaaaagcatatcagcaacttttcagagtagatgaaggatatcttcatgaagatgcttacaacccacttttccaatgaagaagaccacggtgccccgagtactctgccatggtgggagtactggccttgagccttgctcagtagtagtaaattatcttgccctcgcaatagatatatggcagaaaggaaagatt

SEQ ID NO: 636 - DNA, 1888 bp, Pinus radiata
aatccacataaaatccaaccatccataatttacaaaggttaaaatttcactgtagacaaatgacaccgacaaataacgtggatctctggcctgttcaacgtgattcttaattttgagttccatgtaaagtggtaactataagggcagtagcagtatggactagacagttgcagagttgaatggggcggtgttggggcgcctgcaacagcagcagtagtgcaggtgacgctgccgtgccacatacggtggagatgcacgaagaagaagagaaaaaggggatgtgaccggcgaagggcacgcacacccaccaaatagtcattgacacctgtgggttatccacccatcctccatacactatacatccatactgtcatactccagtactccctacttttcttccacaatagaaaacaggcccactagtcacttcatgcaatccctctttctcaatttcttccctgttagcctgagggctgcaaagcccaggcaggccgagggactgattagctagaaaaaactggatttcgagagacctgcaggcagcagacaggcatcctgcgaatgagaggtgacagctggagcagcaaccatgacatcctcgtttctatgagaatctatagggcctggagagagtgagcacagctgcacgaggtggactcaccataattgctaccagagttagaagagaggatctattactattattattttgattaaggtttcttattgttgctaagattcactaggccatgagtgtgcctgcgaagaagcagacactttaaggtgtgaaagtcttgaccttgaagtaataaaaaaagtggcaggacgatatggcttgtgataggagcgcattgtatccctccaatgtaatcatgaataccgaggacaacagttctgctaatgctatagctgccatgattgcaaattcttgtactccacctgcaacgtttcaaggtaatcgatctatgagtgtttttgaaactggaaatgagcgtaaaagaccagctggcaactcctactcggccttggaattgtctgatgacattggggatgaagatggttctgatgattgcatccatttgggagagaaaaaaagaaggttgaccttagagcaagtgagggctctagaaaaaaatttcgaaatggcaaacaaacttgaaccagagaagaaaatgcaattagcaaaggctctaggtctgcagccaaggcaaattgcagtgtggtttcaaaacaggagagcaagatggaaaaccaagcaactagagaaggacttcaatattctcaagcacgactatgattctctgaagcaaaattatgataatcttatggaagaaaataacaatctccaggccatgatcgaacgtctaagaaataaatcacagagctgccatgaccagaaatttcaggcaaattcttccaaattacaaaaggacgatcaggacttgcccattctcatgatgtctgcaaccaaagtttgtgcaaacaaggagaataataatgaagggcgttctagcattggaagtgaaggcagttctgtcttggacatggacagccccagcaccattgaaagccaacaaaatattgattccataggattctccaacgttaaagctcgtgaccctcggcttgaatgcaatttcaggcctaaagtggaggaaagtgtgattgaagcagatgaaccttgcaattatctattttacaataatatggagtctggtcccctcttgtgggagtataattggtcttgcctttagcaagtaacaagcattatctgatattccattatagttaccatccattgtctggcatagcttttttcttgagaacatatattatcctttgtgacataaagataagcaaagcttatttgcggtggttaaaaaaaaaa

SEQ ID NO: 637 - DNA, 1888 bp, Pinus radiata; identical to SEQ ID NO: 636

SEQ ID NO: 638 - DNA, 1795 bp, Pinus radiata
ctggttttggaagtggcagggtcatttgctcccaagatctcatgcatccgggggccgccccgcctatggctttgcatcgctggcttctggggaatggaagagcaaagtgaggcggaggctgaggatgatcagaatcaaccccaggaggaggaggagcctggaggaagttaagttagcatcatgggaatgcggaacaaggcattgggttttggattcaccagcagcatcacatgtttgtctagataacgtttcgttttgagatctctgcatatccctacgctacgcctccgtccacggattcatggggcagcagttacaagaataaagaagggagtggtactactactgccaggatctagggccacattcaaacccaaataaggatattgccatccctacgaggactaaaatggaaacaacagggaccttcaaattttctattccctcgcctctggttgggtgcccaggcaatattcatgatgacgatgaagaagaagatgaggaggagtgcagcgggactgggcagcaaacgaggaagaagaggaggctgagcttgcagcaggtgagatctctggagaaaacctttgaggttgagaacaagcttgagccagaaaggaaattacaacttgcacaggaattgggcctccagcccagacaggttgctgtttggttccagaataggcgtgctcgctggaaaaccaagcagctcgagagagattacggacagcttaaactcaattacgagtgccttaaatcgaacttcgatgccatcaagcaggaaaaccagaagctcacatctgagctcaactatctgaaggaaaaatgggaggaaactcagaatctggaaagggataacaccgatctcaacaaagcaaatgaagaaaagaaggtttttggcacgggggaagataaagctatatcagataccaaatcactggacaaaacaatggtgtgtaaacaagatcatgacggtgctgagatcaaggttacaggcgtagccatgatattcaatgaaaaattagaggggtcggagagcgagagcagtgccatagtgaacgagcaggcagataataataacaacaacaacagtccccattccatcgatagccacatttctactttgtctctgaactgttgttatgttccggggcctcctgtggcttctagcgctattgatgaaggcctaatggaggctctatgcccgaaaggcctcattcgaccaaaggaagaacatcatcaccaacaaaacttcagagcagatgctaactttgttcaagaggatccggcctgcaatttcttcaatgtggacgatacaactgtcactctaccgtggtgggaatgggcttgatcagctctaatttctttggcctggtaaataatctacgaagaagtcaaacgagctatgaatatcagagcatcaatgtaggttttggtagtgagtggtgaatgactactaatggccactcagctgtctgcatgtcaacaataagcagagaataaagtggtgattgtgatccacaatctgctgctctaatggtgttctcagtgggaatcgatttcagatcaacaaacagttttgtagggcatatcacgcatagtttctagctagttaggtttgaaaattattgctgcatttcccggagattatgaaagactgttacaaagaatgtatgttggttttgcatatgttggattaatcatttccagccagtattctttccagttttgccaataaaatgttggccgagtcccgtgctatgttgataacttcatctgttaaattctcttaatacgc

SEQ ID NO: 639 - DNA, 1532 bp, Pinus radiata
gctgcctttgcgttctaagccgtgttctggaagttgagagagagggtttcagaggttggaactgtgtggccttgagacaaagtgtactatacgattttcatcatccctgacgtctggtgaggcagcatatatcttggggttggacttgcctggtttcttttgtgtgaggattattcatggaggagacaaagcagagaggtctggaacggctgaagagtttggcaaatgatgataccactggtttggctctcggcgtgggtctgtctatggcgatgcctgccacaataacgcaagaagatgaccagaaaagcgcgccgctgcaactcgaactcttgccctttcgccccatcgcttcccgcgttgggacttctccggcgccttccccgccgtttcgctggttcatgcccaataactgccgggaagaggtgacggtagctgagacgaatctgtccggggtcgcgcgcggcggcggcggaggaatagacatgaatcgggttccgtccacaaacgaatacgaggaatcggcggtttttcaggccgatgccttgcgggtggtggacaacgggccgatggcggtgaaaagagagcgagaaagagcctttgacttagaggccgagagggatcgaacctgcgacgtgagttcgaggaccagcgacgaagaggagataggttcgacgaggaaaaagctgcggctttccaaggagcaatctgcactgcttgaggaaagtttccgggagcacagtactttgaatccgaaacagaagaacgcgctggccaagcagttgaatttgcgcccgaggcaggtcgaagtctggtttcagaacagaagagctcggacaaagttgaagcagacggaagtagattgcgaggttctgaagcgctgctgcgaaaatctaacggaggagaacaggaggctgcagaaagaactgcaagagctaagggctttaaaggcggcgcctcagccgtgcgtgatagggcaggataattattacatgcctttgcctgccaccacgctaaccatgtgcccctcctgtgaaagggtggctaccatggaaaacagccgaagccttcaattctccaagtcacagatttctcagtttacccaacagtccgcagcctgttagtcttttattactaaactcatacttcagttttttgggttctttcaaggctccttcgataaggtttgccttgccttgtacgtttaaactcaaatcattccacacaggtcctttttttcccctgtccagatttcacccctttacaaacacatagaaatacaccatataatccttgtgggagaaatatttgactaacaataccaatagtgaacaaagtgcccgggatcttacatatgttgtatattacgctggaaatctatccacagatgacagatttctctattcattattgttcttgttagttctgtcgtggcagcacccagcatgtacattttgaggccggggaagccaaattttactctttttacaataatcataatattattatgagaggttttgttaaaaaaaaaa

SEQ ID NO: 640 - DNA, 1685 bp, Pinus radiata
ctccttacacacacaattcaatcaatcccctcgccacgccaccgcgttcgcctgttcttcctcctctggatcaacccattcccacagtcctacttcgctcaatccgacggctaatttttgcgaaatctctgtctctttctcttattaccggtttctgattagaaactggcaaaaacagaggatttagcagtacccaactggggaacagagcgttccgaatgatgggtattgttgtttcctgctgtctggtatctcgcatgcgagctctctggagaagcagcttctttcgccataaagttcacatatctctgggcaactactggttttgctagcgattctgaggtgggcatatgctcagcttttaatgctactagaggacaccgtttgaaggagtttttctctgaggagatgatgatgtctggtgggagaatgtatggtgggccgaacgtccttgtcacggccaacgagaacatttcccgctctgcagatgcactggaagctctactttcttctcctgttttcaatggttcaagatctgtagctaatttggaggaggtgataggtaatgtgtcaaaaagatcattttacaattcctttgaccaggaagaaactggagatgaagaccttgatgattgtatccatccaccggagaagaagagaaggctgactgctgaccaagtgcagttcctggaacgaagctttgagatcgaaaacaagttggaacctgagcgcaagatacagctagccaaggagttgggcctccaacctaggcaagttgcagtctggtttcaaaaccggcgggcaaggtggaaaacaaagcagttggaaagggattatgatattctgaaatcacgctatgagaatttgagagttgattatgatagcctgctcaaagaaaaggataaattaagggctgaggttaccttcctaacagacaagctacacgacagtgaccatgaagccctcacaaaggattctgagtctgctgacaagaaagtctatccccagcctgcctcccactctgactgtgttggggagcctgaaagaagtactgctgccaaggatacaccaccaggttgtaaacacgaagatcttctgagctctggaacagatagcagtggggtcctggatgaagatagtcctcaccatgttgactgtggtcattcatccttggaccatgtgaactctcatctttttgaagcagatcagtcagacctctcacatgctgaagaagaagaagaagaagaaggcatgagtgaaaaactgcttcctcagacatacacatatcatcatctcctcaaagtggaagacggtgcttacccagatgcttcaattgcgtacaatgacatgtttgttttggaggatcaagtacagcttccctggtgggactagccataattatgctgctgttatgttcatctgttcgtttcccttgcccagaataagagcagattgatgtaatagcatatgagagctaactctcaaagaaagtagagtactattgacaaggtttagttttacttgcaactgtaagtgttaagaagattttgaagggtggctgcatagacattctcttcactcatgatgtatagcaatttctaatggttttcaggttttctcttatgtatgttgcccaaggtagaggtgaaagagtgaatgcaagcctactttgtttaaaaaaaaaa

SEQ ID NO: 641 - DNA, 1337 bp, Pinus radiata
aaatttagtgttggtagactctcgaagcgtatagctgagagtctttaaacatgggtattatggcttgctcactgggatcccgtatgcctactctgtggagcacaagcttctttcgtcacaagcactttctctagtagagctattatcagaagaactttaggaagcaaggggtagttgtctgtattaaataaaaatggcgtccaatgggattatgttcaatgcttccaatcgaaatttgatcgtcatggtgaatgaagctccatccttcgaagctaattcaagtttggatggagtgatgaagaatgtgtcaaagaggccattctacaatacacttgatgcagacgaagcaggggatgaggacttgctggacgagtgcgttcatcagccaggaaagaaaagaagactttcggtagagcaagttcgctttctggaaaagagctttgagttggacaacaagcttgagccggagcgcaaaactcagttagctagagatttgggattgcagcctaggcaggttgcagtctggttccagaatcggcgtgccaggtggaagaccaagcaattggagagggaatacgacattctgaaatcaagctatgatactctcagggtggattatgataatttactcaaagaaaaagataaattgagatctgaggtcatttgcctgacagacaaactacatgccaaagagaaaggttttgaaatccaaacaaatgatttggagacaacttgtaaaaaagcattcatccaatccgattcccagtttgagagcttggagaaatctgggattgtttccgaaggcatgactgtttcttttgatcagcaactagtgagctatagcattgaagatcatcatagctcgggaacagatggaagtgctgtcgtagatgaggaaagccctcatcacattgatagtgggcattcttcggttgtactattgggctatagcgttgaagaccctcttagctcgggaacagatggaagtgatgtcttagatgaggaaagccctcatcacattgatagtggacattcttcggttgtaggctatatcacctcaacccgtctttcacacattgaaacagatcagtctgacttttctcaagttgatgaagaaggaagcatgcgtgaaaagcttcaatttcctcaggactgtcataatctgaaaatggagtgtggacttttcccagaggcaccaacaacatcttgtaattatgtattttccatggatgattcatggtgggactggtcataagtagctaattttctatttagttcattttgtacgatctatctcatcacagcaaaatggtttaaacttaaagtagaaaaaaaaa

SEQ ID NO: 642 - DNA, 1854 bp, Pinus radiata
ggtcacagagcatcagccccctggtcacatgccttcggtcacacagggctccgccatggccaaccccaatttcgtggctttgcataataatcaggtcatgacggaggagcaaatggagaccctgcgcaggcaaatttgcgtttattcaacaatttgcagtcagttggtagaaatgcacagagccatgtcacagcagcagccttcttcagtgcctactctgcttatgggacaacacatgctttatgatctagctcaaggaaatccagggtttagaacatctgctagacagcgctggacaccaagtcagactcagcttcaaatattggaaagtttgtttgatcaaggccatgccacaccaagtaagcaaaaaataaaggagataacaatggaacttagtcagcatggtcaaatatctgagaccaatgtttataattggttccaaaatcgtaaagctcgtgcaaaaagaaaacaattaccttcacagaggggaggcgaatctgaaaatgagactgatgatgaataccctggagaaaaaagatttaaacctcaacatgattcaaatgcacagaatccaaaatcaggacactctgaggcagatccacaggttcataaaagtgatgatgtggttcaaaacaagccctgtacaactgaccaaaaacaatttggaatccaagaaaatgatacccaatctttattacagcgtgaagatgaaatgaggcctcatgcgtcgttgggtagcactatgcttggtgtgagtggcagtgctgaacatgaatccgttgaatgtctgcctgaagttaaacctatatattcttcagttgaagttggcaatcgtgatcatgatgcaactcaagcatatatacatggttctggtaccacaactggccaggttgatgggaaatcatggcaagtgcccagtgttgtagttgatgttagaagaatgtttggtgaaaatgcggtgttggtggattctcgtgggcacatggtcccgactaatgacatgggagtctcatttcaccctcttcaagcaagtgaaggttacactgtcttaagccaatatcagtgtgcttctggagtacctgtccatgccctccgagccaacaccggagatccatatcggggaacttaaaggtcaatctggatgatcaagctcaaatataaatatatcttctcagtgtaagggggcgaggatttgctgtttaattaacaagccaatggtgcattgaaagtactagctagtagcacaatgtgctcatcaaattgacagacctttcttcagtataaaatcgtttacttttgatgtatctgcaacggtattggttgcaatctcagctggttcctttagagggcagtgcacatattccaaaggtcatgggatgaacatatatataattctgacagtatatcatgaagttccatctgagatcagttttgatttgcatgcaatagggtatatgtatctaaatgtttatataggttcatactgaagtaggactctttgcctgaaagtcaaatcggtagacccatttgaatctcgagtagttatttttcagtgctaatctataccttattaaagttatggtccatattgccatattctaatgaatgtggcaagtgatgctatatgtgaatagttctttctgaacaacaatagactgatagtaaatacaaatctgattcctagtaacctcaatggttcagggttgggttcttttgctctatggggttggaacatgtgtgccaccctttcgaggaagttatgatcattgattactataaacttagttttgtaacatggaaaatgtattgtattagctgcctgtgaaggcatttattggcctccgaaaaaaaaaa

SEQ ID NO: 643 - DNA, 1513 bp, Pinus radiata
gccagcttgtatggagtccacatggttgaatatggcggagatgtcggcgttggatccatgatggcacttatgaccgaacatcatcctgaaagcgaaagcattatgacaagcatacccatacccagttcttattcttcatatagtcatgggcatggtcatggtcatggccatgggcatgggcatggtcagtccgaatgtcttctttctgcggcggctatgttccaaacctctcggccatgtcaaggctcaaacaagtttgagcctgcaaatgcacaacatataggaggaggaggaggaggacgaggagctggtcatttcgtcatggaacagtttatacctgagcaggccgtcatctctgattcgtccatatcttcggtgaaaacagaagtttgcagcggtagtggaggccaatttgagctgatccgcaggaaagaagaggggagatgcggccgtgcctatgctgagccttcatttgttgtcactcctctagttacttcattacctccacagcagcaggaaggccggatggtaacatccctggcagtggatatggacagctcatgttcttgtaaaccaaatgaagctgatgccatgagagcaaaaattattgcgcatgtacactatcctcgcttagtggcagcttacatagactgtcaaaaggtaggcgcccccccggaggtagtttcagagttggatgatctaagtcacaaatgccaaactcaacactgtgtacctacaataagcgtcggagcggacccagaactggatcaattcatggaagcctattgcgagatgttcatcaaatatcaggaggagcttacaaagccctttaaagaagcgatggcatttttgaagaagatcgagaaccagctgggtactctaaccaaagggactatcagaacttcgtcattagatcaaggtgacgaaagaggagatggagcagcatcatcagaagaggaagacggtagtggaggtgaagtggagtttcatgaggtagatccccatgcagaagaccgggaattaaaagatcaactcttgcgcaagtatagtgggtacttgagcagtctcaagcaagaatttcttaagaagaaaaagaaaggcaaactccccaaggaagcaaggcaaaagttgttggattggtggaccagaaactataagtggccatatccttcggaaagtcaaaagatagcattggcagaatctaccgggctggatcagaagcaaataaataactggtttataaatcagcgcaagcgacattggaaaccatctgaagagatgcagttcgtggttatggatagtcctaatcctcacaacgctgcttttttcctggagggacatctcaggacagatggaactgccttttcaatggattgttgaagttaaacccatttttgaggcaaacaccagttttagtgcaatgctgtagatttgtctgactcatcttttatatgtatagctggatctctaaaatgggccatgtttcataacgtgctagatatgagctcgtgcg

SEQ ID NO: 644 - skipped

SEQ ID NO: 645 - DNA, 2043 bp, Pinus radiata
gcttaggctttttctcatgtttgatatttctgcccactgcactgatcaaggacttgatgatcagggggcactagatacacattgttattcttccagttgttgacttagtaggttttatacataagctgagcttttatcaatggaagccaaaatggcaaacttgaattctgtcacaaacatgccatttgcctgcgagaatggaggttgcaacaagcgtttcaggcccctggttccaaaattaaccctttctccaaacagcgctgctccaatggcgaatgcagtctggtccactcagcagtctcatgatcagtacagccagctgcaacaagctttcagttcggctactagtggtaacagtgtttcagtgtccgctgcagcctgccttctagagccaaagattagcaggttggatggaaaagtagatgacaattccaatcagagaaaccaaattgataggcttatcaaaggtgaccaacaaaacatgaaggaagaacaagcagaaagctgtgcagtacagtctcagccagcagcctctgggactcgatggaatccaacaccagaccagattagaatcctagaaatgttttacaagggaggaatgcgcacccccaatgcagaacaaatcgagcacattacagcacagctgaggcagtatgggaagattgaaggcaagaatgtgttctactggtttcagaaccacaaagccagagaaaggcagaagcaaaagcgtaacagcagcatgcaccaggtagctgctactgcagcaaagaaaactccaacaacaataatggcagataaccctaatgaacttcacaagcccaactccaacggcacatactctctctataatttgcctttcacagcaatgtctgaagattctcggctcatgttcacttcaacgtccttgctaactatgccatgttcaaagggactggcagcctctttggcgcaggtgggtgttgatgtcctaacacctgcaaccaaaagagatgggctagatgtactaaaaaaaagttctcatgggcctccacaagtacagatgaatgaagaaggatcgccatcgaagaacagtatgatatgggattccattaattccagtggagaaggaattataacaaatctggcattgagccaggctgctgctgatatgcctgtgaatgcagtaaactcatgcaaacgaaagaacagattgtggcaagtcatgagtcccaacgaagaacttggcctgcacacagaaagcagctcagaatcaatctgcctgcagacatctaattctgatcccattaatccatctgactatactaacgaagaagaccatcgccaactccagactctgcaactattccccttgcgtccagaagggtccctcaaatctaagggagaaaccaatatggacaactcagtattatccttgcacgttaatccttcttccacttatccatttagagaatttaacaagtctgcagaatcctcgactcagatgggagctgccattttcgaggaacacaagtattccaaggcagctgaattttttcctaacctctctgcagattattccttcttgaattccatgacatgaaattgttgtcgaggaggatttccaatttttgtaccaatatagttttttttttcttttctgaaaaattgttgggttgcttttttccttgaacaaaaatcattagttatcatttcaaagttgcttctgtcacgcgtgcacacacaatctctttacagcaataaaataaatataaagaatagttgcagatccttactgcagggaaaaaaagcagttgagaaaaagagacctgaagttggaagagatagctatgcagagaaaaatgcaactttcctcagcgaatcacataaattgtatattaatttgttaaataactttacgacttttaagcgctaatattgacaaaggtatggttgagattgtgaatgccacattcgtcacttacaaaagtcaggtgaaaggcgcttgaaataaatttaaagaaagatttttattaataatatataaatattgtatcaaaaaaaaaa

SEQ ID NO: 646 - DNA, 2439 bp, Pinus radiata
gcagtatttgcccgaattgtagtagggaagtatctgaggttaagcgggtttctctctactgcaagtccctcttctcttctacaaagacgccgccggaagttgcaggaggcttggaagctgctggccaggacctccagaattccaagaattcggccccgcggaacaaaggtagcggaggtacctacaatcctatttggtgttttagctttaaaattagtgtgtgttagccatggcgttccacagcctctctcacgacatgccactgcagcgtttttcagagcagcgtttggacggaggagggacaagatattcggagcgacgcgcgccggccggccaattgggaatagcggaggaaggaaaagaggaaattccgattcccaggcagagatacggaagtttggggtatacggaagcacagtcttcatcgtcatccgctaaggcggcattagcaggagccggtgagtgtggaggtggagataaggtgcccatgcttgtgcttcctcttatgagcgaatccggcagtgcgagtgaaaataacgttaagcttggaacgactaacacttggctcagcagagccgtctcgggacagcacagggcgcagcagcagcagcagcagcactacgcggaacggagcgtggaagagggcaggaaatggtgcggctgcgcggccggctctcgcgactgtattcattctaatttcttgaagctccagaacccggcaagtgcgggttcgagctccgctgccgccaacgcgctgtccggcagatggctaatgcccggacctttgctgaacgacaagattgaggggagggaaggggtcgagctacttggaggagaaattccgggcgagtctattatggcattatccgcacaatttaagactgcgggttctgctgcgccagaaagggggctgttgaatcttcattcggcggatgctgtgaatagcaacggagaacctgtagatagcggaggggccggtggagatagagacggaggggaggaggcggaggatcatgcagcgttgtggcaaagcgccaggataaaagctgacattgtctcacatccgctttacgaccagttactgtccgcacacttggagtgtcttcgcatagcgactccgaaggatcagcactcgatgattgacgcgcaattagagcagtcgcagcatgtcgtcaccaaatattccgtccttggcaacgataatttcctcgtcggcgacaagaaagaactcgatcagttcatgacacaatatgttttgctgctttgttctttcaaggagcagctgcaatatcacgttcatgttcatgttatggaagccgtgagggcatgcattgaccttcagcattctcttctaacactaacaggagtgtcacctggagaaggtaccggtgcaaccatgtcagatgatgaggatgataatgcagatagtgacaccgatctttatgatggaggtttagatggtgggcaggatattgttggacttgggcccctgatacccactgagagtgaacgctctcttatggaacgggttagacaggagctcaaggtagacttgaagcagggatacagagccaaaattgcagatgtaagagaggagatcttgcgtaagcgcagagcgggaaagcttcctggtgacacaacttctcggttgaaggcttggtggcaatcacattctaaatggccttacccgactgaagatgagaaggcgagacttgtacaggaaacaggcctgcagctgaagcagatcaataactggtttatcaaccagcgcaaacgtaactggcagagtaatccttcctcatccactactttaaaatcgaagcgcaagaggtgatgaggctttgataatacttacagtagtagatcaactcgttactcaccctacaccatacgttattgcacaaacagttcactaactccgacttgagttaggcgccacgagtgcaaagatgtgtttgtgcttgttgtctaacagagtatttcttaaattaggagagaagcttatcagatttgcaagaggagagatggaagcatgggaaggcatagtcagtccaacagtgaaaatttcgagttttagaacagagggctacagagcagaggagagaagttaaagttgagagtatctttacaccatatattaagttcactgcccacagaataatttggcaaatgccttgatggtcatcctcaatcataaagttactcgaagcgagctgctaaactaatgcatcctatacatagagcctgaagcttttaaggtccgacgcaacacatatgtttccctattttttttacatgcatatgtggaattgagagatgacccctaaaccaattccaacctttttctttatcaataagaaatgacagttcccagatgtataagaatctttcaccatcaaatttaatacgtgagctcaaatttttcttataaaaaaaaaa

SEQ ID NO: 647 - DNA, 2922 bp, Pinus radiata
gcaacaacaaaaacaaccactgagttattgtggtgtgtcgatgacattgaagcaatcaaaagcaaaacaccgagtggtagtcgtagttgaaggaggaggataccatggtagttggttaaggggagttagtgtgggagatcggaagatttttgaggatggcatgcccgggttttgtgctcggggagtctcgatgtttctgctacgtttctgcttcgatatcgtcttcatatatcttcttcttctgctagttccttcttctcatgcctggttttcttgttcttgttcttgttctggttctggttctgctgccgtacgccgcgccttcgagtctctcgctctacctctcttccttcccttcgcctcgccttcttagtccgtctgcgtaagtgaagcatctcgctgttcaatccctcggaccgctgctgctgagggtttctcctgcttttatctttatttccttttccggagtgcaaagagtgcgggcttttacccttttctgcaggatctgtttaagatcgaacctggagccctcacgtcttccagatcggatgcctgctagggttctgaatacgtgttttatctaaagatcgatgcgagagcagggcgtgcgactcgaaccctcgcgctttgggttgtccgtgtacgggttttcagatctgtagggtttctgttttattttctgaaactgtcgtcgcagcgacccgctgtttgcaggaggaggatctgctctgccgtttgcttgccgtgaaagaaatcgaacttccggcgcttgggtgcgagaaatatttgcaaatcgaacttccggcttgggtgcaagaagcttttgcgttttcggtttcagattaaagcaatatggagtcagaggaagacaaaatatctccagagaacaagaaaaggagattaaaaaccccacagcaggtcgaaggtctagagagcttttatgctgaacataagtatccttcggaagctatgaaatcacagttatcagaagaactgggattaacagagaagcaggtacaaggatggttctgtcacaggaggcttaaggataaaaggctcatgaaggaagaagcttccaacaatggaaaacaagatccacacaatggcataatgcaagattctgttaatggagtcaaacaagattctagcggcagtggaaaaaaatctgatcaccaacgccattcgaggtgcaaagaggttgaaagtcaacgatttgcgaatgccatggattatcctgcagctgtccttgcgtcagagcttagggatcatgatttgttcaaagtaaaccatgataacgaagacacctttgcaggaagtagttcagcttcacaagacagatcgtcattacaaagtgggaatccttatgaagctgaggcaagaagacgcccatttcagaatggtaagcattatgaatttgaaggaaagaggaagaacagaagctcttatatggatccatactcagaagaggatggtgaacacgaagctattactgctgtcagggagcagctaggtgatgaatatcgagaagatggcccaccacttggtgttgagtttcaccccctaccgcctggtgcatttgatgactcaacagaacccccctaccagggtaatattgttgtacaggatatccagagaatgccaaagaagatgatggaaccagatactcgcaaaatgtttcgtccagaaggcttccatactccctgttcgacaggagtgggacttggatacatgtccgttcctatgggtctaaaatttgaacgggcatctcctaagtttgaacgagcctccccaaaatgtgaatgggcttcttattccaaacatgagtccttgaatatcaaatccgcttggaggcctgcaaacaatcatctacaaataggtgataattatcatgtgcctgatctgaattcttcaatgcagttggatgaagattctcctgatgattcaccatcatctgaatttgtcacaaaaagctatccagcttggcacaagcaagaacctgcaggaaggctgagttctgatgctcatttgccactaccgtatggaagtaagaatgggatgatccctgggaaagttctaaatgcaggcaaagaattctctattccccgcccttataatggtggggatatataccatgatacatctggagtaaatccaaatgtgaaagctgcaatgccccctgtgcaaagtcgtgatctgctgtcatctcagggagaagataagttccagccaaaaaagatgaccaagagggaaaggcttagagaggaaagaaaaattaagagagagcaggatagtgcattgcgattgaagcagaaattaattccaaaggaggaaaagatgaatactcagattgaaaggaaaaagcagatggaggaaattaggaagccgagagaggttgccaaatgcctagctgctaatgagaaagttgcactttcaaagaatctaatgaaagggcataccggggaaattccaaacaattttagcgggggtggtttagtggctgcctgctcctccatggaataatttcaaggacgtctgaaagttgtgtattgtaattgggacagctacaaggtttagcatcacccactgtttctattctcttcagggaatcaggttgagaagttccaaaagctgaaataacaattgaagagatcatatggtgtacataattctattcatcatctttttggttgtatcaacaaaattcccctaacctaatcaaactttcagatccagatggttcaaattttgtatatgaaaatttctagtcctacaagtcttctgtaaatttcgactgtcagatacttattgctcctgccagttgtttgctgagcaattacttaaaaatgttgttatgtaatatccctcaagcaaccattgattcaatgagattttctatttctgggttttggaaaaaaaaaaaaa

SEQ ID NO: 648 - DNA, 3090 bp, Pinus radiata
gcaactaatgatctgggtggtggttgcttctgtttttgcttttgaataggcccccacaaattcaaaaacaacaggattaagatatggttttctcactgtcattacaccaacctgtgtgcattcaatcaatacacgtttattcatcaaaagattttaagatgcccctcataattatcactgtgtatttgatgcgccttcattgttcttaaatgcaatccatgactggcagtcatatgatatattcgtcagattgttacatggccagcactgcttctgtatattccatggctggattttggtgaactgaattaattggaattggcatttcaagttgactgggttgattttagatatatatatgcccatttgggttctcggaaggagaaaggaatatttctcttacagtggatatgatatgatatcaaataggtcaagaaaaatcatcatatttctgaggccaaggcaaaggaaatgacagggtttgagcgaaggatagtgattaaaatgactcggtaaatctctgaaaacatgccttttgctccaacgatggcacatgctcgagtcactgcccctgcggtcaagtccagaaacccaagcaatttcttctcatcaacggggctttctctcatgttgcctggtggtggtggcggtgaagggcagaacagaagtgggcatgatgaggatcaggattacgagagtagcgagaacatggaaggtggatctggagatgatattgcagaccttgaccatcctcggaagaagcgttaccacaggcatacccctcagcaaatccaggaaatggaagcacttttcaaggaattccctcatccagatgaaaagcaaaggcaacaactcagcaaaaaattgggacttgcccctaggcaagttaaattctggtttcagaatcgtcgaacacaattgaaagctactcaagagcgacatgaaaactcgctgttgaggcaagaaatcgatcagcttcgatcagagaatgtgtccctaagagagtcactaagaaatccaatctgttcaatctgtggaggacgaggacttaatggggatctcatgtcattcgacgaacagcagctacggcatgagaatgctcgcctgaaagatgagctggacagggtttgtgctttggtggagaagttgtcgggtcgaccaaattcatccagagcacctgcttccaattcttcgctggacctcacagtgggcttaagtggactgcattcgcctgccatgaatagtgttaaccagcgtgctatggtgctgatgggtatagaaagatctaaagttacagaagtagcattagctgccatggatgagctgatgaaaatgagtcaaactgaggaacctctgtgggtgaaaaaccccgaagcaggcatggaaactttggaccatgaagaatactcacgagagtttccaaggcttatcggaccaaaaccgatcggtcacaagactgaagctaccaggcatacagacatagtggtcatgaagagctccacaatagttgacacacttatcaatgctaaccggtggatggaaacatttccatgcataatatcaagggctactacggtggatgtgatttccaacggtgtgggtggcactaggaatggagcgctacaattgatgtatgctgagttacaagttctatcacctcttcttccaacacgggagatttatttcgttcgatttagcaagcagcatgctgatggcctgtggggagtagtggatgtatctgttgacagcttattggacaatccagatccatccttaactaaatgcaggaaacgcccatctggttgtctgttgcgagatatgcctaataaccgctccaaggtgacatgggtggagcatttggagtatgataatgttggagtgcacaggatttttcgttctataataagcagtggaatggcatttggagctcaacgttgggttgcaactctgcagcgccaatgtcaaaggattgcctttctcatgtcaacaaacggtcctacaggagatcttgcagctgttccaacacccagcggacgccgaagccttatgaaacttgcagaacgtatgacaaataagttttgtagtggagtgagtgcatcgagtaggcatacatggactaagctatctcagggaactggcgacgatgatgtccgggtgatgtcaagaaagaacgtggacgatcccggagagcctcccggagtagttctgagtgcagcaacatctctctggcttccagtttctccaaaccgcttatttgacttcttaagggaccagagttttagaaacgagtgggatatactgtccaatggaagcccaatagaagaagtaactcacatatccaacggaaaggatcgtggcaacagggtttctgttcttagtgccaaaaactctagtcagagcaacacgttaatcttgcaagagagctgtgcagacacgtacggatcgatggtggtttatgctccagtggaaatctcagcaattcatcaagttatgaacggcaatgactcaattaatgtcgctctccttccttcgggttttgtcattcttccagagggaccacctgagagccgatcagtaattgacaatcgacaggtcgaaggatcgatcctgaccattgcatttcagatacttgttaacgatctcccatcggcaaagctgacgctggagtctgttgagactgtcaacaatctcatttcatgcactgcacagagaatcaaagctgctctacataaagtcgaggatgtttgatgttcagagatcggtcgcaagctaacttaaatatgtcttcaattatttttttttaccaaaacaataaatattatttatgagtgttgaacaacaccattctcgagttttgggattgtatattatcagtttgaaagtgtgagtgcaatttgataaccgactatagggatggaaggaaaactgcatcgaaatccacacgaagcaatgaaacctgcaccatttttttttatggttggcagacctgtaaatctccaagcatgcaattggaattaatattcctgcttgcccgctgtaactctctttgttttgatatagcagaaacatattacagtagcaaaaaaaaaa

SEQ ID NO: 649 - DNA, 3284 bp, Pinus radiata
ctgtgcacccgctacgctcttcctctgcaactcctcctttccccttatcagatgttttcataattttctgcactgcaagtcttttagactcagactcacgtccgggcttgtaaaaatcgatttgggtttgactgccacaagttttcagattcgagagagggggagacagagcgagaaggaagagttggcaacagtcttttgacttaccttccttctccctctttctctctagacgtgaagagagaccttcttccaaaatttgtcttttaccgcatcatttcaacgaacagttcgctcggagacaacagtggaagagatttttccaggtgtacgacaggcaaaaaaaatatcggggccttgactagcggtggtagtgataaatctgtgcgggcttcagaatctagagagtgtgcgggcttcagaatctagagtggcaagaagcagaagcaagaagatatactataaattagatgaattgaatcctggcatcaagattgttgtggaagaaaatgggaaaaggatagcactaagaaatattggggtggggaaggggagattgaaacatccatcgtatgtggaggaggagctgtagcagccagcaaagatgccggaaggcttaatggttcatgcaaggcatctgccctctttaatagcaaaaccctccttcacttcttctggtctctctcttgcgccgccgagacttgttgaagaacgtcagaacagccaaacggcggaaacagatcttgaaaaaatgagagaagaggaatttgagagtaaatccggaagcgaaaacatcgagggagcatctggagaagagcaagatgtggatccacggtcacgaaaaaaacgataccatcggcatacccagcatcagattcaagagttggagatgttctttcgagagtgtccgcatcctgatgataaacagaggcaggaactcagtcggcgactttgcctcgagccacgccaaattaaattctggttccagaacaaacgtactcaaatgaaggctcaccatgaacggcaggataatattatgctaaaatcagagaatgagaagcttcgtctggataacatgaggtaccgagatgctttgagcagcataacatgtcccaactgtggaggtccggccacattgggagagatttcatttgatgagcagcagttacgtatcgagaacgccaagctcagagaagaggtcgaccgcatttcgggcattgctgcaaaatacgtggggaagcctctgccatctccagtaacacgtcttaatacactttcttcatcgacattagatctgggcagcggaggagggtcatcgtgcctgggagattttcatggaacagctggcggggatatcgttagcaggcacgttgtgttggcagactccgagaagccaatggtggtagaggtagctgtggcagctatggaggagttagtccaaatggcacaagtgtgcgaccctctttggactacccgttttgaggatggatgtgaaattctgtgccaggaggagtacactcgaatgtttcctcgtggcaacttaggttcgacttctagatcgccttatggagtgaagacacaagaagcgtctcgtgatactgcccttgtgatcatgagctcaatcaatctggtcgagacaatgatggatgtgaaccaatggtcaagtatgttttcgtgcatcgtatctcgtgcgtccacactggaaattttttcaacaggagtggcaggaaacttcaatggcgccttgcaagtgatgtatgcagaattccaagtaccgtctccactggtgcctactagagaaaattacttcgtgagatattgtaaacaacattcagatggaatatgggcggtggtggacgtctctcttgacacgttgcgtgggaacccgcaaccccatcccaactgccctccttcgactttaagatgccgaagacgaccgtccggttgccttatccaggagatgcccaatggctattccaaggttacgtgggttgaacatgttgaagtggacgagagggctgtgcaccgtatttatgataagttggtaagcagcggtatggcgttcggcgcgaaacggtggctatcaactctggaaaggcagtgtgaacgtttggccagtatgctagcttgcaatatacctgcaagagaccttggagtcatatcgaatccggaagggagaagaagcatgctcaagttagcggagcgcatgacgaatagtttctgcgctggtgtgagtgcttctaatgcacacacttggacaactctttctggtagcggtgctgaagatgttcgtgttatgactcgcaagagcgtagatgacccaggcaggcctccaggcattgtcttaagcgcagcaacctccttctggcttcctgcacctcctatgcgagtctttcaattcctgcgtgatgaaaacttgaggaacgagtgggacattctatccaatggtggtttagtccaagaaatggcgcatatcgccaacggtcaagatcctggaaattgtgtctctcttttgcgtgtcaacaacttgaattcgaatcagggtaacatgcttattctccaggagagctgcactgatgtatgtggctcttacgttatttacgctcccgttgatatagtggccatgaatgtcgttctcaacggtggtgatcccaactacgtggctcttttaccatcgggttttgctattttgcctgatggcacacagtcgagtttgagtttgggtagcaatgtcattaatgacaaaatctccagtggctcgttgttgactgtggctttccagattttagtcgactctgtgccaacagcaaagctatctttagggtcggttgcaactgtcaacagcctcatatcctgtacagttgaccgaattaagacggctctgaactgtgaaaacgcttgattgaacaatgcgcctcttgtttctcgtttcgtttcgtttcgtttcgtttcgttttcgtgtgtgtgaaatgtctaaacgctgccttttgcttggcatttcacccacaaaaataaactgaaactggatttcctactgcattcataaatggaaagggaagtcaagagcgcaccacagacaccccttgccttgtggtaaagtaacaaggtagtttccaactcctgcttaacctcaacgcaaggatagtggttcgggtattgacttccctgcgttaattttccaatggactggtacatatatgtatgtatgcttgacctaacccaacactttttaatacgaggctacctactatattagtgcaattcttcattgaataaaaaaaaaa

SEQ ID NO: 650 - DNA, 3193 bp, Pinus radiata
attttgtcaagttccaaattattggctataccaaaaaagaagaaaaaaagaaaactagccatcttcaagcaaaacttgtgcaacaaattccttctttattaggaagcatctattacgggcaagcttcaacagctaccggttgtggcagttcattgcatgtacgggcaaagactcaaagctggggttctgttgtgacaagtactgcaacttcaactttgcttgttgctccaagcatacaaacaggcagtttggtcaaatagcagagaaaagtaatggctacctattttccgggttccaatattcaagctgataatatgcaaaccctctacttaatgaacccaggttatgcaggttatacagatgcaacaacttcagggaacatggttctcctaaaccactcagtaggaaatacactgcctgcaaataatatggctggtgggcaaccttcacagcattttattggaatcccacttccaactgcttcactttcacaacaacgctcttctctcggagtgatgggaaattctcctacagctcagcaggacattaacacaaatttacttgcatcacgaattgggggccatccttacaatgtttggcgaaatggaggaaatgagttgacatttatgcaaacaacagatgctgctggcagtagtcagaccctgtctggacacttgaataattctggaagtatgggccatcagccagttgctgagatatcccaattggggttgagacgagcacccatgtcttccattcaagaacagcaatcgggaatgcttccaagtggactaagtttgcagttagagcattcacatggctccactggacatgggcagggtctttcactcagcctctccccgcaacagccatcaactgttcagctgccctcttttcagaaccaacccactgactcagacataaactgcccaggaatatctgcaacttcagaagagaacatcagcagaactgatagaagtacgagcaaatgggctggaagtctaagtgcctttcgagcatcctcaagagatgggatgctaggatctgggttttcaaacaccgggttttcaggcaatttacttgcccctggagccaacaaacagatgcatcttgattccagttctactggagcaccagggctctcaaatgttctgataggctccaagtatcttaaagcagcacagcaattgctcgacgaagttgtcaatgtaggtaagggcatcaagcctgattcagccaaacatcagaaatcacaatcatggattggaacaacagctaataaagagaatagtggagctgaaggtggtgggaaggatggagcagctgctgcccctacatggcgttcaacttcagcccaagaaacaaatgaccgtccctctgagctgtcaccagcagaaagacaagagcttcagatgaaaaaagcaaagcttgtggccatgttggatgaggttgatcaaagatacagacagtactaccatcagatgcagattgtagtttcatcatttgaagctgccgctgggtatggagctgccaagacatacacttctcttgctctgcaaacaatatcgaggcacttccgatgtttgagagatgcaatcagtggacaaattcggctgaccagcaaaagtttgggtgaagaagattcaacagtgagtggaaaaggtgaaacatctcgtctccgttttgtggaccagcaattgcgacaacaacgggctctccaacaattaggcatgattcagcagcatgcttggaggccacagagaggacttcccgagcgatctgtttctgtcttacgggcttggctatttgaacattttcttcatccgtatccaaaagatgcagacaaacatatgctcgcgagacagactgggcttaccagaaatcaggtctcaaattggtttataaatgcacgtgtacgcctctggaagcctatggtggaagagatgtatgtggaggaaacaaaggaggcagaagtagaccatggatcaaatgataaaacaggtaaggagagtggcgagaaaaaagaagatgcattgtcaaaggaaggagctgcaggcaataatgggaatatacatgagcagcaaagtgggaaaatctcaaaactcgacaatattgcacaggatggaggtgctgatgaaaaacctgctggtgtgcccaaatctgaaaatgcttctaatttgataaatgttagaaaccaatcatttggcatgggcggaacatcagatagccaaattttcaacgaaactgaaaatgaagggattagacaaggacaactaaagaaagctaggaatggaactcaagagtgtacttctcttctgtccccaaacatgagcattgaagttgatttaaaatcagatgaaacaaacagtggagaatttggtgaccacaagttcagtgatgaaaggcagaacactgaagattacagctttgtccataatgccatggttcatccagataatagtggaagttttgggtcatatcagataggagatttgagtagatatggccatgaatcatttactccaagattttctggaagtggtggtgtgtcattgactttgggactgcaacgcacagatggtttatcattacagggagctcagcagaattatatgtccacccaaagtctagcactagggaggagacatgatcttggaggtaactcgagtgattattgcaacattgaaacttcagcacctcatcctgcaaacctctatgagaatatcaacatccaaccccgaaagtgctttgcaactcaactaatgcattgattttgttgcctaagccagagctgatatgctgtatagaggtgtagtatgtctgcttagcatgattattctgtgcactcatttcatttccttttgtatctttttgagttgtaactttcataatatttacaacattgtctgttaccagacttctgtataagtcataaattagggaaaccatgttaatacaggccttttttctccttctccaaggagaaaataatctgaggtctagtgtaaaatgcacgtgaaaatactggttgcattgttgcaacctatgcaagttcacataaagatgtctttcgtcataagatttgtaaattatttcattctcaagggaacgctcgtcaggatgataccgaatgtaaaagtatttaatatgcaagttgcattgtatatctcgctgtagctaaaaaaaaaaaaaa

SEQ ID NO: 651 - DNA, 3010 bp, Pinus radiata
tttcgtcaaatgctcactattgtatacgcgtattttattattgctcccactgcaccacaacacctcagcataggaaaccacatttgctctttctcccctgtttaaaaacaaaacgctccacatgccccaactgacagagagacctctggctcgcccaccattttatttacacagcagatctccacttctacttccacttccacatccagatcgaaactctgctaacattcctgatgactctattctgctattggtgaggaatgactgtgactgtggtgacagcgcaatcttttggaatggaagcgggcaagtacgttcggtacactgcagagcaggtggaagctctggaacgcctttacaatgactgcccaaagcccagctctctgcgtcgccagcagctcatcagagaatgcccaatcctttcacacatcgagccgaagcaaatcaaagtctggttccagaatcgaagatgtagagagaaacagcgcaaggaggcaagtcgtctccagactgtcaacagaaagctcacagccatgaataagcttcttatggaggagaacgatcgccttcagaagcaagtctcgcagttggtttacgagaatggctatttcagacagcagatacagactgtttctattaccaccacagatactagctgtgagtctgttgttactagcggtccgcatccgcaccacctcacaccccagcatcccccaagggatgctagccccgctggattcctgtctattgcagaggagactttgacgcagtttctttcaaaggctacagagactgctgttgattggatccagatgcccgggatgaagcctggtccggattctataggcattgtgactatttctaacagttgcactggagttgctgcacgagcttgtggctttgcaggtctcgaaccttcaaaggtcgcagatattcttaaagatcgtcccgcttggcttcatgattgtcggcgcctggatgttttgactgcatttcctacgggaaaaggaggggcagtcgagcttctatacacgcaaatgtacgctccaactacattagcccctgctcgggacttattgactctgagatacacatcattgttggaagatggcagccttgtggtttgtgaaaggtcattgactggtactcagagtggtccaaacatgccgcctgtccagcactttgtaagagcacagatgcttcccagtggttatttgatacgtccctgtgaaggtggaggctgtataattcatattgttgatcatatggacttggagccttggagtgttcctgaagttatacgcccactttatgaatcatctgctgtactggcccaaaaaatgaccattacggcattgagacatttgcgtcaagtagctcaagaggtctcaggtgaagtggttcttggttggggtaggcagccagctgctctgcgggcatttagccagagactgtgcaggggtttcaatgatgctgtgaatggctttgcagatgatggttggtctttgttgggtagtgatggggtggaggacgtgatcattgccataaattcatctccaagcaaatttttaagttctcaaattgcttcttctgatggcctttcagctcttaatgggggcattatgtgtgctaaggcatctatgctattacagaatgtgcctccagcactacttgtccgcttcttgcgggaacatcgctcagagtgggctgattgtaacattgatgcttattcttcagctaccatgaaagcaaatgcttacaatgttccaggttcactgggaggcattacagggagtcaagttatccttccactggcacatactgtggaacatgaagagttcttggaagtcatcaaactcgagggacatggtctcacacacgaagaagctttgctgtctaaggatatttttctgttacagctctgtagcggaatagatgaacatgcagctggattctgttctcaacttgtgtttgcaccaattgatgcatcttttgctgatgatgctcctctgctgccctctggtttccgagtaattcctctagaatctggatcagatgtttctcctccaaaccgaactttggatctagcttctgctcttgagattggatctgctggaactcgagcaagtggtgattgtggtgatagcccatgcaatctgagatctgtattgactattgctttccaattcacttatcagaacaatgtgcgagacagtgtagcagccatgactcgccagtatgtccgtaatgttatagcatctgttcagagggttgccattgcactagctccttctcaacagagtcctcatataggaccaagactacctcctggtaccccagaagcacttacgcttactcgttggatttttcagagctacaggatgcatctaggactagagcttattggagataattctgaacccaatgagtctgtgttgaaactcctgtggcaccattcagatggaatcatgtgttgttcctggaagccattgccagttttcacatttgcaaatcaggcagggcttgatatgctggagacaaccttggttgctctgcaagatatatcattggaaaaaatacttgatgagaatggtcgcaagaggctgtgctcagattttacgcaaattatgcagcagggctatgcttatctgccctctggaatatgcatttctagtatgggcaggcctgtttcatatgatcgagctatagcgtggaaggtacttaatgatgaagacgttattcattgcatagctttcatgttcttgaattggtcttttgtgtgaccagttttgggatgtaaattcaatagaaaagtcatgttgggatcttatcatccaaacaaatgggtttactgccttttgaagcgtttgtaactttaagttttatgccagctggacagaacaacccttctaaaagattttaaaggctctaatggatcatgtaagcagcatcttgtggatgcattttctttaattgaaggacagacgcttagttaaaaaaaaaaaaaaaa

SEQ ID NO: 652 - DNA, 2938 bp, Pinus radiata
gtgggaggagggcggctctctttgtagagggagccgaggtcgctggctgcaggtaatgccggctattttcttctgccatttttttatttgaatttgggcaatgttcccgagagctgagttttggttgggcttaatttttgtgtatcaggggttctaagaacaggtattataaggtgaatttggggaaatttgatggcagtgatggcaaacaataaggacgcgaaaaattcaatggacacgagcaagtatgttcgttatacgtctgagcaggtcgaagcgctggagcgtgtttacagcgagtgtccgaagccgagctcgcttcggcggcagcagcttattagagagtgccctatactttccaatattgagcccaagcaaatcaaagtttggtttcagaatcgaaggtgccgagagaagcagaggaaggaagcctcgaggcttcagactgttaacaggaagctgacggcaatgaacaagttgctcatggaggagaacgatcgccttcagaagcaagtttcacagttggtgtatgagaatggttacatgagacagcagctacagaatgcatctgtggccgccacagacacaagctgtgagtctgtggtgactagtggtcagcaccaacataatccaacacctcagcatcccccaagagatgctagccccgctggactcctgtctatagcagaggagaccttgacagagttcctttcaaaggctaaaggagctgctgtcgattgggtccagatgcctgggatgaagcctggtccggattcgattggtattgtagctatttcaaatacttgtaatggagtagctgcacgtgcttgcggtcttgtaggattagatcctacaaaggttgcagagatccttaaagatcgcccatcttggcttcgtgattgtcgttgccttgatgtcttgactgcgtttcctactggaaatggtggaacaatcgagcttttatacatgcagacatatgcggccactactttagcttctgctagagacttctggactctgagatacacaacagtgttggaagatggtagtcttgtggtttgtgaaaggtccttgagtggtactcagggtggtccaagcataccgccagtgcagcattttgtgagagcagaaatgcttcccagtggatatttgatacaaccttgcgaaggtggtggttccataatccgaattgttgatcacatggatctagagccatggagtgtgcctgaggttttacgaccactatatgaatcgtccactgtacttgcccagaaaatgacaattgcagcattgcgtcgattacgccaaattgcacaggaagccacaggtgaagtagtttttggttggggaagacagccagctgttctgcgaacatttagccagaggttaagcaggggtttcaacgaggccgtgaatggatttacagatgatgggtggtcattaatgggcagtgatggagtggaggatgtcactattgctatcaattcatctccaaacaaacattttgcctcccaagttaatgcttctaatgggctaacaactcttggtggtggcatcctttgtgcaaaggcatccatgctcttacagaatgtgcctccagcattacttgtacgtttcttgcgcgagcaccgatcagagtgggcagattccaacattgatgcctattctgcagctgctttaaaatcaagtccttatagtgttccaggatcaagagcagggggcttttcagggagtcaagtcatccttcccttagcacatactgtggaacatgaggagttcttagaggtcattaagctggaaggtcatggccttactcaggaggaagctgtcctgtccagagatatgtttctcttacagctttgcagcggaattgatgaaaatgcagctggagcatgtgctgaacttgtttttgcaccaattgatgaatcctttgctgatgatgctcctttgcttccttctgggttcagggttattcctttggaatcaagaacagatggatctgggggtcccaaccgcacattggacttggcttctgctctcgaggttggatcaactggaactagaacgtctggtgactctggcaccaactcgaatctgagatctgtgttgactattgcattccagtttacttacgagagccacttgcgagaaaatgtggcagctatggctcgtcaatatgtgcgtagtgttgtagcatctgtccagagggttgccatggcaatagccccttctcgactgaattcacatgttggcccaaggccacctcctgggactccagaagcacttactcttgcccgttggatttgtcagagctacagactccacataggggtggacctgtttcgagctgattgtgaagccagtgagtctgtactgaaactactttggcaccattcagatgcaatcatgtgctgttctgtgaagtcgttgcctgtttttacatttgcaaatcaagcagggttggacatgctggaaacgacattggttgcattgcaagatatatctttggacaaaattctggacgaaaatggtcgcaaaagttttttcacagattatggtcaaattattcaacagggttatgcttatctacctgctgggatatgtctctcaagtatgggcaggcctgcttcatatgaccgggcaatagcttggaaggttctgaatgacgaagacagtacccactgcatcgttttcatgtttatgaattggtcctttatgtgaccattctgttcatgcagaaggagtatgtgaatactcatttttgtggaaattaagtagtcggctaaattatcacatattttattaagcttgtttggctaatactctcagaactcatatacctattagacaatttggatggattttgtaagcagcactttcttgttgcattttgttatatttaaagattctcagtgagacattgtggtcaaaaaaaaaa

SEQ ID NO: 653 - DNA, 2933 bp, Pinus radiata
gatgatttatgccaactggaagctatactgtgctctctcagctaattttacgctagcttaaaggccttgatcaccattgcagagcttgcttttaacctctgatgtgggaggagggcggctctctttgtagagggagccgaggtcgctggctgcaggggttctaagaacaggtattataaggtgaatttggggaaatttgatggcagtgatggcaaacaataaggacgcgaaaaattcaatggacacgagcaagtatgttcgttatacgtctgagcaggtcgaagcgctggagcgtgtttacagcgagtgtccgaagccgagctcgcttcggcggcagcagcttattagagagtgccctatactttccaatattgagcccaagcaaatcaaagtttggtttcagaatcgaaggtgccgagagaagcagaggaaggaagcctcgaggcttcagactgttaacaggaagctgacggcaatgaacaagttgctcatggaggagaacgatcgccttcagaagcaagtttcacagttggtgtatgagaatggttacatgagacagcagctacagaatgcatctgtggccgccacagacacaagctgtgagtctgtggtgactagtggtcagcaccaacataatccaacacctcagcatcccccaagagatgctagccccgctggactcctgtctatagcagaggagaccttgacagagttcctttcaaaggctaaaggagctgctgtcgattgggtccagatgcctgggatgaagcctggtccggattcgattggtattgtagctatttcaaatacttgtaatggagtagctgcacgtgcttgcggtcttgtaggattagatcctacaaaggttgcagagatccttaaagatcgcccatcttggcttcgtgattgtcgttgccttgatgtcttgactgcgtttcctactggaaatggtggaacaatcgagcttttatacatgcagacatatgcggccactactttagcttctgctagagacttctggactctgagatacacaacagtgttggaagatggtagtcttgtggtttgtgaaaggtccttgagtggtactcagggtggtccaagcataccgccagtgcagcattttgtgagagcagaaatgcttcccagtggatatttgatacaaccttgcgaaggtggtggttccataatccgaattgttgatcacatggatctagagccatggagtgtgcctgaggttttacgaccactatatgaatcgtccactgtacttgcccagaaaatgacaattgcagcattgcgtcgattacgccaaattgcacaggaagccacaggtgaagtagtttttggttggggaagacagccagctgttctgcgaacatttagccagaggttaagcaggggtttcaacgaggccgtgaatggatttacagatgatgggtggtcattaatgggcagtgatggagtggaggatgtcactattgctatcaattcatctccaaacaaacattttgcctcccaagttaatgcttctaatgggctaacaactcttggtggtggcatcctttgtgcaaaggcatccatgctcttacagaatgtgcctccagcattacttgtacgtttcttgcgcgagcaccgatcagagtgggcagattccaacattgatgcctattctgcagctgctttaaaatcaagtccttatagtgttccaggatcaagagcagggggcttttcagggagtcaagtcatccttcccttagcacatactgtggaacatgaggagttcttagaggtcattaagctggaaggtcatggccttactcaggaggaagctgtcctgtccagagatatgtttctcttacagctttgcagcggaattgatgaaaatgcagctggagcatgtgctgaacttgtttttgcaccaattgatgaatcctttgctgatgatgctcctttgcttccttctgggttcagggttattcctttggaatcaagaacagatggatctgggggtcccaaccgcacattggacttggcttctgctctcgaggttggatcaactggaactagaacgtctggtgactctggcaccaactcgaatctgagatctgtgttgactattgcattccagtttacttacgagagccacttgcgagaaaatgtggcagctatggctcgtcaatatgtgcgtagtgttgtagcatctgtccagagggttgccatggcaatagccccttctcgactgaattcacatgttggcccaaggccacctcctgggactccagaagcacttactcttgcccgttggatttgtcagagctacagactccacataggggtggacctgtttcgagctgattgtgaagccagtgagtctgtactgaaactactttggcaccattcagatgcaatcatgtgctgttctgtgaagtcgttgcctgtttttacatttgcaaatcaagcagggttggacatgctggaaacgacattggttgcattgcaagatatatctttggacaaaattctggacgaaaatggtcgcaaaagttttttcacagattatggtcaaattattcaacagggttatgcttatctacctgctgggatatgtctctcaagtatgggcaggcctgcttcatatgaccgggcaatagcttggaaggttctgaatgacgaagacagtacccactgcatcgttttcatgtttatgaattggtcctttatgtgaccattctgttcatgcagaagagtatgtgaatactcatttttgtggaaattaagtagtcggctaaattatcacatattttattaagcttgtttggctaatactctcagaactcatatacctattagacaatttggatggattttgtaagcagcactttcttgttgcattttgttatatttaaagattctcagtgagaaaaaaaaaa

SEQ ID NO: 654 - DNA, 3101 bp, Pinus radiata
aatctgaaaccccccttatacacatgcctcttccttcctcattatagcacgtcagtcggctcgttttcctctgagtttgggtttcacttttttgacaagcagccggaacccagttcgaatccccccggtcttggcgcccccaccgcccccgcatactgttgttattgctttagcattcttttaatgcccagcaccgcgtttattgcatttgcattgatgtccttaggctgtgtcgtggttaattattagtaatattgggctcagacagatgaagaagaagaattctgtttttgttcgttttcgatctgtgaggaagaagaatagttttgtctgaatggagcttgtcaatgctgggctgctccctcagctcttccagaggcttggaactattattattactgtgaattaaagagcagaagaagaagaagaagaagcgtttttatacacagagagttttaggggtagtgggatttagtggttggtcactcgggtaatggcagtgacgtctggcaaagagggaaagtcatcaagtatggaccaaggcaagtatgtgcgttacacagctgagcaggtggaggcactggagcgactctaccatgattgtcctaaacccagttctattcgtcgccagcagctcatacgagaatgccccatactgtccaacatagagcccaagcaaatcaaagtctggtttcaaaaccgcaggtgtagggagaagcagcgcaaggaagcttctcgtctccaggctgtgaacagaaagctttctgccatgaacaagctgttaatggaggagaatgaccgcttgcagaaacaagtctcgcagttggtctacgagaatggatatttcaggcagcagttgcagaatgcctccatagcaactacagacactagctgtgagtctgtggttacaagtgttaaacatcaacagcaaaatcacctgacgccccgggatccccccagggatgctagccctgctggactcctttctattgcagaggagactttaacagagtttctttcaaaggctaaaggaaatgctgttgagtggatccagatgcctgggatgaagcctggtccggatgctattggaattgtcactatttcacatgggtgtactggagtagctgcacgagcttgttctcttgttggtatagaccctacaaaggttgcagagattctcaaagatcgcacatcttggcttcgggattgccgaagtgtggatgttcttactgctttctcaactggaaatggaggaacaattgagcttttatacatgcagatgtatgcgccaactactttagcttctgcccgagatttctggactcttagatacacttctgtattggaagatggtagtcttgtggtttgcgagagatccttgagtggaactcagggaggtcccagcatgcccgcggtgcagcagtttgttagagcagaaatgcaacccagtggatatttgattcggccatgcgaaggtggaggttctctaattcatattgttgaccatatggatttggagccatggagtgttcctgaagtgctacgtccactgtatgaatcatccactgtacttgcccaaaaggttacaatgtcggccttacgccatttgcgtcaaatagcacaagaggtatcttctgatgtggtccttggctggggaagacaacccgctgcattacggacatttagccagagattgtgcaagggtttcaatgaggcagttaatggcttcacagatgatggatggtctttgatgggtaacgacggaatggaggatgtaactattctcgtcaattcatctccaagcaaactgttcggtcaacagtttgcttcttctgatgggcttcctgctcttggtgggggcatcctatgtgccaaggcttctatgctattacagaatgttcctccagcattgcttgttcgtttcttgcgagaacatcgatcagaatgggcagatagtaatattgatgcctattcagcagcctcttggaaggcaaatccttgtactgttccatcctcacgaattggaggttttggaggtggccaggtcatcctcccattagcccatactgtggaacatgaagagtttttggaggttatcaagttggagaatcatggcctgacacaggaagaagctttgctatcgagggatatgtttctgttgcagctttgtagtgggctcgatgaaaatgcagttggggcctgtgctgaacttgtctttgctccaattgatgcatcattagctgacagttctcctttgctcccttctggtttcagagtcattcctttagactctggaatggatggctccagtccaaaccgtacattggatcttgcttcttcccttgaaattggatcagcaggagctcgaacatctgttgattatggtggaaactctggcaacctcagatcagtattgacaattgctttccagttcacttttgagaaccatttacgggagaatgttgcatccatggctcgtcaatatgtgcgtggtgttgtagcatccgtgcagagggttgccatggccctagccccttctcgactgggttcacatcttgggccgaggctacctcctggcaccccagaagcacttacccttgcacgttgggtttgtcagagttacagattccatttgggggtagagcttcttagacctaattctgaggtcaatgaatctctgctgaaaacactttggcaccactctgatgccatcatgtgttgctccttgaagtcattgcctgttttcacctttgcgaatcaggcaggccttgatatgttagaaacaaccctggttgccttgcaagatatatcattagaaaagatacttgacgacaatggccgcaaaagcttttgctcagatattgctcaaattatgcaacagggatatgcttatctacctgctggagtgtgtgtttttagcatgggcaggcctgcttcctatgacagggctattgcttggaaggtcctcaatgatgaggaaaatccccattgcatagcattcatgtttatgaattggtcctttgtttgaccattatttttcattgtacaaagtataccaagtccttgaagttaacttattgaacaaaaaaaaaaaaaaaaaa

SEQ ID NO: 655 - DNA, 1919 bp, Pinus radiata
ctccgaagaagcgaatttagtgccaaaaaagactctgcgaggaggtaagtttggccgtttcttgagactgtttgatggccgtttcttgagactgtttgacgctttcaaagctaggactggcgcataaagagcaagtattcgagattttagcggctctttctcgcgtttagacggtgtttgaaagtttctggcgttcctcgagctttccgccagtgcctttcttgtgcgttatttggaggattgtgccactttagagaccagatttgacaaattcgtgtgactaagtcgtcctcgagataaattttacgtaattcagaccttctgtcggttattcgagggggatttcatcggattgacccgaaaattgtgtaaagtcaaattgagaagggctctgttttaggcacaggttttccttttctgtcttcctgtgttttgaagcgatgttgctggtgctgttccgtaatgttcaacgataatatgtcctgctcctctgttggcgattcctgaggcttgaagtcgagctctcgggctgtgccatggctcattcggcgaaacaaaacaatgatggaacgccggtcacagtagagtctcaccgatctgtgccggctccgtttctcattaagacatatcagctggtggatgattcgaacacggatgacataatttcatggaatgaagcgggtacaacgtttattgtttggcgccctgcagaattcgccagagatttattgccgaattacttcaagcacaacaatttctcaagttttgttcgccaactaaatacatatggctttcggaagattgtaccagacagatgggagttctcaaatgagttttttcgcaagggggaaaagcagctactttctgaaatacacagaagaaaaggtctaatacaacctcctccaccacctgagaacagatccatttcaccgtctaactctggtgatgagcaaacgtggtcttccacctcctctcctaactcttccacgggggtggatgcccttagccataagaatgcaattgaagaaaatgagaaactgagaaaggaaaatctgttattggtatctgagctgacacaaatgaagaagctccacagccagcttttgctcttcttatccaggcatgtaaatatcacatcagcagatcatgttgccaattttctgtcccaaaatgttggtccttctgaagggttgtcaatgctggcacggttaaaagattatttggaacaatatggaggagaggagatttcaagagattttcctggtagttccttgagctcgggaatttctgtggcaaatgacgacccttttgtttcaagctcggcaaaagaaagcatggcttcaaagaggccaccttttgtagatggtgcatgtagagaagtaggtaggaaaagttacatttctgtaaagatagaagatgatgacgagaaaggaaaccccaagctgtttggggtacctctgcttcctagcaaaagaccccttccaggatctaacgataatgggcaacctgaaccggtgattcgcaaaattggaaggtgtgccaactgatttcactcccacaagggagggtttatctttgttttgaactacgctatctctttttcctgtagccaaaatggctgcagctgaagaaaattacatctccggtaaaatgcctgccgtaaggacttaaacctatcgttttatatttatatgctgatctttactatatgttaacggtcaatctatgttgatcttatatctatatatatatgtttctggccgatttttgtcaaagattccagggcatgaatgcttcttatgagagcattgcgacttcttgtaacagctgtaaattttttgaattctgaatcacctcatgaaacagattgtggtgaaattaagctatagatgtgaaacaccatttcatttaaaaaaaaa

SEQ ID NO: 656 - DNA, 1301 bp, Pinus radiata
gcagccttggaagtatctcttttggtcttaggtaatggaattgtaaccttcccgaacaacggcggtagaggtctggagattcgcatgtacgaagataaaatggcgcaatctggggaacagcctaatgaagccacggttcctcgccctgctgattctcatagatctataccaacgccgtttctcatgaaaacctaccggcttgtcgacgatccgagcttgaacgacattatttcatggaacgaagacggcactacgttcatcgtttggcggcctgcggaattcgcccgtgatttgctgccgaattactttaaacacaacaatttctccagttttgtccggcagctgaatacatacggatttcgaaagattgtgccagacagatgggagttcgccaacgagttttttcgcagaggagaaaagaaattgctctgcgagattcatagaagaaagaattcacaagccaatggtgctacggctaataggcctgcatctccgtccattacaggcgaggatcagcaaggttgttcttccacattgctccctctgtcctctcaggctgaagccggtgtacttttggacgaaaatgagaggctgaaacagcagaatttgttcttgatgtcagaggtagcgcagataaaaggtttgtgcagcgatattctggcatttatgtctaagcatgcaaatatatccgcagaaagtttaagaaaatcattcgacctacacaacgttccagatcgttttcagcaaggagagccgatggacggatccccggcccagtctaaggattcatgtcaaaggactcagctgtgctcatccgttcatcattctgaaaacgagacagcaaacggctgcggaaattccagagaaatggacgacagtaaatgcgttgattctgtcaaggcagaagataaagataactccggcaaccccaaacttttcggcgtgcctttgcttagcaagaaaaggtcgcgcccttgctctccagataatgacgagaaacccgaagggaacggaaatcctttttgcgtcggaaacgatgcagctttaaaatgcgtgaaagcagaaccaggactggaaatggatctgagacagaaacaggctccatggctgaagtttctctctgttcgtaacgagaaagtctgcaattaaggtttgatcacaagatcgacgtggattttgtctcatagaatcatcgtccggttgtaagtttcctatgtaatctcatccataaaaatgtttattgcagtattccccatacattaataaattgtctgttaattattagttcttcaaaaaaaaaa

SEQ ID NO: 657 - DNA, 1733 bp, Pinus radiata
gcagtcacgggtttgcattgagattttcttctttcttgttgggttttaggcattattatctttttttttttaaatctcacggggctctttcgctgctgcagcaagagcatctctcgaaaccaacccagacagacagaaattcttgcagacattcatgctagaaaagacccttcttatgatcatccgctcgcccgccttctctacctttttcttcatcaccaggcactgtcgggccggagctctaactccatattcattctcatccctcggctccatggacttttcgcctctttcttctaccagcagagccctggtttagcagaaaatcctctgccaaaatcctaaaggcgccctttttaataacaatttcgcgcattgaacgctgccatgactctgttgctggatagctgtgaaggaatgctactgtccgtggagtctcacaaatctgtgccggcgccttttttgacaaagacttatcagctggtggacgatcccgccaccgatcacattgtttcgtggggggaagatgacacaacttttgtggtgtggcgaccgcctgagttcgctagagacctgctgcccaattacttcaagcataacaatttctccagctttgtcaggcagctcaacacctatggattcagaaagatcgtcccggaccgctgggaattcgccaacgaattcttcagaaagggcgagaagcatttgctgtgtgagattcacaggcgaaagacttcatcacaggccgtgccgaactctgctcatggaatgccaatgagcagctccatttctcccacaacttcagacgatcaagattggtcgcctctttccactccactctcttcgccacggggcgtagcagcagcggctgcggtggctgcggcttctgtcggtggcggaggcatgggaggatcgttaatggtggggtgttccggcggcggagcaggaggaggcgcaacggcagcaatgcacgctagcgccgctgctgcggccgccgcggtgtcggctctctcagacgataacgacagactgaggcgcaacaattcgatgctgttatcagagctcacacatatgcgaaagctctataacgacattattttcttcgttcagcaccacgtcagaattcccccgccgcctcctcaccagtctggatcttcttcctcttcctccgccatgaacatgaacagactcaagtatcaccaccaacccaccgccaaccctaatgcagtcccgctgctcctcgaagccccaacagtgccctcaacgccccgaatcgcagacgcaagggatcacagaatcatgaatcccgccaccagagaagtcgtggaaatctcgtcctcttctcctcgatctcagcagctcttcggcctcgccactgcaagggcctcatctatatctttcgtggacacgaaactcaaagaaatggcggccgccgcaacttcgagcccgtccacgagctcagtgacagtagcagatcaagaaggtataaaaagccctccaaagctcttcggcgttccactccacgggaagaaacgcttgcatccccagtgggacgttgtcgatcaagcagacacacctaacagtcgaaatataatagtgacaccccccaaagttctaaagacagacttagctctcaacctagcgccttcctccgcttgaaattcagccaactgtattttattttagtggaattgcagctaattttgacagaatttagtttttcaaaaaaaaaa

SEQ ID NO: 658 - DNA, 2049 bp, Pinus radiata
gcattgcagaaaaaaaacacgactgagccggcgccccacagaaagggaaaaggaaacgaagggattctcccggtcacgagatcgattcccccttctttttgtcgccttgtttgctctctggcgtcttcagatctgtttcggcctttggaagagcttctgaatgatgtaaattggaggtcctgttgccggcttagtccatgtattgatttgggttttttcacttttgggttttttcgatttctctggggttttagggtatggatggatctcagaacagcggcggcaatgcggtgcctccgtttctcaccaagacgtatgacatggtggacgacagctccacggactcgatagtttcatggagccccgggaataacagtttcattgtgtggaatccgccggaattcgcacgagacttgttacccaagtactttaagcacaacaatttctccagctttgtcaggcagctcaatacatatggcttcaggaaagttgatccagatcaatgggaattcgcaaatgaagattttctccggggacaaaggaatttgttgaaaaatattcacagacgcaagcctatgcacagtcattctcagaatccccaacaaggcgtatgtaatgatgctataaaatatgaactggaggaggaaattcagaggctcaagagggataagggtctgctcatgatggagcttgttagaattaggcagcaacatcaaggtaccgagatgcatatgcagaccttggaggagcgtttgcaagccatggaacaccgccaacagcaaatgatggcatttctggccaaagctgtacagaagcctggatttgtggcacagcttgtgcaacagagtgaaaacaataagcttcttgaagcagctaataagaagagaagattacccaagcaagagaactgttcagaggctggggaaactgagttgacagacagtcagattgtgaagtatcaacctgcttcaggtgatgaatgtagtgcagttccgttgaaggttttaaacacggacccatttaatagaatggaatcatctttaaatactttggaaacctttttccaggatgtgggtcaggcatgtggtgaagtgatggatagtggaaattcatctcaagcaggtcttacagagatgcacggaacatgcttttcaagtatatgtatttcaccagcaatttcagatattcaaggatcatgttcattatccgagatgcattcttcatcccatccttctccacagttggcagaatcaattactagtgaaattccttgtcagatgagtttgggactttctctttctcaatgtgaaacttccaagggtggggagactcctaaccagagtggcaaagatgagagagaggcttacatgggatccaagaccagtggcatagatgtcaactcagaaccagtagcgatggagatgggagacaatgagagagctgcagggaaagtcaccgccagtgggaaggtaacttctggagttaatgatttattttgggaacagtttctaacagagactccgggctcagcaacagatacacaagaagctgagtcaaaaattcaggagactagaactaaggatcaagatgaaaggttgcctgagaatgggaagtgttggagcaacaagcagacattggatcaacttacagaacagatggggcagctggcatcagggacgcaaacttgaaataagattatagaggctgctagtaggtgcatatcactgtcagttctgctaaaatttctggttagcaatggtcactgtttatgtgtcctaatgaattgctccaaatagattctctataagctgctgtcagtatctctgctacattgcaaatgtaaaagggtttaaccagtgtttttgtaattcattgtaacatttgcacattcactgagattgagagagcatatggacatgaatactggaaatacaatattctaagagtgatctgtccttcctcatgtggtgacaacactgttgtagcatagattttacagtattttgtattattatttttcaaagttcaaagttttttagaaaaaaaaaa

SEQ ID NO: 659 - DNA, 3160 bp, Pinus radiata
ggtcaaccccgaggaatgccacacactaaactctacagaggctcccatcctgacatgagtgtgttcatcttcgacctttctacctgccctgcaccttcttgctcctttcctctttgggcaaaaattaaggaaaaaaaaatggtccggactctagaaatatctcgacacagcgtgtgtgagggcgaataaaaccccagtaagggatcgactttcgtcggcgtttgtcgatataatttggacagttcatgtcgactacacaattcattcattcattcaaaggttttgctgaggtttatccaagtgggtaatggtgatacccaaccgtatcgaactccgaagtcaatcaaaaaacttggtatctccattactgtttcttttcttgatccatcgaccgtttctgagttgggctggcctgagtttctggggcaaaaattacccgctgagttcagaaaaagaagacaaggcaccttccaaaatttacccgccatggcgacctctgcagaaggttcaagctcttcaccccttggcttcgtagaggaaagttcgcaacaattgccttctgtcgcgccccagcccatggaagggttgcagagcagcgccattcctccgtttctcactaagacatatgacatggtggaggatccttcgacggacccagtggtctcctggagcagcgcgggcaacagttttattgtgtgggatccccccgagttctctcaaaatttgctgccccggtgtttcaagcacaacaatttctctagcttcgttcgccagcttaatacttatggatttcggaaggttgatccagatcgttgggaatttgcaaatgaaggtttcttgcgtgggcagaagcatttattgaagaacatccatcgtcgcaagccagttcagattcagcagttgtcacctcctcttgggtcctgtgttgaagttggaaaatttgggctagaaggtgaggtggagagattaaagcgtgataagaatgtgttaatgcttgagctggttagattgcggcagcagcagcacaatactgaatgcgaaatgcaaacaatgaatcaacgtttgcaggctacagagcagagacaccaacagatgatgtcttttctagctaaagctatgcagaatcccagcttcttagcgcagctagttcaacagaaggaaaaaaggcagctggctgcagccagaaagagaaaacgtttgccaaagcagcagcaggacccacaaggggacatggggccatctaatgagggacaaatcattaaataccggcccaatcccaatgatgatactcagccatcattaattgagacatttgagttaggatcaggcgcaaaactggaaccaccttccagtccttttcgagcattttttagtggaaatccaggagagaacctacaggagagcaacacattagcaggagaattgatggctgtaaagggagttgaacaaatgatacaggaaggtgttccaaatccagttgccttagaaatccccaacatgtcacatttgcagcctccctccgtcgtagcacttgccaaaggtaagcatgtcgagagctctcaacctgaggatgatctgcaaggtgaggaatatcttgtttcctttgggcagactgcgtgctcggaagaagaaagtacagatctgatgggcttagaactggatctgcctggagatgttgatttctgtataaacaaagaggaacccaaatcagtcctgggctgtgagatgagtaatgatccgttttgggatcagctttttggtgataaccctcagtctattcaatcagggcctgaaggagcaggtgaatttccggggactggtatccaggggccagaggaaaaacctggagctggggaatggtgggatagtcaatcaaacatgagtgagattgcaatccagatgggacagcttgccaaggacccacctaatgcttgatattcctccggcaaagcagaattacatgcagacttcttcaaattttcacttaaaagcttcagtcatctctgtggagattagcatgttcgtaatttagtccttggtgttcaagaaagtggatcccattgttgctgtgagcagactagttagcttggttagctgcagcatattttgacttgttaaaatgggaaagtgtcgatggctgtgcaggagtctgaggtctgtggatcattagttctattatgacttccttcagaatattttaagtttattaaaatgagaaagtgttgatggcagtgcagcagtttgtggttcgtggatcattagtactatcgtaacttgcttcagagttcaatacaggaaaccatccattcccttatctgcatgctgctgctccttttgtgacaacctgttgtcctgtgtatgattgtgttttaaaagacacaattggtggcagatgtgtatcagttgcaatatatttgggagccacctatgtataactctaggttccggattgttgtctctggagtccttagctgcgtacaatccgacaattgacattataaatgcttcatacttaatgacagttttgtcactttgaacccttagaatacgattacgatctgtaccctgtctaaaacagattgcctcgagcttcccattagacacctttgttactggagtaagtgaaatgctttctgtatcacagctacttgcaatgttatgactgcacaatgctttggattttgaggctgatgattttgtatgagtcagtaagatgtaagggggctatgtaatccatctttgagagcatgctgcgcctattgagtgggcattaaattcaggatgtcatttgaagtcgtttaatatccattcaaaagagaactttgatagttgaaattatactgaactgaaatattgtgacaaattgtgagattattctcacttgtgcaccaattgtaaaggccaaaatgtagagtatcgtctgtcatctgtaaaatgttgttcaattgataaaatgggggagaaagatggtttcaatttgctagaagcatgggatttatatagaaaattgcaacaagatttggcgttagctatttctttatgtggattcgatgtgatatttgtaaatggccatggaagatgctaaactttcatgacaagttcatcaatgttccttaaacaataacaggattattgactagtatcttatttaaaaaaaaaa

SEQ ID NO: 660 - DNA, 2575 bp, Pinus radiata
cacaaacgaagcttccctggggactaaaaatggccagcacggagattatttgatgaagcacgcgatgacggaacgggaaagtgaaagctagataacgtttcgttttaaatacagcgcggccgaggcggccggtcagtcaacggggtttctagtgcggtcgtctatattttctactctcctttccactctgcaaaatcagaccttcatccattccccacggcattagattcaatccattctattaggctcctttaagcgaggtcgcgggttcgaacccgatcgaatgatgcgaattggataccgtttggtgtagaattctgatagatttcgtgcgatggagggttcacagaacggcagcagcaatgcaccgccccctttcttaacgaagacgtatgatatggtggacgacccggccacgaatgctatggtgtcatggagccccggaagcaacagttttattgtgtggaatcccactgaattctcccgtgttctcctccccacttactttaagcacagcaacttctccagcttcgtcaggcagctgaatacatatggttttcacaaaattgatccagaacggtgggaattcgcaaatgaggggtttctgcgaggtcataggcatttgttgaaaaacattcacaggcgcaagcctgttcatagccacagtcagcagaaaggagagagtttgtctggaggatcatgtgtggaaatcaaacaacttgaagatgagactgagaagcttagacaggaaaaacaagggttggtgctggaattagtcagacttaagcagcaccagcagggtacagaatttgacctgcagtcattggaagagcgattgcagctgatggaacaacggcaacaacgtatgatggcattcttggctaaagctgtgcagaatcccaattttgtagcacagctcgttcaacatcacgataagattgctcatattgctacgacaaacaagaaaagacgactgccaaaacatgacgaggtcttggagattagcgaaaatggatgtaccagtagccaaattgtaagatatgatccaggtaagagtgatgctttcagcagagattctccagataagcttgaaacatccgcggatgcatttaaaaacttttttgatgctgttccagttgatgctcatgagaaagcaaaggattgtggaagtccccaaagtcactcctcagggccaactattacagagatgcatggaaaaccttgtttccctgatatgcctgtctctttaggggtttcggatatttatacatcttcagctttgtcagatttgaactcctcgtctgggttgccagaaatgtctgtatctttgagatcacaagatatacaagcatcagcagggttagtagggtcccttcgatctgacattctatgtaacttgagtttgagtcctcactcttcttcgcttgaattaagtaaaatagatgacgcaacaaaagctatccagtcaggcagtcctgagaatagaagtcttataggatctaagacgggtagcaatgatgggaattcagaagccatagatatggaggtaagattgcgatatggtgcagcaaaaactactgtgcaggagggttcagttaatggtaaggccagagggacaggtaaaagcatgggtgctgagacaaccaggaagcggatcaatgatgtgttttgggaacagtttcttactgagagtccacagccaatagacacagaggggactgattcggagagtcaggagagtagtaaggatcaagacgatgttgtacctgaatatagcaatttctgtaatagaaaggagaatcttgatcaacttacactacagatggggcaactggcatcatcagtaaatctttgacatcagattaagcatgagtattgaagtgactgcggcactaacaacaggagaatataggaatgccagtaaagttaattgtttctgaagaacaccagcgggttctagaatctagcctgtaggtgtatcttatgttgctctgtttgatgcttctttcaagattctactagttatatcggttaaatgcttgcgagagatatgcgaaacagaattctatcaattttttatgcatcactccgtccaaaatgcattgctgcttatttcagcagatgagttgggaatgcaagtaggacttcaggtttgttgatgcaattagcctttctgaaaaccatccactacattagaactttctctccttatgtgtgcatagtgattaaaggatgtcttgtaatattttctctgtagtactggaggctgtttagttaatgtttcatgtcatccattatatgagttacgaatggtttctaattgggaaatgacaatgagctgtcatgcctatagcctagtgatcaaatttgagcagaattttcaaattttgtgaaagctacagtaataagttccatctagcatttagaatttcaaacaactatctttggatgaggagttatttgatgctgtacctatatgttttttgatctgaatgtttcagatgtggcttatcatgctagaggatattattttactttgaaattaatagaaagaatgtggtttttaaaaaaaaaa

SEQ ID NO: 661 - DNA, 1798 bp, Pinus radiata
gtagagagatccctgggcctagaagtgttttcggaggtacacattctgcttcttcaagtaccgctaggaacccacttggtctggttaaatatctggaggaatttgtaacccatcaacttcaaatcttgcagttcaatcggtaatcaatgaaaagcatctcagaatttatcacccatgtgctaattctatgagtggtttttgtttggtgtaggagcgcactgcattctacttcggaaaaaaatatggatgcagagcactttcctgtaggtttctttaggtgggatcagagaccagcaccagttgtagcggcagcagcagcaccaacaacaactgtctttaacaaggaccatggacgaccgttggaagtcattcttcccatgaatgggagaaaggatttgaagtcccttgaagatctgtttaaagagtatggagttcgatacgtaactcttgccaagatgaccgagatgggcttcactgtcaacacccttgtcaatatgacagaggaagagattgaagatttgatgaagaccctggtagaactctatcatatggatcttcttataggggagagatatgggattaaatctgccataagagcagagaagaaaaggttgcaggatagcttggagatgcaaaggttggaaatcttgtctgaggcagagagaaagaggatattacatgatgatcagaatacttttgcagctgctatggcatccgaaggaacatctaaggaactgagagcaaatgacccactgattttcccagaaagcacaagtgcagatcatgccccaatgaatatagccagctgcaaagacagtactctcattctccagaacagtaaccaggcacagttttgtggctcgggattgattggagtgcctgagcacagcagtgagagcgatgaaaggaaagctgatacgaataagcagaaaaggaggcggtccaaggagcctggagaggatggggaggacaggcctagagagcatcctttcattgtcacggaaccaggagaactggcaagagggaagaaaaatggtctggattatctctttgatctctatgagcagtgtgggaaatttttattagaagtacaaaggattgctaaggaaaagggagaaaaatgccctacaaaggttacaaatcaagtgttccgtcatgccaagcacaatggtgctgtctacataaacaaacctaaaatgcgacattatgttcattgctatgctctgcattgcttggacagtgagcaatccaatcacctcagaagactatacaaggagaggggagaaaatgttggggcctggcgccaggcctgttactatcccctggtagccatagccagagagaataattgggatattgagggcatttttaataggaacgaaaagcttaagatttggtatgttcccacaaaacttagacaactgtgtcatatggagagaagcaaagagtgtcaatagtttcattgagattaatgtgtgtaatttaacttaggcagctgtgtcacatagagagaagcaaaaagtgccaatagtttcattgagattaatgtgtgtaatttgagctgctcagcttcaagtgtagctccgtgattattgggcatttgtgttctcactgtgaccttgcatatcagatttgatatgcattgtgtcatgccgttctttcaaacattgtatatgtattggcaactgggtatggatctgctcctttctccgtcactaaacatgcggaaacctttgtttctccttgtgataaatttcagtacattactgttcatagttattttctttcaaaaaaaaaa

SEQ ID NO: 662 - DNA, 1488 bp, Pinus radiata
ttcagataaggatttttaattttttggttttcatcgcccagaatccaacattcaagggatggatcctgaaagcttttctgcagctttcttcaagtgggaccagagaccgcctgctcttgcgcccccacaaatgcagaggagtgcaggattggaagctcagcgtattttccatgacttcggtgttccaaatgcagctgccatggcagcttccaataacagcagcagttgcaggaaggaattgaactgcctggaggagctcttcaggaattacggcgtgagatacataacgctgaccaaaatggtggacatggggttcactgtgaacacattggttaatatgactgaacaagagctggatgatctagtcaggacccttgttgagatataccgtgttgagctcctggttggggagaaatatggaattaaatctgcaatcagagcagaaaagagaaggttggaagaagcagaaaggaaaaggatggaacaactctttgttgatgttgatggaaaacgcaagattgatgagaatgcacttgacacactatctcaggaaggcttgtcagtagaagagcctcaaggagataatgctataattctttcacaaaataatacatcagcaaactttcctctaaacctaaatgcaggcatggatccagtgcttattctccaaaacagtggccacctagggactactgtcagtgggcttattggaatgcctgacactaactatggaagcgaacagacaaaggcttgcaaaaaacagaaaagaagacgttccaaggattcaggagaagatggtgaagaaagacagagagaacatcctttcattgttactgagcccggtgaacttgcaagagggaaaaagaatgggttagactatctctttgatctttatgaacagtgcgggaaatttctgctggatgtgcaacatattgcgaaggagaggggagaaaaatgtcctacgaaggtaacaaatcaagtatttcgacatgcgaagcattcaggcgcaggttatatcaacaaaccaaaaatgagacattatgtgcactgttatgccctacactgcctggacattgaacaatccaaccgtctgagaagagcatacaaggaacgaggggaaaacgttggagcgtggaggcaggcctgctattatcctcttgtggccatggccaaagataatggttgggacattgagggtgtgtttaacaagcatgaaaaactgcgaatttggtatgttcccacaaaattacgtcagctctgtcacttggagaaaagtaagcagtcccatctataaaactttcccgtgactctaatgatctggccaggctataaaactctaattgtcaggccattctgaatcgtaatcgctagatataaatcattgtaatgtttaatcctatgtttggttatgtatcctgggttctagattgtaacgaaactctcttatatttatttagtacatattctcggttttacctaaaaaaaaaa

SEQ ID NO: 663-665 - skipped (3 entries)

SEQ ID NO: 666 - DNA, 1403 bp, Pinus radiata
ttcgcttccgaacataagcgcggttccagcgttcgtaacaaacttttgtggcccctttttatcgggagatcgcgggttcgagtccgttcttgtgttttctccgcgtccggagcactcagttcaggtgcccaaaaattgatcgttttcggtcaaatttcgttaatttccgaggacgacttgctagttgtatggttttaattttttttttcaacgaagaaaagtattaaaaattccagcatttacagttttgaggctcatagaccgagggaattgcgatataaagcaaccttctgccctttagctggcaccggcagcagaacgggttggaatggagttttagaagtatcagattgactattcgctgtagaaaaggcaagagcctgtctgaatccgcattggagctgccagatcttgtattctaaggcaaacactggggcgagaaagatttccacggccatttagaaaccgagggctcaaggaccattattttgcaataaaatttctcggatcgtggctatggccttcaccggaacgcagcagaagtgcaaagcttgtgacaaaacggtttattttgtggatcaactgtccgcggatggagtttcttaccacaaggcttgcttcagatgcaaccattgtaagggaacgcttaagctgagtaattactcgtcaatggagggagtgctatattgcaagcctcactttgaccagcttttcagagagagcggcaattttaacaagaactttcagtcccaaagatcaagcaaagcaattgacggtctttctcctgaaatgacaagatctcctagtaaagtgtccatgatgttctctggaactcaagacaaatgtgctacctgtggaaaaacagcataccctcttgagaaggtcactgtggaaaacttatcctaccacaagtcttgtttcaggtgttctcatggggggtgttcaatcagtccttctaattatgctgcactagaaggcatactgtattgcaagcatcatttttcccagcttttcaaggaaaagggaagttacaatcatctcattaagactgcttctatgaaacgagcagctgcagtccctgaggtagcaagtgcagttcctgagatataattttactgtgatctagttacttcattaccatttgtgtttgtattttgaagagtttacacggtatgctagtttgttggggaaaagagacccgatccaccaattgtatttgccaagccctaagtgagggacattgcggtataaggtcttgtagtttaatttatattgggttgtaaaaggaggtaactctgtgtatccgatattggcagtgcttattattatggtttgcaaaagtttccaaagtacatatactatcagctatcataagtgccccgttgtttgcacctaaaaaaaaa

SEQ ID NO: 667 - DNA, 1176 bp, Pinus radiata
ggaagtggacaaactttctctctggtgtggggagcactcaaaatggggaagacgaagatggagattaaacgcattcaaaaccctagccgccgccaggttactttctcgaaacgcaagaacggattgctaaaaaaggcattcgagctttctgttctctgcgatgctgaagtcgccctgatcattttctcggaaactggcaagatctgcgagtttgcaagccacgacgaaagaacattgttggcgagaagcagattagctggtgatcagatcaggggcttggagctcccttccagtaggagctggaaaacaagtgaaggttgtagctttcatcagattggtgaatcacaactcaaagctttgcgtgagaagatgaacaagctgaagaaaaaggaacgaaacatggttggtgaagacttggattcattaacgataaaggaactgcaacgacttgaaaatcaattgcaaattgggattaaaagaatttctgataaaaagatgaaaatattggtacaaagttccaagttattactacaaaaggtaatatgatcgaggattcattatggacaaatgtgctaagaggaattacatcaccaaggtacgcgcgttggaagaggagaaaattgaacttgaaacgaagttgcgaattaaaggctattccttcagttcagccactaacctaaatcttggactttcgtatagtaccatgcccagcgggctctgcgacatgaacagcaatggaaattccttctccgttgagataccttaatcgaatacaataactaaaatttctcagtacggatctatccactatttattgcagcttcttcaaccaaatcatgtattagaagtccccaaacgtatatatatatatgagacggtcatgtatattttaatccttctgatttacagaaggtcacttccccatttccatattgttaaactaaattccccagaaaagtgccattttcccatatgttaagcccggagccccatgtggctgctcctatttgcatataaattaagcgtggatgaaattttaattgtccatgtaccagtgaaattttatttgtatactgataaaagaatgcttactggttagatgaagtgatttgtaatttgtgaagagtgtgataaggaaatagagaaaaaggttgtggaatttgcataaaaaaaaaa

SEQ ID NO: 668 - DNA, 702 bp, Pinus radiata
ctgagagttaagtgattgttgggagggaaaagagaaaaaagaggagatcaagaatggtgaggggaaaaatccagatgaagaggattgagaatacggccagcaggcaggttacattttccaagcgtagaaatggattgctgaagaaagcttacgagctctcggttctctgcgatgcagaagttggacttatgattttctcgccaggaggaaagctctatgaattcgccaataccagcatggagaaaatactggagaagtaccgaaagtattcacagcacactagtagaaatggtctgactacagagcaagataacgagtgtgtaaagcaggaacttgcaaataccaaagcccagatgagggttctcgactcagcacaaaaaaagatgctgggggaagatatggagacatgttcgatgcaggaactagatgagttagagattcaatttgaacagggactgaattgtatacgagcacgaaagacagaactattaatggctgaagtagaggagcttgagcgaaaggtaacattaagtgcccaaagatatgcttccactgcataggaacattgactcatggactccattgttgaatataaatattatccataaagattgaaaataatgtttttcagagcaaagattgaaaataatgttacggtcttagataacagataacttcgtctacaaaaaaaaaaaaaaaaaa

SEQ ID NO: 669 - DNA, 884 bp, Pinus radiata
ggaagagaccatttggttaaaaggggatatcgaatatttctgctaatttcttttggcctctctggttatttaatgggctaccgttagatgcgattattgggttctcatcgagatagctgttctgccttccccacctgagagtcaagtgattgttgggagggaaaagagaaaaaagaggagatcaagaatggtgaggggaaaaatccagatgaagaggattgagaataccgccagcaggcaggttacattttccaagcgtagaaatggattgctgaagaaagcttacgagctctcggttctctgcgatgcagaagttggacttatgattttctcgccaggaggaaagctccatgaattcgccaataccagcatggagaaaatactggagaagtaccgaaagtattcacagcacactagtagaaatggtctgactacagagcaagataacgagtgtgtaaagcagggacttgcaaataccaaagcccagatgagggttctcgactcagcacaaagaaagatgctgggggaagatatggagacttgttcgatgcaggcactagatgagttagaggttcaatttgaacagggactgaattgtatacgagcacgaaagacagaactattaatggctgaagtagaggagcttgagagaaaggtaacattaagtgcccaaagatatgcttccactgcatataaagtactatgcatagtaacattgactcatggactccattgttgaatataaatattatccgtaaagattgaaaataatgtttttcagagcaaagattgaaaataatgttacggtcttagataacagataacttcgtctacattacatgcagttaatatctataagtattttgttcgcttcaaaaaaaaaa

SEQ ID NO: 670 - DNA, 1010 bp, Pinus radiata
gtttgttgcggttctccgttccgcgggtctgattgattaattaaagagcaagagtgacgaaaggagtctggagaatggcaagaggaaagacccagatgaagaagattgagaacgtgaccagcagacaggtcacgttttctaagcgaagaaatgggttgctgaagaaggctttcgagctctcggtgctgtgcgatgcagaagtgggacttattgtattctccccaagtgggaagctctatgaattttcgcgtccctgtatgggaaaattgttggagaagtatgaaaagaattcacgagaaagtggtataaataatgcggctaaagagaaagatactcagcattcaaaacgcgaaattgcaaatatggaagagaaaattaggatcctcgaatcaacagaaagaaagatgttggggcaaaatctagcatcatgttcagatgaggaattaagtcagctacaaagccaagttgaacgtggattgaaccgtatacgaagacgaaagaatgaactattaatggatcgaattgaacaacttaaaaggaagtgtgctgatctcgaaggaggttcggttttgacatcatctgtgctccagcctggaagcacccagtgcattgattttgagactcaattggttatgggacctccaaatgtataagatcaccttcctaaactcatcttgttttcattatacaaataagctactacattacccttcctgttattttgtaaaccaattctcaacagtgtgaatcaagattagaatgtgagtgtaatcctttttgtatttcgtatttttgtattaagtcgaactcaacctggaactatttgctcaccgatcgccattctctctctactttactaacttcagagaacgaaaccaatctggtctgtgcttccccttggtttgtggtgaggaaaacctaccctactatcctccttggtcttatgtaaacgaattaagtatcaaaacaatgttgatcaaggccggaatttgagtgcagtaaaaaaaaaa

SEQ ID NO: 671 - DNA, 1008 bp, Pinus radiata
ctgaagtgccgtcgattgttcgggaggatagcgttttcgaagttcgttgttgagttatctcgcgagactgtagaattttagggttgttttccacaaaccgacttttcccgacttcaaatcttgatattgaagtgacatggccggcgagaaaagaaagattaatagaatagctaacgcttcggccaggcaggtcaccttcgcgaagaggcggagggggctgttcaaaaaagctcaggagctatcgattttatgcgaagccgatgtagccctcctcgttttttcttcaactggaaagctgtaccagtactccagctccagcatgaaaatgatattggaccagtatattttgtattctagatcaattcaaaaggatggaaagccaaatctggaggagagtcacgatatccaaaagataaaacaacaaattaaagatattagtcaaaatttgagaaaactgcgtggtaaagagcttgaaggatcgtccgtaaaggacttggaagaactagaagaacaacttgagatggggttaagtagtgttcgatcacgaaaggatgaatatcttattatggagataaatgagcttcaacaaaagggaacacgaatactaaaggagaatacagatctccgtcggcagttaaaggaacgatatggcctccacatggaaaacaatgagacatctggaaataaagatccacagtcgtccgaatcaaagatttgaaattacataaatcgcccattgaaggctcggggcagtctgatattttcttgcatctagggttatcttcgcagccaaacatttgaaacacttattcgtcgtcttccgtgatcaaatttcaagaactgatttctatttctatttttcacatgtgaaaacatggttggccaatgaaaaatggagatggcttgcttaaatatacagatacgaatgaataagatgggttaatattcctgtcaaatttgtgaaactgggattgatacatgaacttgtgagatatctaaaattaaaag

SEQ ID NO: 672 - skipped

SEQ ID NO: 673 - DNA, 1162 bp, Pinus radiata
gctggttgtagaagccactattgaatcctatttaagccactgttgaatcctattttatatcctttcgttttattttatatcccctgacccgatagtctctgatttgcctgcttggagaggaggatggcaaggggaaagacacaaatgagaaagatcgagagcgcgaccagcaggcaggttacgttttctaagcgcagaaatggattgctgaagaaagcttacgagatgtcggtgctctgcgatgcccaactgggacttattgttttctcccccagagggaaggtctatgaattctccagtacctgcatgcagaaaatgttggcacggtacgaaaatttttcagaaggaagtaaagcaacgagtacagcaaaagagcaagatgtccagggtttaaaacgacaaattgcgaatatggaagaaaggattgaaattcttgaatccatgcatagaaagatgttgggggatgagctggcatcatgcgcattgaaggatttgaatgagttggagagtcaggttgaacgaggtttgagaaatactgaaatattggtgactgaaatagagcaacttcaaagaaaggaatggatattaagcgaggagaatgctttcctcggcaaaaagttcgtgcatcctcattccgtttcgaaaactcctggaagtgaatcgggaagcatccaaaacagtgaagtcgagacgcaactggttatgagaccgccatgtacaaatgctcattttcttattaatagttctcattgataatcaatgtattcgtaactgtgttatcaatttattatgaaaattttatattaataaaaggtaaagctgcttctcatatcgcacctaattgttcaccacgtccaaaaaaaggctcttgccaagtgaactaaatgttttttgaaccgaagtctgtcttccaaactcagtatgtaagcttgctatgaatacatactttaaaggttttgtattagcattacgagcggagttttcctcattcatccgatgagcatgaagagtgaggagtataatattgacgcatgtggagaatttaatgttgcatatactcctacgtgtatatatgtgatgttttatatatatatatatatatataatatcgatttgaatctataaaattttaaattatatatttagtttaacaaaaaaaaaa

SEQ ID NO: 674 - DNA, 1122 bp, Pinus radiata
gcaggttttcagatgcgcctcccgctacattccgaacaagggaacaggtgccttatctatcaataaagacgagccaaggagttgcagccaatagaagtggacaaactttctctctggtgtggggagcactcaaaatggggaagacgaagatggagattaaacgcattcaaaaccctagccgccgccaggttactttctcgaaacgcaagaacggattgctaaaaaaggcattcgagctttctgttctctgcgatgctgaagtcgccctgatcattttctcggaaactggcaagatctgcgagtttgcaagccacgacgacatggcaacaatactggaaaaatatcgaatatacacggaaacagatggaaacatggagtcctcgtcggtccaaagcgtgaagattggtgaatcacaactcaaagctttgcgtgagaagatgaacaagctgaagaaaaaggaacgaaacatggttggtgaagacttggattcattaacgataaaggaactgcaacgacttgaaaatcaattgcaaattgggattaaaagaatttctgataaaaagatgaaaatattggtacaaagttccaagttattactacaaaaggtacgcgcgttggaagaggagaaaattgaacttgaaacgaagttgcgaattaaaggctattccttcagttcagccactaacctaaatcttggactttcgtatagtaccatgcccagcgggctctgcgacatgaacagcaatggaaattccttctccgttgagataccttaatcgaatacaataactaaaatttctcagtacggatctatccactatttattgcagcttcttcaaccaaatcatgtattagaagtccccaaacgtatatatatatatgagacggtcatgtatattttaatccttctgatttacagaaggtcacttccccatttccatattgttaaactaaattacacagaaaagtgacattttaccatatgttaagcacggagcaccatgtggctgctcctatttgcatataaattaagcgtggatgaaattttaattgtacatgtaacagtgaaattttatttgtatactgataaaagaatgcttactggttagatgaaaaaaaaaa

SEQ ID NO: 675 - DNA, 877 bp, Pinus radiata
ccaaaatggggaagacgaagatggagatgaaacacattcaaaaccctagccgccgccaagttactttctcgaaacgcaagaacggattgctaaaaaaggcattcgagctttctgttctctgcgatgctgaagtcgcccttatcattttctcggaaactggcaagatcagcgagtttgcaagccacaacgacatggcaacaatactggaaaaatatcgcatatacacgcaaacagaaacagatggaaacatgggggcttcgtcggtccaaagcgtgaagggatggtttcctaattttctcgagattgcgggaatcacaattgaaagcgttgcacgagaggatggacaatttgaaaaacaggaacgaaacatggttggtgaagacttgcagtcgttatcagtaaaggaattgaatcgacttgaaaatcaattgcgaattgcgattaaaaaaatttctgatagaaagacgaaaatatttgcacaaaatgcgaagtcattagcacaaaaggtacgagctatggaagaagagaaaattgaacttcaaagcaagttgcgtaccagagacgattccttcagttcgactaacttaaatcttggcgggctctgcgacggtaacatcaatggcgattgcttctccagtgagatacattaatcgaatactataacattggacctctctactatttattactgcttctccacccatatcacgtattaaaaagtcccgacacggatagaaaataaaaaaaaagtattctatgacacgatcatttatattttaatctttttgtttcacagaagcagatatttttcacgagaaaaaaaaactgaacatgcttatattcatctcagaatgttttacatattctaaaaaaaaaa

SEQ ID NO: 676-677 - skipped (2 entries)

SEQ ID NO: 678 - DNA, 1301 bp, Pinus radiata
ggagactccggatcaatatttctccgccaattcagtaccagagcttttgcgatacgggagcgcatcgcatctatttggaggcgcacatgttgcttcgcctcattcgcctgcatccatcgacatgccgctttttcttcttcacctttcgactccttccgggcctatagactagtataccttcgcaatctctgataccgcgagtccgcgccctggaagctagtctaaactagtggatggatttttgtttgttcctcctgaaacatattcttgaatagtggcaggaagccattaacgagagtttgatcatcctgcaaaacctagtaaaccctggagctagtataaactagtggaaggaagctcggttattctgttcatagatcgaatttgagttcaacgcctgcctatactcagatttcagaaactcttgggatttttgagtaattgtgcaaaatggggcgcggtaaaatacagatcaagaaaatcgagaatagcgtgcataggcaggtgaccttctgcaagcggcgaggcggtctgatgaagaaagcctatgagctttcagtgctgtgcgatgcagaggtggcgctcatcgttttttctggcggagggaagctctacgaacttggcaccagcaacagcaacaggaacagtatgaggtcaatattggaaagatatcaaaagtgttcacagacggcaaaacatatgaacttttcgaataatacttcagacgagaaaatgaagcaagaaataaatttacttaaacaacaaattgatcagctaaaacttactaacagatatttaatgggagaagggcttggctctgtctcattcgaggagctaactcaattagagagtcgcctacaaagaggaataaatcaagtacgagcaaaaaagcacgaactgatgctcgatgaaataagagcccttcagagtaaggaacatacgttaaggataaacaacatgatgcttcaagaaaggttggaagaatgtacaaatggcaagagactttcgtcgctcctaacacatggatttacaacattattgcctaaccaacatgttccttctggatatgatctaagtaatcagtcacttagttcaaatgttgagatgtaacatatagtacgttgtagatgtgtttccttgtggaacattatgacttcaaaacatgggttctaccaactttcttgtttgtatatttaaggacaacgacgaggtatcctatgtctatatatccataagacaataagtcatgaaaaacaatttgcaataatatattttggtggtttatttttggaaaaaaaaaa

SEQ ID NO: 679 - DNA, 945 bp, Pinus radiata
gggattcaaagaaccagaagcgatggggcgggggaaaatccagataaagaaaattgagaatactacaagccggcaggttacattctgtaagcggaagaatgggttgctgaaaaaagcttatgagttatctctgctgtgcgatgcagaagtggctctcctcattttctccaccagtgggagactctatgaatttgcgaataagagtgttagcgcgacaacggagcggtacatgagaacctatgcagagaacatgcctcagtctcgagctctgtatccggattgtcaccattggcaagaggaagtcagaaaacttacacagcaacgtgatagtctaaccaattcgatcagacaaataatgggtgaaggccttgaatcattaagcatgaaggagctcaagcatattcaagttcaattggaaaaaagtattagttgtgtacgatcaaagaagaacgaaatgctacttagtgagatggagaatctacaaagacgggattgtctattatctgctgagaaccagtttcttcgtagtaagataaaggaactggaagactgttctgggaaaccagatcaactggaggccacctttgctcaaaatttcatccaacaaaacactgcaaccgaaactcagcaacactcacaaaccgctcctgtagttattcaaacagctcttcagctaggatgaggccagagatgtgattattttatggggcttgagagaaatctattcaagtttgtacattgttcatagatgtgataagatgttgagataaataatgctccggaacaaaggagcttccagtaataatagaatttttaggtgcttcggtgcactgttacatattttttctgatttctagataagtcagtatctatgacatcattatttttttagtaataataaaattttcaagtgcttcggtgcactgttacccattaaaaaaaaaa

SEQ ID NO: 680 - DNA, 937 bp, Pinus radiata
gaaaaactggttcggctatcgttagcagtcatcatgaggtcgcaattttagcgcctctttaatatctgctgggtgcttgttctcattgcctggaaccagatctacaggagactgtaattcactgttttgcactgtagaaaggagaggacaagaatggtgaggggtaaaactcagatgaggagaatcgagaacgccaccagcaggcaggttacattttctaagcgtaggaacggactgctgaagaaagcttacgaactgtcggtgctctgcgatgccgaagtggcgctgattgttttctctcccagagggaaggtccatgagttcgccagtcccagcatgcaaatggtgttggataagtaccaaaagtattcacaagaaagcggaataagtaataggacgaaagagaaaaatactcggcatttaaaaggagaaattgcgcaaatggaagaaagggttaatattcttgaatcagcacaaaggaagatgttgggggaggatctagcatcgtgctcaatgaaggaattaaatcagttagaaagccaagctgaacgaggattaaaccgtatacgggcaagaaagacagaaatattaatggatcatagagaacaacttaagagcaaggaacggatgctcactgaacaaaatgtttttcttcgtaaaatgtgtgccggtagccaagatgattcagatttgacaacacctgcaatccaccttgaaaggataagaatggagcacagtgaagtcgagactcaattggtcatgaggcctccacatgtacaaaaaaatcacctttccacgtatagtgttcattaatcttccttcatttcaataagtttacatgataaaattactattactgagcgtgtaatttttcttttcatattttgattatacaaataaacattgtagctgtaggctctatttgttaaaaaaaaaa

SEQ ID NO: 681 - DNA, 1007 bp, Pinus radiata
aaactccttcagcctgtcacagaataccggggcgcttcgcatccatttcgagacttatgttccacgcgcacatgttgcttactctagacttttgtattgtcgcgatctcttggaccgcaaggccgcgcaagtggacggatctttttggtttgcagcatattcttcaatagggttggaaggcattagattcagattttgagaaactattgggattttgctgaaaatggggcgcggtaaaatagaaataaagaagatcgagaacagcgtgcacaggcaggtgaccttctgcaagcgcagaggcggtctgatgaagaaagcccacgaactttcagtcttgtgcgatgcagaggtggctctcattgttttctccagccgaggaaagctctacgaacttggcatcagcaacagaaacaggaacagaagtatgaggtcaatattggaaagatatcaaaagtgttcacagacggcaaaacatatgaacttttcgaataatacttcagacgagaaaatgaagcaagaaataaatttacttaaacaacaaattgatcagctaaaacttactaacagatatttaatgggagaagggcttggctctgtctcattcgaggagctaactcaattagagagtcgcctacaaagaggaataaatcaagtacgagcaaaaaagcacgaactgatgctcgatgaaataagagcccttcagagtaaggaacatacgttaaggataaacaacatgatgcttcaagaaaggttggaagaatgtacaaatggcaagagactttcgtcgctcctaacacatggatttacaacattattgcctaaccaacatgttccttctggatatgatctaagtaatcagtcacttagttcaaatgttgagatgtaacatatagtacgttgtagatgtgtttccttgtggaacattatgacaacaaaacatgggttctaccaactttcttgtttgtatatttaaggacaatgacgaggtatcctatgtaaaaaaaaaa

SEQ ID NO: 682 - DNA, 1057 bp, Pinus radiata
agcggatggatttttgtttgtccctcctgcaacattttcttgaatagcggcaggaagccattaatgagatcttgattattctgcaaaacctagtaaacgctgaagctagtataaactagtggagggaagctcggtaattctgttcatagagcaaatttaagttcaacgcctgcccatactcagattttgggattttgctgaaaatggggcgcggtaaaatagaaaccaagaagatcgagaatagcgtgcgcaggcaggtgaccttctggaagcgccgaggcggtctgatgaagaaagccttcgagctttcagtgctgtgcgatgcagaggtggcgctcatcgttttttctggccgaggaaagctctacgaacttgaaacgagccacagcaacaggaacaaaagtatgaggtcaatattggaaagatatcaaaagtgttcacagacggcaaaacatatgaacttttcgaataatacttcagacgagaaaatgaagcaagaaataaatttacttaaacaacaaattgatcagctaaaacttactaacagatatttaatgggagaagggcttggctctgtctcattcgaggagctaactcaattagagagtcgcctacaaagaggaataaatcaagtacgagcaaaaaagcacgaactgatgctcgatgaaataagagcccttcagagtaaggaacatacgttaaggataaacaacatgatgcttcaagaaaggttggaagaatgtacaaatggcaagagactttcctcgctcctaacacatggatttacaacattattgcctaaccaacatgttccttctggatatgatctaagtaatcagtcacttagttcaaatgttgagatgtaacatatagtacgttgtagatgtgtttccttgtggaacattatgacaacaaaacatgggttctaccaactttcttgtttgtatatttaaggacaatgacgaggtatcctatgtctatatatccataagacaataagtcatgaaaaacaatttgcaataatatattctggtggtttatttttggaaaaaaaaaa

SEQ ID NO: 683 - DNA, 1000 bp, Pinus radiata
gagcttcatccgccattattgggtttcaattcgatcttgatttgccagagacgatgtgaattaccattctgtgggcaaaagcgagagaggaggagaatggtgaggggaaagacccagatgaaaaggatcgagaacgacacgagcaggcaggttacgttttctaagcgcaggaatgggttactgaagaaagcttatgagctctctgtgctctgcgatgccgaagtgggacttataattttctcaccaagagggaaactatatgaattcgccagtcccagcatggaggagattttggaaaagtataaaaaacgttcgaaggaaaatggcatggctcagacaacgaaagagcaagatactcagtattccaaacattccaaacaaaagcttgcaaatatggaagaacagattaggattcttgaatcaacccaaagaaagatgttgggggaagggttggaatcgtgttcaatggcagaattaaataagttagagagccaagctgaacgaggattgagccatatacgggctcgaaagacggaaatattggttgaccaaatagaatgtcttaaaaggaaggaacgtctcttaagcgaggagaacgccttactcagtagaaagtgggttgatcgtcaatccgtggacggttccggttcaacatcatcttcaattggattgggaagcatcgagcagatcgaagttgagacacaattggttataagaccgccaaatgcacaggatcactgttctgtaaatagtggccattgaaattattatttaaactgatccatcttatcaaagtttctgtgtgatcgaaataggttgtagtccagcctcattgtttggcaaaattcagatagacgctctaatcactggatatggaatttgaactaaaagcacaacagcaagtacaataaacttgcccattcttatattttcatgatataaataaacattacaatacggttggtattgatatatatttttcttatatctaaaaaaaaaa

SEQ ID NO: 684 - DNA, 1097 bp, Pinus radiata
aaacattgcaagctgcttgtttaatttctgtgcttcaagggaaaggagaggaagagattcccagaggagaagatcaagataaatggggagggggaagattgaaataaaaatgattgagaacgcaacaaacaggcaagtcaccttctctaagagaagagggggacttaaaaagaaagctcaggagctctccgtcttatgcaatgcagaagttgctctcatcattttttccagcaccggcaaactccatgagtggtcaagctcgagctcattctttatgttacaaaaaagcatgaagaaaattctcgagagataccagaaatcagagcagggactaggactcatggattatcaacatcaacagctgttgtgtgaaatgagacgaatcaccaaagaaaatgaaagccttcaagagcgtttaaggcatatgaatggcgaggaagtcaattcattgaagctcccagagcttttcaaactcgaagagcagcttgacaaggcagcaactcaagtccgaagaagaaaggatcatgttttagaaaatgaaagaatcaagcagaggaacaagatgcgtcgtatggaggaagagaacatcattcttcacggaatgcttgagcagaatcagggacacatggaagaggataacggtcagtttaatttcgtactctaccaaccagtgaagaaaatgcggactgcgttccctgcaccactgctccgtctacagccaaatcaaccgaacttgcaggatattggatattaactaagtcgatgttcatcactagttataagcttgatggagatctaagtcgtagtggtagttttggatacccaaaccttatgaaagatgattgcaaataattatttcaaagttatgaatatcacattccagatttagctatgtaaatggtcatgacggcgttgtatgttttataaaattatttggagacccttttttagagatgtctgaaatagttttggagatccaaaccttatgaaagatgattgcaaataattatttcaaagttatgaatatcacattccagatttagctatgtaaatggtcatgacggcattgtatgttttataaaactatttggagaccc

SEQ ID NO: 685 - DNA, 1636 bp, Pinus radiata; identical to SEQ ID NO: 286

SEQ ID NO: 686 - DNA, 1196 bp, Pinus radiata
cggattctcaaattctgggttcgagaagtggttaggttatcgttagcagccattattgtgtttcaattttagcgccggtcattttctcagtgattgattcgattcccctgttccgatttaaccaagagtctctgattgattgttttgagggcaaaagggaaaggagaggagaagaatggtgaggggaaagacccagatgaagagaatcgagaacgcgaccagcaggcaagttacgctttcaaagcgccgcaacgggctgctgaagaaagcttacgagctctcggtgctctgcgatgctgaagtgggacttattgttttctcccccagtgggaagctctacgagttcgccagtaccagcatgcaaaaattgctggaaaaatatgaaatttgttcacaagaatgtggcacaagtgaatcaaacaaaaagcaagatccccagtgtctaaaacaagaaattgaaaatatggaaaaaagagttaggatacttcaatccacacaaagaaagatgttaggggagggcttggcactatgttcaataaaggaattaaatcagttggagggacaagttgaacgaggattgaaccatgtacgagcaacaaagactaaagtacttttggatgaaatagagaaacttaaacaaaaggaacatgtttttagagaagagaaagctttgctccataaaaagtcggttaatcttcgaggtgctaatggctgcacaataccttcaattggattgacaagcatagaacgcgtggaagttcagactcaactggtcatgagacctccacatgccacagagatggacgacaactttatggatgttgacaacgtgccactatctggatgatgtttttctgtttctgttacataatatggccactgatgacaccatactttattttggtatttgctttaaaaatgactctttctttcactgacttttgatggactgtatgatagttgatttttggtcctcatactttagcaaatggttatgggtacctgttttggcccgaggccttggaggatctactctctatatgttactgttttactttttacatttgtgctcactgtatctcatatgatgcacttgcccacatatgatggactctgtgtagcttccaactagacaggatgtactgttttttcataccttaatatcaactagtgttttttcttactgaaaaaaaaaa

SEQ ID NO: 687 - DNA, 952 bp, Pinus radiata
ctcttgtctgttctcgaaatcggccaaaatgggaaagaagagggtggagctgaaacgcattcaaaaccctagcagtcgacatgctactttctctaaacgcaagaatggattgctaaaaaaggcgttcgagctttctgtcctctgtgatgctgaagtcgctctcatcattttctctgaaactggcaagatttacgaatttgcgagcaataacgatatggcagcaattctgggaaaataccgagtacacgaagaaggcactgaaacgtccagtccaacatcgcttcaaaacgtaaagtatcatgaatcagggcttgagaaattgcaagagaagttgaccgctttgcaaaagaaggaaaagaacttgattggtgaagacttggaggtattaacaatgaaagaactgcaacggcttgaaaaacagttacaaattggcataaaaaggattagtgatagaaagatgagaatattttcgcaaagttccaaattattaacacacaaggtacgcgctttggaagacgagaataagaaactccaaaccaagatttgtactcgaggtgaatcctccacttcagtgcaggaaactgtagtagtacaacaaactaacttacatcttggacttaataccttgcccagcaggccctctgagatgacaggagatggcgataattcccagataggagaaactgaaatctctaatgcctgatcaaatgactatttattgttgtttctccatatgttccaagaatttgaaaatccacgacaaatggaaaactggttctatgttagaggatcatacatattttttgcttttttctagttatggattttaatgtcttcaactttgttttaacatggttttggtttttttaactgaaaatatcatttttttccagaaggaaacacacgggtttttatatagtatcagtacatattcaaaaaaaaaaaaaaaaaa

SEQ ID NO: 688 - DNA, 832 bp, Pinus radiata
gggcgttgtgatctggttcgtctgtgccttggggcaaaaaaggagcaggcagatggggcgagtgaagcgagaaataaagaaaatagtaaacgccaccagaagacaggcgacgttctccaagaggcggaatgggcttttcaagaaggctaacgagttagcggttttatgcgatgcagacgttgggcttatcgtctacaacaccgctgggaagctattcgaattttccaactccagcatgaagatgcttattaataagtatttgaaagatcgaggcggcggtgaaagcgacttcttttgtgagatgcatggatgcgatgatgaaatcgaagtggagaggttgaaagaggatatcaagaatctttctcgtttttgccgaggtgatgagcttgaaggaatcagtttgaaaatgttcgaagatcttgaagaatctctagaaatggcggtaaagtgtgttcaatcaagacagcgggaaatttttacgaggcaaattaatattcttcgaaatcaggaaaataacgcactaaacgaaagaggagaattacgaaatcggatggaagaaatacatacacgtactggctccacaagatattgtgagttggttgatgtcgaaagggagtctgctgaaaatataaattctgaaagtaccaatggtaccaaaaatagacagtcaaattatgccaataaagaattggacgattttgaaactttcttaaccttgcggctatgatgcccattgtgcggaggaaaaaaatatgttgatttgtaaatggtttggttggtttgaaaaacacaatctcttaaaagttggcgatggattaaaataaaaaaaaaa

SEQ ID NO: 689 - DNA, 991 bp, Pinus radiata
gcttgttgtaggacttcggatttggcggatttttgtttttgtttttgcccttgctgtctacgatttgtatgttaatcgcgcgagatctttcctgttgttgtaaatctcagtttggagtgacatggcccgcgagaaaatagaaattaagagaatagctaacgcgcccgccaggcaggtcacgttttcgaagagaaggagggggttgtttaaaaaagctcaagagctgtcgattctatgtgaagccgatgtagccctcgtcgttttttcttccaccgggaagctctacgactattccagttcaagcatgaagatgattttggacaagtatagtttatatccaactacgaatcaaaaggacggacagccgaatcttgagcctgaaactcaagatatcagaaggataaaacaacaaattgaagagattactcagacattgagaattatctctaatgagttgcaacaactcgaagaacaacttgaaatagggttaactcacgtccgatcaaaaaagggtgaaaatattgttaaagaaataaatgcacttcaacaaaagggaatacgaatcatagaggagaatacgaaactgcgtcgagagctaaaggaaggatatctcaggcatgtagaaaataatgacgcagaggagtctgtcttaattgaaccattggaaaatcaggatcctcagtcatctgaatcaataactacttatgcttttaatttcaaattgcataaatcggccatgaaagactatgaggattctgacacctccttgcagctggggttatcttcgcagtctaaattttgagactctcgcaacgtcatcttgagtgattatatttcaaaaggtccttcatattttaacaattttctgatatctgaggaatatgaagcatggatagtgtaaaaaaaagacatgttttttcaggacgaaaaagcataattatatttatataaaaaatataaacatagggcatatgcacaatgaaaaaaaaaa

SEQ ID NO: 690 - DNA, 1138 bp, Pinus radiata
agtattgaaattcccctgttttgatctgatagctatggatctgatggagtcttttgaggcaaaggggaagggagagaagaggagaacggtgaggggaaaaacccagttgaagaggattgagaacgggaccagcaggcaggttactttttgtaagcgcaggaacggtctgctgaagaaagcttacgagctctcggtgctttgtgatgccgaagtggcacttattgttttctctccaagagggaagcgctatgagttcgctaatcccagcatgcagaaaatgttggcacggtacgaaaatttttcagaaggaagtaaagcaacgagtacagcaaaagagcaagatgtccagggtttaaaacgacaaattgcgaatatggaagaaaggattgaaattcttgaatccatgcatagaaagatgttgggggatgagctggcatcatgcgcattgaaggatttgaatgagttggagagtcaggttgaacgaggtttgagaaatgtacgagcgcgaaagactgaaatattggtgactgaaatagagcaacttcaaagaaaggaatggatattaagcgaggagaatgctttcctcggcaaaaagttcgtggatcctcattccgtttcgaaaactcctggaagtgaatcgggaagcatccaaaacagtgaagtcgagacgcaactggttatgagaccgccatgtacaaatgctcattttcttattaatagttctcattgataatcaatgtattcgtaactgtgttatcaatttattatgaaaattttatattaataaaaggtaaagctgcttctcatatcgcacctaattgttcaccacgtccaaaaaaaggctcttgccaagtgaactaaatgttttttgaaccgaagtctgtcttccaaactcagtatgtaagcttgctatgaatacatactttaaaggttttgtattagcattacgagcggagttttcctcattcatccgatgagcatgaagagtgaggagtataatattgacgcatgtggagaatttaatgttgcatatactcctacgtgtatatatgtgatgttttatatatatatatatatatatataatatcgatttgaatctataaaattttaaattatatatttagtttaaaaaaaaaa

SEQ ID NO: 691 - skipped

SEQ ID NO: 692 - DNA, 974 bp, Pinus radiata
gctttcctgttgttgtaaatctcagtttggagtgacatggcccgcgagaaaatagaaattaagagaatagctaacgcgcccgccaggcaggtcacgttttcgaagagaaggagggggttgtttaaaaaagctcaagagctgtcgattctatgtgaagccgatgtagccctcgtcgttttttcttccaccgggaagctctacgactattccagttcaagcatgaagatgattttggacaagtatagtttatatccaactacgaatcaaaaggacggacagccgaatcttgagcctgaaactcaagatatcagaaggataaaacaacaaattgaagagattactcagacattgagaaatatgcatggcgaggaacttgaagaattatctctaaatgagttgcaacaactcgaagaacaacttgaaatagggttaactcacgtccgatcaaaaaagggtgaaaatattgttaaagaaataaatgcacttcaacaaaagggaatacgaatcatagaggagaatacgaaactgcgtcgagagctaaaggaaggatatctcaggcatgtagaaaataatgacgcagaggagtctctcttaattgaaccattggaaaatcaggatcctcagtcatctgaatcaataactacttatgcttttaatttcaaattacataaatcggccatgaaagactatgaggattctgacacctccttgcagctggggttatcttcgcagtctaaattttgagactctcgcaacgtcatcttgagtgattatatttcaaaaggtccttcatattttaacaattttctgatatctgaggaatatgaagcatggatagtgtaaaaaaaagacatgttttttcaggacgaaaaagcataattatatttatataagaaatataaacatagggcatatgcacaatgagataagagtatatatatgtcacacatagacctgtctaattaaaaaaaaaa

SEQ ID NO: 693 - DNA, 1087 bp, Pinus radiata; identical to SEQ ID NO: 299

SEQ ID NO: 694 - DNA, 1225 bp, Pinus radiata
ctgttttgaggacagattgccttaagctcttgccttcttgggagttctgtgagaacgattcttaatttctgtatgtctggtaagacgactgctgcgtcgcccactcagagcaaaccagttatctcttaggtatcacaaatatttcgtatgaagcatcgacaggcttagctagttcccttgtgttctaccgcataactcaagatcagatttctctgagtgttttgaggctcggaaaaatgggtcgaggaaagatcgagatcaaggcaatcgagaatcccactaacagacaagtcaccttttccaagcgtaaagcaggacttaagaagaaggcccatgagctttcagtcttatgtaatgcccaggttgctctaatcatcttctctgcaactggaaaaatctttaaatattcaagttccagcatgagggaaataatagacagataccagaggactgaaaagacaaaactatgggacagtgaggatcaacatatgttttctatgatcgaaagaactaagagcgagaatgagacccttcgaagtactttaagatacatgagaggtgaagatcttgacttgcttaatgatacaaataagatggccaatctggaaaaaatccttgaaacggccaccgctagggttcgtagaagaaagaacgagcttatggcaaaacaatcagatgacttagagagaacggtggactttcttcagcatcaaaacgaacagctgttgaaggtgctagagtgtcactcacgaatgggaaatccagtacacggttacagtgcctctcctcctctttgttaccaagttgaacaacagcaaccgcaacaccaacaccaacagcatattcctcttcatatactcatgcctgacgttcctgtcaagccaagtcaaccaaacttgcaggacagtggatatccacaaccagatctacagttagggtatgatcaacttatacccttgctctctatcttttcctaggtttctgtaacaactgttgtgaaggaaccgtccatatcaatcgtcacaagtcgtgatgcatcattgctttatgcaaactgatattattgagaaatcaactcaaagtaagttgggctctttggaagtttacactgttgtttatgtacagtacaaaaagctgaactataatgtattccattgcagttgaatatactttctctatatttttcattcttatgactaaataatatttcattttaaaaaaaaaa

SEQ ID NO: 695 - DNA, 1346 bp, Pinus radiata
gaggtagattagattcgactccctgaccctgggaggaggaagaagaagaagaacagcaggaggaagcgaaaatttcttaatagtaaccagagaatagcagcgggtgaagaagcagagggatcttgcaatggggcggggtcgggttcagctgaggcgaatagaaaacaaaataaatcgacaagtcacgttttcgaagcgccggaacggactgctgaagaaggcgtacgagctatcagtgctgtgcgatgccgaagtggcgctaataattttctctaccagaggaaagctttacgagtttgccagttccagcatgaacaagacgttggaaagatacgaaaaatgttcatatgcaatgcaagataccacaggcgtttcggaccgggaagcacagcagaattggcaccaagaagttacaaagttgaagggtaaggttgagctcctgcagcgatcacaaaggcatttgttgggggaagatctgggtccgttaaatgttaaggagctacagcagcttgaacgtcagctggaggttgctctgacacatcttaggtcaaggaaaacgcaggtaatgctggaccagattgaggaacttcgccaaagggaacggttgctacatgaagtaaacaagtctctgcagaaaaagctttccgaaacagagggaagagatgtaataactggcatagagcaaacttctaatactaatactggtactaacggtccttgggattcttctatcacaaacactgcctatgctctctcacaccctcaacaagattcaaattcaagcctccaccatgtggactgtgaacccacgctacagattggttatcagcctgtggctcctgaaagcatcgtccctcctcatcagccgccgcacaaccaaacgccgaaccaatacatgcaaggatggtgggtttgatatttaacatttatcattatcagttacttcaatcacaacaaaagcccaaagcgtggtaaattacgaaattagaattatattatcattaaaaaaaaaccctattttcattgtatagcagtaggcttgatttactgctatgatagcggaggttttattgggcaaacaaaccctactggtatattagaccttcttgtcgacaaagtttaattgcataaatcttgtatgctaatctggccgctaaaagagcgatggaaaaatagttgtcccattcacaacacatgatatgtttaaatccaacgtgtatgtgtctgcaaaatattattatacactacggtttatcacatggtagtcgattcgccatacttttcaagtgtgaattactacagtatttttattctaataaatagcatgttaaaaatcaaaaaaaaaa

SEQ ID NO: 696 - DNA, 1305 bp, Pinus radiata
tctcgcccgttttttccctgcactcaccacttccatcgccattgctggaaccctagaagaccagtctctttcttttttaactcaggagttaaatcgcaatacaaaactcctgtgctggactctattgtatcatagtattcagcaagagaggccatggggcggggaaagatcgagctgaagaagatcgaaagcacaagcaacaggcaggtgacgttctcgaagcggcggatggggttgcttaaaaaggcacaggagctttccgtcttatgcgatgcagaggtcggcgtcatcattttctctaataccggcagactctacgacttctcgagctccagtatggagaagatgattgaaacatactatcgatttattgaaaaaaatggccattcccagcaaccgcacctaccgatacatcccaatcaagacctaggaagactgatgcaagagcttcaggcaattgagagtacgtacaaaaagtcaataggagaggagctgtcttcgttatccatcactgacttgaagcggctggagcaccagctcgaactaggaatcagtcgaataagaggaagaaagaaccttcttgttgaggagcagatagctaatctccaaagcagggagcgtgaattgctagaagagaacaatgtcctccataggctggtctcagaagcccggagctccacggagatggcagcgtcaagatttgtaaacgataatcttgcagttaatatatcgtccgcacctgtaacgtctaccaacccctttcaacaaagatttgggcagacatcacaagtttgcataggaaactcttcatcatccagaaatatcgagcagagctcgtcagggcctcattcaattgcccagcagtgtcctcttcccgatcagcatggttaccatactcaatccgccggtctaatactagatgaatgggatctgatggaggaatatggttctgttatcatcaaatgaccttcaaagctatctatcgatttctttccttcaaggactccatcataccctctcatatcataaattattataaacggacgtggtaacaattattgcaaagcattcaatgatttggtggcagtgagaaccaattaaacaaaatattgggaatatattctacaatatgagaattggacaatgaccaccttgtcacctggtttacgaattataaattgtaatttataggtttattaatttgaaaattaaagattcattatttgagagtttattgaggaagataaatttaattttttatattatttaaaaataaagattcaattttttttgccaaaaaaaaaa

SEQ ID NO: 697 - DNA, 1795 bp, Pinus radiata
ccgcaagtccttctctcggattccatttcttcgttcacgaaactgaactgtttctttgtgtctccttcacggaactgggcaaaaccttctctatcagactgagcgtatccttacatggttgggctaacacgtggctcttcaccagcattttatcacacggttgtctattttcctcggaatctagttcaggtcaagggtgtatactcttcacaaacacattattcagaaacccgactggaacagcgggatgttcggattctgtcccaaatagatttaattccacagactccatattgcagaagcgaatttcttgaagcagatgggtcgcgctaagattccgataaaatggataccgagacacacttcaaggaacatgacattcatgaagcgaaagaaaggattggagaagaaggtaaaggagctaagcattctgtgtggagtagaggcgtgcatggtctgttttggcccacagatggaccagcagaccacatccgactatcctgatgtctggccaggaaagtcaaaagctcttgagatcgttgagagatatagaaacctttcaaaagaagagcaagcaaagaagaagcttgataactccagcttcttggagcagaggataaaaaaattgaaagttgaattgagtgccaaaaggaaggaaaacagagaattggaaatggaggctgtgtattcttgggatgcatgtttaaattattttaccatagatcagctaaaagatcttgtggattacatagatatcaggcttgaaactgcaaatgagagaatgaattttctcagtagagatgaacgtgagatttccaatggtgccaggcagcaaatggaagatggcggttcatacaactccatgatgccttatcaaagtggccatgatagctcgggttcaactttggatcatttgaagccctatctgagtttagaaggccactacaaggaacacatgtcctcttgcgagacagtggccatggattattccaaggccaatcccccttttataagagcttttaacgattatcatgcacccaattacaaggaagccatggacaatggtgaagatgataggatggctgtttgcaattctcatttgatggttaacgagagttttcctctgttgggtattgatggtgtgaatcccatccagtcaagcacaggaagttgctcacagtggtgtcgtaccatcacgccctgctctttgcacaaccctttgtattctacttgccctcaacatgatggtatgaatcccacaatccaacaagttcaattttcttgtgagcctcattatcagcagtggttggatgagatgatggaatcacagaccattcagagggtattaggagatgaaggcatcaatttccaaaacgacagcggtgttcgatctactccccttctgttgaacagatcttcgggaagcaatgaccattgttacataaagaacatattttgaaacttcaaaaaacaggaaagtcaaggtgctgctctgatgagaaatctagaccaaaggagctgttgcattttctcattcactcatacgaggttgtaagaatgatactttccatggattactatgttgtgttgcaggactcctgttgggttcaaatttagtgattttacttacacatgcccaatttaatacagtgtagaataagttcaatttgatgtggaacttttgatgatctactacaagggagtccattttgaagcatacatagcaatgaatgtatgctggttttgatttctttagtgtatttggatccaagcaaattttcaagtaaaaaaaaaa

SEQ ID NO: 698 - DNA, 681 bp, Pinus radiata
gcttgaattcattaaattcttgccattgagtggcctctctgcttagtctgcctgctattatcgtcggagtactgtacttccttctagaatcggtggcttcttcttcatatcccaccaccattttttgaattctcagggtaccatgactgacatggatcgttcctcatcagatgacaatacatcagtggattctcaagatgatgtgaacgagagctacaaggtggatttctcagaggatgaagccgatctcatcagcaggctctacaatctacttggccagaggtgggctttgattgcagggcgaattcctggcagaactgcagatgaaatcgagaaatattgtagtaaacgatatgccagtgactagcaataggatcacactctgtggttatatgaatccttaattaactaattatgaagagggcataagaagcgttgctgtatgtgatttagtttgtgatggtttgtatattggttgagtgatgtgcatatctggggtgtatgcatgtgtatgagtgatggaggcatagggaacccaactggggcttcgataccaggagatcaagtttacacccagttttagattgatggtcatttttcttttctgctcagcaggcaggaagcctgaaactgtataacaaattttcaagtactcttattgttgtcgatgtagatctgatt

SEQ ID NO: 699 - DNA, 729 bp, Pinus radiata
cacgggttccagaccttttgacatcttcattattcttccgcctgtgaaaagatggggagatctccgtgctgtgagaaggctcatactaacaaaggggcctggactaaacaagaagatgaccgccttatcgctcacattcgagcccacggcgaagggggctggcgttctcttcccaaggccgcagggctgctgagatgcggcaagagctgcagactgcgatggataaactacctgcgtcccgatctgaagcgtggaagcttcaccgaagaagaagacgagctcatcatcaaactccactccttcgttggcaacaagtggtctttaattgcagggagattgcccggacggacggacaacgagataaagaactactggaacacacacatcaaaagaaaattgctgagcaagggactcgacccccaaacccatcgtccactcggccagccaaacaatacccccgtcactcggcctgttcccgagcacgaaattccggcattccagaaccctgcaacgccggagatagcagacttgttacagcaccaccgattggaaagctcgcctatcaaaccggcagcttcggatgcggaagagcatcccgacctcaatctgaatttgtgtatcagtttgccgtctaattcggccccggccgtaaacagagtatcgagcgtcgatacaatagtagattcaaattctaattctggcgacgggctgtgctggcagtttctctga

SEQ ID NO: 700 - DNA, 1092 bp, Pinus radiata
gccgcttcggcccgagcaattttgcttctctgctaaacgatgggaagagcgccttgctgtgccaacggtgacagaagcaagggagcctggaccaaggaagaggatgacaggcttacccaatatattcaggctcatggagaaggatgctggcgttctctccccaaggccgcaggtctgcttcggtgtggaaaaagttgcaggctgagatggataaattatcttcgccctgatctgaaacgaggaggtttttctgaagatgaagacgatcttattctcaaactgcacgccctcctcggaaataagtggtctctgatagcgggtcgtttgcctggtcgaactgacaacgagatcaaaaactactggaactctcatctcaagagaaaactcatcagcatgggggtcgatcccctgacccatcgtccatttcagaggaattctcgccatgatctttcgcttcctgggaaagttgaagtgcctgaaatagcaaggccgcgtgagcttgtcgaaaatttctttcacagtccgtcagaattatgcggcgactccgagcaagtttcagatgctgcaagcgaatccctagcgcgggatgagccctccacactaaatctcaacctggagctctcaataaactgggcttcaatgcacgtagctgtgaaggaggaacccattttaaaatccaaaccaggcgaagaagaaggcgcaggtggtcgctttgatgaaaagggatatctgtttcgatatgaagaatgcccggttgggaaaagcctgctgtgatgagatgaaaagttagatgcgcagtaatgtgatttatgcaggttgaacttattttgatggtagaaattggaaatattttggaatccaaaggatagttgtttgatcaaccaaaatctacagtccgaataaatggttatttatgcctaatgcaaccccaaagaaaatcatccacccaggtctgaataatatattcatggagaagggaactcctggtctcatgccctaattcaaggaaaatccacctggggctctgaatattgtattcatggatgtaagaaatatcaaaattccattgcaaatttatggcaaaaaaaaaaa

SEQ ID NO: 701 - DNA, 1085 bp, Pinus radiata
tgaagatgggaagatctccctgctgcgagaaggctcataccaacaaaggggcctggacaaaagaagaagaccaccgcctcattgcttacattcgagccaacggcgaaggcagctggcgttcccttcccaaggctgcagggctgccgagatgcggaaagagctgtaggctaagatggataaactacctgcgtcccgatctcaagcgtggaagcttcacagaagaagaagacgaactcatcatcaaactccactccgtcgtcggcaacaagtggtctcttattgcaggaagattgccggggcggacggacaacgagataaagaactactggaacactcacatcaagagaaaattgctgatcaagggaatcgacccccagtcccatcgtcctctcggccagccctacagcagcaacaatatgcccgtctctcggcctatttctgacctcgaaattcccgcattgcagaaccctagaacgccggagatagcagacttcttcggacatgatcgatcggaaaggtcgcgtgtcgagccggcggttttggacgcggaagagaacgcagacctcaacctcagtttgtgtattagcttaccgtctacctcgtcccctgccggaaacggcccttcgagcgtcgatagaaccgtggtttcaactcctacttctggcctctgactgttaactgcagaaatgttggaggggtggtgatatgatgagtgacagtatagataataagtgaccaattgtcaccaacacaggcattctggtcagtggcagtgaatatatcctaccattttaaatgaaattccatcctagatgacagggcacagataaaggcaatggatatctacaaattggatggctaaaataatcaagctacaagatctgagcagttgatggtggaatttccacatagcaaagagtagtgcaaaagcaaatgtattatactaaggtgtgcaagaagaacttaacttaaatgtattatattaaggtgtcagtcactacttgccaaggtgtaacatgcatggcatggtagtcaagttttgagtgcttaatttagatttaatgttttggttttgaaaaaaaaaa

SEQ ID NO: 702 - DNA, 1012 bp, Pinus radiata
cttggccataatgggacgcaagccatgctataatgcaaaagatggagtaaataaaggctcctggacagaagacgaagatcttcgcttgatccaatctatagaagctcatggtgaaggacgctggtctgctctagccaaaaatgcaggtctgaagcgttgtggaaagagttgcaggcttcgttggatgaactatcttcggccaaacctcaaacgtggtaacatttcatcggatgaagaagaccttataataagactccataaattgctgggaaaccggtggtcattaatcgcggggcgtataccgggcagaactgataacgaaatcaagaactactggaatactcgtttgaacaagaaagttcatggcaatggcagcattggcagattgaagtccgttagacggacagagccaaatgttaaggaaacggctgtgaatttgaaacaaaccataaacaccaaccagttgggtgaaagagacaaagttattgctcaagagttgaacaagggatcgacatcttccaattctattgaatccgaaaactcaatgtgtcccacgaaacaaaatccaagctcctatttacatgcaggtaccgtatcggcagagatgaagttgtggaatcagttgcaattaaatcttatccttccttcatcatggaccaattcgagtttcctgcatattgacgactctaatgttgatactgaggaaaatggccatccatattcttgtacctttgatactgtaaatgtctgtcaagattttattgaccagaggatgtatgcaatccctcacagttctttgccatcccctgaatttgtccccacagacacgatgggtgagtttgcagatttcttcaattttattccctatccatattgatctgcatcctggcactgcattcaaaggatgactgggaaagtacatagttgggtttcatcacctattgatgttttgtgagaccaggaagtgggaagctattagtgttcagctgattttaagagcctaaaaaaaaaa

SEQ ID NO: 703 - DNA, 1253 bp, Pinus radiata
ccgtggctgttcccaggagaggagagcctcagctgtctcgatctggccttaaggggttacagaagaagaatttcgaagatgggtagatcttcttgctattcaaagcaaggtcatagccgtgggatttggacccctatggaggatatgattctctctgaatacattcgaattcatggcagtgatggatggaaaaatatcgctaaacgagcaggtcttaaacgacgtggaaagggttgcagattacgttggttgaactatcttcgccccgacattaaacgtggtaacatttctcctgatgaggaggacctcattattaggttgcatggccttcttggcaatcgatggtctttgatagcaggacgactaccgggtcgaacagacaacgaaatcaagaattactggcacactcatatgagcaagaagttgtacccgtcaatgaacgattctcaaccaaaatcttcgcaaaaactcagaagaagagcaaaatctcctgttcctgtcccaaatcctgtgttcaaagccacagccgttagaataaaaccagccatgagacttcctggaattgtaagagaaaatggctataacgatgctggttccagtaatcttatatcgtatgaagccttcagattatgcaatgttaaagaaattaggaaatcttcatggggcgacctacttgtgaacgattcaatcggatacgaagaatccgaccttattgctttgggattggctgataatcccgtcgaaacatcagctacaaatcctctatctcctatgtggagtttagctgaccagcagtctcctcattacgatcattttgaggaagatgcagctactttagccgagagttcgttttatttgaacgagaagtcgtctcaagactgtaatctgctcccttctctgtccgactgttcaacaggttttacatcagaaggattgtacagagaaatggtagaactctacgataacgcagaacacgatgattggattcatgaatttggttatttagagaaatgaaacctgttgcgatcaaatgacgcatgggtggagggaggtttacacaaagttgagttgcaacatcgtgcggaaggaatgagctgtagacaaattcttgctggaacaccgtgaataaatccggtgatagggaatgcagtcaataaaattttacaaaggtttcctaaattgttcacacattgtaggtctattgcaatcatattaagtcaataaaattttacaaaggtttcctaaaaaaaaaa

SEQ ID NO: 704 - DNA, 1003 bp, Pinus radiata
cacaagaagatatcaagcaaatagttacacaccaagaaaatccacaatgggtagatctccttgctgcgcaaaggaagggctcaaccgcggggcctggacgaaaacggaggatattattctctccgaatacattcgaattcatggcgatggtgggtggagaagtctccccaaaaaagcagggcttaagcggtgtggaaagagttgtagattacgttggttaaactatcttcgtcccgacattaaacgcggagacatttccccagctgaggaggagctgattattcggctgcaccgccttcttggtaatcggtggtcgctgatagcaggacggctgcccgggcgaacagacaacgaaatcaagaactactggaacactcgtctaagcaaaaagctgctgctctccatgaacaaatctcaatgcaagagcaggaaaaatctaaagtcaaaagcaaaaccttctccaatacaaaatcgtgtcttcaaaaccaccccggtgaagataacaaccacagtgagactttctgggacagcaacaccaaatggctccatgaatggttatggccgcagtaatcctagttcagataaagcctccaaattgtgtaatgttaaggaaactacgaattcttccaagtcctggtgcgaacatcttgggatcgatacagacgctacaatttctaccagttctatgtcatcgttaccattagagagatctccacattcctattattttggagcagatgcagctcctttagccgaaagtttgttagatttgaacgagttaggtcttactgtctcggatgatcaaagaattgaagaattctatgatcacacacaacacttggattggattcatgaactcgattatgcagagggaccaagcccacagtcgctgagtttgctactgttggaatccgatgacgaaagggaggagaggctgggagaccatggacagatcccataagaaacaattaatgtatctgacttttatttaacaaaaaaaaaa

SEQ ID NO: 705 - DNA, 1003 bp, Pinus radiata; identical to SEQ ID NO: 704

SEQ ID NO: 706 - DNA, 1201 bp, Pinus radiata
gcacattttccggagatctgccacacagcttttgcttgcttccattgatactcgagcttaaagtttgttctgttcaagcatgaggcgaacaaagggtttgtcaaaaccctcagatggagtgctccatcgaggttcttggacaccagaggaagacaggattttgaagacgtacatagaagctaatggtgtgggacgctggagtactctgccccaaaatgcaggtctgatgcgacgtggaaagagttgcagattgcgttggatgaaccatctccgcccaaatgttaaacgtggtcacatttcagcagatgaagaagagcttattataagactccataatctgctgggtaacagatggtcattgatcgccggaagagtgccaggaagaacagacaacgaggtaaagaactactggaatactcgtttgagcaagaagctgggcagcactggcgacaaccttgcacggtcactggctcggaggcagattgctaaggcaagtccacgaatcggcgtggacaacgacgctgcagtacatctcaactctgaatcttccaatttcaagtttactccaagcctcagatcgccaacgggttccaccattgtccctgaagaaactcgctcagatattcagttaccgtcaccggaaagcaacaacgacggcgaccgaagaaccacagttgagaaagacgacacaccgcatttagaaccgttggatattgctcagacaaacccctgtggagtacctccgccggaagaaattgggcagtgcagtgcacaagagagcgggtttgtggaacaaaatcatgatatgaattcactaggcaaagaacagagccctgatttttcctctacgccttacaatacttgcttggattctctcctctggtttaactattctcccgagatggatgatctgtttcactgcgattacgaccaggaaacaagcttctcagttagttttagtgaccatctccagtatatttcatttgggtcacagttttggggagacatgatcagttgaagtctaagtacagataatggaggaaattaataaacagatttcgctgcagttctatggctatagcccttcattttttttttggttcttggtggtcatgatgatcagtatcatgtaaatctaataaattaacccttccgggtttcctctaatgtcgaattcagcttcccagccttaaaaaaaaaa

SEQ ID NO: 707 - DNA, 1793 bp, Pinus radiata
cttatcggaagccacaccaaaccaaatcagaaataatgggtagggctccctgctgcgaaaaggttgggctcaagaagggcccctggacgcccgaagaagatcagaaactcgttacttacatacaggagcatggccatggcagctggagggctctgccgcagaaagctgggttgctgagatgcgggaaaagctgcagattgcgttgggctaactatctaaggccagatatcaagcgggggaagttcactgtgcaggaagagcagactattattcaacttcatgcactacttggaaacaggtggtccgccattgctactcaccttcccaagcgaaccgacaacgaaatcaaaaactactggaatacccacctgaagaagcgcttgctgcagatgggaatcgaccccgtgacgcacaagcccaagtccgaatcgattatggtacctggtgttcagtcgtccaatgggtcctcgaatctgagccatatggcgcagtgggagagcgcgcgcctggaagccgaatcgaggctggcgcgcgagtccaagctcagggccaggggcctctggtctgcccagttgagaaacgttaatgcgagctcggatttattcagccgattgcggagagccagtccagggttcgaatccgatagagaggaatcaaagattcccgggttgagttctcctctgggctttgattgtatgaaaataacacagaaatgggacaagttccaggatttgaggtcgggaaccaagttagaccagtgcaatttgtcagtcttgggaggttcactgggtagttatactccactggagaatgaggaccgagctagtaagacgagctatttgggccttctgcaacaagctatgtgcccttctgctcagggcagcaaaattctgtttaatgaggccaagaagttggtggagagccaaaagaaccgacagactaatgcaacggccacacttcactggtctacttatcacatagaccagtctgagaattgtgatgagaagaaaccgaccatagtttctgagaaagctcacagcgatgttcagagctgcagccatgaagaaaatgtcgagccagccgatagccatcacgagcttttgctgtcctctgttatgttaaatgacgggaattgctccagtgcgaggtcagacgtgtctgagctcaccaaaaccgaacaaggagctgatgccagttatgataaagtcggaaattctgataatatcctcagcgagtttcaacacattcattatgatgaaattagcagcagtggtggcctgaagtctggttcgagctacgatggttttaatgctgatatgcttttagatctggtagtaactccccctaatggttattctaccgctggctgtggcgataatcgatccctgagcggactgtctgttgacgataataaagaatactggagcaatatgttcagtgtctgtaattctcttcctaatggcaaccacagtggagttcagggtatcttctagggtgattttattgtctaaaattaggtcgagatcgaatgaagccgtgctcagttttgtagacgagaatttcaatattttgtaacacagtcgtttggtaaactgtgaatggtatccatatcttcattctgggaattgtgcgttgcgcgctgtgtgttgtgtgtgtttttggcacactgtctgtaattgcaaactgtgttcagcatcgtagcagacaagaagtgtttctaactgaaagggtggaatttaatcccttataagttaaagcttgaatccatatatttgttgggaataaaaaaaaaa

SEQ ID NO: 708 - DNA, 1362 bp, Pinus radiata
ggacaacacactatatagatttataaaattatatacagaggagatatccaattgcaggcagcttcccttctctttctcggcccttattttattctgtctctgccagaatcttctccagacaatggccaggccttgaggcttcagaaccatcctcgaatgtggaaaattcgacgattctgaagagcttatactctgtctcttctcagatcctgttggcaaaaaatggggaggcaaccttgctgtgacaaagtgggattgaagaagggtccatggactgcagaggaagacagaaaactggtgaattttatcaccctgcatggccatggatgctggcgcgaagtacccaaacttgctggtctgcttagatgtggcaagagttgtagattgcgttggacaaattacttgcgcccagatttgaagcgtggattattgtctgaatcagaggagaagctcatcattgatctacatgctgccatagggaataggtggtcacgaatcgctgcgcaattgccagggagaactgataacgagatcaagaattactggaacacgaggatcaagaagaaactgcgccagatgggaatcgatcctgtgactcacaagcctttcacccaaatgcaaatgcagagcacccctgcccagactctgctgctgcaagaaaatgatacagagcagcagcagcaggagcaacataatgagcctgatcctgatcagaatcagagcagcaatggcactgtggagacattggtctcgagggcgagagaaccccacgacgacatagagcctctgcagaatttcaacatggaggattcgaattttaacatggaggattcgatgcaattgttcaatgtctgctcgcccaccagcggggtaagcctgtctgggagaaccgaggaggtcgattcagatgattctgatcaggtctccaagagcttcggcaatggcagcagtacccattctcagtacattgggcgagaaacctctggtgtcaaggccgaatgtggtttgtctggttgggatcagatggctggcgttttgggcgatcccctttctgagtggaatgtcgatttggaggcctgggctgctggattggatgcccctgcggcctctgcctctgcatggattcagcagctccctgactgccaatggaacgacttccaaggcgattttgagatctgcagcagcaagtcatgtccggagactctgcaaagactggggccctttcttgatgacgatgaattgtgaaaaaggaaatccaagaatctctttgtttctctcagaaagacactgtacattaaccaagtaaatatggaggaggaggatgagacctaatagttaaatatatttatataaaaaaaaaaa

SEQ ID NO: 709 - DNA, 1793 bp, Pinus radiata; identical to SEQ ID NO: 707

SEQ ID NO: 710 - DNA, 1737 bp, Pinus radiata
acgagcgggcgcggccgggtgtgcgcgggcgtcgttgggcctggatacaagtagcctggatcgcgtaggagcaaacggggctgttgtgctgccgaaactcgaatcgatatgctttgtggccggttcaaatatttgagctggcttagcttctctggttcagaaatggcggactaaagtaatagtgtgccccgaggtctggtgttcgaatctcgttggcgtgaaaggtcaaatttttctctcgagtttcattgattctgaaaaactggcatagctatggcgatgagcaatgggagattgtgtgaagatttggataggattaaggggccgtggagccccgaggaggacgcgtcgctgcagaggcttgttcagaaatacgggccgaggaactggaccctgataagtaaaggaatcccggggcgatccgggaaatcgtgcaggctacggtggtgcaatcagctgagccctcaggtggagcacagaccttttaccccgtccgaggatgctgctattctgcaggcccacgcgcagcacggcaacaaatgggcaacaattgcccgagccctccccggccgcaccgacaacgcgatcaagaaccactggaactccacgctacggaggcgctgccgggaccccgaaaagggcatcgttgtccacctggacgacgaaatcagcagcttagacgccgctcgcaagcggagcagcgacggcttctcccacgatggcagcagtgcgctggaggacaacggatgtagcagctgggaagtggactccaagcggctgaagagactaggagaactgggaacagagcagggccccgaggttgaagccgaggtcgaggtttcggaccggagcgacgccaacccgggacgcgtgctgtacaggcccgtgccggtcgtgtcttttttcagttcattcgggaaaaccgttgcgaatctacaggaaacggcggccggcgcagtcggtgtcgatccgccgacctcgctgagcctgtcgctgcccggactcgatcccgcgatcccctctccgaagctgtccactcaaaaggactctcacaacaatagcacagttaataacaatattcctattccgccggtggtggaatacatgagagcagacgaggcggtggtggagcgactcagcaccgccgtcaaggccacggtggcaagcatgctaacgcctgttctgaactcgtcgccacgtggctacaacccaccggctgtgagcagcgaccttctggcgctgatgcgggatatggttgcgaaagaagtgcagaaatatatgtccagtcatcaccagcccggcatgtacacaccgctctccccccatcccgagttcttgggagccgctaatctggtgagaaatgttgttctcggcggcgccctgcatctacaacaaatgacaatctcgagttgcaggtgacgagttcgagtctcgggcgcggccgaagggcgcgtgagaaaccaggacctcccacaactttcaaccgaggactcgaaactcaggaatcatgtcgtgtctatgcataataatttttggaatgagaaggtggctgagtgctgtatagagagaaaggcaacgcctacttgccatccacactcggccgttacaataaaattttaagcagcagccattaccgaagttgaaatttgctgctgataatagtgtaaagcaaaccaagcaactttttctgctgagaattttaaagttctggaaaatcccttgaaaaaaaaaaaaaaa

SEQ ID NO: 711 - DNA, 1234 bp, Pinus radiata; identical to SEQ ID NO: 331

SEQ ID NO: 712 - DNA, 1737 bp, Pinus radiata; identical to SEQ ID NO: 710

SEQ ID NO: 713 - skipped

SEQ ID NO: 714 - DNA, 2036 bp, Pinus radiata
gcttgatattgcaatgggacgccacttatgctgcaaccagcagaaagtgaaacgtgggctatggtcaccagatgaggatgagaagctcatcaattacataaccaagtatggttatggctgttggagtgaagttcctgagaaatcaggtcttcaacgttgtggaaagagctgcagattacgatggatcaattatttgagacctgatatcaggcgaggtaatttcagtccaaatgaagagaagcttatcatccatctgcacactatggttggaaacaggtgggcatacatagcatcccatttacctggaagaacagataatgagatcaaaaactactggaactcttggataaagaaaaagcttgctaaggctgaaataatctcaaagaatattgaggcttccaaagtacataataatctgccccagttcttgttcgaagaatctgcaactctgggcaatgaaaacaagctgctaaagtctgagatgaatactgatgggcatgcagctcctcagagccatgttctcccttcaaaggaaacttgtgaaacttttccattatgggattataagatgatcaatcattcaaccgcaaggaattctcaatatgagatggaagacagcaaaactgctcttaccatcgatagccttctaattcgcacagattcagaaacaggacctattagagaattcaatacttgggatccttctggaattctgactaactctagcagcaaaaactgcaaaaacagtgatttccaatatatattacaacgggacaatggccagcaggttcaaggacttccagtttcaaatacatggcatggctacagtagcttgaacccaattgaagggtccttttattacaatccaaattcagaaagcagtaatgcagttcacacaacatcttctataaatgagagtgacttcatgagatcgctggatatggggccattaatttattctcatcatgaaacactggatcctgctgatcatgctaacgtagccacaatgtgggaatcgggttccagccctaatggggttgatttaggttattccgagtgcctatacagtggtgaacaatacaaccatgccactgaaaacagttgcagctatttgcctccactctatgatgtcagtgaagaatctgcagccattgatataaaacacagtggcaacaattcactgagatatctggaacaaatccaaagtaatgagatcaatatatcccaagaaatggatgccattcagcaaatatttgagcaaaattcaagcctagttacaacaattcagtattgcttgggatctcattctccagtgtcagattctcatcatcttcaccatcgtcctcaagatgcttttgattgatctcaatcgtcaccacagacttcagatcagctcttcttctctcacagcgtagagctcctggtagtacttttactggtttgttttgggtattctagggtttttactgtctcaacatacgttcaagcaactgtccagactacgtacacgttattcatgatttactagaccctgcatccctaatcactgcatggtatttacctcttgaaaccttgttctataaggatgccatttttcctttgttcaactattaccaaattgatttattcgtgttgaatagttaatgttaccaagaacgttgtgtattggctttctcacttaccggactgattttacgtttagggattctacaataagattgttcgtgcagatattctgccataagtttcggtcattttgtcaatattaccgtatatttgattgcaacgggtctgctggtactgttgaataaagcaaatattcagcaactctctgtacatgcagttcagttcaataagaacaaaacatgtaatgactcaggcagtgtgctattggttgtctcatctttggcgctagtcaatttccgaggtaattgccctttctattgtaaagaagctgttttgtaatagcaatctgttattctgtgtgcttctgtttgaatggaataccagaaaaaagagctttttctaaaaaaaaa

SEQ ID NO: 715 - skipped

SEQ ID NO: 716 - DNA, 1085 bp, Pinus radiata; identical to SEQ ID NO: 701

SEQ ID NO: 717 - DNA, 1085 bp, Pinus radiata
cttcgctccatcttccatttttgttttctgacaaccttttaaacatgggaagggcgccttgctgctctaacgatgacagaaacaaaggagcctggaccaaagaagaggatgacaggcttatccaatatattaaggttcatggagagggttgctggcgctctctccccaaggccgcaggtctgcttcggtgtggcaaaagttgcagactgagatggataaattatcttcgccctgatctcaaacgagggtttttctccgaagacgaagatgatcttattctcaaactgcacgccctccttggaaataacaggtggtctttgatagctggccgtttgccaggacgaacagataacgagataaagaactactggaactcgcatctgaagcgaaaacttatcagcatgggaatagaccccctaacccatcgtccttttcaaaagacttctcaccatcatccctctcctccacagaatgttagagaggctgaaacaacaccttccattgggattgttcaagatttctttcgttgcccgtctgaacttagcaccaaatccgagcaaatttcagatgctgcaagcggactcgcgcaggatgagcaaccccacccgaacctgaacctgaacctggagctctcaatagctcgctcctcagtccatcgagtagcagagaaggaggacgttgttaattcccagcaaggcgaaagcaatctgagtgagggaaagtgatatttatgtcattatggagactgccctccccctccaatgcaacactgagatgatataaatgtccctttcccgctcaccaaagccctacggggcaataacgaatacatgaaaaccgtttggctcatagcaagtctagttttcaacacttactattatttaaggaacgtaaaaagtgtccagttcaattgatgtattttgtgacattttgctttgttagtcacttacacatgctacaagttttgttggtcagtcacctcacacttttggtgtgaaaaatggcttcaaggcttcctttgtatggataccagttgcattggcaatatgtaaaaatgcgacatgtaatgttttctaaaaaaaaaa

SEQ ID NO: 718 - DNA, 1370 bp, Pinus radiata
acggttcccaatccctagtccctgcactttactcgtctctctgtgaagatgaggagattgcgctgtgagaagggtaatacgaacaaaggggcgtggacccaacaagaagatgcccgactcatcgcctacattcgagcccacggcgaaggcggctggcattcccttcctagggccgcaggtctgctgcgatgtgggaagagttgcaggctgcgatggttaaatcacctgcgtcctaatctgaagcgtggaaacttctctgaagaagaggatgatctcataatcaaactccacaaccttttgggcgataagtggtctcttatcgcgggtcgattaccgggccggacggaaaacgaaataaagaactattgggatacccacattaagaaaagaaaattgagcagggaactcgacccccagtcccatcgctccctatggctgcctgacaatggcagcactaccctcagctctccgttcgctgacgaccacgaaatctcggctttgcagagcccgagaacggcagagacaacagacttcttccaaccagaccagtcggaaagctcgcggatcgagcccgccgcctctgaaaatgaagagcatggtgatctcaatcttgatttgagtatgagcttgccatcaaagtcgccccgcactgaaaacagagttttgagcgtggatggaaccgcggattcaaattttaattctggttgcggactgtttcgtgtttatatttaggtggggatgtttggttattaggaaatttgatctcggttcaattttagacaggactatatacgactgaaaaatattctagacataatttcttcaaccacaaataaattttgacaaaaaccgaatattgtgaagaaaatcatagcagtttctctcacagggacttttatgtacgactgagagatattgtggacataaatttgtcagcgacaaataaattttgacaaacgctattagagccagagattgtgaagagaatcatggctgtttctttcacggggattgtttcatttacagggttgggctatagcctcggggccattcatggactattaggattttcaattaattactcatggtgtccacaagactgtgtccaaatttgttggtttcttgtgatgacaagcatgcagcaatctccatggatgtctccatggatgtcaagaatgtggacgatggtaagatgatcatcgtgccaaaccaaaccagtaacgatgacttgagaaatacgttctttgtatgtaacgtaaatatggacaaaactagtccgtattttttgattggaaggttctccgaaagcggttaggaatcgttctagtttttttttaatatatcataataagtttgagttaaaaaaaaaa

SEQ ID NO: 719 - DNA, 1273 bp, Pinus radiata
gcattattctgtctctctggcaagatggggagaactccctgctgtgaaaaaggtcatacaaacaaaggcgcgtggaccaaagaagaggacgatcgcctcatcgctcacattcgagcccacggcgaaggccgctggcgttcgcttcccaaggccgcagggctgatgcgatgcgggaagagttgcaggctccgatggataaactacttgcgtccagatctcaagcgtggaaacttctcagaagaagaagatgagttcatcatcaaactccactcaattatcggcaataagtggtctgttattgcagcaagattgcccgggcggacggacaacgagatcaagaattactggaattcgcacatcaagagaaaactgctgagcaggggaatcgatccccggtcccatcggcctctctgccctcccagcaacactacctctctgtcttggcttgctcctgaccgcgaatttcccgcaatccagaaccttagaacgccggagataacggacttcttccagcacaatcggtcggaaagctcgcctatcttgccggcagcaccggatgcggaagaggatccccacctcaatttgaatttgtgtatcagtttgccgtctaattcgtcccccgccgcaaatacagctcagagcgtccgtaaaactgtggattcaaatcttaattctggcagcgacgaagtctgttatcccgtaggactgcaaataaattatgggaagtactgcgacagcggatactgtgaacagaatgcgagctgtttctctcaatttaggcttgtcttataagacaagagcagaaaacgatggattccttattaataggactcaaatcttttaaatatccatatgatagtaggcgcaacagaatggaattacaggcataccaactgtggcggcttttaatttgcgctcaacgtaaaaacaaatagagagggacacagatgggtagttatctgagcgttgcagcgacctgcaaaaagtgtgcaggagttgacagaacccacttcacatgtatgcttatcaacattgcagtggatactggcctgctgcaatgtgttgttctcgactccgtaattaaggtgtcatttgctaattggataatatgatcactgcttatttaaaactttatcctttgtactttaatgtttgtttttatttgaaaacttccttaagagatttgtaattcgtatgtaaatttgttgttttctttatttaaaaacttcattaaatcattccagagtttttaattaaaaaaaaaaaaaaaaaa

SEQ ID NO: 720 - DNA, 1379 bp, Pinus radiata
tccaatggaatgcttctctcctccatcattggtcaattcatgtacctcacaacaggccaagaaggaaccccatcttttcaatttgccactcattttcatacttgggcaggataagttgagaggaccaaatagttttttgactggggtgtggaattgagatgcctgcaaacatgtcaaatggagagtggaccagagagcaggataaggcgttcgagatggcgctggcagaccatttggaagatacaaaagataggtgggaaaaaatagccttggcggtgccgggaaaaagccctgctgaggtcaaacgccattacgaaatccttgtagaggacattgcctccattgaagctggtcgtgtgcctattccatgctatgtggatgaagttgcagagcaagctgctgataatggaagcgccaagaaagggggaacccattcttctgtttatgcgaatctggcatctgaaaataatggaacgggaaaggggagctccaaatccgaccaggaacgtcgcaagggaattccatggaccgaagaagaacacaagatgttcttgcttggtctggaaaaatttggcaaaggtgactggaggagcatctcaaggaattttgttatttctcgaactcccacacaggtggctagtcatgcacaaaagtattttattcggttgaattcgatgaacagggacagaaggcgatctagcattcatgatattactagtgtgaatgggagtgatgtatcatcaccacagggacctataactggtcaaggaaatcaatcttcaggatctgcagggcaatctgctaatcatgcttctcagccagggcttcctagtgtatatggagctactgttggtcagcccattgctgggcctatggtttctgctgttggcactcctgtaatgcttcctccgggacatgctccttatgttgttccagttgcttaccctatgccacagccaactatgcatagataactagagagaaggagctgagcactttggactgcaaagcttcatttgataatatgtttgttgtcatcgtatcaataggaaatgatgcatgtcaactgatcttctaaatgctgatcagttggtgtatcattgctcaatatgcaccttttcctgtgtggtatgaaagagatcttttcttcctccactaagattgccaaagtggaggacgttaattttcttgcaaagaatgattttgatggttgcaaagaatgattttgatggggatacatgtaagaaaaaactcacagagttgctattcttttattatttcctttcttcagtcaaaatcagaaaagagaaagcctctggatacagctagcaatattatatgataactgttaccatttggcgcagaatccaaaaaaaaaa

SEQ ID NO: 721 - DNA, 1884 bp, Pinus radiata
gctgcaaataaaataaaggaagtaaatttctcagcgcgcgtgcaccgtcgctaaacatcccgggcatataaaaatatcagaaggcggtgcagatgcaaagagccaaaaaccccaaaacccttttcaagattgcgtgtcaacccacttatttactcttcccggtcagagatttacccattttcgcctcgattgtccgaagggtggagatagtttgttcgaacgatgaaaaccagctaaaacaaagcgcagggattggcaggattcgagcactggtctcttggggcggagttgatagaagaagaagaaacctaccatatacacatacatatattatatacatagacacatgggggctccgaagcagaaatggacttccgaagaggagggagctctcaaagcaggtgttgagaagtatggcactggcaagtggcggaccattcagaaggaccctgagtttggacactgcctcgccgctcgttccaatgtggatttgaaggataagtggcgcaatatgagtgtgagtgctagtggccaaggttcaagggataaggtaaagactccaagagtaaaagctattgcctctctgccttattcatcagttactgctgaatctacttctgtattctcaatagaagcaacaacctcaacaactccagataatcttatttcccctaaaagttcatcaaatgggaaaattcactcaccaaggtacgatggtatgattttagaagcccttacaagtatgcaagatccaaatgggatagacattgccacaattgcaagtttcatggaggagcgacatgaattgccccccaatttcaagagggcgcttggcacaaagctaaggcggttggttgcacaggaaaaggttataaagattcgcaatagttacaagctcaaagatatgacatctacagaagtgacatctgaagtcttgggatctgcaattccaattgataattcaatgcaatactctaatgcattcaccaatacaattgataccttttcagtagatagagtaaatgaagcttcaatggctgctgccatgaaagtggccgatgcagaggccgtgtctgccatggcagataaagcagtggaagagtctgagttagctgcaatgttagcagaggaatcagatatgatttttgaagcagcatctgaagtatttgaacaattgttgcaggatggggtgcttgtactttcttaataaatatgagttgccgcaaatgctctacattccagagtgagcccttttcagcagttcaggaatgcaactatgtacagaattttgtcattggtaatgtcaacatggcatagagctttggttgcaaccagtatgttcttgcaaaatttaggggggtctgcttcctttccaagctttgccactcagtatttagttaattaagttgttgcactgatgttcaaagggatttgtcccttgcttttttaattctaggtttaatcttgacattaacggtgctgttttcctttttaattgtcagaatccagtgtttggaaaaaactaattgtatatatgaagagaacgggtctctgttctttacgtctaagattcttggaacgttccacgagtgtataaagaaatatcttgacagtcaccttaaatttctgtaagctagttctttttttttgttgcttactaggaagaaatgctccactgacttgtgcttcaacatatcagggaatggtcgaggggtgatgaacacgtgtcagtgttttaaaattattggaactgcagggttagaaaggaacatataatcaatcccttcattaaatgcatctactagtttgtggaagttattttattttgattttccctttttaaatagtatctatcaaagtttgctgtcatcaagtaaaaaaaaa

SEQ ID NO: 722 - DNA, 1943 bp, Pinus radiata
ggtcacaggccagcatgcccaaaaagcatgcggaaaaagcagcggaaaagacgagcggatccaaaaatatttcatgtacccacttatacaaagccaccaataagaaaaccccatttcactaaatccagtattgcaagcgcccacaagcccagaacggcataagcactgacaaaggattttaagatctgtgcgatgtgggatatggatttgccttcccaagggtcaagtttgagttcatctggttcagtttggactatacaacagaacaaaatttttgaaaatgctctagctgattttgataaagacaccccagataaatgggagaaagtggcagccaggctgcctggaaaaactgctacggatgttagaaagcattatgaagatctcgtggaagatgttacttgtattgaagctggccgcgttgccctacccacgtacagtaactcttcctgttcacatgaatggttagaaaaatcaggcgctatgcacggattgaagcaacaatttgggagtggtgggaggggacaatcaacaaaggcatctgaacaggagagaaagaagggtgttccctggactgaagaagagcacaggcagtttttgatgggccttcgcaagtacggcaaaggcgactggagaagtatttctagaaactttgttgtgtcaaggacaccaacccaagttgccagccatgctcaaaagtactacattcggcttggttcggataataaaaacaagagaagatccagcatacatgatatcaccactgttcatggtacagacaggatgccttctcctttactgcacgtttctaataggcagactaattccccctcaacacaggcagaaatgaatcattcaccatgtctgacatatccatctcagatttcacgaggacctctaataaactctttgggacctcaaatagatggtaaccttctattttcacctcactatcctctaaatctgtatacccagagagggtttgggggcctttctccaagaactatcattcctgattcctctatagctatgcaccactcaggatatcctgggcagtctgccatgcaatattgatgaaaggaaagggagtgaaccaacaggatcaccgttgcattaatatgtctagttctaggtcaaatgtgcagttaattttcttcttctttcttctcactttgagaaaattcttgtgtcctgtaaatatgcaaaggatagcagaaatgatggggtcagcttttgtcatttttgcatattgttagttatgatctatatttgtacactagtccatattttgtacactagcaaacatccgaatactggactgcagttctctttgttgctccctaagcaggcactagataaagaaccaagaagtattcattagacatatctcaagaatgaaagcaagttggtgaggttctagatgcaggatcttctggttcacaagattttcactatacatctggtacttcagctagtggggatccattacagtatgggaactctcaacatcattctaccacagatgcagtgatgttgcataattcctctagtcagctcaaggatggttgagtttaggcacagtatattggagttgcaggttcagaagttaaggggtagataaaaacatggacagctatgtgaaaaaggaattcagtctgaacctgctctgtcttcacaactgagctgcggctcaaataattctttttcgatgtatacaaaaaagacctttcgtccagcggcttcttctctattagctgtggctcacaattgtggggtgtatggtacaatttaaactcaaagtggtgtttgtggcatgtcacactctttagaccgatgggcttggcttgtaagcggctgctctgcagttatcttctgtaatatctttatgtgatgttcgcggtgggaataattttattttggaataaccttgtttaaaaaaaaaa

SEQ ID NO: 723 - DNA, 1023 bp, Pinus radiata
ttgagaatgggaaggaagccctgttgcgataaggtcggattaaagaagggcccctggactgctgaagaagacaagaagctcattaatttccttgctactcatggccaatgctgctggcgcaccgttccagagcttgccgggctttcaagatgcggaaagagttgcaggctgagatggacgaattatcttcgccccgatttgaaacgaggagtcttctcagagtccgaggagaaacttattttagatcttcattcgcgtgttggtaacagatggtcgaagattgcctcgtttctgcctgggcgaaccgataacgagataaagaactactggaacacccacatcaagaagaagctgaagcgcatgggactcgaccccgcgacgcacaggcctatttcagaaacactaccacagccagcccctgtagctgagaataatgatgtacccaagaataacgaagcaggaggcctcgtgaatccttcagaggacgaaaaaccgatccagcaagaacttcaggccagctctgtcctgatgaaacacgtcaaggaagaagaatctgaacaatccagttttccatttaatgcagcaaatactcaaaccacatgcaaaatggatgaggaacttcaagttcccgagatgatgaacgctcagacgccactgttactacatgcagagtactggtgggattacagtgacattgtcgcaggtttcgccgaaagttcacaagacaacattaattcctgggtaaatcctgaatcaatagctggtcacctgttcgaaacccagagaacagtagtccctgtaccggaatcatcgaactcacatttatttctgcaatcactagattattttccacaggggacctcaagtaaaatatttcccctggacttctaacattatcattctttttctgccgaaaagtgatgtaatcctttgttaataatagcctagtaggactcaacctagcttaatttacacattccattcaatttgcttaataatatcatatttatgccaaaaaaaaaa

SEQ ID NO: 724 - DNA, 1502 bp, Pinus radiata
tagcacgaattgcatgtgtatatccatctgcatctctctatccatcagttacacagtatcttaaaagccctactcggggcatatcacgggatggtatgcaagtagaagtgggcgtttaggttttggcagcaggaattctgtcgtggcagtgaaaataatttcacggcttcagtagatgggggcgccaaagcagaaatggacacatgaagaggaggctgctcttaggactggggtggagaaatacggacctggtaaatggcgtgctattctgagagatcctatattaagctcgtgcttgtcatcacggtctaatgttgatctgaaggataaatggcggaatatgagtgttactgcaaatggttggggttcaagggaaaaggcaagactggcactcaaaagaagcaaatacattgcaaagcaatctggcaggcaacttgcgcttagtgcattgagcaatggaaatatggatgttgtggttactaagcccttgtccactgtcaatccatattttccaagctcaaataccaaaagatctatttcaaggttagataagctgattttggatgcagtcttcacattgaaggaaccaaatggatcaaacaaatctgcaattgcaacatatattgaggagaatcaatatccgcctccaaacttcaggagaatgttgtcatcaaagttgaaatcactagtaatatgtgggaaactggtcaagataagacaaaactacatgataaatggtagttttcgtccagatgatgagaaagtccccaaaaatgagaaagtggaaaagcatgtcacaacccttagtaagaactcttcaaaaaaggtggtaggggaagttggtattgcagttaaatctgaggttgatgcagaagtttctaagatgagaaggatgaatgccgaagaggctgctaaagcagcggctgttgctgttgctgaagcagaggcagctatagcagcagcagaacaagcagcatgtgaagcagcggctgcggaggctgaggctgaagctgcagaggcttttgcagaagcagcgatgatggcactggtgaactctagaagttgttagtagtcatcttcaaatgatgagggattttgttgtgccagttttacagtgctggtgaacatttgctattggatagctcttgatagcacaagttagacagtagttccattatcttattgttttcttttgggcagtggtacttctgaacagatgtgaggtcctgttgtagaataaattttcatttgatcttgtaattatgttcattagcttttctcagcaggaggtgtattataaaaattccctttttcctgcatggtaaacattctcttaggtggttaaggatggaagcacttcttattgacttccctgtacagttcatacaccatgaatatttcgtattttcaagcaactgatgagtttagcttgttttcagtgtacctttttcatatcgttcaatgaaactcactagctgggcttagttaaaagaaaaaaaaaa

SEQ ID NO: 725 - DNA, 1136 bp, Pinus radiata
ggctgttcccagaagaggataccatcagctgtccagtttgtcctaagagactacagaagaagaatatagaagatgggtagatccccttgccccccaaaagaagcgcttaaccgtggggcttggacaggcatggaggatacgattctcaccgagtacattcgagttcatggcagtggtggctggaaagatatctccaaaagagcaggtcttaagaggtgtgcaaagagttgcagattgcgttggctgaactatcttcgtcccgatattaaacgtggtaacatttctcccgaggaagaagagctcattattcggttgcatcgccttcttggaaatcggtggtctctgatagcaggacgactgcctggtcgaacagacaacgaaatcaagaattactggaacactcatatgagcaagaagccatggctgtcaatggacgaatctcagtccaatacttcgcaaaatctcaaaacgaggtcaaaatctccggttccggtccaaaatcatgtgttcaaaaccaccgccctgaaaataaatccggcagcgagattctccggaacggtaagtgcagatggctacagcggtgatggctgcagtaatcatatatcaaatgaagccttcaatttctgtaatgttaaagagactaggaaattctcatggcgcgagctacttatgaatgattccatcagagacgaagaatccgggaatactgctttcgcaactactaataatcccgtcgaagcagaagccacaaattctctctcttttatgtcagatttagctgaccaggaatctccaaatcgcgatcattttcagggagatgcaattactttatccaatagtttattgtatttgaacgagaaatcatttccaaactgcaatctgctcccctctccatccgactgttcaacagattttgcatcggaagaattctacagaggaatggaagaattctacgataacgtacaagatgaagattggattcgtgaattcgattattaacagaaatgaaacctactggaacctgccgagcaatgggagagctacagacgaatttgaggtagaagaccgtgaataaatcccatgacaggacatgttatcaataaaatttatatgaggaattttgtctaaaaaaaaaa

SEQ ID NO: 726 - DNA, 1257 bp, Pinus radiata
agcgccgtggctgttcccaggagaggagagcctcagctgtctcgatctggcgttaaggggttacagaagaagaatttcgaagatggttagatcttcttgctattcaaagcaaggtcataggcgtgggatttggacccctatggaggatatgattctctctgaatacattcgaattcatggcagtgatggatggaaaaatatcgctaaacgagcaggtcttaaacgatgtggaaagagttgcagattacgttggttgaactatcttcgccccgacattaaacgtggtaacatttctcctgatgaggaggacctcattattaggttgcatggccttcttggcaatcgatggtctttgatagcaggacgactaccgggtcgaacagacaacgaaatcaagaattactggcacactcatatgagcaagaagttgtacccgtcaatgaacgattctcaaccaaaatcttcgcaaaaactcagaagaagagcaaaatctcctgttcctgtcccaaatcctgtgttcaaagccacatccgttagaataaaaccagccatgagacttcctggaattgtaagagaaaatggctataacgatgctggttccagtaatcttatatcgtatgaagccttcagattatgcaatgttaaagaaattaggaaatcttcatggggcgacctacttgtgaaccattcaatcggagacgaagaatccgaccttattgctttgggattggctgataatcccgtcgaaacatcagctacaaatcctctatctcctatgtggagtttagctgaccagcagtctcctcattacgatcattttgaggaagatgcagctactttagccgagagttcgttttatttgaacgagaagtcgtctcaagactgtaatctgctcccttctctgtccgactgttcaacaggttttacatcagaaggattgtacagagaaatggtagaactctacgataacgcagaacacgatgattggattcatgaatttggttatttagagaaatgaaacctgttgcgatcaaatgacgcatgggtggagggaggtttacacaaagttgagttgcaacatcgtgcggaaggaatgagctgtagacaaattcttgctggaacaccgtgaataaatccggtgatagggaatgaagtcaataaaattttacaaaggtttgctaaattgttcacacattgtaggtctattgcaatcatattaagtcaataaaattttacaaaggtttcctaaaaaaaaaa

SEQ ID NO: 727 - DNA, 1153 bp, Pinus radiata
gatgggaagatcttttagttgttggagctgttcaaaagataatggccacgagcgtcttaatcgtcgatcttggactgttgaggaggatacaattttgagtgaacatatcaaaactcatggagttggtcgatggacatctcttcccaagaaagcaggtctaaaacgatccgggaagagttgcagattacgttggtttaactatcttcgtccagaaattaagcatggaaatatttctccggaagaagaggaactccccatcagattacatcgtctccttggcaatagatggtcgttgatagcaggacgacttccacgtagaacagacaatgaaataaaaaactactggaatagtcatttgagaaagaagattgaaatgggtgaactcaagccaaagattcagaagcccttaaaaaggtggggcataccttcttactttgattataaagaagagcaggccaaagctaaagataattgtatctctcacactacacccgtgatgaaaagggccgtcggacattgtggaacagtaacttcagatgtcgaaaattataataatgataattatgatctcatacataataaccttgaagccattaatccagaagaagaaggcatgaaagcagcaaatgatcatgtcatggaaatagatgcctctaaatcacggtgtcaattactctgggagaattgtattggtaatgataagaacgatggtttcgaggtgaccgatggccttcaaccaaacagcattgtaagaacccataactttggaatagaacatcatctacatgaccagttctgctactatacgaacaattatgaaatacattcttcttacccttccttttttgaagaccaggaattccctcactccaagcattttcattccacatctttcgagagtttattagatttgagcgagcttcccttctttccccagtagattataatatcttatctgtatgcaataggtcatctgagaagaaaattctcaatactatatccaagtggaagactaactcaactatcaaggggaaattggagtgccctagagttttctattctgcacatgcttttatggtaataagatattgttttcagacctgccattgtggttggtggcatttggctttattcttcggtttttgctgtaaaa

SEQ ID NO: 728 - DNA, 1461 bp, Pinus radiata
agcaccacgcggttttggattctccctgttctttgttctgttgcgttaaagattggttgcaggtcgaatcgcccaggccgatttgaattctcctgaggattgacaagatgacgcgcaagtgctcgcactgtggcaacaacgggcataactccaggacgtgccctaaccgcggcggggtgaagctcttcggcgttcggcttaccgatggcccgatcagaaagagcgctagtatggggaatttgatgatgatgtccaaccctagctctcccgctgacccctccgagccggcctctgccgctgctgctgccgcggcggcggcggccagtggctatctctctgatggtcttgttgaagcctccacttcctccaattctcgcgagcggaagaaaggtgtgccatggacagaggaggaacatagaatgtttttgctaggtttgcagaagcttggcaaaggtgattggagaggaatagcacggaattttgtcataacacgaacacctacacaggtagccagccatgcacagaaatattttattcgacagagcaatatgactagaaagaagagacgttccagtctgtttgacatgacgccgcctaataatggtgccccgttatcatcacagccagcttcggatcaggaatttgaatcaaattattcggaaaagactgcagaagcggaaaactctttttcacagtgtgcagcagcaatggcttgtggtgttccaatgacatttccaggtttcatggcaccattacttccttttccattcccagtttggcctggttttaggcctgctacaacagaattgccaccaaattccaatatttttaagccaagggctgagattccaaaagctcctgtgaatattatagatgaaacaggcatctcaaagttgagtatcggtgatccacctggttctattgaaccttcaggattgtcactgaagcttctaaataaaccttcaaggcagtcagcttttcatacaaatccagctctgaatgataatggcttcagttctagtggcaatgcgattcatgtagtttaagttagtaaacaggaagaagatgatgggattggattcattttggatgttaccccatgcatacatcaatctattcaaaacagacagggtccccggtgctgttgactggattgtataagattagttggatgtttctcaggtgcaaaggatcataaatcaaggctcaggaatgggatcttggattttgtaggaatgagggttggtatactgggttgttatgatgcttgaatttcactttgcaaaaatgcaaatacttttttgtgcttgaactgcaatgggacaatgtaatgctagattcttgagcttttgttcagttatagtttttagtaccatttggattacatttgtaagaacaccctctctatatcacttttggggatatgagggaaataaatgtttaataaccattctttaaaaa

SEQ ID NO: 729 - DNA, 1372 bp, Pinus radiata
ccaattcttacattctttgagtgaattcaggcttccaccgagaagatatcaagatggggaggtctccttgctgtgataaagttggggtgaagaaaggtccatggactccggaggaagatatcgctcttgtgtcttatattcaagaacatggcccggggaattggagattgatccctgttcgaactggtttgttgagatgcagtaagagttgcagattaagatggacgaactatttgaggccaggaatcaggaggggaaactttactccatatgaagacaacattattattcatcttcaggctctattgggtaacagatgggctgccattgcctcctatcttcctcagaggacagataatgacatcaaaaactattggaatacccatttgaagaaaagactcaccaagcagcaaacaatgattgcaggcaatgagctaaatcatgatgattccatcagaagatcttcgttttcatcagatgattatcgttcatccagaggtcagtgggaaacaaaacttcaaactgatatacatcgtgcaaagaaggctctgtttgaagccctaaacatgcgggacccttcttcaagcctgcaaaccagtgggacaacgttggattcaacttttatggagagaaattcaaattcatcatatgcagtcagtatggagaatttaacaaaacttttggagggttggaaacaatcctctcctaatgaaataaaggcctcatcaaatacaataaatcctcttgaagggaaccagtcccaaagttctcagtattcagcagaagtacccatatcatgtgacagtgaaattgattgcttgcatgatgtggataatgggagcttagcatgggtatcaccgtttaattcttctcaagattatggtgatgatgggggttctcttcatgattttgatctctatcaaagtgacagttatcagaacactatggacagcaatcttcctttttctgtacttgagaactggcttatggaagaaaccaattaggacaagttcagttacagcatgaacaaggttcagtatgtatagtcagggccaactcggcccatgaatcgggtagtgtgtgttttattgtatcatccatgttctcactaatattcttaatgagtggatcttcgtttgaggagttttctctgagagagactagctgaatctgcacgaaatcaatcaattcgtgagacagcaaatttgaatgcaactttaaaatattgagatacactagtcttccagcattcaattttgtacagatgctaactcccccacacaagctaaggtttttgctagctaggggctacgtagtaattgtcttgtcatcacgaattcaaatagttcggacattcagattaaaaaaaaaa

SEQ ID NO: 730 - DNA, 1796 bp, Pinus radiata
catggtagtttttttctgggagaggactgcagtgaaacacttggcaatgcggttcgatcgattgattgaatgaaagaactacactcctcctcccccttttattgacttttatatagcgtctgtatctggataattagattaggtatcgatctctgatttggatctgccttcggttttggattttggattctctggttcctggcatctctgtaatttggtacgaattgggctctgtctggtttttttttttttttgtctgtctcttggctttcgattaattaattccaaggccggtaaacatgacaaggaagtgttcgcactgtgggcacaatggccataattccagaacatgccccaaccgtggtgtgaaattgtttggagttcggctaactgatgggccgatacgcaagagtgtgagtatgggaaacttgttgcattattccaacaacgcctcttcctctaataacagcccggcctcagcttcagctatggagccttgcgaatcagttgctaatgctgctgcttctgcagatggttatgtatccgatggtctcgttcataacaattctcgaggagagaggaagaaaggggttccatggactgaagaggaacaccgcatgtttcttattggccttcaaaagcttggaaagggtgattggagaggtatatcaagaaactttgtgccgacaagaactcctactcaggttgctagtcatgcacaaaagtattttattaggcagagtaatctaaccagaaggaaacgacgttctagcctgttcgatatcactgctgaacctatcagttgtccattaccttcgcctgccttgcctgtattgtcatcacagtcggcctctgatcaagaagaagccgaatcaggtgataattctgcaaattctgcagatgtagaaactcttcttcctcaggttgatgaaacagcttctgctgatctgacagtgttcccaggttttgttaccccttatgtaccatacgggttccccatatggcacacttttagacccacaataactcaaacttccaatgtttataagccaacagctgtaatgccaactgctccaataaaaatggacgaatgcacagggttatcccagttaagcctcggcggtgttgcagcggcttctgcaatgaaaccctcagaactgtcactcaaattacatggaagacccccctctagacaatcagcttttcaggccaaaccatctctcaatgaaagcagtagtttgagttccagcagcaatgtcatcagtgtagtctgaattgcaaggaaaagcaggtgtgaagaagatgatggtatggattttataatggaaacaatggtggtttccattatgtatatatgggtttcttctgcagcacaaaggttgtgtgcctggttgatattgcaattgctcccagaaatcttcaggtcgatctctagcattgatctttagtatgctaaatgaggcaacaatctgtaagtgagttcttggccttgacatgttgagggtacaaatcaccacaagagctgcaattacaaagatccatgaatttgactcaaaagaatacggtgctttgcaaagacctcaagtggttactctatggggtgaagggcaagtacttattgtgaagtgactaattttttttttatcaatgcctcatattaattgattctgttagtttttaggaaggtgcaggaagtagcagtagggtgttcctgctttcttgtttattttgaattttttactgtgtaacttaatccagatagatattaaagaatgcatatttgaataaaaaaaaaa

SEQ ID NO: 731 - DNA, 1318 bp, Pinus radiata
agaaggttggaatggcttagtccgctcatttgatggcgaacagatctttgtggggaggttcagactttgattatgagaacgaagccgatacgaggaagggtccatggactgtggaagaggacatgcagcttggtattgtaaatttgcacggagaaggacgctggaactttctcgccagagcatctggcctccagagaactggtaagagctgccggctaaggtgggttaactatctccggcctgatctcaagcggagcaagatcactcctgaagaagaacgtttgattattgaactccatcgccgttggggaaataggtggtctcgtattgcacaaagtttaccgggaaggacggacaatgaaatcaagaatttctggagaactcgtatgaagggaaaactaaactcagaaactcagaaggacatcgccggcgtggatgcagacgacggagtacagtttgaaagcgaattgggatcttgccgcctcccagttatttcatcccatgcactgcctgaagtagacgttgcagagccttcgagtactttcccacagcaaaatgccgaggagataatggtccagacaaacacaaccccttctcttcaaaatgataccccgccacaggtaatccagagtagcgaaggaaattctgaaaatgtattgcagggcggagaaattgatggtcactatcaaattaatgatgatgggcagccaggggaaagtaacccggaacatttggaaggaccggacagcgtgtttcagaaaactaggttacctcacactttctctgtgggttctctcgtaacattactatcctctgagttctttgcagatagcgccattcaagattgcaaaatatcgcctctttcctcctatgtggcagcttcgccggaggctgtctccgatagcgaaatttacttgtcttgttattcggatgtattatggaacatggatgaagaagataaccgttgctttcgcagctggcaatccgcagaggatacgcgattatattgaacaacaagagaaagaatccggaatgaagctgttaatactctctttcactctgactctcttttcttgtcagataaaaccggatcagttaaattttgtggcaactgcaaagtttatactctgttttttgtattctcaacagtatttccgcgttactgtttctggtaacaaagggttattttgagtgtaggtttggtacttccaacggatttggaacaaagcggattttactgcacgacagttaactgtcctctcccaacaatcgagttccgttggagtcaataaattttgctcaacggttaaaaaaaaaa

SEQ ID NO: 732 - DNA, 1765 bp, Pinus radiata
ctcgctctcgcgctctcgtcagtcgagcgtgttcgtctcagcctcagagataaaaagaggagagcagccgaagaccaggagggtagagaggcttatcagactcacatcaaacgaaactggagccgtgaagggttagttgcggtgttaaattctaggacagctttccgtattagaaagaggcgccctttacgggagtcggcaccaaaccagagtggagagaaataatgggtagggctccctgctgcgaaaaggttgggctcaagaagggcccctggacgccggaggaagatcaaaagctcctcgcttacatacaggagcacggccatggcagctggagggctctgcctcagaaagctgggttgctaagatgcgggaaaagctgcagattgcgttggactaactatctaagaccagatatcaagcggggaaagttcaacccacaggaagaacagacaattattcaacttcatgcccttctgggaaataggtggtccaccatcgccactcaccttcctaagcgaactgacaacgagatcaagaactactggaatacccatctgaaaaagcgcttggtgcagatgggaatcgaccccatgacgcacaagccgaagtccgaatcgactattgcagttggccgtcagtcgtgtaatgggtcgtcgaatctgagccatatggcgcagtgggagagcgcgcgcctggaagccgaatcgaggttggcgcgcgagtcgaagttcagggcccagggcctatggcctccgtccatgagaaaccctaatgtgaactcagatatacttactagattgcggttagccggtcaaggattcgattccgataaggaagggtcaaacattttggggttgaaccctactggcggctttgaacgtatgaaaatagcaggcaaatgggacaagttccaagatttgagtttggggattaagtcagaccaaagcaattcttctgcgctgggaagttccttgagaggttataatccagtggagaatgatcagagcgcggaccgagccagtaacacgagctatctcagccttctgcaacaagccatgtgtccttctgctcaaggcagcaaaattctgtacaatgaggccaagaagctgatggagaaccagaagaaccggcaggctaatgtaacggccaccctttataatgtccaccaacctcatggaaattgcagtgaaagcaagcatctatgagaaagcccagaccgatgtccagagctccagcgactgagagaacgtggagccatcaagagattctgtacttgtactttgcccacaggaattatttggtacgaggtcagatgtgtcagagctcttcaaatctgagcaaggagttgaccccacttcatgttttctctgcatgctgagttacaaatcgacctctgcttaattgaattgggcgtcctctcctgctaaagctgctccattttgctgattaaagctgctcttacacgctggcataagtcgcacttcatggtcaatacaattgacgatgacagaacgaaaggaaatgatgaaagaaagatgaggaaatagtgaaaacaaataaatgggatatagcgaaaatcaaagatgataagactcttagtttccttttctctcgaatccagtttcttcgttctctcctttcacctccctgtatgtatttatttttgtattcaattactctaacgtgattagtgtatttacatttgtattagatgtgacttttacattttaatgtataatagattaatgttttaaaaaaaaaa

SEQ ID NO: 733 - DNA, 1307 bp, Pinus radiata
tccaagtctgggctgtggatctggaacgcattttaagctctggtctcttcaattgggtttctggtagcgagctccatcacaatggtcaaagaattgttgatgatgtgttccaactgtgggcacagtgggcacagctccagagcctgtcctgatagaggatctgtcaaattgtttggggtcaggctcattgctacagacgatggcatggcctgcatgagaaagagcctcagtatgggcaatctcggtcattaccgttcactttacaatgtcaatcactgttctgggacaagcgaatgtggatctgcagatcaggatgggtatttgtctgatggatttgttcattcttccagcaatgcacgcgagaggaaaaaaggcgtcccatggtcggaggaagagcacaggatgttcttgtatggactggaaaagcttgggaagggtgactggagagggatatccaggaattttgtgacgaccagaacacccacacaagtagccagccatgcccagaagtattttctaaggcagagcaatcttaataaaaggaaacgtcgatccagtctctttgatatgtgtcctcatgattcccatgtcacaagctcttttcgcagagaagactcattgggaaacctttatgaattttcgccaaaacattcggctttgggggtatcgcctaatttcgaactatattcatttggtgtttctccaactttatctctaggaagatccctgcaaccagtggaagcagttcttgaagagaaagcagcccattatcatcctgtgaactcagaagaagatacatccagtatgtcgagtactactgatgcacctgccaaggaaaaaaactcatggccaagtagtgcaccacagaaatttcagctgtcgctgtggccagaattggagctgatgacatctagtaatgctagttcaggtaaagaaaatggaatgaagccaatggttgctggtatgcctgtacactgtggggaaaatacagatttgagtcttagcattgcacttcctccaagaaatacaagtttaaattccaatggaagcctcagcaatgcgattagagtagtctaatattactgcatcttaataattgacctctgagatcactgcacagcacacaattatgtcagctgatccatagtcagagttgttgtcctctttcatttagatatatatatatatatatgtacatatatatagatgcacagttatgaacagtgaacttgtctatgtttgtttcactcttgagcattattgaatatatcgatgaacagaagctattctgaagtcttaaaaaaaaa

SEQ ID NO: 734 - DNA, 1719 bp, Pinus radiata
ttgcaaggccctttccctctctgttgccaaacctctagattctgctcaaatcctttccgccgacgatctttttgaaaactttcgacggatcagagcgacggtgactgaaaagcttcaagatgttccatttttcgccatttgcagtggagtatctctaaatctactaatggtccggagcttggttttgaactaattcttacgaatatgccagacagcacataagtactctacagcgggttgttctgtaatatattttccattgccgaaccctgcaaataagtctgcagataaaatcaatcacggaatcacgagatctcgttatctgtatccaaaagtcttacggtgactcctgaatcgagccatagtttagctgctgcgaatcttgatcaagcgattgtctcaaaggatcgggtaatgcgtcaaggtagatttaaaatatagaagaaagttattccagcaaaactggcgaagttagatatgaacaggaggtgctctcattgtggacacaatggccacaactccagaacttgtcccgacaggggagtgaagctattcggcgttaggcttaccaccgatgaaccgatgaggaagagcctcagcatgggaaatctcccgttaactcccgaacaatctgaatctggagctgctgaagacggatatgtttcggacggcttggttcaaaactctcgtgaaagaaaaaaaggcgttccttggacggaagaagaacataaaatgtttttattagggcttcacaaattgggaaaaggcgactggagaggtatttccagaaactttgtcacttccagaactcctactcaagttgctagccacgcacaaaaatattttcttaggcagagtaatttgaacaaaaggaaacgaaggtcgagcctgttcgatatatccactgattcgatggaagattgctatcaaggaatcccggagctgtcaccggtgatgcacgatctcagcctgggccagaattcatctctgacctctggaaatttcttcgaaactggaggagcacctccaaatttagccgcctctgtgggagcattttctgtacctccgttggcagcatcgcggccagttattcccccttgcctatctttgggaatgtacaaatccgacgatggcgaaatggccagatatgaagctaaatattcctctctgaatgaggcggaacgtcaagaatctggtgggtactctaaccctaccagtcactattcattcactctgccattttggccagacttaggcacaaaggcttccaaaataattaagccaagtgcgccaacttcgccttcaatggaggcaagagaatcgatcgaaaatagcgggttgagtctgagcatagcccctccttccgtggatcctccagcgcctcacaacactctcaaccttgaccaatccaattctcgccgctccgcgtttcgttccagcaaccttgattccagcagcaatgccattagcgtagtctgattaggattaatattaagaatttcgatttattagggtcgatcactattttgtagtgaagtgaggtctattcttgtttttttttaaatatatatttgaagtgccctgtgctgctactcccattccaggatgtcttccaatattttattttgcaggtagaagcgtacactgtaagttcttcctatggtcgacaaaaatttaaatattctttctttatgttacctttgtcttttaaaaaaaaaa

SEQ ID NO: 735 - DNA, 1508 bp, Pinus radiata
gggaacagcagagctcaaagcgggtctttattttgtttttgttgagtgataggggagacagggatatccttttgtatatcctttcgaaataacggggcgtttagcagaggtttttgataattttaggcaaagaaggtagccgcagctcgcagggagggtttggaaccgtctggtttttgtccagtagcggcgtgcggtcgtattagattcgttccgtggagtgtgctttatagcttttgaaattctcattatttttgactattttggaggaaaacaggccttcgatttctgtattgcgttgcagatttgttcgtttgaaggggaacgcggcgccatgtcttcgaggagctgttcgttgtgcggccttaatggccacaattcccgtacctgtgtgggaagtggtgtgatgctctttggggttcgtctgacggatggaccaatgagaaagagtgctagtatgaataatttgtcaaacttatctcaatatgagcactcggatccggctgaggttgccgctgaaggttttgatggttacgtctcggatgacctcgttcattcatccagcaatgcccgtgagaggaagaggggagtgccctggacagaggaagaacaccggatgtttcttgtcggccttcagagagtcggtaagggggattggcggggcatttccagaaactttgtaaagactcgaacaccgacgcaggttgctagccatgcccagaagtatttcttacggcagagtaacatgaataggagacgccgtcgatcgagtttgtttgacatcacgactgatacgtttttgagcattccggttgaatcggaggatctcgtcccaggaaccggaaacaccccttcatttacaaggcagctcagtctggggcaaaattcaagctttccggctccagagactgggaatttcgctattcctgtcacatcatttccggttcctctgtcgcatgcagtgctgccaggtctacctgtaggtaaatcacatgaactagagaaagaagaaagcactccgatggagtgcggtgacagccccggctcatcctcattggcattttctgaagatgcggtgaatgcctccgtgagccatcctaagataatggatgtcgggcctctgcgttataaaatgtggaaagcagctacgccactttcgtccgttgaagggtcaaaggttgtgaggcccatcccaattattccaactccgcccttgaaaaccactgaatctgatgttgaaaagcccatgtccagccagaatcctgtaatggagccctctccattatctttgaagctgtcggaacaaccaaagcggcactctgctttccagtcgatgacatcccatagtagtcatgagttgaaatcgcaagggaacctcagcaatgtaatcagcgtagcctaagatgtagttggaagggactagcctgctatgctagtcatgattatgaatggaaatacaggcttgttaattttagttctttcttatatgcaaaaaaaaaaaaaaaaaa

SEQ ID NO: 736 - DNA, 1240 bp, Pinus radiata
gtttgaagtagaatttacctatcaattgcgttaaagatactctgttttcggccctgaaccctaccaggggaacgcggcgccatgtcttcgaggagctgttcgttgtgcggccttaatggccacaattcccgtacctgtgtgggaagtggtgtgatgctctttggggttcgtctgacggatggaccaatgagaaagagtgctagtatgaataatttgtcaaacttatctcaatatgagcactcggatccggctgaggttgccgctgaaggttttgatggttacgtctcggatgacctcgttcattcatccagcaatgcccgtgagaggaagaggggagtgccctggacagaggaagaacaccggatgtttcttgtcggccttcagagagtcggtaagggggattggcggggcatttccagaaactttgtaaagactcgaacaccgacgcaggttgctagccatgcccagaagtatttcttacggcagagtaacatgaataggagacgccgtcgatcgagtttgtttgacatcacgactgatacgttttggagcattccggttgaatcggaggatctcgtcccaggaaccggaaacaccctttcatttacaaggcagctcagtctggggcaaaattcaagctttccggctccagagactgggaatttcgctattcctgtcacatcatttccggttcctctgtcgcatgcagtgctgccaggtctacctgtaggtaaatcacatgaactagagaaagaagaaagcactccgatggagtgcggtgacagccccggctcatcctcattggcattttctgaagatgcggtgaatgcctccgtgagccatcctaagataatggatgtcgggcctctgcgttataaaatgtggaaagcagctacgccactttcgtccgttgaagggtcaaaggttgtgaggcccatcccaattattccaactccgcccttgaaaaccactgaatctgatgttgaaaagcccatgtccagccagaatcctgtaatggagccctctccattatctttgaagctgtcggaacaaccaaagcggcactctgctttccagtcgatgacatcccatagtagtcatgagttgaaatcgcaagggaacctcagcaatgtaatcagcgtagcctaagatgtagttggaagggactagcctgctatgctagtcatgattatgaatggaaatacaggcttgttaattttagttctttctaaaaaaaaaa

SEQ ID NO: 737 - DNA, 1391 bp, Pinus radiata
catcgtggctcttcccggcagacctagtaagccgactactgtaaatttattcttttagggttacagaagaagaaaatacaagatgggcagatctccttgctgctcaaaagaagggctcaaccgtggggcctggaccaaaagggaggatatgattctctccgaatacattcgaattcatggcgatggcggatggagaaatatgcccaaaagagcaggtcttaaacggtgtggaaagagctgcagattacgatggctgaactatcttcgccccgacattaaacgtggaaacatttcccctgatgaggaggaactcataattcggctccatcgccttcttggcaatcgatggtcgcttatagcaggaagattaccaggtcgaacagacaacgaaatcaagaactactggaacactcatatgagcaagaagctgcttccattgaacgaatctcaacccaagactttgcctgtccccaagaggaggtcgcaatctccttctcccctgcaaaatcgagtctttaaagccaaccctgtgaaaataacaacggtggtcagtccctctgacattggaagaccaaagggctacagtaatcgtagatcagatgaaactacgaattcttccaagtcacgctaccagctacttgtaaacgattccgattccatcacagggagtgaatcaaagcccattccctctgcaaatgccgacaatcacgttgcaacagaagctgcaatgtcgagcttagcggaccagcaatctctagaatccaatcatttttatgcagcagctatggccgacagtttattgtatttgaacgagctatcgtctcccgactctgatctgctctcttatccctccaactgttcaacagattttgggttagaagagttctacagtgtgcccactacagagaccaatgggtttgaagatatgtgttcggatcaaagaaatatggagcgcgttgacaattctacagtggctgagaagcaagtaatggaagaaatattccataacacagaacgcctagattggattcatgaaattgattatttacagaagtcaagctcacagcagctgagctttctgctgctggaagccgaagatgaatgggaggaaagggctacaggcaaagctgtgccggaaaacactgaacagataccgtaggaagcgaaaactaatggataattttccaggcgttatgtaatcaataaaatttcaccagtgttgtttaatttgcagactttgtagatatgaagtaggagatttcaattgttagctttcaccagactggaaattcagattaatgtaacaaaattttagctttgttttatcacttatgtttatttaatcagattggcgtgggctaaaatgcccactttcctggtgaaaaaaaaaa

SEQ ID NO: 738 - DNA, 1670 bp, Pinus radiata
ttcagatctataaatcaatgtctgcattaatgacaaactaagttgaaattcccaaatgttggtggttactatttaggatcggacattaggcgttgtggtctcgggttcgattcacaaggcatttctgtttcggaatttcaaagcaacacgtatcagaaaactgattctatactgtgatgacgcaggctactaactacacagcaggtaccatcagagacgatcaagaggagcaatgtgtgaggaggggaccttggactgttgatgaggacatgagccttattcgatgcgtaaccacccggggtgaaggtcgatggaacacagtagccaaatttgcagggctaaagagaacaggaaagagctgcagattgagatggcttaattatcttcggcccgatgttaaacgtggaaacataacgccggaagagcagctattaatccttgaactccaccgtctctggggtaacagatggtccaagattgcacggcaactcccaggcaggactgacaacgaaatcaagaactactggagaacgcgcattaaaaaacacattcagaaagctcactgcgatgctaaccctagacagttagaagactcgttgcggtattcatggctgtcagcactattacagccgaaaggtattgaaagcagcaaccagtctgcacaagcagcgtcctcgtccgaaataatccaaccctctgaacttgattatatgctcagccaatacaaatggatgagtggcctggaaactgaaattgcaggtattaatgaacccggagatagtctgaatccagcaagctttcggactagccaaggctccatacgcagtagagaatatctgaatcaaaacagcagagcaactttccaggatgttcatgatatggatcaatcaacatctgaaaaacagaattgctactatcaccaatctctatttggttattcaaattctgactcagttcaccatgagatttctcaggctatttcaccatcagaggtgggaatagacaaggacatgggcactccctgtaatggggtggctttagtgcaaccaattatgatatctgaatctgaagagctcaaagacattcatgaatcaacagcagggtttggcattcaatatgttaactcagaggcacagacttcgtcctgtaacaatcaaatatctggaattgaaacgaattggccacaagagtccaacaacacaagcttatggaacgaagaactttggtatataccatcaagtgcacaattatgaaagagagtcaatcaaggcattcatacatcaacagtttggtaacccatttataaattcttgaactgagatacctcaagtgtgtatagtttagtgatcatggaattgaattagcagtggtagaaatggaccaaagaagttcatactctcagaggaaatttgtggtttaaacaattagacaatgactatttagtatggacatttcacaaggttacttaatacctagtgtactgtaacatctcatttatttatggttagcagcaagtgaagtgaacattcagcatgtctggttttcagcttccatttctacctcaaaacatgtttaagttgtgagtggtgagtcgctatgtaaaacatatctatgaatgtaatatttttttttaagaaagattgctcatcttcttgttcataaaaaaaaaa

SEQ ID NO: 739 - DNA, 1737 bp, Pinus radiata; identical to SEQ ID NO: 710

SEQ ID NO: 740 - DNA, 1517 bp, Pinus radiata
aaaccgccaagtgagcttcatatctaaccaataataacacctgtatagcttcacagcaacagggcaccatgggccgagctccttgctgtgataaaatgggagtaaagaaaggcccctggactctagacgaagataaaatactggtcgactacattaccaaacatggccatggcaactggcgtgcactgcccaagcaagcagggctcctgcgatgtggaaagagttgtcgcctgcggtggacgaattacctgaaacccgacatcaaaagagggaattttagtccagaagaggaagatcaaattattaaattgcatgagctcatagggaatagatggtccactattgcttcgtacttgccaggaagaaccgacaatgagatcaagaacgtgtggaacacccatttaaagaaacgtctcgcgcgtatgaaagccgactcggttgcagtcgacgcacagccaacgcctgcgtcttccctggcctcatccactacagaaatgacgtgccacggttcgagtcctgtaaggtcacaaatactctgtaattcggtcccaagcgcaccatcagaatcgcagatctgtgatccggtttatgttttgccagagctctcagaagacataacctcatcttcctacaacatttgcactagtactatagattatcagagtaccagcactgattcacctttagatgtgtttcagtctgacagtattgattctttagaaccggaaattgatcagaatcatatatccattaataccctggatgagcttgaatgccagcagcctctatcaaaagatccccaaattttcatcggcaattatcaaaataatttcgaagactcggcaggagggtctgcaattagccatgatgataaagcggaaatgggctccagttcgtctcagggcatgagctctgattgcgacggagaaatgataataagcgacaagagcttaaacagtccattgaacctgcgagttgattcccccatgcagcaattttatgctgcagaagttgattggtttcttgaccaatctgaaaacatgagtgctgccatggattcgaatcatttacccacaaataccaatcagctctggggtactgatctccatgttaatgagggcatggatttctggctaaacatactaagacaagtggagccgttgcccttattccagtttgcttcacctgctctggtttcatctccgattaattctagtcaccactgctgattgtttgtcagcttcactgttcagaccgatgagagtttaccataagtaacccaggttggattaccagtatactttttttttgggctccatccgaaatattatccaaaaatcgtgataagagtttagattcctttgtaaaaaagagttgttgggaaaaggcagtttaagattcctatggaaaatcgcattgttgggaagaggcggtttatgtatataggaaaaatcgaaaaacttgttttaagagtttggattcagtacgtaaagattcagaattttataaaaaaaaaa

SEQ ID NO: 741 - DNA, 1797 bp, Pinus radiata
tgtgccctaaaatcccacttctgcccttacgcaacataatagtaatacaacaaggcgctgcctgtgttaccacgcctttatatatgtgaccttggactaggccggcctgaaacacgagagagaccaagacaaacacaactttaatagtaatctgcagggagaaaggcagatatacatccgatcatggggcgcgcaccttgctgtggtgatcacgaagggctgaagagaggaccctggacggccgaagaggatcagaagctcatccattatgttcagagccatggtctgggcaattggcgcaaccttcccaaacttgcaggtttatccagatgtgggaaaagttgcagactgagatgggcaaattatttgcgacctgatatcaagcgtggggccttctccatgcctgaggagctcaccatcattagacttcatgctgtccttggaaataaatggtcggctatagcctcgcatattcctggaagaacggataacgagataaagaatcactggaatactaaactgaaaaaacgactgcttttcatgggaatcgatccggtaacccacatgccactacctacaccagatatgttgtcgcctttcatggcgtcgtcttcgactcccatagctgctcgattgaatagtgcattggttgaagctcagttaggacgactggccagagactatgtcaatactgctcatgtctctgccggcactgctgatcatcagtactcgtggcaactgtcccaaattttgaatctcttgggcgcgcacaataacccagtgtcagcagctccatcagggttattatcttccatctcaaggaatgaattcctccagccagatgcattaacatggtctcatggctcccagaagcagataaatcacgaattcatttcaaggcaaaaggatgattctgcaaagtataatgcgttttcacaagaatcgttacaattttctgacccgcagaagaaatcaaaaggaaagaacttatccatcaatactgatcacagcaatgaacatagaactccatcgtcattgatagcggaacggccgtcagcttttgacacagaaatttctggttggaatccaatgcccattctaatgccatccaataaccctcatcagaatgatcatcactactcctacagcgatgagaaatcttcatctaccacatgtacaaattcctgcaagggaggatcagaaaatacagaaaacaccattcaatatcaacaggacgctccgttcggatcagcgataagaagttcgcttagcatgtcgctgccagcagcaagtgtagatctacacgaggacgaaagtaactattgggccgacctgttaaattccattgaggacagcaatcccgccttcccactccctagtccgtaacaacatctgttgctgattttttttgggacggttattatgtttttcagagaattgggccgcctggatgtgccctgccgcatcatttcgcattgattttggcacagaggaattgtttattgagattgcatgtgttgataaactaatatttttatgaaagagtaactggggataaagtttctggaatatttgtcgggttctgtcacaaagagccacagagagtgacaacatatttcagaagcaagctaccattgatctttctatttgggattgatttattttctttgctcgcgagtggacaagttgacaataaacaataaaggtttgggtgactaaccttgttggagattcctggactctgttctgaatacgaaaatttatttataaaataactcttcctttctaaaaaaaaaa

SEQ ID NO: 742 - DNA, 1914 bp, Pinus radiata
ggttattcgagatacgattgatcatgcttgaaggctatgcctatgcttgcggaaacataccgtgacagctttgagacgacttcgggaggtagcagcgtggatctggtaggaatggctctaccaggtttggcccctaatttgtcttctgcttcagtttcagcttcagcgtcggaagattctgccaagaaaataaggaaaccctataccatcaccaagtccagagagagctggtctgagcaagagcacgataaatttctcgaagcccttcaactatttgatcgtgattggaaaaagattgaagcttttgtaggatcaaagactgtcatacagattcggagtcatgcacaaaagtacttcttgaaggtccaaaagaatggcacaagagaacatgtaccacctcctcgtccaaaacgcaaagcatctcatccatacccacagaaggcctcaaaaaatgttcctgtgtcacagcaagtatcaactgcttttccaactgctgctactcaactagattctggatattatccaagggcagagtcgtcttccatactcaccaaatctggctcgtcatgcccaactgtttcttcctgggttcatcataccataccatcaatagatgcttcgtttgtggaaaaagatgatggtgggcctccaggcattgcaacagggaataattgcagtagtggtagcactgagagttctcctcctacgtggccaccctgttctgaaatccctgagaaagtcaaaccagatttttcacaagtttataagttcattggcagtgtctttgacccgagcacaactgatcacttgaagaagcttaaggaaatggatccaattgatcttgaaactgtgttgttactcatgaggaatctttccatcaacttgtccagccctgattttgaagagcacaaattatttttatcagtatatgacatgaatcctgaagatgctgaacctgctatagaaaatcaaacagacgagtgcgtggcagtgccaggcactgctgcaaagcagccatcggatctttggaatggtcctctcggatctgttcatctggggtcagtaaaaggacatgagaaagaagaacaaaatagtcaacagaaaagccatgatctgaaaggatcgtcagactccaaacactctgatcttgatggcagttctgttaatggtactgctgcttccttccatggcaacctagctaagacttgcggcatgacaagaagctgtttttcaaatgaagctccaacataaagtgctacacgcgggagtattgagttagctttcaagatataatcgagtgtgaatgtctggctaagctgctcatgtaatttgttatttacttattctattttgtgatacctgtaatttaaatgttaggtgttcagagtgtataggtaaatctctgccttcaatagtttgaatttgcaaaacgtaagccagttggctacccgcagactgtaccatgaattggtggcatgtagactattcttttctaaatcattcaagtttacctcataaaagctgccatgtctcaattgttttggcttctctacatctctgttgtcagctgtcattatgcactaatggcatgtggaaattcaggtaaagattagccaagttcacagtattttgaagtttcaacgcagctgagctgatgagcatcgtcttccatttctttgccaaatatacactgttaggtgcccatttgaatatataattgctacaacaatatttatgattgagagaattatttatgattgagagatggatagtgacatgataaatcacattattgggattgggttgacgtttcgaaccaactaatgtggttcatcttgtttgtatatttaaattgctatatagtattgttgcaaataaaaatccaaatataaaagtttctgactaaaaaaaaaa

SEQ ID NO: 743 - DNA, 2039 bp, Pinus radiata
gaaccaagaaaccaagaaacgcacccattggaaaaggacttacgcggctttccgccacaattttgaaggttcaacagttagtcagaagtcttcgcattgtgcagtcagtgtgagagaaaaggcgtttagtcctcaacttacagcgccgtccgattcccgagtcgtagagaagggaggacaaggcttttgcctcagccgtgcactccattccctctgattgcttgcctgcccggcgcctgcgcctagtggtatctgactcataattggtttcaagatatatatcacggattaaacacccattgatcgattaggctcccctctcccccacctgcttgctcacctgtctctggaaaaaaataaaaaaggcccaatccacagaactggaacagggcatgtactggctgacacagacctacctgtatttgcttgttctcatccactgtgttatgcacagcatttcttttgatcatctgtaggtcaaaataagctgtccagtactgcaaagctgattttctacagtttagattattcataagaaaatgggtcgagcaccctgctgtgacaaagcaaatgtcaagagagggccatggtctcctgaagaggacaccatactaaaaaatttcgtggagaagcatggcactggaggcaactggatcgctttgcctcgcaaagcaggtttaaaaaggtgtggcaagagttgcaggctgagatggctgaattatttgaggcctgatattaagcatggtgacttctcagaagaagaagacgacatcatttgcaccctgtataccagcattggaagcagatggtctatcattgcagcccagttgccagggcgaacagacaacgacataaaaaactactggaacacgcggctgaagaaaaaattgcttggcaaatgcagcaaggacaacgataatcagcaaatccgacgcctactggcaaaagaagcagctaaaggcgcgggaattagaggactttacaacggtgatcataatatttcttcagaaacggccgccatttctgcatcaaacactcaaagctcgtcagaatctctgacagaaacagccactgccgcaaatgccatgaatagcccttatagtgccctagaaacgggtaaagtcccgggatcgaattcgtctgagtcaaaagcggccggttttaatgccacccacagtcctaatacccattattatgaacaaggtttcagtcaattcatgtctcaggcagatcagtattcttccctgacacacatgcttctgagactcgagaataacgagagcgattgctcaacagacaatattcaatctctgggcatcgatacaattcccagtgaggtccctttctacgcttccacggccatgaatgtaaaagctgaagccatggagcgcccatctagtgatccccagctcaatcaagcccgcaattcagtgcctgcactctgggaaacctgtaccagcaattccacatctgggggcaacaattatcagttcagtacgttgataaacgatgatacgggcaatttcagctatgggctctcagcggacatggatgagttcatagtgtatcgaaattatggaggcaatggctcaatatctcaggtgaaagaggagcctgactactccacagctgaagcctactgggcttctcaactagctgaacctgcaaagtcctcaggcttaacaacaacatgtcccaattattcatacattttgccatcatctgagggtggtatgggttctggaactaccccacaggggctctttcaggagggaattatctattgactttactgtacataatattctgacaacttcattctctctgtatcatgacccattgggggatctcatatttgttcatccaccacttttgtatgtcagttacttgaatagtgttatttttattaattccattcagccacttgaatagtgttatttttattaattccattcagccactgtaagcattctgcagctgaaactaatgcagttttctataatgagactttttgaaagtttttttggtgaaaaaaaaaa

SEQ ID NO: 744 - DNA, 1531 bp, Pinus radiata
tctgcatttcagccagtccatggtttcaaggtcgaatctccttgctgacatgaatccatcaatatatatagagagagagaaatatacgtttttcagatttaagcatggccgtttaataatctgcattgcatggcgagattgtatttgtgttagaagttgattttctgttttttctctttcagttagttagtccaataaagcagagatgggtcgtgctccatgctgcacaaaagttggtctcaacaagggagcatggtctgccgaagaggatagtcttctgggaagatatattcaaactcatggtgaaggcaattggaggtctctgcccaagaaagcagggctgcgaagatgtggaaagagctgcagattgcgttggctaaactatcttcggccatgtatcaagcggggaaatattacaacagatgaagaagaacttattatcagaatgcatgctctcttgggcaaccgatggtcgataatagcagggagagtccccggccgaacagacaacgaaataaagaactactggaacactaacttgagcaagaaacttgctgtcaggggaatcgatcccaagactcataaaaaaatcacgacggacggcacgaacagagtcaacggtgatcgtttcagccagaggaaaggtgagaaaatatatgattctccacagaaacctcgacagccggaaagaaatgttgcgagggccgcccaatcaacagggctcgtgattcctaatgttcacaatctaaaagcggatttaaaagcgcaatatattgcaagaatcagagaatttaaaagctctaatactatcagctcctcttctcgacttaatgcacagattgagccaaagtccagagagttaagtacagaagatccgatatttcgttgtagctctgcatcagaaaaaaccagagaaaccactcatccagatttcatggagccccacccagttgcaagctcagatgccgggaaacaaaccaatgatagtactgtatattgcagcagtgattcagctgccagctgttccttgatcgaacacttctccagtgaggatgatcatcactacttgtctatggagggaaattctaatgaatgctacagtcagacattggctgaagactatggatctctgaagcccagtactccacatacagaatcagagccaatatgtgatagcagagaacgtgacaatgacagccatgtgcagaaacatgaccagttcccggaatatgatgtattcagtttcttcgacgttcgcaacgctgagaatgagatttgttgcagcgctgatcagtgggtacatgaacaagaagcagaatttatgcagcagaaagatcaagaaatgcctcaacttggcagctgggagaagcaaattgatgatcaagaaaaagagaattttgaatctcatgtaaacaatgatgtgactgcaatgtcatgggaagcatctttttggttttagcaggaatcaaaatttaaggtgcaggatgattaaattccttactccttagttttttgtttttcaaaaaaaaaa

SEQ ID NO: 745 - DNA, 1691 bp, Pinus radiata
gcgttttcaaatacgcgagagagagaggggccgaccaaaggaggtctgcagttcgaatccgattacgatcgtgttgtgctgaaacaatgggagttccaaaggacgaagcggcgatggcaatggcggtggcggagcggatcaaggggccatggagtcccgaggaggacgcatcgctgcacaagctggtggagaaatatgggccacggaactggtctcagattagcagaggaattccgggccgctcggggaaatcttgcaggctacggtggtgcaaccagctgagcccccaggtggagcaccgacctttcagcccacatgaagacgccaccatcatacaagcccatgcgcggcatggcaacaagtgggctacgattgcccgcctcctacccgggcgcaccgacaacgctatcaagaaccactggaactcgactctgcgacgtcgctatcatggcgagaaagaccagagcaacgggctagctgtgaacttggagtcggcagctgaggacaaagaaacgatgactccgatgacacctgtcacagccacggcaacggcaacggcaacggcaacggcaatgccagtggctttagtgttcccaacggctgtagacaacgtcaggaagcggagcaacagtagctgcagcgctaatgacaatccaggagatgccgaggtcgaatcctgtaggcttaagaggctcaatttttctgaatccccatctagttctgaaaatattaataataataataataatgaagaagctgttagtggccattgcaattcggccgctgccccgggttcgagtcccgggcaacagctgcatcgccctgttccgcgacaatctgctttcaattgctatgaagctgtgaaagtgcaggaggaagcgtctgcctctgtttctgcttctggttcggcttgcgctttcgatcctccaacctccttaagcctgtcgcttcctggaagcgcttcttcaagcgagaataacagcagtggagaatgcagccccacagaacagagctctgaaatgaaatatgcaaagtttcaggcttatcaacaaccgactggttattcgtttgccaatccgtttcctgttggtggctacatgaagacagaggaggccatggctatgatgtcgactgcagtcaaaattgcaatcgggcaagcacttcccctaattttccagctgcctagcggtaattcccaagaaggatgttcgggcgattctgctaattatggtggaagtttgctgtctattatgcgggagatgatcgcgaaggaggtccagagttatactaacggatcgccgtgttcaaatcaggggtccggaatgaattctgtagctccggcgttcagagaagtaggcttaatgctgaaaaaataagaaaaagagtcttatggcggtgaaatggagaaattcgagaaatatgtcgtggccttgtgggataatttcggagggtctgatcaaaacacaagggcgcaggattggaatttatttgtggaaaaatggatttctcccagagggacagaactgtaaagtgctgaaggcgatctcgatttctgttgattttctttttgaattgtatatcgtgaatctgaatactttcttcttctgctgcggcttgtatacaaaaatgaataaaaagttttctttattatagaatagcatagcgctatttgatgccattcaaaaaaaaaa

SEQ ID NO: 746 - DNA, 1708 bp, Pinus radiata
ggatgaggagccccctgaaatggacagatgaaggagcggcaaaggtggcggtctgaagaagattctctgttactttcctatgttaagcgatacgggccacgagaatggaaccttatatcggaaagaatgaatagagccctggacagagatcccaaatcctgtgcagagaggtggaagaactacttgaagcccgggatcaagaagggctccttatcagaagacgagcagcgtctcgttataagtcttcaggcaaaatacggtaacaggtggaagaaaatcgcagcccaagtgcctggaacaactgccaagaggctgagcaaatggtgggaggtctatagagagaagcaagataagataaaagacaggaacgaaaggactatcgcagattctgctaccaaaattgaggaaggtaaatatgatcatattctcgagacatttgcagagaaatacatgcaaaagcaaaagcaattggctacttctagcggctgtaatttaccaactattgctgcaatgccttctgggcttcctcctcccattagtttcagtatgccaacaagttcaactccagatttcattcatttcgccatcccatctgcatctacacctaccacttgctcgtttggagctcctacaccgtgtcttcctccatggatgtcgaacaggccaaattcagctcatggctcgggggctgaaccctttcttcattcttcccccttatcaaagtccagcccctcatcctcctcttctccttctgtaactctttctctttcaccatcttcaagtactccagtgatgtccgcgaacacagcttctgcctgttcatcatggaagcaagatactgcaaaacaatctagcgagaataatgtaagtggagattccgaagctgctaaagataaaaatagaggaatctcgcatgtacaaatgccctctatggatccaagcaattcggcttccagccatcaggctgcaggaggtcagggtgtgatcatgcaggaaatatctttgttcttccagcactgcagagaattggaggagagacaacagtcgtggtcagtgcacaagaaggaaactagttggagactgaaacgacttgaacagcagcttgaagccgagaaagctcgcaagcgcagagaaaaaatggaggaaatagagtctaaagtgcgggctctcagagaagaagaaaattcgtatttggatagattagagagtgattacagagagcagctttctcgaatacacagagatgcagagattaaagaggccagaatgatggaaatgtggacagcaaagcatgtgcagatcacgaaatttttcgagcagatggtccaccgccatgaccctcataaatccatttaaagtaattcaatgcatgtgcatctgttgtaagtatcatttgtatacatgccttttgcatcagaacgatacagtctgattatggcagatcaacaatatcatttagcacagcttgttggtcatcaaaatcatgtcaggttagattttcctctgcgccttgctgtgaacaaggcagcttttgggttagtttacccaaaaacctttggttatttcgatgtaatggctcaatttctgttcttagcttcccaattttcaggactgcagttgtgacctatggaatgtgtatttctacctagtggaaaaagaagagtatattacttttatacagtaattttattttaaattaaaaaaaaaa

SEQ ID NO: 747 - DNA, 1717 bp, Pinus radiata
gtttatatgccatagtactcgtctatgttggcagataaaatctcacctggcctagttggagaaggaagacaattcagttttatatagccctgattgattctgcttagagtctgtgggttgagagaagaaattattttccttgggctgaagagatcaggctaattatggggcggacaccttgttgtgaaaaaaatattgggctgaagaaggggccatggacacctgaggaggatcaaaagctgatagattacatacaaagccatggccatggtagctggcgtgcccttcctaaacgagcagggctcttgagatgtggaaaaagttgcaggctgagatggaccaactatttaagacctgatataaaacgtggacagttttcatttgaggaagagcagactataattgaactccatgctgttcttggaaacaagtggtctactatagctgggcatctgcctgggaggactgacaatgaaataaaaaattactggaacacccatttgaagaaacgccttcttcagatgggaattgatcctgtgacacacaggccaagaacagacctcttggcttttcccaatatccaatcttcaatttttaatacacctggttttggtcatatggcccaatgggagagcgccagacttgaagcagaagctcggctgacaggagagtatttgagacaagccttattcatggcaggcaacggatcagccacagctgatctattcatgaggccgtgcaaatccgaatttggcaatgatcagtttaatttgacaaaaaatatgggcaacccaccatggatacagcagcctggaatggccttagactataagggtgccgtacctcagagtttggagcagtttttacagacaaatgtatgttctgcatcagacattaatgggggtggttgtttgagccatgaaggtggcttcagtattacgaggtttgcatctccatgttcaacgctggatggaattcaaatcaaaacagaacctcagagtctgtgtggtcctcaagtagtgaaaaatgatagtcagtttcttcatagtgaaggagatctacgaaaacaagccatgcttgatatgaatgtaggaagtaatgttctcagtaacatgaatgctgaatccaaggtttcatttggtcacaatggtattataactgaccaagaatacaataatttgggtcaaatagataataataaccatctttctcatgcagctactacactatggcctgttgaaggccagttgcaggccatagccagtgactccatgcctggattgatatcttccaccagctgcacttcaaacaacatttacagccagcctggtttaattcctcttctcaattccacaacctcttcaatgggtgatacaaattcttacagagaagcgcagccagaacagaaccaggatcaggcaagcaaacaatactggagcaccatgctcaaggctgctggaacaattcctgcctcccacatcatcagtgctcggcaatgagatatatccttttttctgcacaataaataatttctccattggcactatcctcttctgaattggtataaatattgtttgatttctctgttaaaaaaattctcatggtcatggtctggttgcaaaaatgttatatgcaatttcaatacgcgaagaagtcaatcaagatcagaagaactgaccaggtttttctcggacagatctgtaatttgtaataaact

SEQ ID NO: 748 - DNA, 1793 bp, Pinus radiata; identical to SEQ ID NO: 707

SEQ ID NO: 749 - DNA, 1716 bp, Pinus radiata
gtgaaaatgagctgcacaacaggaggactctcctctcccgtctccaaacccaagctaaggaaaggcctctggtcgcctgaggaggatgataaactcatcaactacatgatgaaaaacggccagggttgctggagcgatgtcgccaagcaagctggtctgcagagatgcggaaaaagctgtaggctgaggtggattaactatttaaggcccgacctcaaacgcggtgcattttcaccccaggaagaacaattgatcatacacttgcattccattctcggcaacaggtggtctcagattgcagcccgtttgcccggacgtacggacaacgagatcaagaatttctggaactcctgcataaagaagaagttgaaacacctttcggcctccaccaacaacagtaaatctatctctgcacctaatcgtaccagtaccatgaattcatcgatcacgcccttttctgaatcgtctgccgagccattggaggtcatggcaacaaggtatcagccatcgaatgcttttaatcatgaagtgcccactgcagaaaatcagttttgtattccggatgtattggcgttaagacatgagcaagtacagagtcagaatcaattttcaattgatcaggactcggccaccaacaacctcatttcccacctgtggaattccaattctacagctgtttcttctcatgagagcttctcccatgccttcatgtctccgggtctgcaaacgcaaggccatgttgtaaagactccaattaaaccatgcgatcaaatctcgtggagtacaccactgactcgtgaagctgctgggtctcatgcctgcaattactctcttggctgcaacatccctgctcttgttgagagcgagtcactgaaagaaaaattcaagaatgatgcaggcgatcagattaatgaaaatgagatcatgtattcttccacggcatcttctgtgataactgcatggagcactaattcctattcagatgccgaatattgtactgtcgatccacatgatcaggtgggaagtatcctggaagattacgtgagccatgagaagactacggatcatcagccatgcccaccacttaattcctctctgcaattcagtgcccctgaaattagatggactgctgatcagtctaacgatcatgaggaatatgactgcaaggatcgtctaaatttgagatatgatgtaaatttggggtaccctaataatactaacaacaaacagaacggttaccagctgcctcagatcggaggaggaggggttaatggcgatcactgggattgcacaagaattcccaacatggaagaagccaacagtacaacaccaacttctacgatactaggaggcagtgggcagtttgagtttgagtgtgatggtgatgcaggcggccaagtcacagcttgggctcatgacgctctgtataatgatatacatacagctgcttctgatctgctaggtcaaatctattttggctaaaatcgaaggcatcggttcagcaccaaatctttgctccataacccctggttttcaacgtcctttgtaatttgtaatttcagtgaatgttttttcaatgggattttagtttccgtgtacgtaaaagttatttgtaatttcatttttacccaaaatactatttgaattttgtaatagaataaaaattaagagcaagtggaccatccctccctttctctttaatgaataaaaaaaaaa

SEQ ID NO: 750 - DNA, 2387 bp, Pinus radiata
gcccaactcgtactggctgcacgcaccacgacgagttcagtttaaaccggtatacggacgagaaaagaactctagccagttgatgttgttgttggatggattattgctcgacctctgggcctagttactatctctgatccctaatccccttcggccacaaacgagaaactccgcccagttggtgacttacagcctctgtacctagtctaaaaaggcggcctagtccatagctttctttcagagtacggggatttaataattctctgaattgttagctgtatataataagctgagaatcgaagagtggggagatacgaagagtaatggggcgccactcgtgctgctacaaacagaaactcaggaagggtttgtggtccccggaagaggatgagaagctggtgcgccatattaccaaatacggccatggatgctggagtgcagtgccaaagcaagctggcctccagcgttgcgggaagagttgcaggcttcggtggatcaactacttgagaccagatctgaagcgaggcacattctctccgcaggaagaaaatctcattgttgaactgcattcagtcctcgggaacaggtggtctcaaatagcaacacacctgcccggaagaactgataacgagatcaagaacctctggaactcgtgcattaaaaagaagcttaggcaacgaggcatagatcctaacacgcacaggcctctcagcgaggtgaatgccgaggcaggggattctaagaacgataacagcaataaagaagtcgaaactcaggcagccatggacgaatctcatgtttctgcagggaacgaattcaagcatctgaatgcaattcctagggctgatacggccaatcctaaattctttcatgttcccgttgaggacaacactttgattgctagcgattcccaagcaatgctgcagaatggatttatcaattccaacagtaccactactactactactgctacttctactgctagtgctgccaatttctctctgcccaaagaattcttcctggaaagatttaatagtgttaatgctacgcccacttcagtcgaggctggtttcaatttcattaatcaaacaaccagtacccaaggtttcactggtgaaagagatcagaagctgatcgataatcccgtcttatgggtattgcaggctccgaatcgatccgtaggtttccctacagaaaacttgatgccatggccaggtcaaggtcttgccaaggccgtgtcagatgcattctcggacttttcaagcgatgtttgcgattataattcgataatggcgaatccatccatgtacagaccgggaccctgcctttcttctttgctatactccgaaagatccctcgaccaggatttgctggacaacgcaggcactaattgcatgaatggatcaggcgcagcaggatcagctcagtactgggacaataccgataataataataataataatgtgaggtcgagtagcaggagcagcagctgcaacagcagtaccgccaatcttgaggtcaataatggcgccgccttcggccatttttggggattcggtgagagactagatgcaactgacatcacctctgaaaatgaacgaaaggctccgctatttttggagagagctgatcagtccgaatacgccgttaagtggtctgaaatgctgcctccgttttcaagccacacgcaagaggagacactgccaatatatattacaacagactccaagtctcaagatctagtatctagtgagaacattaataaccctaaccacgctgccctaaattccgccatttttccaatatcatggcagcagcttcagaacaccgaataccccgtacttggtgacaggacggccacgatgctcagtactccgttgtctgatcccgacttccaccgcattgctgcagttctggaccagatttagtacaactttcagtgccaggtttagttagtcattactaattttcatgggtttacatattccacagattgatttttgaaattctcacaaactcgcagccgtggatgactcagatgtaataaaattacagtagtgatcgtgtccagtgtccaggttatagctgatttaatttttaatctgttgatctgtaaataggtgagatacaaaaaacgcagactgaaagaaaacaacacgtattatatatatataatacttggggtcatgaagctcatcggcaacccagatcagtgagaaaataatacgcgtgcatgcattgttcatatttggctcaagtattgtttcagagagattgattcttctggatttctgtgtgcactagaagcataaatgtgtgtcaattttcaataatgttgtgaattaataaagccgctgcaaccgtttgcagaattctataaaaaaaaa

SEQ ID NO: 751 - DNA, 2909 bp, Pinus radiata
gctgattatcgaggaaaaccagaatcttctcgttttcacttgctgtgtttttctctggactaacgatgaagatgtctctaccttctaatgttctcactctcagtgcggattccaattctaattccaattcgatctcctcgtcaggagacgaactcgccgcaaaggtgaggaagccatacacaatcacaaagcagagagagaggtggagtgaagatgagcatcttaagtttctggaagccctgaaaatgtatggccgagcatggaggcgaatcgaagagcacataggcacgaaaacagctgtccagatacgaagccatgctcagaagttcttctccaagttggtaaggggatcttcaaataaaggtgtgtcttccacagagagagcagaggatattgagattccgccacctcggccgaaaaggaaaccaaggcatccttacccccgtaaagctgcgggtacttcccatcagagtggatcaccagcaagtaatgaaggggatgtatttcctccagttgtctcatctgtgcctttactgagcctgggagatggaccttgcaagcgtgctcgatttgatcaacacaatgcaaatacaaggctttctaacagtgataatgcacaagacatcaaaatggagtcacctagattgaacagctcgccattgagtctcaagcttttcggccaaacaatgttcgtctctaatagtgaagggtcgaatactttctcgactgaaccagctgtaagtaacaatcaaggagattttcaggaatttgttccagtgcaacaagaaaccagttctttgaggactaaagccaaaaatcaaatactggatgatggaactgaaatcttacacggctatggtctaaactctcatatcactgctgtggcaaacactatcttacgttctggatctgtatcaactgcagacaaggattccagagaaaaaacagactcggacgaacaactttccagtgaactggacaccaattcaagttgtctaacaagaaatcaggaatctcctagtattttctcaggttacccaaggcatgtcccagtgcagcgtgttgtagatggagtggtttcagaaaatgtgaatgaggttgttaacatgacaccattgtctgagtcatctttggctatgagcatgtctaataacacatcctcattgtctaagtctgagatcatgagtccatgcccttccactttttctccagtattcccttgggttcagatgcagcatggagacacagctgttgcagaagcagttgcagtagcgacagttgctgcagcctcagcctggtggtccttgtatggtgctgtgccctctcatctccacgaaagaatgttttcaggagcagccacagatgcggagaatatgtcatccgcatgcaaagctgaagctgtaatgggagttagagaacaaagccagtcaaatacgactgaaagagaaggtgagaccttatttcaaggttcacaatctgagaaccgcacatccagtttcatacaagaatctaatgatgcacgacgtcatacagaaaagcaaagctgccaaaccaaagaagaggaccaaataatgaaagagacggagttaggaaaagaagggtcagggtgtgcttcaaacactccttcaagcactgaacctgaaattgatccttactcggggactaacagtcaggggaatacaagaaattgtgtgcagagcatacaatgtaatggtggaggatatcttcctgaagcagaagaaggttcatccacagatgaggaagaaacacgttacagcgacaatctatcaacaaagcaaggtggactcaaagaagccaaaatatgtattcagaacagtagaaacaacagttactccagggttgatggccatgtcgatgatacatggaaggatgtcttgagtgagggtcaaattgcattcagagctttgtttgcacaagaggttttgcctcagagcttttcatctggagatggcacgttctccaaaataaatggcagggattccttctttgaggattcaaagaaaaaatcaaacagaagtgttgaaggtgagacatgccctcatgtcaaaggtagtggaaccagtgtggaacaagcgtacactggtaaagtacatacacagagtccaaaagcttcttttgtatcaacttccagggaggaggtactggaagattcagaaggtgctgtgagccatgggctgttggaagtatcagctgttaatttttgcaaagcaaacaaattcttttcttcaagcttttcgaagtcaaagtctggagtgggttttgtcccatatgagcgatgttcaatgcaagcaagaaataatgaactgcatctgtgatcccagaaaccaaaaactgtgaagatgttttaagagaagaaaaaagaatctgatcaaaacaggaagtaatttcttccgcaatatcagttcatcttgtgtagctcatagtcaagggctgcatagattcgggtgtcatccagcatgcaggttgagtatctcaaccagttagctgcttattgctcttccatggagattttgtcgatcatttaagctggtattctggtgatctgaggtcattcatgctgccgaactagttgcaacacacaattccatacgttctgacattggctgggctgtggtatactgtcagtaacttgagagtgtcttgtaaaattatttgcaatattcctcggaggatgcaaagatcagggcaaatcagatgaggaaacaatccctgtaccataatcaatctgtaaatataaagccagagtactgtaatagaaatggtcttagaaatgggctttcttttaccctttcaaagaagggatctctttgcctagttgtgagaaattttgtaagctatcgttaatttacaagaaaagcattttgacagcttttcaagtaaaaaaaaaa

SEQ ID NO: 752 - DNA, 1322 bp, Pinus radiata
gataaagtatgcgtttgaacgcattggggtcaagtgttatggcctctccttttttgtttttgcataataaagcttgtttttttgggttgcaggcataattttatcttgggcttcacggcacctctttgccccgcccacactccatctattattagctggcggtggactaactttctagattttatgggaaccaccatggagagttggcactctggaaacctgttccatttctcattcggtgcttcctcacgctgtatctttttgtttcagtgtttgggacgagcagcagcataaaatggtttgttaatggcgggaaagaatagaaactccacagggagttctcagttgattgatgccaaacttgaagagtatcgaattaaacaatgtcctgcatgtggtcatcagattgaacgccaggaggctcttcaagattggcctgggcttccttgtggagtaaaatttgaccctacagatcaggagctgatagaacatctacaaggaaaggttggcttagataattccgcccctcatcctttgattgacgagttcattccaacaattggaggggaagatgggatctgttattcacatccagaaaaacttccaggaatatctcgtgatggcctgataaggcattttttccaccgaccttcgaaagcatacacgacaggcaccagaaaaaggagaaagatacaaacagcctgcgatgagagcagtgaaggcgaaacaagatggcacaagactggtaaaaccagaccagtgctggttaatggcaagcagaaagggtgcaagaaaatcttagtactgtacactaattttgggaagcacaagaaacccgagaaaacaaattgggtgatgcatcaatatcatttgggttcacaggaagaagagaaggaaggggagctggtggtttccaagatcttctatcagacacagccgaggcaatgcaattgggaaaaggttacagatgggggggatacgcacagggttagtgtcacagaagcaactcaagtttcagagagatgcacagctggagaaactgttagttccactgccaggcatatttataatcacttggaacagcaaacgaaaatcacccaccgttcctatgatttatctgtaggcagattagaaaatagtgatcgtgtcagcatttctgaataacttaaccctgaaaaccagaaacagcacccaaggagactggtttttggtagaaaaccattccaaaatcttaaataatgataccacctccatgatttgatcttcatgggagtaaaagattggaatggagactcctttatgggaaaaatcctttttgtaac

SEQ ID NO: 753 - DNA, 1064 bp, Pinus radiata
cgatcgcttgctcgctcagcaagaaacagtcgttgacgatggagggagtggcattccagcagcagacggtgccagagctgcttgtaggcttcagatttcatcccaccgacgaggaactcatcacccattacctggagaagaaggtatcctcctcccctctgcctgccccaattattgcagacattgatccctaccaacacgacccctgggatttgcccgcaaaggcatttttcggagagaacgaatggtattttttcagtccgaggaaccgggaatatctcagcggagcgcggccaaacagagccgcaggctctggctactggaaatctacgggatcagacatacccattgttaataagtcgggaagcacgtcgccgagaaaagtgggcgcgaagaaagcactggtgttttacaaaggaaaggctgctgagggcgtgatgaccaactggatcatgcacgaatactgcctcgcccaaaccctgccaaccaagagaaagggatctgtgcccttggacgattgggttctttgccgattgtttcagcgactgaatcattctcccgggatgctctcgtgctcacagctggaggtcccgtcgccatcagctactgacgtgcagcgcaccggacaaaaaccagcgatgccaaaattcagttccttttcgagggtgcttctgaacgaggttccatctatggagaacttaccgagccatgccacgtcagatgccaacaacgcagccgtgtcctctgcggagtccacgtactcgctgcaggtagttcaccacccgctaaattcagcggagagcggaagccactcgtcaatgaattggtctgcgcaacgcctacagggaatgtctcgtcgtcgtataaatatttttgacattttttctgataaaaatccgtcgggaaaagaggggaagcaatcctagtctttgagaactgtgattttaacagtttttgggttccaacgaattgtatctactcatgagttatccgattttcaaggtggcgactataaatgaaataaattgcgttatagctgttactctctttgcttaaaaaaaaaa

SEQ ID NO: 754 - DNA, 1201 bp, Pinus radiata
agaagtatttactggaatttgacagcgaggtgaaacaaattcaagggagaatatgacacagaagggtggaacaggaggacagatagatttgcctccgggtttcagattttttcccacagatgaagaacttgtagtccattatctctgcaagaaagttgtgtctcatcctcttcccgcttttattataggagatgtggatctctacaagtatgatccatgggatcttccagaaaaagctttgtttggagaaaaggaatggtattttttcaccccacgggaccgtaagtatcccaacggttctcgccctaatcgggcggcagggtccgggtactggaaggccaccggcgcagataaacccatcacgacttgcggtgggaggaagcgagttggagtgaagaaggctctggttttttacaaagggaaggctcccaaaggatccaagaccaactggatcatgcacgagtatcgcatggcagaaatcaatatggccgccaggaagaaaaacactctacggttggatgattgggtgctgtgccgcatatacaacaagaagagcagtgctgagagactagaagagaagaaattggctgaagaaatggagtcccgccacgatatgcaggaaactgtgggactccacgatatgcaggaaactgtggagcagcagaagaaaacgcagagtgtcccttcagagccatctcccactgatgcttcaactgtgtctgcagaagctgggctcccatccacaaattcatccctttttaaccctcatcttcctgctcctcccatgaatcctttctgtcaacaccagagcaccactacagatgaagtccagatgaacattaaactggcaaaccagcttattcagaagcagcagcagtcagggcagtgcttgaatttcaacttgggtctggacattgtgcagagccctttcttccagttggataattcagagccatcttctttgttcaacccataccaggaattcatggacaactacagtatacagagatcttattagactctcagttagtcatcccatacactgaatgctatgcccaatttctatgattctgatacagtgtcatgtcacatcacatcacatcaccatgtgtaaatggttcctgtatggtgaaagtatttagcaccaacaacttgaaaaatagcaaagcaaagcaaagcatttattctttcaaaaaaaaaa

SEQ ID NO: 755 - DNA, 1290 bp, Pinus radiata
ctttggtttttgcaatttcggactggcatatacatgtatgcgagagattggaagaatgggctgcaaatcaggaccaaactctgagcagatcaatctgcccccaggtttcaggttctaccctaccgacgaggagttgatggtgcactacttgtgtaaaagagtggcttcacagccctttccaattcctattattgcagagattgatttgtacaagtttgatccatggcaactacccgagaaggcattatttggggagaaagaatggtacttcttcagtccacgagacagaaaatacccaaatggatcccgtcccaatcgagctgcaggatctgggtattggaaagctactgggacagacaaacctgttacagctggagctaacaagattaaggttggggtgaaaaaggctctggtgttttacaaggggaaggctcctagaggtgtcaagaccaattggataatgcatgaatatcgtctggccgatagtgccagtagggctgcaaagagaaaaggaagtataaggctggatgactgggtactgtgtcgaatatatgaaaagcactacgccacccagaagaacggacctaaagaaagcaatgagttatcgtcctgtgtggatcaagaagaagatcaatatatggtggccgctgcatccacatcccctgcagacatggacgacagcaagttgctcatcaatctgccgcgaatcaattccctgaacagaataaactctcttctgaaattccccaccagggaggtcatgaagatgccagaccccaattataatcagacagagcaacaatattccagagcagaaacagttgctggttctaattccggatgccaagcgatagagtatgatcagaattcaccatactggagaaaccagcaattcggatacaactatgatcagatggtgcagaacccgtttcctcatcagttagagaatgttacatccttcggaggcaattctagtgtttattttgcaaacctggctgcagagctcctttagtattcattctgctcttctttgaattacccatggagcttccgcctttggcaacgcaaactacctaacagtggcgattctaactcgatttaatctcttccttccctgcaataacttaccttgcacgggccatggtttccggctgcttaaattttatatttccgatccttttgtctacattttgtaagcttgttacttactgtgttctccaatggcatgagattcttggctttgtattatacagctaaaattatttttgaaggtattccttaaaaaaaaaa

SEQ ID NO: 756 - DNA, 2401 bp, Pinus radiata
gatatcgactcctcctcccttcaaagctccccactccctccatctcttttcatccatttctctgttttctgctctgctcgcttcgtttcggttgggtgctcaacactgttacaactgtttttcctctgacattgaggccccaattctcacttctttttttctctcttctccgcgttgcttctcctccccatttaccatccattatcatagccctctctgcacactaccccgccagtcccctttgcaagttttttcccttctcgtatatttcttcttttttccgctcctcgattcctgtacgtattttttgcccacccttttgtgctagtacatttcccggatctagcgccacacacttatgttttcttggctctgatccccatagcatgtacttactgctggtgcgcaaattaatgcacaaggttgcctccctccgtcgatatcaaatctaaccggagctgttgctgctgctgctgagtccaaatctaagcctgaagtgggctgtagatccttctttctacagccccctgaggtacttatatgaccttctgatcatcacagcgcacaaccttcaacttctcggccacatgttcgtttctcggcttcatcttcctcctcgcagacatttccaattctgagattcaagaaaacagctggagttcgcgccttgagcttcaaaagtcgcagggaggagcgttgcctcgaccaactacttctgcaagtaagaactatcctattacaatgaacacgctatctcgcgttcctccaggtttcagattccatcctaccgacgaagaacttgtagattattatctcagaaagaaggttgcttcgaaaaggattgatttggacgtgatcaaggacattgacctttacaagattgagccttgggatctccaagagaaatgcaagatagggtccgaggaacagacggagtggtatttcttcagccacaaggacaaaaaataccctacaggcacgcgcacaaacagggccacagcggccgggttctggaaagccacgggaagagataaggcaatatactgcaagttgaacctcattgggatgaggaaaacgttggtcttctacaaaggccgcgctcccaatggacagaagtcagactggatcatgcacgaatacaggcttgagaccaatgaaaacgctacacctcaggaggagggatgggttgtttgtcgcgtcttcaagaaacgcataacaacacagaggaaaggaaatgatgataatgtctgttggtacgaggaccaggtaggtttgatgcccgagttagattcacccaagaaacttcctcaaggtggggatatgggataccaacttccattcgcctgcaaacaggagctagagttacactaccatatgtctcatgatccgtttcttcagcttccgcagctggagagtccaaaagtaccctgcaacgcatcctcaagcgcaccaggaaaaagggctgaatgttcaatgccatacaatggatttgaaacaggttgcaacatggaaggacaccatggcaatgccaatccacagtcagcagctacccaagaagatcaacaaggtgttaacacatacaatgaggagcaggttactgactggagagtgctggataaatttgttgcttcacagttgagccaggaggacgtgtcgaaggatgctaggttttctaatgaaacaatgtaccccatacctgatatgactgtgcttctgcgacagtctaataaacatgagcagcaagcagattatgcctcaaattccaactgtgatgttgatctctggagctttgcaggaaaatgaacagccctctaccatccaacaattacatgaacaaatggtaactttaactggcttttcatgtacataataaattacatctaaaggcatcagatttgataggcagtttatggtcgatttattaaccctcagtccttgagggggtgctgaagacaatgggaagaaatcagacaacagagttacatgggaacaatcaataaatatgtggtcagatcattaaggaagtcttgcagccctctgtaaaatgtagacaaatttgtacaccaataagctagctgggtgagctatcatattaacatgtagaatttcacagtgagtgggatatacataagctggatacttatagccctgcagtacattaattgtgttaaaacttctatttatatccctttagttccatcatgcaacttttaatagaccagtacatgaactggtcgtctactgtatgctatgaccatagtcagaatgcaatgttattggattaccactatataattcactgctaaattttaggaaatagacttttgtaagctgtaccgaataactttggataccgtattacctgcaatacaaaatatagaatgatttagtaaaaaaaaaa

SEQ ID NO: 757 - DNA, 1573 bp, Pinus radiata
gggcagataaattatcaagagcgaaaaaaagggagaagggagacgagtaagtggaatttggtttcacttgttaggcttaagaggtggtagaggggaatcgacaccccttctttgcccatgggaacattagcgttacccccgggtttcaggttccatcccactgacgaagaacttatctcctgctatctcaagggcaaactcgatcatggccttaaagaagcagagatcgaggttattagcgaggtcgacctttacagaaacgagccctgggatttgcctgagaaatccttgctgcccagcggtgatatggagtggtatttctttagtcctcgtgataggaagtatccgaatggttcacgcactaatagggctactgaagctgggtattggaaagccacaggaagggatcgtaaagtttactctcgagcaaacacagtaggaataaaaaagactctagttttctatagaggccgggctccacaaggtgaacgaactgattggataatgcatgaatatcgtctcgaggaaaatgaatgtgaggcaggaccttgtttgcaggttgatgctatgccagacactccaagaatacaatgtgaatctgcatgtcttccatctgtcgaaagtgagctccgatatattccagttaatataagctttcctcagtacggagttccaaatggacatttggatgcatattttgaagaagaaaggatgctagaggaaatgttgtgtgtggcttcacaggactatactaattctaaagcatatcatacttctcttggagatacctgtgctgatattttgaatggaggttatataaaagtcaagaatctaataccttccacaggggaagtggagaatcatgattcttgtttatgggaggttccttatccctcatttgatcacgaggaaaccggaatccagttatgctctcgtagtccagttctgcagagtcataagcaaggattttcatttgagggtacagctgcaagaggagtttgcatgcaattccacaaaatggaagattcctcagaaataaatgaaaaagatgtaactgtaagacattcacagaatatgcgaaatgattggtatgtcagtggccaagaaagggagcaactgcactttgatcgatttgctgggaagaaatgggactcagaggtgagaataaaactcaataaattatgatgacaatgaacagttgtttgttaaaggttttagacagctgaaaataggtgcttctcattttcaaacatgtgataatcttctgtctgacatacctagcacctgccccatccacattcttgtgactgggaaagatcagcagctttgcagtgaagttggaggcagcagtaattgttgccattgttttctcattaaattggtgaattgtgggatgtatcaataggtttgtttgcacgtctgtatattaatttattaggccttgatgttcattgtttgcacaagaggagcaaaagggataggagtttgccgcactcaccaagtaaatttggatgcagaatatcagggaaaataaagattctgtgcctgaagctttgacaacataaaaaaaaaa

SEQ ID NO: 758 - DNA, 1846 bp, Pinus radiata
tctgcattcagttcacaacatatcacaagtctgagcgttcatgggcgacttgaactgcttacctccaggctttcgatttcatccaacggacgaagagctggtatgctattatctcagaaagaagctttctaactcgaagtcggagttggaatccgattacttgaatccaattacagatattgatctttacaagtacgagccatccgacttagcggcgacggcatgcttccagggccgggatcaacagtggtttttctttacggaggggaataggaagaaataccctaatggatcgcggaagaaccgggctaccgaaggtgggtactggaaaaccaccggtaaagaccgccgggttctgtcgaaaggggtgactgttgggatgaagaagactctggtgttccacagagggcgctcgtctcgcgcggagcgtactagctgggtcatgcacgagtacaggcttgttcatggcgaggctggggagtcttctttgttggaaaaggatcattttgttctctgtcgagtattcctgaaaagtggctctggtgcaaaaacttgcgaacagcatggagtttctctttcaagagaagattcaagatcaacagataatcagtctgcacttgtgacagaaaacaaacaatatgatgatgttatactcccatcttcaggggagggtgaggtagaagagacatattcaccgctgaagccccttactgccacttcagaggaaaacaccattccctgggatggagatcatctttccaagttcttgctggaatgccttaaagagccagataatgatcaggctgcttgtgattcactgcaaattccagttggggctgatgaatggtctggtttaattaatgatccttttgctgaagtggagggagtcaacactcttgttgatgaagtggacattttgatcagaaatgatacacatgaacaaagttcagctgatcaaaaattacatacagaaaggaatgtccacagggttgattatatcgatgaagcaaacattactgagcaatcaaatttcgaggaattattttctccagcttatttaggtggagactttttggagttgaatgatctaatttcaccacttgattcagatttccttctctaggtcaatatctatgatatacaaggctaccacattagtagcctaaatatggttggaagtgataagtatgcttggttactgttgacaaaatccatgtgtcaacagcaattaaaaacaaatcccagaacatatacatttgcaacgactatttcaagagttggctacatggcaagtgtacgttggctgtaatgagcagctgaagaaaattctgagaagcaataggtttactggacgacaagtttgactcagatgataaaaagtgctcagcattttgaatacaggtgcagtcaatgactaatagtgttagcatggtttctaggatatccctacatatgggatgtgctccatctgttgcaggcacttttgctcgagattcaacttatttgctgttcgaagctaactagatagaggagacaatgaattgctcattcatcctgaaatgcagttctccatctattttcttattctgaagaaattaaggtagaagtttaagtttgtaaggtaggtggatgttattgtcaatatggatttgatttagttgtttgcgtgcttgctatcaatatagtctgtgctggattgagcccagaaaaatgctccagaatatttaggacatttgtagaattagtcacaagtttgcccgttcactttgatattttgacctcatttgtttttctactttgggctgcttgccaagcgtactattatcaattttttttaaaaaaaaaa

SEQ ID NO: 759 - DNA, 1295 bp, Pinus radiata
cagagcatcaagaagaaaacatcgacataagcatgggaagaagagatgcagaagcggatttacaattgcctccgggattcagattcttccctacagaggaagaattgattgtgcattacttatgcaggaaagcggccttgctgccactccctgttcccataatagcagatgtggacctctacaaatatgatccatggcgtcttccagagaaagccctgttcggagagaaggaatggtacttcttcactccccgggatagaaagtacccaaatggttcaaggcccaacagggcggctggttctggatactggaaagccactggtgccgataagcccatcacttctactgcttctaaaggagtaaagaagagagtaggcgtcaaaaaggccctcgtcttctatgttggaaaagcacccagcggctcaaagaccaattggctcatgcatgaataccgtcttgccgatattaacaggcctgcaaggaagaaagacagcttaagattggatgattgggttctctgtagaatatacaacagaaaaatcagtgctgagaaattagcactagagcagaaggaaagcttcaatgatgtaccaatggaaaccattgatgaaaaggaaatgaaggttgagcccacctcaacttcattcaatcatagcaccattgaacagagcaacccatcctttgaccatttgagtaaatttggatcttctccaacatgctacaactcggttcccccgggtgcttctcccatgaattctaatagccgtttccagaatctggatttcttgcaaaactcaaccaccccttttagtggcagtacccttaaggctccagtgcagaatacagcattcaacccaatttccccctcacagacaaattacaattcaacagagttaatttcaggattgcatgatgatttcagttgttccaaggcatcatcattttcagaacccatttgggagaaagaagttgagagcagcttcagattggaaaatttctcgcagaagcagcaacaatcattatttaatttggatctggaaggtctacaaagttccttccctcatttagaccagatatcttttagtgatgcttatcaagactggtttctagtctagcgacccatgacccagtggaaggtctattggcctttgggttttttttgtaattttttaaagactacctctaattccattgaatttatggacttacagcagttttaactgacagcatgttacatcatttttttaataaaattatgtctcgcagggttctcccgcatcaaaaaaaaaaaaaaa

SEQ ID NO: 760 - DNA, 1366 bp, Pinus radiata
gggaaagggtcaaacggcaatttattccaaggagcaatttcttgcaccacaagatagagtgaaatatctttatcagtcacagagcagggggtaaacattaaaaaaggcaatagcaggtcaaaggatcgaaactcctgagaagcatgggaagtagaagtgcagaagcggacttacatttgcctccgggattcagattcttccctacagaggaagagctggtggtgcattacttgtgcaagaaagcgacctcgcagtcactccctgttcaaataatagcagatgtggatctctacaaatatgatccatggcagcttccagagaaagccctgtttggagagaaggaatggtacttcttcactccccgggatagaaagtacccaaacggctcaaggcccaatagggcggctggttctggatactggaaagctactggtgctgataagcccatcactgctaaagggggaaagaaaagagtaggcgtcaagaaggccctggtcttctatgttgggaaggcacccaaaggctcgaagaccaattggctcatgcacgaataccgtcttgctgatcttaatacgcctgcaaggaagaaaggcagcttaagattagacgattgggttctctgtagaatatacagcaaaaagattagtgcggagaaattacaacgagagcagaaggaaagttccaatgatgtaccaatggaaaccattgatgaaaaggagatcgagaatcagcccacctcagcttcgatcgagcacagcggcattgaagagagcaaaccattttctgacaatttgaacgaattgggaccttcgacaacaagctacaacgcggttcccatgaattccaatatatatttccagaacccgggtttcttccaaaactcaaccacccctttcattggcaataccctcaaggctccagtgcagaatacagcattcaacccaatttcctcctccgtcaaccaccattggacaaattgcaattcggcagacttaatttcaagattgcatactgattccagctgctccaagccatactcagaacccatttcggagaaagaagaaatacagagcagcttcaggatggaaaatatctcgcaggagaagcagctgccattatttaattccagtctggaagatatacaaaatacctcttcttatttagaccaagtaacttttcctgatactcatcaagattactttactaccttaaactgttcagactacttacccaggttctaccctaatgagctcttccgttgagttcatgagttacagcaaggtttattgccccctggttaaattatttttgaccttcgattccactgagttcggggacttacacagccagggttattggcccctgg

SEQ ID NO: 761 - DNA, 1404 bp, Pinus radiata
ggagaggagagggtcaagagacttgagagacttcagaagaaaacataggcgtaagcataaacatgggccgaagaaatgcagaagcggagttagagttgccaccgggattcagattctgccctacagatgaagagctgttggtgcattacctgtgcaagaaaggggcctcgcagtcgctgcctgttcccataatagcagatgtggacctctacaaatatgatccatggcagcttccagagaaagccttgtttggagagaaggaatggtacttcttcaccccccgggatagaaagtacccaaatgggtctaggcccaacagggctgctggtactggatattggaaagctacaggtgctgataaacccatcagtgccaaaggaggaaagaagcgagtgggcatcaagaaggctcttgtcttctatgctggaaaagcacccaaaggctcaaagaccaattggatcatgcatgaataccgtcttgctgatgttagcaggcctgcaagaaagaaaggcagcttaagactggatgattgggttctctgtcgaatttacaacaaaaagacaagtgctgagaagttagcactagatcagaatgaaagctacatggatgtaccaatggaagccatcgatgaaattgagatggtgaatcaaccctcctcaacttcaatcgagcatagcggtattgaacagaacgggccatcttctgaccttttgaacaaatcgggaccatctccaacaagccacaacggggttccccctcgtgctctgcccatgaatactaataatatcagttcgccgaacctggacttcttccaaaagataatcaccccttcaagcgccggtacccctaaagctccagtgcagaatacagaattcaacccaatttcctcctccatcaaccagcaatggataaattacaattcaatagacttattgtcaggattgcatactgattccaacagttccaagccatcatcatcatcaaaccccattttagagaaagaagaagttcagagcagcttaagattggaaacttcttcaccagaggagcaaaagccattctttaatttcagtctggaaggtctagaataccccttctctcatctagaccaaataactcttcctgatccttatcaagactactttacaagttggaccggttcagacctaccaaggttttatgctaacgacatgcgcttctgttgagtagtttgaccagttcaaacctaccaagttctttccctaacaacatgcacttggtcatgaacttacagcaaggctattggccctggttaaataacttttgataagtctgcttgcggttcagtccctgcctttgagttcatggactgagagtaaggctaaatggccctgggtaaaatgatttttttgagtaaaaaaaaaa

SEQ ID NO: 762 - DNA, 1734 bp, Pinus radiata
ggcaggtcagagcatcaagtgtattaaaagaaattgcagtagcagagaaagtcagagcatcaaaagaattagcggtagcagaagcaggtcagagcatcaggagtattgagaagaaaacacaaggataaacatagccatgggtatgagtagaagaaatgcagaggctgacttacagttgcctcctgggttcagattcttccctacagatgaagagctggttgtgcattacttgtgcaagaaggcagcctctcagatgatccctgttcctataatagcagaagtggatctctacaaatatgatccatggcagcttccagagaaggccctttttggagagaaggaatggtattttttcactcccagggatagaaagtacccaaatggatcaaggcccaatagggctgctggttctggatactggaaagctacaggtgctgataagcccattactgctaaaggtggaaagaagcgagtgggcatcaagaaggctcttgtcttctatgctgggaaagcacccaaaggcacaaagacgaattggatcatgcacgaataccgtcttgctgatgttagcagacctgcaaggaagaaaggcagcttaagattggatgattgggttctctgtcgaatatacaacaaaaagatcagtgctgagaagttagcacaagggcagaaggaaatctcccatgatattgtaccaatggaagccatcgatgaaaaggatatggataatcaaccctcctcaacttcaattgagcacagtggaattgaacagaacaacccatcttctggccgtctgatgaaattggaaccttctccaacaagccacaacgtggttccccctcgttcttatcccatgaattccaatttcaatttgcagaacccggatttcttccaaaatacatcaaaccctttcaatgccagtacccccaaggctccagtacagaatacagcattcaatccaatttccccctccatcgaccaccaatgggcaaattacaattcagcggatttggtttcaggactgcatactgattctagcagttccaagccatcatcatcttcagatcccatttcggagaaagaagaagttcagagtagcttcagactggagaatttcttgcaggagcagccacaaccaacgtataatttcagtatggaaggtctgcaaaatcccttccctcagttagaccaaataacttttcttgattttaatcaagattactttactggcttaaccacttcagactacctaccaaggttcaactcaaatgacatacaattccaatgagttcatggtcttagagcaaggcttgtcggtccctggttaaatattttttttataagagtctgcctgtacagcttaatccggctatagttattctcaaaccatattctgaatctctcgtattagcttcaaaatcatgtacagcttgattctttggagacaaacctttgacataaaacaggattggatgccacagatattcagtctatctttaggtcccatgctatttttagcaaaaggcccacctcttttttaatcagaagttccactctttctgtccgaactacttttggaatggttgtaacaatataatacttttaatgtaatataaggctggaattgaaggaaaggaaagtttaaggacagcagcttgccatttactttagcatccttgttgaatgaaaggaaattcaatcactttgttatacaactttaaaaaaaaaaaaaaa

SEQ ID NO: 763 - DNA, 1453 bp, Pinus radiata
aaggaattggcatttgagagagcagggaatacagtcaaaggtgaaatcaagatcaagctttacaacatggggagacaggatgcagaggcccagttgaatttgccgcccggattcagattcttccctacagatgacgagttggtagtgcattacttgtgcaggaaggctgcctcactgcccattgctgttcctattattgcagaggtggacttgtacaaatttgatccatggcagctgccagaaaaggcactgtttggagaaaaggagtggtatttcttcactcccagggacaggaagtatccaaatggttctcgacccaacagggctgctggctcaggatactggaaagccacaggtgcagataaacccatcactgctaagggcagcaacaggcgtgttggcatcaagaaggctctggttttctatgtcggaaaagcacctaaaggaaacaagactaattggattatgcatgaataccgccttgctgatgtcaatagatctgcaaagaagaagggcagcttaaggttggatgattgggtactttgtcgaatatacaacaagaagagcagtgcggagaagttagctaaggagcaagagtggtcctcagaagaggcaatggaacaattccacgaagaaattgatcaaaaggtgccaggaatactgcccactggggatactacaatgaactcgaacattgagcattcacaaagaacttcacaagattcaaccaaatctgccccctctccgaattgcagaacaatctctaagcatgattcaagaacttctgccattacttccatgagctacaactcaaactccatttttgagcagaatttgaacatttcaaatgccagtagtgctccaatggagcttccagaacttgtcccatttttcaaccctatgactaatcacaggacaaattatgattcagcagatttaattcctcctattctgctcaccgattcaagttgttccatgcaatcgtcgcatgatcttaaatccgataaagaagaagtgcagagcagctgtagattggaagaattgaagcagcaacagcggcagcagcagcaggagaatgctggtttgaaccaatcagtgttcacctttggcttcgagagtctgcaaaacccattcccgcagttagaccaaatacagccttcctccagcaatgatcctttccaagattacttagccagcctcacagctccaggctacttaccgaggtcttctttttagggggattgatagtcgagtctaagttacaggtcgtcatacaagaaaagtagaaattagtagttagcgtgtatagaagtagcagaatttgttgaatcgaagcaaaattcattcattctttctctgacagagaaattgagtgtatgtgcaagcctcctcattttttaatgcaattcattctatatactcctctgagagcatattttacttaaaaaaaaaa

SEQ ID NO: 764 - DNA, 1667 bp, Pinus radiata
gcatggacgaagcagatttggagttttggatttactgtaccgtatattgctaggatatctccattttcatttcccccttcctccaaaagtctgcagccaaagaagatcgaaacctttaaaaacttacggaatgactttatcagtaaatgggcagtcccgagtgccgccaggctttcggttccatccaacggaggaggagcttttatattactacctgaagaagaaggtctcgtttgaaaagattgatcttgacgttattcgcgatgtggatctcaacaagctggagccatgggatattcaagagagatgcaagattggatctacgccacagcacgattggtacttctttagccacaaggacaaaaaataccctaccgggactcgcacgaatagggcaacagcggccggcttctggaaagccacgggacgagacaaggccatacacacgaatttgaagaaaataggaatgcgaaagacgctggtgttctacaaaggccgagcgcctcacggccagaaaacagattggattatgcatgaatatcgcctggacgacgccgaatatccccaagccaatacattcaacgagttacaggaggacggctgggtcgtgtgccgagttttcaagaagcgcaatcatcacaagagccaagaatcggcggaattgtcacccaaatacggcagcaaacaattcagcaacaacaaaattctgtcagactcagattgccccagcgataatcttacagaccagttgcactacacgcatcagctgaacatgtgcaagcaagaactggagatgcagcaatacgcgttcccccacgaccaattcatgcagctgcctcagctagagagccccaagatccccacctgcaacaaccctccttcgtccggcatcaaacgattctttcccgatagtcgatcagggttcttccagctcgaaaacattcctaactccaagcgcccctgcagctatccgatgactctggacatgaccgaattggagggctccacggtcacgacacacgaccatatgaccgaattcaagcccacggaagaagtccagaatttgcaggactggacagtgctggaccggctggtagcttcgcatcttaacggtcaagaggtcgaaactcccaagctggaagtgaggacctacggcgctcctaattcttcttccgatcatcaggccttggtggatgcagcaacagcgtctggagatcagctcacacttctaccccagcttcgaattaacagactgaacccccatgactactcttcatgtgaaatagatttatggaacttcgtaaagtaaaatattattcttatgatctgcaaattaatatactcatgtagtttaaacgttaaagctcctaaaaacaaattccatgactgctcattgatggtatttgctgtaaggttttagggaatagaatgtgaatgtagcaagaagagatcatatgaggctctctgtgtaaatatagtttaagatgtcatagttatctatggattcatcagttacttgacataggttagaatcagtctgtgaagaacaggctgatacactgaaagagctgtatccttattcaaattgtcgaccactccaaggttgaaactgcagacttaatattttttattatttcaataattactattattatacaaaaaaaaaa

SEQ ID NO: 765 - DNA, 1587 bp, Pinus radiata
ggttcaacttgtccaaatccaccattccgtgcttctggagagctgggcgttcataccgattgcagattccagatcgcaatggcgagaccatggattactgatggtaggagaatcgcaatgaaaataagaaatccaacacaacttctcgaaaacgagaacgggagaaatgatgtcaggatagcttgccccaattgcgattatgaaattgacaatagccatgtgactcaagagtggccagggcttccctctggtgtaaagtttgagcctagtgacgaacagcttgtaggacatttagcagcaaaagttggaataggaaattcaaggccacacccactcatcaatgaattcattttgacactagaggaacgtgacggcatttgttatacacatcctgagaatttgccaggggtcaagcaagacggaagcagcacccatttctttcacaggacaagcaaggcttatacaactggaactcgtaagcgtcgaaaggttgacaattttcgttggcacaagacaggaaaaacaaggaaggtatgtgaaaatggggaacagattggttgcaaaaaaataatggtcctctatacgactccttcaaaaggctcaaaatcagtgaaaacagattgggtgatgcaccaataccatcttgggactgaggaggatgaaaaagaagatgagtttgttttgtcaaaaatacaattaaagcaatgtgataaaaatgatccaggcatacctgaagaggaggatgctgggacttcaaatagcaaaggtgatccatcaacacctacaacaagtactcctccccaaccatgttcaaagaagcaacattcttgtcttgatcgaattgaggaagaacatatgtttcgtgcatcatcacctcaggctgcagatcttgatccaaaatttcatttgccttccgaacctattgaagcagaatgtgatggacaaatctttccagacgtgacttcatggttggcaggggaatctcagtgttttgaagattcacaggagcagatggttggccatttttcttgcgaggagatacttggaaacggatcttgtcaggagaatgttgaagaaacgaacatccctggtttgtctgattgtggtcggattggagggaatggacatgaaaaggaaatgcagcaaacttcatattctgatctagcaaacttagattttgatacgccacctgatgggcccattccattagattcacagttcagttcccaagaaagccttttaggatggttaaagaactttggtaacagccaatgaagtatatgatgaactttttcatgcatgttaaggtcatgctcggaggctattttgttttgaaaggagttgaatatccatctacagatttactgtttcgatttacatttggaatcaataaaccgttaaaaagatttttcaccgccttcggaagtaataaataccctattgatattcatttttatctctagtatatcagcactatttatggaggaacagaaaaatggactgatatagtatggtcatatagtatggtcacatgtgtgccagcatttgcttaattataatttatcattgatattcccaaaaaaaaaa

SEQ ID NO: 766 - DNA, 1895 bp, Pinus radiata
ggctccattgattgatttgcagattattcagaaatggccagggcaccatggcttattgatagcagacgctttgcaacaaaaatcaagaatccaacatttgatccttcgaaagaagatcaaaatggcggtctagttagaaaatgcccgaattgcaactatgaatttgataatagtgatgtagctcaacagtggccaggtttacctgctggggtgaaatttgacccatctgatcaagagctcatgggacacttagcagcaaaagttggagtgggaaatggcaagccccacccattgattgatgagttcattcctacactcgaggaagatgatggaatctgctctgctcgtcctgaaaatttgcctggagtaaaacaagatgggagcgtgtgtcattttttccatacgacagctaaagcctaccatacaggcaaccgtaaacgccggaagatccaagaagaccgttggcataagacaggcaaaacgaggcctgttatagaaaatgggatacatagaggctggaaaaagatactggttctctatgtgagcactgggaagggtaaaatgtttgagaaaacaaattgggtaatgcatcaataccatcttggtagcgaggaagatgaaaacgatggtgaatttgttgcttcaaaaatattttaccaacaacagcataagcaatctgacaaaaatgaagtacctcaagaaacggaagttacgagtttaatccctataccagatccattaacccctgtcacatcagctccaaaactatcttctcatgcaaagtcgcaagcagatctagatagtgtgagagaagagcaattggattgtatggatagtcctggccagggagtaagtcaccatacaaatgaaaatttggattattcaacatggcaggggctaaattgtcaggaaaatataagtttggatgattcaatcttgctaccaaaagaatctcagtcaagggttgattcacaacagcttctagatgattttttgttttgtgctgagactgttcagtgctcttcgcctcaaaatctcattccagatgcggtcgaacatggtcgcattaaagctaaagaacttgacaaatatggaaatgtgtctgatgccattccatgtcttgacaatactgaacttgatacacatcctcaaaatgccattctagatctgggtgaacatggtcgcattaaagctaaagaacttgacaaaactgtgaatgcatctgatatgattccatgtcttgacaacattgatcttgatacacctcctgacatagagaacattgaactaaatttcaattcccaagagagcctctcagcttggacaaggggcacaacacattgattcaaaatgatagagcgctaagaaaagtatgagagtgccacagtacagaaggccctctacttgctggtaggatggaaatgtggaaggccctctacttgcatatttgatctgtttttcaaattaaaattgcacatccaagattcatatggaaaatacagattcatacaaccacatgcagattcgacatctttttattatagccaagcaatatatacagaagaaagctttttatttcttattttgtatcttttgatatttcatacatagctatctattagcaaaattagattatccgacttcaacggtattccgtctacggagatgcattgttaaattaatcagtatataagatcaccagccagcatgcggctaattttgatggataccatacagtttgataagttgaaaggctcgtctgaagtctgatatgtactgaagcacttaatgttttggccatttattacattcgaaattctcaacattgcaccgctggttatttatttaagtatttaattagagtgaaatggagctttccatagttaaaaaaaaaa

SEQ ID NO: 767 - DNA, 2116 bp, Pinus radiata
cgaagttttaggaaggagcagaagttcgtcgctcgagagaggttgcttatagaagaggttatatctctgtctgtctgtgaatctggacttttgtctgtggaaaggagtgacctgacaggaaattgatgtgggttttcttggattttctgaagctcgccaaaattgtgtgtactctatacggcctaacattacagaggtgtctttatttccatcccccaacaccccccctgacaccatagttatcctgcagcccgctctctcaattctctgaaattcttcttcttcttgcactgcccctcgtgtgtgtcatggagtcagcgactgtgaacaacaagcaacagcagcagatgaataagattgatgacgagcatctgcccccaggtttcaggttccaccccatggatgaagaattggtgacatattaccttacacagaaggttcttgatagcagtttctcctgcagagccattgctgaggttgatttgaataagtgcgagccctgggacttaccagacaaggctaaaatgggagagaaagaatggtacttcttcagtctgcgagaccgaaagtatccaactggtacacgcacaaaccgagccacagaggctggatactggaaagcaactgggaaagacagggaaatataccgaggcaaaactaatacactggttggcatgaagaaaacccttgttttctacaaggggagagcaccgaaaggagaaaagaccaactgggtaatgcacgagtatcgtttggagggcaagtttgcatattatgattttcctaagactgcaaaggacgaatgggttgtaacaagaatatttcagaaatcttctggagctaaaaagggtccattagggcttgggagaagctccagttatcttgatattgattctccaaatttgcctccacttttggagtctccttgtatccccaccagtgttgggggtgcgatatcttttgaaagtgaatcagcaggatctgaccagcagcatgtgacctgcttctccacgccaggttacaccaacaataaccaaggttttgggctggcccctaatcaggttcagcaaaccctgggttccatttcttctgacatgccagatttccaatttctgcaaaatatgctaatgggtatgaattctaacagcagccctacacagatctcaccacagatgtctaatcgtgcttctcagcttccatcctatcccatgggccctaattctaacttccctacgtttgccaatctcctctatcccggtggcatgcagcaaaattcttacaataatatcttcaagactcatgcagacattgccaacgatagatttaagcaatgcaagatggagcctccttctccattgttcgatgcttctggaacagtcaagaactcaacagtgcagcaaccaggttcaagccgctggattaaccctagcagtggctatcaacacggaaatcaagataatctggagcaaaagtatcgagtccctcagcagcagcagcagcaaatgcagaatcaaaacatggtgagcctctcacaggaaactggcctgagcactgaaatcaacacagatatgtcatctgtagtttcgagtcaactgaaccaggcatatcaggaagagactccagacatggattccctatggaattcattttcatgaaaagggtcaaccaattcacagtgctgtttgttatagaacaatctgtatataaaaaaccctttgtatgaaggtttcaaaacccagtggccctacttctgtatggcacccacttaactgatccaaatattattcccacccatttaacaaattcacttatatttagtccctgcacatattcactcactgaaaattcagtcttccagtttggtgattatgaaattcttatgttgtatacattgtattgattgatagatacacagcatcagctgtaattatattcaatatattttgagtatatactatttctcctcttatttgtttgtatcagtcactgaccctttcccacatattttttcttccctttcggtaaatacaaactacctcacctgcatggtctgtaatatgtaaaggactcattgatatccagattaatgtaaattccattgattgcaaaaaaaaaa

SEQ ID NO: 768 - DNA, 1734 bp, Pinus radiata
gggcagattaattatcacagcgaagcaaaagggggaagggagaccagtggaatatgagggagtggaatttggtttcacctgttcggcttaagagttggtagaagggaattcgaatcccctttctttgaccatgggaacattagctttacctccaggtttcaggttccatcccacggacgaagaacttatctcctgctatctcgagggcaaactcaatcatggccttaaagaagcagagctcgaagttattaccgaggtcgacctttaccgaaacgagccctgggatttgcctgagaaatccttcctgcccagccgtgatatggagtggtatttctatagtcctcgtgataggaagtatccaaatggttcacgcactaatagggctactgaagctgggtattggaaagccacaggaagggatcgtaaagtttactctcgagcaagtacagtaggaaaaaaaaagactctagttttctatataggccgggctccacaaggtgaacgaactgattggataatgcatgaatatcgtcttgaggaaaatgaatgtgaggcaggaccttgtttgcagaatgcttttgtcttatgtcgtgttttcaagaagagtggacttggtacaaaaagtggagaacagtacacggcaccacttgagaggggtgatttatctcctacagagaaaaatccctcccctggttactctggtgacatggaagtgcagtcagaagatctgtcaaagccagtggagggaattgatgcaaatttacatttaccatcaaatatatcatcgaagattctacatgatacaactggagataatgaaccacttaataaatggttagacatattgctggatgacactattccaaactcttcatgtgttgcagctgatgaggacacaattcacacacaggttgatgctatgccagacactccaagaattcaatgtgaatctgcatgtcttccatctgtcgaaagtgagctccgagatattccagttaatataagctttcctcagtacagagttccaaatggacgtttggatgcatattttgaagaagaaagaatgctagaggaaatgttgtctgtggccccagaggactatactaattttaaagcatatcataattctcttggagatacctgtgctgatattttgaatggaggttatataaaagtcaagaacctaataccttccataggggagccggagaatcatgattcttgtttatgggaggttccttatccctcatttgattgtgagggaagcggaatccagttatgcactggtagtccatgtttgcagagtcataagcaaggattttcatttgagggtacagctgcaagaggagtttgcatgcaactctacaaaatggaagattccacagaaagaaatgaaaaagatgtgactgtaagacattcacagaatacgcaaaatgattggtatgacagtggtccagaaatgcagcaactgcactttgatcgatttgctgggacgaaatgggactcagagaatatcaaggaaaatgaagactctgtggctgaagctttgccaacatatatgactggtcaaattgatggtatgtgcactttgaatattttcttaacactaaaaaaaatcagtttagaatgacaaagcttatattgttctttgatgattgctgtatgatactaatacaagtgcaaaaaaaataaatattaaatttgaaaatttaactacttaagtcaaaaaaaaaa

SEQ ID NO: 769 - DNA, 2049 bp, Pinus radiata
attttaatctacaaatatggaagcactaggtctccgttagggtatccgttatttgacgggagagcgacgacagtgatcaagctatccatcccaaatacgaacccggttactgttcccagtaatcactgaagagcgacacgtatgcgcaaaatatctgccccaattttcattgggtttttattctgcaaatatggacgccctacatagtatgttggttgggcatggcggagagacatacaaataataggtgggcggaggcattatcagccgccagcacagaaagacggcaggttgattagacggcagataaattatcaacggcgaaagagaagggagcagggagacgagtggagaggtttgtttgtgtcaatatgagggattggaatttggtttcacctgttaggcttaagcgttggtagaggggaatcgatacccctttctttgctcatgggaacattagctttacctccaggtttcaggttccatcccacggacgaggaacttatctcctgctatctcaagggcaaactcagtcatggccttaaagaagcagagatcgaggttattagcgaggtcgacctttacagaaacgagccctgggatttgcctgagaaatccttactgcccagcagtgatatggagtggtatttctttagtcctcgtgataggaagtatccgaatggttcacgcactaatagggctactgaagctgggtattggaaagccacaggaagggatcgtaaagtttactctcgagcaaagacagtaggaataaaaaagactctagtattctatagaggccgggctccacaaggtgaacgaactgattggataatgcatgaatatcgtcttgaggaaaatgaatgtgaggcagtaccttgtttgcagaatgcttttgtcttatgtcgcgttttcaagaagagtggacctggtacaaaaagtggaaaacagtacacggcaccacttgggaagggtgatttatctcctacaatgaaaattccctcccctggttacactggtgacgtggaagtgcagtcagaagatccgtcaaagccagtggaggggattgatgcaaatttacatttaccatcaaaaatatcatcgaagattccagatgatacaactgaagatagtgcaccacttaataaatggttagacatattgctggatgactctattccaaacccttcatgtgtagcagctgatgaggacacaattcacacacaggttgatgctatgccaaacactccaagaatacaatgtgaatctgcatgtcttccatctgttgaaaatgagctccaagatattccagttaatataagctttcctcagtacggagttccaaatggacatttggatgcatattttgaagaagaaaggatgctagaagaaatgttgtctgtcgcctcacaggactatactaattctaaagcatatcatacttctcttggagatacttgtgatgatattttcattttgaatggaggttatataaaaatcaagaatctaataccttccataggggagctggagaatcatgattcttgtttatgggaggttccttattccttttttgatcgcgaggaaaccggaatccagttacgttcttgtagtccagttctgcagagtcaaaagcaaggattttcatttgagggtacagctgcaagaggagtttgcatgcaactccacaaaatggaagattcctcagaaataaatgaaaaagatgcaactgtaagagattcacagaatatgcgaaatgattggtatggcagtggtccagaaatggaggaactgcactttgatcgatttgctgggaagaaatgggactcagagaatatcagggaaaatgaagattctgtgcctgaagctttgccaacatatatggctggtcaaattgatggtatgtacactttgaagattttcttaacactaaaaaaaactgattagaatgacaaaaattatggtgttctttgatgatcgctgtaagatactactctacaagtggaaaaaaaaatattaaattctaaaatttaactactaaaaaaaaaa

SEQ ID NO: 770 - DNA, 2046 bp, Pinus radiata
ggagacatacaaataataggtgggcggaggcattatcagccgccagcacagaaagacggcaggttgattagacggcagataaattatcaacggcgaaagagaagggagcagggagacgagtggagaggtttgtttgtgtcaatatgagggattggaatttggtttcacctgttaggcttaagcgttggtagaggggaatcgatacccctttctttgctcatgggaacattagctttacctccaggtttcaggttccatcccacggacgaggaacttatctcctgctatctcaagggcaaactcagtcatggccttaaagaagcagagatcgaggttattagcgaggtcgacctttacagaaacgagccctgggatttgcctgagaaatccttactgcccagcagtgatatggagtggtatttctttagtcctcgtgataggaagtatccgaatggttcacgcactaatagggctactgaagctgggtattggaaagccacaggaagggatcgtaaagtttactctcgagcaaagacagtaggaataaaaaagactctagtattctatagaggccgggctccacaaggtgaacgaactgattggataatgcatgaatatcgtcttgaggaaaatgaatgtgaggcagtaccttgtttgcagaatgcttttgtcttatgtcgcgttttcaagaagagtggacctggtacaaaaagtggaaaacagtacacggcaccacttgggaagggtgatttatctcctacaatgaaaattccctcccctggttacactggtgacgtggaagtgcagtcagaagatccgtcaaagccagtggaggggattgatgcaaatttacatttaccatcaaaaatatcatcgaagattccagatgatacaactgaagatagtgcaccacttaataaatggttagacatattgctggatgactctattccaaacccttcatgtgtagcagctgatgaggacacaattcacacacaggttgatgctatgccaaacactccaagaatacaatgtgaatctgcatgtcttccatctgttgaaaatgagctccaagatattccagttaatataagctttcctcagtacggagttccaaatggacatttggatgcatattttgaagaagaaaggatgctagaagaaatgttgtctgtcgcctcacaggactatactaattctaaagcatatcatacttctcttggagatacttgtgatgatattttcattttgaatggaggttatataaaaatcaagaatctaataccttccataggggagctggagaatcatgattcttgtttatgggaggttccttattccttttttgatcgcgaggaaaccggaatccagttacgttcttgtagtccagttctgcagagtcaaaagcaaggattttcatttgagggtacagctgcaagaggagtttgcatgcaactccacaaaatggaagattcctcagaaataaatgaaaaagatgcaactgtaagagattcacagaatatgcgaaatgattggtatggcagtggtccagaaatggaggaactgcactttgatcgatttgctgggaagaaatgggactcagagaatatcagggaaaatgaagattctgtgcctgaagctttgccaacatatatggctggtcaaattgatgggaacttagtacatgggttgacactcacaattggggttggttcaactaaagatgtacatgagaccctggcctaacaacaaagtgctcaaatcattaaaaatatgtgatgtgttccatcgttgtcggctccaatggtctatgatatcagggctaattttcattatttggattgtgtgttgggggcaataattaattcctaatctagccacccttggattttgtgcatagtgtctatgttatgcaatatgtcatctctatacctaggcgtgtctttaaataaaatgattatattgagtacttgcacttgatggagctttggactacattgtaatttgaattgtcgtgttaaaattcaattcattataaaaaaaaaa

SEQ ID NO: 771 - DNA, 1930 bp, Pinus radiata
gtttatgtaccagaggttcttatgaacgtaagagatttgaatttgttttcaactgcaaggtttcaaagacagttgaagagttgatatcaccagcggggagaggattattgttactccctttggccatgggaacgcttgcattacctccaggtttcaggttccatcccacggacgatgaacttatttcccactacctcaagggcaaactcaataatggcctcaaagaagcagagctcgaggttattcccgaggtcgatctttacaaatgcgagccgtgggatttgcctgagaaatcctctctgcccaacactgacatggagtggtatttctttagtcctcgtgataggaagtaccccaatggttcacgcactaatagggctactgaagctgggtattggaaagctacgggaagggatcgtaaaatttactctcgggcaagtgcaataggaataaaaaagacactagttttctatagaggccgggctccacaaggtgaacgaactgattgggtaatgcatgaatatcgtctcgaggaaaatgactgtgaggcaggaccttgtctacagaattcttttgtcttatgtcatgttttcaagaagagtgaacttggggcaaaaaatggagatcagtacacagcaccagttgagaaggatgatttatctcttacaaagaatgtaagagatcccttaccttatcactttggtgacattgaagtgcactcagaagatcggtcaaagccagtggaatcggttgatgcaatttcaagtttaacaccaaaattctcattgaagattttaaatgatacaactggggataatgccacacttaatacatggttggacatatttttggatgactctaattcaaactcttcatgtgtagcacctaacaaggacacaattaacacacagtttgatgctgtgctagacaatccaaggatgcagtgtgaaactgcatgtctcgatgaaagtgagtttccacaaattccagttgatctaagctttttccgctacgaggttcaaaatggatatttagacacattttttgaagaagaaaggatgctagaggaaatgtcatttgctgcctcccaggtttacaataactctaaggcatatcattcttcccttggtgacgtatttgccgatattttgaatggaggttgtataaaactcaagagtctaatgccttccatagaggagatggagcatcatgattctggtttatgggaggtacctaatagctcacttgatcatgtgggaactggaatccaaataagctctcatagttcgatgttgcagggtcaccaacgaggatttttatttgatggtacagctgcaagagtttgtttgcaactccataaaatggaagattctgaagaaagatatgaaaaagatttgagtgtgcgaaaattgcaaaatacatcaaatgatatgtatgatggtaacaattgttctacatgtggtccagaaacgcagcaactgcactttgatcaatctgatgggcagaaatgtgattcacacgtgagaaaaataaatgaaaagaataacagagaaaatgaagattctgcacctgaagatttgtcaacagatatggcttgtgaaattgatggtacttctagtcaattttattgtaagtttgattctaatcaattttattctaagtttgatacgagttgtgatgtgatctaatctagagaattcaagtacctctctctacatcaaaaatttgtgagaaaataatcattatattttctttcaactatttttttttaaatcatacttttacatgagtaaaataatcataatgtatttttaaaattcttttggagactaggataacacttttattatagttatatgttctgattcagaattatgtttttttaatgattaaccatcatgttattgctatccatatagcatggtagatt

SEQ ID NO: 772 - DNA, 2501 bp, Pinus radiata
gatcaagggccgggcttgactactctatgggtttagagatttgatccatgggatacggttaacaagctagtggagaagtagaaatttggattaaattattcaaacagagatttcaatggatcaagtttctctacaacctggattccgtttccatcccactgacgaagagctagtcagttactacttgaagagaaaagttcgtggacaacgttttagtttcaatgcaatttcagagattgatctatataagtttgagccttgggatttaccaggcaaatcttgcctaaagagcagagacttggaatggtattttttcaatcccaaggatagaaaatatcccaatggttcacggacaaatcgatcaacaaaagatggttactggaaaacgacaggaaaagaccgagctatttcttcagcttcaaaaacagtgggcatgaaaaagacactagtataccacagaggacgagctccccgtggggaaaggaccaactgggtgatgcacgaattcagacttgaagggaaggatttaaagatgcccaacatagctcaggactcctatgtactatgtcgggtattccagaagagtggtcctggtcccaaaaatggggaacaatatggtgctcctttcagggaagaggattggaatgcagacatccttggtaaagctgaaacaaaatcttctgtagaaatggaccacattagtacaaatgattccactttgagcaaaaccatggaggaagttatttcataccatggagagaatcctccattggataacgagattgttgcccaagtcgacgaaccagcccctgcaagatctgattatgatattaataggatcttggaagagaatcctccattggacaacgagattgttgcccaagtcgacgaaccagcccctgcaagatctgattatgatattgataggatcttggaagaatggattggcaacccaaatgatatggagccaaacactgatgaaaatgaattggtgcaaggaaatcaggactgggatactctgatctcaaaagaaacattggaacatatcattgtgcaaactgaagatgttgaggtgtttaatgatttgggagacttgtttggcaacataaataatcctgtgcagagaaatatggaagattatgcgggtgtctttcatttgcaagatggcaggggagttgaagagcgggtatctacaagtattgatccgttcatatcaaatccacatgaatcatcgcctgcgtttcttgatggatctttcttagagctgaaggatcttgcaaatccagttgagctaaactcttctgatctggagacctttgatataaaggatactttctttgatgtctcagagtccccagataattttgctgcttcatcaattgccttgtattctaaggagagtcaaaaccagaatactgacttacgttttcttaggggtaaacaaaagatgtcaactgaagtgtcagaacagactcacagtccaacatatggatacagtgtgctccaagaggcttataatgtggaaagacacccattttccagtccactaggggaaaatttgggatctctatcttggatgcaagaacaatggatcaataatgctagtgatggctttgccttttcggaagtagatgttgcaagaaatctggttccttcagcagattatgagtttatgacaaaaagacaagatgcaagtgctggaatgcaaaacttaaagaatcacgaggattctgatattgggtcatcttccaaatttgcaagcatgctggcatctattcctgcacgtcctgcattggcagctgaatatcccttcaaaagcaaatatttgtcactagtgcccaaggtcgattcagtaactgttgaaactgcaactaatcatgttgctgctgtatctattacctgtgcatgctctatggtcctagaacccaagataaagcattcatctggggctctattacctacttgctcatgtggtgttggtaatggcattgtgcaagggtcttttgcatccagttggcctgcaagcagctctattggcttcaaatcagcagatttggtcacaccacgaaaaacatcaggggggttgcatgctggcttactttttgtgtttttcttaggtgccatagcagtttttgtgtgggcgttgcttatgggaggtacctttatattaggcaagtacatgtacaagttggttatatcgtaagaacacctataatggtctgttcagcattcagttaaaagatttctagatattatataatctactagaagctggttttctaggaaataactctatggggcattggttatgtggtacatttgatttgaaaatgtttcaagtctcagaaaccatctgtgacctctcctttgttttgcttgcagtggatttgtttttctcttccagtatgtttaactttattgaaggacatgataagttattcatagccctaatagtcgaagtacactgtctctagttaataatcaaaaaaaaaaaaaaaaaa

SEQ ID NO: 773 - DNA, 2731 bp, Pinus radiata
gaagaagcgaggagggtttgtagtggccagaggaagcgaggagggtttgtagtgtccagaggaagcgagagtgggttttgacgagaagcgagagtgggttttgacgagaagtggatggcaagctcagtacaggcagcggcggtgaatttccccccggggttcagatttcggccctccgatgaagaaatcgtggggtattacttgaagaacaaagttcacggcaataaattcgagttcgacgttattcgcgagatcgatctttacaagtgtgagccttgggatctacctgagaagtcaatcttgccaagtagagatttagagtggtatttcttctgtcctcgtgatcgtaaatatcccaacggctcacgttcaaatagggcaactgaagcaggttactggaaagctactggaaaagatcgtaaagtgagctctcgctctaataattttaaaattggtactaagaagactttagtcttctacaaaggccgtgctccgaatggagaacgaacagattggctgatgcatgaatatcgcctggagggaacgcaatgcaaaggaggaactaatttgcaggatctttatgtgttatctcgggtattcagaaagcccagacaaggttcaaatgatcaagagacatttcaggaaccttttcccatcataaacaaaacctcttctcctactgatggctcagatggtgacattgaaggtcagtcagaagatgcctcaccgggaaagccggaagatgatgctccggcaagttcacggtcagaaacatcatcagagattttagacaataagatcgaagacaattgtattgatggaccaatggagtgtcccgaggacatatccaatccaaattgcaattcagtatcacaccgtgatacctctaccaaagaaaatgatgattctcagcggaggaaccaacaattgcaaaatgatccattctattcaccatatgagtatgagttcccacttatttttaataatccgtattcggactattcgcttgggacgcaagtgaatttctctgtcatggaaccagaagcatttgaaagagattttgattttggatccgtttccgatcaggataatattgaccttgcatcgatgctaaacagcattgaatgtgaagatctttatccattgctacccattatcgaggaagaaaagaacgacgaaccttgtgtggcagggttgcttactagcatgccagacaatggtgttcaaatccaatttcgctctcgatctcagttgtcgcatagcaatcaacagccattgcctagtcaaggcactgctatgagaagacttcgcctgcagatatacaaaactgaagaatctgcaaatggaagaaaagagaatccgctcactgtaaatggccggtcagcctcttctgactgtaacagtgatgatagcgatgagtctgaggttatcacacagtccgaggactctccactggcatctttcccaagtcaaataagctgttgtagtgtagaagatgatgcagattctgatacaatccacgattctgttgagagttctgaaatagtagcgaatggtcatgactttaatttggaaccgacccaatttttaccctctagtttctttcctgttgaggcggcttcagagaaaagtgacatgtctgttaacagcaaagaatcagcagataaatctgttcttattgagagaacagaatcggtgatgtcatcagcttgtagtcagtcttcatccacagaaattcaaatagagacaactgtatcgcatactacaagttctcaagaaattgactcggtcagtgtgaaatcttctgctttaggaatggaatctcccactgttctggcttctaagaaggccttggtctcagagggtgcatctagttttggttccagacaattgggagctatcagttctaatcataatggtgtggcagagacccaagggttaggtaagttcacaggcttcaatgtgattttgactggcttgaatctgagagggaagtttagagaaaagtatgtaagatctgatcatgtagaggagtcaagaaatgtcgcacagaatgtttccgatctctgttctaaagactccagcaaaggttttagcagtttaaggaaggcattgggtatcttcattcagccttttcagcttcaaagcaagatgtccaaaggtgctaattgtattccattaatatgcttgctcagcacagtgtttttagtcttgtgcatatggaacacatacctttctgctcgaagctcatctcctatcattttataatagagatcttggtttcttgcattatgtaaccaacacctgccattgaatctttatatgttaataggctctgtatatagccaaaatcctttggtattcactcttcacagaagacctggaatgccttttggaatcaggcttctttttgtcaagtagtttgtcatattatgatctatgaagtaccccacaatcacactttattgattgcaattgatgtagaggatcttcacacaatgcaagaggttgaatctgtctgcttgggctggacaaggattgtaatctagtatattttcttggtctactttagttggcattatattcagcccagtttgagggatttttgcatagaccagttccagtccccttacgggatgattataaacatgtaattttgacattgtaagcgtaccttgttttaatacttgggcacatcatttgatatcaaaaaaaaaaaaaaaaaaaaaaa

SEQ ID NO: 774 - DNA, 3325 bp, Pinus radiata
gcggacacgtgccaacatctcatattaaccacggattcgacttccaagtgaagaccagggcgttcacaccttcccccaaccgcgaagcggtaaatggtgccacgcgtataagccctattcggcataaattccccgtcatgaaggagagatatacaccgtgggatgctgacatcagagcaggcgacggtgtcttcttttatgaatttctgagaatgtgtgtagctgctactttactctggtgtgataagggagagggcaacgtgtgttccgaacctccgctcgtgcctttcaatcgaaattggaggttggacattattcaggattttatttgaattcgagcaaaggttttattccttgtaaaaagattcgccagaattgatttttacgatagacgtcgaagtgtaaatttgtagatttgtttcaattcgatggcaccaatttcgttgcctcctggctttggtttccacccaacagatgaagaactcgttgcttattacttgaagaagaaagtacatggccataagattgagcgtgacattattcctgaggtggacctttataagtgcgaaccatgggatttgcctgataaaatttgccttcaaagcaaaaatctacagtggcatttctttagtccgcgcgatagaaagtatccaaatggctcacgtactaacagggccactgaggctggttactggaaagcaactggtaaggaccgaaaagttacatctcagcggagcacaattggaacaaaaaagacactagtattctacatgggtcgtgctccatttggagaaaggacagattgggttatgcatgagtatcacctcgatgagaaggagtgccaagcagcaggtttacaggattcttttgtcttatgtcgtgtggtcaagaaaaatggattaggaacaaaaagtgatgaccagtctgttgccccaactgagaaaaatgattcagatggtgcaaataacaacacattacctggcattctggctgaaacattctgtactggacatcaatcaccagttttgcaagaaggtgaaaataaatcaaacttaaaactgccatctgaaacatcatctgagaatttaaatgacatgaatgaagagagtgttgagagatggttagatattcttctggatgatcccgatcaaaattgcagcattacatctccagctgagttgacaaataatgcaaaggttgacactgctcaggaaatacaagaagtaatttcaagtccactcaactgggtacaagactttaattggattccagctggtgtagactttaatacacctggagacttggagcatcttcaatttccaaatactctggaaacatttgaggaagcagaaataatagaggaaatatttcatactgcgcaggcatctcaggaagataatattgaagctaattctttgttacttagtgattaccttgatgaaatttggggaggagaggaatttagagatgagtatcatgatacttctatggtgcagactggcaaccacactaatccagaggttactggaattcaattacgtcaaagaagccagatatgccagcaggaactgccctatcagggtactgccatgaagagggttcgaatgcagaaatatccagtgcaacattctgccattgaacatcaacaggatggatgcactgcttactctgaaaatgattgtatctatgatctacaagagcaacatatcttattagacagttttaacaggcagaaccataattccaagaatatgacaccgcttcaagatccagtgccactagcttctgcaaggcaaatagatgctatcagagaaggtcattcaccataccatttgagaggtccattggcaaacgaaagtcttggtaagaatcgccagaaagctcattcaggtagaggtgtgggtagttcattttcaagggacaactgccaacctggaactagtagcatgggttttagacaagccaatgaatataaattcaattttcccttgcatgattctgtaatggaaggagagttatcagcttccgatcttgctgataaagttactgttaatcatgtcatatcctcaatgcctccgcagtccttgatatatgggcttttcctgaatagccagtcttcagagatagttgatattcctgctgagtcccctaaccaaactatgaaacatgaaccgggcaatagtctggagatatggaagtctcagcaacaggtgttgacatcgcttactgaagataaaatgcccatttctaaaataaatcaccagacttctttgtcagaggatggcctgctctcaactgtagctgttattaaagaacatgagtttgtaccatctgaagatgattcagagacaccagaccagtttggtgaaccaattaagggttcatcatctggagaagtaccagatagttcaggagcttcatctaaagtggttcatccagagaaaattttaccagctccaagctcatcggaaccgacatctgtcagaggctggaaaatttcacaacgaatcttaaaattctgcagttctattccttcatatgcagctccagtgatggaatatttaggtcgatttaatcccaagaaagctattcttccttcagaatttgcatgtaattttggtccaacagatggtgtgactgatagtgctggtaatatgggaacctgcatgtgcactgaaggaaatatggagcatgccagatctaacattttcttgtctcagttgaaacagagagtgaagcctaaagtaaaaagtgttatgcctgatagtggagaagagtcaggagatgctatgaaaatgttttgtcaccgttgtgctgaccaaagtaacagtgctactctccatggtttggagccgccatcaggtgtactcaatggcttctctgagttttggaacagatgtgctccaacaagttctactagtgttattgtatcagtatgccttctaggcacaacaagtttactcttccttttcttgctgtttcgagctatctggcgcttttctaggagtgtatccgcactcattttctaggggagacaggttgtcatgcaacatgtaagcctcactggactaaaattctgtatttatcaggtgtcatacagttgctcttttgtggagtttttagaagtaggtttcttttcagtatttgtagaccgagaaagaacctgaaatatgtattcatatttagttttcttctaaatagctaggaatcagtatatcttaactaaaattataaaattgactttatcaacagttgagagtttgcttgcctggttgggaatgtgctgtgggctaaatatatatgatggagtgttagaaaaaaaaaa

SEQ ID NO: 775 - DNA, 3212 bp, Pinus radiata
tgataagggagagggcaacggtagggtttcacgaaacccctgtaatgcctatgtgcaattactcaatttctgctgtattttaccacggcggagcttggatgccttctccttgttaaatagtcattgatttcccccggatttgaacggtgaatttgatacattttctggtctttatttttattgtttcattttttctttctttagtgtgttccgaacctccgctcgtgcctttcaatcgaaattggaggttggacattattcaggattttatttgaattcgagcaaaggttttattccttgtagaaagattcgccagaattgatttttacgatagacgtcgaagtgtaaatttgtagatttgtttcaattcgatggcaccaatttcgttgcctcctggctttggtttccacccaacagatgaagaactcgttgcttattacttgaagaagaaagtacatggccataagattgagcgtgacattattcctgaggtggacctttataagtgcgaaccatgggatttgcctgataaaatttgccttcaaagcaaaaatctacagtggcatttctttagtccgcgcgatagaaagtatccaaatggctcacgtactaacagggccactgaggctggttactggaaagcaactggtaaggaccgaaaagttacatctcagcggagcacaattggaacaaaaaagacactagtattctacatgggtcgtgctccatttggagaaaggacagattgggttatgcatgagtatcacctcgatgagaaggagtgccaagcagcaggtttacaggattcttttgtcttatgtcgtgtggtcaagaaaaatggattaggaacaaaaagtgatgaccagtctgttgccccaactgagaaaaatgattcagatggtgcaaataacaacacattacctggcattctggctgaaacattctgtactggacatcaatcaccagttttgcaagaaggtgaaaataaatcaaacttaaaactgccatctgaaacatcatctgagaatttaaatgacatgaatgaagagagtgttgagagatggttagatattcttctggatgatcccgatcaaaattgcagcattacatctccagctgagttgacaaataatgcaaaggttgacactgctcaggaaatacaagaagtaatttcaagtccactcaactgggtacaagactttaattggattccagctggtgtagactttaatacgcctggagacttggagcatcttcaatttccaaatactctggaaacatttgaggaagcagaaataatagaggaaatatttcatactgcgcaggcatctcaggaagataatattgaagctaattctttgttacttagtgattaccttgatgaaatttggggaggagaggaatatagagatgagtatcatgatacttctatggtgcagactggcaaccacactaatccagaggttactggaattcaattacgtcaaagaagccagatatgccagcaggaactgccctatcagggtactgccatgaagagggttcgaatgcagaaatatccagtgcaacattctgccattgaacatcaacaggatggatgcactgcttactctgaaaatgattgtatctatgatctacaagagcaacatatcttattagacagttttaacaggcagaaccataattccaagttatggcagaatatgacaccgcttcaagatccagtgccactagcttctgcaaggcaaatagatgctatcagagaaggtcattcaccataccatttgagaggtccattggcaaacgaaagtcttggtaagaatcgccagaaagctcattcaggtagaggtgtgggtagttcattttcaagggacaactgccaacctggaactagtagcatgggttttagacaagccaatgaatataaattcaattttcccttgcatgattctgtaatggaaggagagttatcagcttccgatcttgctgataaagttactgttaatcatgtcatatcctcaatgcctccgcagtccttgatatatgggcttttcctgaatagccagtcttcagagatagttgatattcctgctgagtcccctaaccaaactatgaaacatgaaccgggcaatagtctggagatatggaagtctcagcaacaggtgttgacatcgcttactgaagataaaatgcccatttctaaaataaatcaccagacttctttgtcagaggatggcctgctctcaactgtagctgttattaaagaacatgagtttgtaccatctgaagatgattcagagacaccagaccagtttggtgaaccaattaagggttcatcatctggagaagtaccagatagttcaggagcttcatctaaagtggttcatccagagaaaattttaccagctccaagctcatcggaaccgacatctgtcagaggctggaaaatttcacaacgaatcttaaaattctgcagttctattccttcatatgcagctccagtgacggaatatttaggtcgatttaatcccaagaaagctattcttccttcagaatttgcatgtaattttggtccaacagatggtgtgactgatagtgctggtaatatgggaacctgcatgtgcactgaaggaaatatggagcatgccagatctaacattttcttgtctcagttgaaacagagagtgaagcctaaagtaaaaagtgttatgcctgatagtggagaagagtcaggagatgctatgaaaatgttttgtcaccgttgtgctgaccaaagtaacagtgctactctccatggtttggagccgccatcaggtgtactcaatggcttctctgagttttggaacagatgtgctccaacaagctctactagtgttattgtatcagtatgccttctaggcacaacaagtttactcttccttttcttgctgtttcgagctatctggcgcttttctaggagtgtatccgcactcattttctaggggagacaggttgtcatgcaacatgtaagcctcactggactaaaattctgtatttatcaggtgtcatacagttgctcttttgtggagtttttagaagtaggtttcttttcagtatttgtagaccgagaaagaacctgaaatatgtattcatatttagttttcttctaaatagctaggaatcagtatatcttaactaaaattataaaattgactttatcaacaaaaaaaaaa

SEQ ID NO: 776 - DNA, 1694 bp, Pinus radiata
gtttcgcgtgattgcaaggcacacgcaggcttcactctcccctcaaattcttcacgttctatgcgtccaatagttgcattgaatttgggttcaggctttaactcaacacatccaaactgggcaagaaaggaatctgcgaaatccattgtgggcagtgaaggaggtggggttcgcaggtatccaaacatttggaaggcaatcgacttgaattaaagaagatatatgcctcaggagtcggttacgaatcgtcacatggcaaagcttgggacggatccccagcaaatcagttgggatgagtctcttacgttcgacgaggtcgccaaatttttctcggtccccattgcagaagctgctaacatattaggtgtttctagtaaagttctaaagaagatatctcatgataatggcattccaagatggccataccgtaagttcttggcagggaaaacagttgaagaaataaaacgtgaagcagtccgagataaggaaatgaatgaagaactttcaaaggcatcaaatgataataataaaactgtgccatcaagtggaggcccatcagtggctatatctgctcaaatgcccacacccaaacccccaaatttggccatgcaaaatcaaagcaaaacagggaatacagtcaatgagactggtagatggcaaccaggggttgccacttctggtaatattttgcaaccttctggcagtagaatccctcaagctgcccggcaaccatatcactcgggtcatagggcttttatttcgacatacctggatgatttcaaacaaggattccccaaaaatgggttgtcatctgtttcaaagaaatggtggggaagcagtgggtctatcagtaaggaggatgcacctgaagactcagaaataagtgaggcaaaattaacaagtagaaaatttaatgaatcatcagaaggcgttgaacttgggactacaaatgaaaatggtggcagggtcacttctgaggtggatggatttttgaaggaagggaagtcttctgacagtgaaagtatttcaaagctttttggccacatgggatcccaggatgaagacctgatgcacattagcatactctccagaactagaaagagaaaagcggaaaatggaaggaaagcattgaaactagctgtaactaatggttatggtacatacaagattgggaacaaagacaaaattttgcttgaacgaatatttggatctcccttgcccaggaaatggaaaacaagcttaagtttttcagatggtacagaatagtaagatttttctgtgattaccaaattatcaatttctctctttggaaagaaacttaggcatatgatttgacaggctgcatgttttggcattttagctttcttgcctacactgggaggacaatgataaatgtacactgtacagtagtctggagaattttatcaatgaattgatgatctcaaattaaaataaaacagtcaatgtatgggtgattccagaatccaaacgatgggagaacatggacagcagattccagagtcagggttctccatttgtattatggtttaataccaaagaaaattttaggggctaaatttcattatttggctaattttcctattcttttccaaaaaagaatattcaattcaaaatgaatattttcccatatttcttcacgataaaataattttacttgaaaaataaaaaaaaaa

SEQ ID NO: 777 - DNA, 1968 bp, Pinus radiata
atttctaaagcgtcatagagaaggttgtgaacttggcaaaggtagtgtgttatcactgaaatcctctcaaacttcattgaacgcgactggggcattcgatgtaagaagggatacagaggtggaattgaaatgaatttctgccgctaattgctagatgttacattaaacaaagctttctattttgagggattctggaatggaatatgtttggtttggcaaggctgagcggcgaatgagcgtggaggattgtagatggtaggcagaggagcctggagtagtaggaggaggagcgtggacagcggcagcggcaactcaatgaagtcgagcagcaagaggagggttagaagaggcccaagggagggcacagaagaggacgaagaaaccaaagaaagcgaaggggaagaacaggaacatgatgaagagcagcagcaggaggaagaagatgaagaacagggagaggaggagtctgagaatggacaagtgcttggagaggggttttatgaagtggaagatataagaaagaaaagaattcgcaagggacaggtccaatatttggttaagtggcgaggatggccagagactgcaaatacatgggagccctatgataacgttaaatcgtgtgctgatgttgtacaggcattcgaagacagttatggcggtaggatttcaaagcctggaaggaaggcgaggcgcaagtctggatttccattctctcatcaaaagagaaagcgcgtctctttgtccagcgctgatgaaggcgcagaagccgaggccgaggttgaaaccgaggccaaacgggccaaaacttcatatttcggggatagccaaatttccggtaagtcagaggtggaagtggagcctcaacaacttcatggttctggcgttggcacggtctctgagcaatgccacccagagaaagacgacggagcacagagtcatatccctgaaaaagaaggaaaagaaacagaagagcagaacgggggtaaggatgtaacgaatagtgtagaagaagaggcagagaacaaaaccgaagatcaaaatccacaacaagaggagccgacttcggaagaccatactaaaaatgggcctcctccttctccagaagatgccagatgcgctgaagaaaaggagatggcagtggatgaatctaaaccagatcagggggctgcagtcaatgactcgagtagacacatccagactacccaatttactggagccaagaagaggaaatctggatttgtaaggcgtgtcaagcaagctttggactcacgcgagcatgaattaaagcagggagaggaaaacagcaatagccagccggcaaaagaaatgttcgtagagaattcgaaggcacaagaagcgaacgctgtaggaaacggagaagaaatcaaaagtcagaagccttctattgcaggattgcattctaatgcaaacaataaatcgtcaaattctcctgacagcgcgcttactttagcgatcacccgaatactgaaggcaatcagctacaacaattccacgtcaaacaacaaacaggacgtttctgtcctttttaaagctcagagagctgacggccaagaggtggtggtcgacaacaagttcttgagggcaaattacccattgttgctgatagacttttatgagcagcatcttcggtacagcactgcacagtagagatatatgatatacaaagcaacctgatcacagctggaaagtataattgtttcgtgagtatcttttaggaattctaggttcctgccttcttgtcctatagttagtgttatttaaagaaaatttctcaaaattgctctcagttccttctgtagagaactgtgggagacgttagtgttctgttctggaaaatccgtggtcacatttttaccataagctgaaggtcaccaaatcatgatttcaaacaataaacaagtcagttctatcatgtatttactttgaactttcatggcgtttgatgca

SEQ ID NO: 778 - DNA, 1877 bp, Pinus radiata
gctatagtgtactggtatttcttctgcatgtttcattttctgggctcttagcagcgcacaagaaaatctctggcactgttgtggcttgtgcaggtgatggccgctccctgtgatttgctgaaggtgagtcgatttgtaataagtgttttggctgagggacgagctatggttaggattatggatgatggtttcgattggccatgaccaattagcttttgtgcgtggtgtatataactttatatattgaatcgggatgttgggcaggatgatttaattgaaattttgaatattggattgggcggcacagaaatttccgcgaagattcagggatcgacgttgactttctgtttctctgttgcaggccgtgggcaggaccaattgccccattactcctgatgtggctctaggattgggccagtgtgttcttactgcagaggtcgatagctccagtgattcaagcaagcctaattattatttccccaaggcgatgggggccgattcaactagaacagactacgaggatggcaaggctgtgaccgaggaggactcgagctcgtcacctgcggctgcttcatttttgttgccgaattgggcagggctggaagaaatggggaatggaatcaacgttgtttgctcccagaatattcgaaatccctcggcgcagcgcaagctgccgtcgtcccaatacaagggcgtggtcgcgcagcccaacgggcgttggggtgtgcaaatatacgagaagcaccggcgggtgtggctcgggacattcaactccgaagaagacgctgccagggcttacgacagggccgccataaagcttcgcggtgccgaagccatcaccaacttcggcaccgacaggcatcctggagccttctttctccgcggccactccaatagtgaaatcgtcgacacgacctacgacgaagaacttggcaacgacgacacgacctcgttatcggtgtatcccgacatcgcatggtcgacaacgacagaaccccgcgagcacctgttcgacaaggcggtcacgcccagcgacgttgggaagctgaaccgtctcgttattccgaagcaatacgccgagaaataccttccattcgacaaggcatcgattcacgacaaggggaagggtgtcctgttaaatttcgaggacagcagcaccgaaaagatttggcggttccgctattcttactggaacagcagccagagctacgtgctcaacaaaggatggaaccgcttcgtcaaagaaaaacgcctccaagccggcgacatcgttaccttcgaccggacctcccggtcgcgccgccttttcatcaccttccgccaccggccccactatctcctccctcccgctgccctaccgccgccactcgcacgctgccagctggctatcaatcccttcgctgcgaaagattacccgcacagcgagcagctcttttacgcaccgccgacggcggatgtccaaaattcagcctttcaccgtttgattccttgtgtccccagccctaattctgtggacttattattgaccccgaagtctgtgtcagatgacgggaaaccctcgtccctagctttcgtagatcaccaaaggtcgtctccgtccaccgacggtaattgtgattcttcttcagtctggctgtttggagtaaatctgcagccgaccccattaacttttgcccgggcatgactgtcaaagaagagacttagcaccaaataagagcgaagcgggcgccgaggtgttttccggtgggaaaagagggtgccacagggtcgtggctgtcttgtaatatagtatgattctcttatgagaaggctgtacttttgttgaacgattgaactctatatagacaattgaataaaatgattaactaaaaaaaaaa

SEQ ID NO: 779 - DNA, 1650 bp, Pinus radiata
ccgaggccgagcctgttcagtttcccggttttgttattttctcgttaaggattggacttaggcgggatccatggaaaaaagcccgggaggaccgaagagaacggggagcggattaagcgttgtaaccggatctggcggagagtcagacgaacgtgaggattcgagaaggtatttaatttcgacggagcaagctcggaggctgccttcgtcgcagtacaagggcgtggttcctcagcctaacggccgatggggagcgcagatttacgagaaacaccagcgcgtctggttaggaacgtttaacagagaagaagacgcggcccgggcgtatgaccgagcggccctcaaggtccggggtcgggacgccaccactaatttcagtccggtgggagagggccatccggaggcccaattcatgagagagcacagtaaggaagaaatcgtggaaatgctccgaaagcacacttacgatgaagaaatgatgatgacggtagatcggtgcgcaacaatggataactcggaggcgtcccgggaggtgatcgggtccgggcagggaagatcctgtgaagaaaacaaagagcaccttttcgataaggccgtcacactcagcgacgtcggaaaactgaatcgcctggttgttcccaagcaatatgcggagaagtatttgcctctgaacgtaaattccagcgagaggggtatgctcttgaatttcgaagattacacggggaaagtctggagattccgttactcgtattggaacagcagccagagctacgtgttgaccaaagggtggaatcggtttgtgaaggacaagaaacttgaagtcggagacattgtttcgtttcacagaggatcggttcagtctgaccatttatacatcagctggagacgcaggccgtcgggtcggccccggctcgcagtcaatccccagtcccacgaatccaatgtgagagtagtaaagggctcgtgttccttgaatcctttcaattccggaaaccagagcgccgttgtttataatgcccaatggatgcctgtcttctggtccagttccagaaatcccaatgccttgctgcaattcaattccaaatccatcttccccctcatcaacaaattcggtcatgtggatacactgtggtctgagagtcatcgcgtgtttcctttttactgctcgtcgccgcccactaaagataccgacatgaatctgaagccattgccaagcgtggaccagaatctcaatttacaggagtcagtcaattccggtgacggaagtgatatcaaaccaccgaattctttggtcagcccgcctgtgctctccgtggcacaagaactagacttggacttggacttggacacgccagaacagaagccggcgccgtatctggcgcctgcgaccacgaaaggagtaagacttttcggagtgattttgactgaaacgcagagattgtcaacacagcgtcagggacagttaaatctgccgtagtctaaccagctgcttttttgcttggaaaatcatgacatattttgataaatttttgtaaagataaagttgttaaattttttgatcgcgagtgttcagaagttttaatagttaaatctattatattttcaaaaacataatgtaaacactattttttcccaaatttaaaaaaaaaa

SEQ ID NO: 780 - DNA, 1505 bp, Pinus radiata
gtgatatctatccatttttaaccaaccaaaaccattattgttattatgtggaatgccacgtcgaagggcaaacaggaaggtcagatgccattaaccactgaagcactggaatccaccccgacaattccggatacctatccaccttcaaccaacgagagcaatgattgtcgttatgtggaatgccacgctgaacggcttataagaaaattcgaaaatttcaacatttaattgaagatgtggatacggagtggacagaatagtactccacactttcgacaaacggttggccagccagccgtggcctgtcaccatttacagtgacgccaacgacgaagttgatgatagtgggaggagaatgagagaaaagaaaagatggaaatgcgactgtgagagcctctgtgcttatgcttgacgcaatagcacacaatgtaaagcaattcgctgtacgggcactggaagaacccctgccagattgatggcgacagccatgtgcagagggcccaacatcgacacccacacccatatcgacatcgacatggtcctttgcattttcttgaagaagctgtgattgttcgaccgacacgttactcattcacattgcctctccatctccttcaatcaggattccagaattgcccgtcgaaatggatgaagtccaagtcaaggtcgacattcagagcacaaatgtcagtgccgacgagcccaggcctgcgaagcgccagggtttcgagctcgccaagagccctgaaaacgtggcttcgaaatccactgcgctctcctctccgaaaaaacccaaagctgcttcttcctcttcttcttcgtcgccgagagcgcagcctcccgcttgccaggtggagaaatgcgcggcggatcttgctgatgccaaagagtactataggaggcacagggtttgcgagcaacattcaaaggctcgaattgtgctcgttcttggcctccagcaacgcttctgccagcaatgtagcagattccatgtgttagaagagtttgatgaagcaaaaaggagttgtaggagacggctggcaggccacaacgaacgccgtagaaagactccgtctgattcgtcagttgacagactagattcaaatcatcatcttaatgacaactggttgagacatatgaaggaaactgacaagatgtcaattgtactagagcggaacactacggctaaagtttgcaaggagataaaaaatcattagactctgggcgtgctctctctcttctgtcatcctcagttcagctctcttcgtgcagaacaaacatggccagagttatatttacaattcatcaaattgaattcttgctgtcgatcatgaactgtaaatctaaatatttgaaatttggattgtgttggtcctaactcttacaacttacgaagtccagaatttgaaagtctcatgacttttttgagcttgtatgctacacttaaaatgttgtattttgttttttacttaaatggttggtatttttattatgcaaaaaaaaaa

SEQ ID NO: 781 - DNA, 1461 bp, Pinus radiata
gtggtcatcacgagttaccatatctgcccagacaattcccaggggtggtggcaggagttaccataagtgcccagataattcccagtgagttgatctcataaacagtttactagtgaagctaaaggctacggatcacatcagagatttggctagttaagagtgcctagtttagtagctttagggttagtgctctaacaattccgatattcctcgactgattgctgtttgtcttcagcgcagctgttttatggtttggatgaagaatctattaatctggatgcaaatgtcaaagctgtgactggtgtatagtttcgccctctctagtcttcatctggaaatgcagaccagcagggggcataatcgtccatgtatgtcgtctcacaatacagatcggccaaaacctagaaatttaaggatgacctcagagttggtagaaggatcacttgagtctgcctcttctcgaaattcttcaacacttttggattccccgagattatactggcaagatcagttcgttgatccttgttcaatgtggacccttgggtacagtagcgaccatacaacccttgagcagcccagcggagtaatagagaagagaggcaagctagtgcatggctgctacttcatgaaggaggagaagggtttgttcccggccagaatggagctgaactattctgggcctggatcaactgcatattccggcggcgcttcagaagagacctgccatggaaacacattttgcaggacagaaatttcatcattcacaggctcacagataccccagtgccagtccgagggttgtaaagcaaacttgagcagtgccaaacactaccatcgccgacataaagtttgcgaattccactctaaggctcctacggtcgttgttggcggtcagattcagcggttttgccaacagtgtagtagatttcatcagacatctgaatttgacggaggaaagcggagctgcagaaagcgccttgctgaccacaacagacgccggcggaaacctaaaccgagtcaatgtactacatcccaatgtcaggcagggacaacaaatttacaggatgacgacaagaaaactaaaggattatctggtcatgctgccgctggaattcagattataccaaacatgatctcaagcacaaatacgactctgcccttgattacctctgcaccattgttatcgtcagggacaatgatgatgttcccaaataattatagaggacagattcctgtgccacaaggaacatccaatgacaagacaagttgtgtagagtttctgcatgcaaatattccgcaaatggtctaagatttagcatctctatgactagcagctccaatcgtaaagaaaaaataaactttgtaaaacagttgggatattactgttatgtatctagaaccagaagttttgggcgatctttctgatataattgttatgtgcgatatatttataacttctta

SEQ ID NO: 782 - DNA, 60 bp, Pinus radiata
tttttggtagtatgtgggattcgaacttcgatactcgggcgggcgtgcgtggtatatacg

SEQ ID NO: 783 - DNA, 2070 bp, Pinus radiata
gccttattttattgcacagtaaaatccattcactttaaaatctatcggcttcgctgcaattgtattttgcagtggctcgatgctgaagagcccagactaaaggacttactctgcttttaaataccgttttcttttttgtggggtttttgtttgtttgggagtttgtgcacttccaacttcgataatcgggcgtgtgtgtgtaagaggaagaggaggtcggcgggttgttcttattatttgtgtattgcagcggtgaatgaatagtaccactacattgctctgcaatttctctgtaagttatcccgtggaggatcggttgggaggttaactgaacatgaagattacttcatcccccaccccgacgtgggaatgggataatggagagaatctcatgctctttccaggcaatggcaatggtagccgcaaggccactgttaactctaagctgaaggatgagccgaagctacacgacgccgctgctggtttcctccgggttcaatccgttagtgaagacggtaactcttcccccggggagattcgaacctccgatgccagtactcccgatgatcagcaacatcatagcggcgttgtcactgtggcggttccggccgggtcgggggattcgggggcgattgggttaaagctgggcaagcggacctattttgaggcggtgaaggcaattcccggaccggccccctcggcgtcttcttgcggtccggctgccaagaagcaacggtcggcgatgcaggggacgcatatggtgcctcgctgccaggtggagggctgcaagacggagctcaccgcttccaaggactaccaccgccgccacaaagtctgcgagctccactccaagtcccccaaggtcattgtcaacgggattgagcagcgattctgccagcaatgtagcaggtttcatattttgtccgagtttgatgaagggaagcggagctgtcggagacgtttagctggccacaatgagcggcgtaggaagccccaacctgactcactggcaataaaccctgcaagatttgcttccgccttctatgatgacaggggacttaacagcattttgatggatagatcaccgttcatgcaccaacgcataacttcaaattcaattctggaggattccattgatttcaaacttggtggatatggaaaaggagcgtggccaagggtgaaagcagaggatgaatcatcatatgatgggcaagtatcagcaggtaccgtatcgcatcacaatgctgacaggttgcttttctttttacagagttctaagactgtacctggtggtcctattagtcaagacgttcaccagtacatgcaaagctccggggctcatgcaggacaggccttgactttgtcatcatcctcgggagaaaatcttgcaggtttagacgttgtatctgctacgcatggtttatcaggagtctcggactctgggtgtgctctctctcttctgtcatttcaatccgggggctcaagggcctcaggatcagcttcattcgatatgaccacacggtcaggtcttaccatggatcagcttatacaaggggatcaacctcttatggcccaaccactgatgcaaggagtacaacacaattttggtctttttggagcagacaaattactaacagtctgctctcaatcctctactaatcttgcaacaggtgggttccctgccactgttgtgaattctatggataaacaacaccaaggtgagccacttgtttccaatgcaggtggcattggaaactttggaggacatgtatttggtttgctgcaggggagcaatttcagagcgtctcaggctgcaagctcacaagatatccaaggcaccatagatttgatgcgcaggtcctcagaaacacaaaatgattctcatgatcaacatggtatggtgcaccaaggaagaagacagtttactgatgcgcagttgttgaggtcttttgaatcatctatttacgacactcatcaactgctgtagctctgatctgtttggtcatatggcagtattttcttgccgtcggacttgaagctaactgttaaaacttcattatgacaattatc

SEQ ID NO: 784 - DNA, 3350 bp, Pinus radiata
ggggccgtgtggttttactgggcagtgtgcaaccgcttgcgtagtcactcacagaaatccctctcacacacaaatactttgggcattgctttgatttgtgcaacaaaagcatacagagagagagacacactcacagatctcatcatcaaacttcagtccatgatacccattacttaccgtgccaatgcccgcctgcagccgcctgccctgcctgcctgctcacatatatttgacatagcagaagcagatacaacaggactagcagtagcagcagcagcttgtttctgcagcaggaaggattggccgccttgcctcctgcattctattcttccattgcctgcacgtgtcaatccagaggtctagcaaatttcaaagcgccttcctctatttctatgcccgctgggtgcctcgccctttttattttatttaccccaggcatccctcctattcgcttttgcagtgcgattttgtgcagatcaagacatttgtgaatgttgggatctgcatatactccaagaatagtaagtattattcatcgtcaccataacccagaaaaaagaaaggggcagaaatcctccaaatcctccaaaacttccatgtacagtcctaggttaactagtttttaatacaatcaggagtctgtttgcaaacccttaggatagtaaattcggggtgggtctgtgaagcccaataagctttccaaatgctgctgacgttttgagagaaaggtagcattaatttggaattttttatgaattaagtattggagactggagtacttatttctttctcctgcgcctgctgcccttctgaaatttttttgttcactgtggagcccggcatcgggaattttgttgttcccgggtaaatggaaatcaattcaaattcctgggaatgaagctctgcaaatcgatagggaattttgtaatgtaatgggttttttttgtttgtgtggtggggattaattcttggcccttaactgttaattagtgtctcgtacaagaaagggaaagaaagaaaaagagttcatagaggtttgatcaactgatgggatgaaccctcctgaaagtacagagaacgaaggtgatcagatcagctgggtttgggaccattcacaacatcatcatcatcatcatcagagtcatcagagtcataatcacaatcctggtggtggtgcaagtggcgttgttgctgcgatgtcgattggtttggaaaccagacagtttcaaggtggtggtggccgagtgctggaatacgactggggatcgagtcctgtgctcttgtccggaggacagggaatccctgcccaggataccgaggaaagaaagcctcagataatttctgctgctgctgctgggtctgtgatggataccatacagtacagcgggaacgggaacggaaacgtgaatcttgctgtgaatggaatgctttcgtccggcttcgggcacaacataatctcccctaattccatgggtaacctgctcatgagctcttcctcggcgggtacaagaaacacctatggaggccacaatcatcatcaacaacatcatcatcatcataataatcatcatgtactggacagcatccgttccagtgctccgtcgcctcttctgtattcaggcgggaacagtgctttgtcggggttcgggtctggtgtgtacgccgattccacccgcgctgccctggaagaacacaggaaccacattctgggtttgatgggcatggaccagaagaacgtctttcacaatatcgtgaaaagggaagatctctgtggcgcaggagatttccagacgagaatcgggctaaacttaggactaggcggtagaacttatttttcctcagaggacaatatcgtgaaccggctgtacaagaggcccagggcaatttcaccgggctcgcaggtgcccagatgtcaagcagagggttgcaaggcggatttgagcactgcgaaacactatcaccgtcgccataaggtctgtgaattgcactccaaggcagccacggtcgtcagtggtggactcactcagaggttttgccagcaatgcagcaggttccacgtcttgtctgagtttgatgagggcaaacggagctgcagaaaacgccttgcagatcacaatagacgcagaagaaaacctcaacccaatgcagttgttacagtctcgaatactgaatcatcttctgcgctcaagaccactgatcaagatcaagataccaacagcggaagcaatcagtcaagtctgcagcagcctgaagtacagatttcccggtcggaaccaccgggcttgttgaccggaatttcactatcccaatctctaccactggttctccaaaccagcaaaggacaagagcagtatttgcagcaaacgggcccaaatttgtccctgggaggagaaattgctctggactacccgagacacagctctgggggggagaattacaatgggcttgaaatacccattccatggctgagacctgcaggttccggatcagaatttggtggatctgagaagaatagctccaatggacaactatcagaatctggtaatggtggtgggagctcttctactgttcaggttttcacatccattcagaatctgctccctcttcaatcctccacagaacttggaacttcggaatggatggttaatggaaatctctctggttcaagcagccgaggccagcattatgggtcggccgatctcaatctccagaccagtctagaaggccagcagatgctcagtttgttggagaaagacgtgagatcatccaatacagaccgccacaacactgaggatgcagtagagtacttttcacaacagcaaggcctgaattccaagaattccattgatgggcattctgagcaccgcaatcagctgagttcaagcttcccagggattcaatctcttagaactttgagccagtctctgtatcagaacattttgtgaatcgaggaaaagtctagacattgaaagctttttcggaaactcactcttcttcaagtctctaattaagagaccaaaagtcttacatccaccacagcgtaattgggttgacttcactgcaacaacttcaatcggatttagccaaaacaaatggtccatgcccatgcccctgtccatgtccaggcaagcatctggaccctttgagctgctgctttctggaaactagcttccattaaaacagttatcataacttgcacctcatttttactgtagattattatatgatctcaagagctttagagcttttcctccacccttttttgttcagctcctatcctgcaattattttgcaaatgtaatcgggccgagtacgctctatatcctttagtttaaacagaaatgaattat

SEQ ID NO: 785 - DNA, 3203 bp, Pinus radiata
gggaaaccctgatgtaatcagaagctgcagagcgcaaggaggagaacgaagagcagccatggcggatctgctggacgatcccgtggctttgactttagatgcaggggactgggaatgggacagcgttttggacttctcccccggctctttccctggtcatattttgccttggcagtccgaagaactctcggatgaacgattgttaacttcccaggcccttgaagttcagcaggtacgggaggtgcaaaatgcatctcccaggaatcaatcgcacgatgcggaggaagatgagaaggaggctgcgtccgggcggattcgcaaacgggaccctcggcttacctgctcgaatttcttagcggggcgggtgccatgtgcttgccccgaaatggacaacatggaggaggaattgagccgaaaacgagccaaagttgtcgtgttgcgttgtcaggtgccaagctgcgaggctgatatcagtcacctgaaaggttatcaccggcggcaccgtgtttgtctgggttgcgcgaatgcggccatcgttgtgctggacgacgtgcctcagcgatactgtcagcaatgcggcaaatttcatctactcacagattttgatgaaggtaaaagaagctgtagaaggaaattggagagacacaacaataggaggagacgaaaacctgttaatgttgttgaaggttcagtgcaacaacagactttaagagcagaatcagcattgcagaatgcagatacagagcctcacaatgatggtaaaagtggacaagcatcgaagtcattttcatctctgggctgtggtgaaaagcaagccagcagtgggagtgaagagataaacatttcagaagtagagcaaccatataaaggtgatctatctttgaagaatgtgggatcgaaatctgctgatgttagtaaagttaccagctcgatgccagtaaatgtttctacagaacttgaagggaaactacttccagaaagggatatgggaaacggagaaaaatttaatgatcaggatgtgagagttgtggacaatagtcaagcaatcttgtgcgtgggacctcaaaatggtgataatggctcaacttatgcagaactcaatgaacaatcttatactgggatgccgatggaagaaagctctcgtaaagataggtttccacacaatgcaagtgggaggagcgaaagggatgaaggagctggtccattgcaatcttctctttcttcaaatagacatgacaagcacttctcgtacgcatcagtgtgtccgacaggtcgtatatccttcaagctttatgactggaatcctgcagagtttcctcgacggctccgtcaacaaattctacaatggttggctgacatgcccattgagttggagggctatatccggccagggtgtactattttgaccgcttttatttcattaccgcagttcatgtgggagaagttatctgcaaactcgccaggatacattcatagtcttttgaatggctctcaaagtatattattggacaagggcaacatgcttgtgtatttgaatgacatagttatgcaaattaaaaacggtgaagcatgtttagttaatacaaagatggatatgcgaattccaaagctccattctgtccatcctattttttttgaggctgggtgtcctattgaaattgttgcttgtggcaggaacctcttccgatcaaaatatcggtttctgatatcttttcacgggaattatattcattatggcacatgtgaagccattcctcttggaaatccaagctcatgttttagaagcaaggaaaatattttccacccctcaaatcatgaatcattcaaaatatttattccatcaactgatcccaggttatttggcccagcatttatagaggttgagaatgagtatgggatatctaatttcatccctattctcataggggacaaacaaatttgttcagagtttcaaatgctcgagcaggaacttgtgaaatccggattctgctccagaagtaatcatggacttgctatcggaagttccagttctgatatttgcgagcaaaatttggtgaagaggcagagtatcttggagttacttgtagacataggttgggttctcaaggatcccgaatctgatgaggataaagtaccagtgaattttttacacatacaaaggctgaattgcttgttcagttacttaataaatggccacttccttgctatcacggagaaagttttgcattcacctaaagttgttaaaatgttaaggcaagtatatggaaagtcaaatgaggttaatggtgctgacatgaagttgcttcagaattatgttgagcatgcatggcaatcgcttaggaaacagcgggattataagggtactaccgatttccagtcgttcctcgataacgtagtactgcaaggttttcctcctccattgacaattgcaacattatcttgcaaccagcagcgctgtacagtatctcatgaaaaccaggaaacggaacgtttattgaagatccaacctgaaatcagacctttctctgaaatagaatcaagtgatacacgtgttttgtcagttgaagaaaataacatgctcacgcccttgcttgagaaggaatgctctagcaatattgcaggtgacttgaagtataactcaacatggagaggtccaaaaatagaggttgctgagtacactcgaaagatgaaagtttgcctaaaaggtgatatcagggtcgatcgtcgaatctttatcttggcaattactgtcatttctgtttgtgctggaatctgtgtggtacttcagcatccaccccaagtaatggagatctccatgtcactaagacgatgtttatttggcttgcgcaaagctcgcgaagacatttcacacccttaaataagcatggcactgcttagtggccatctcaaattaatgagtttgtatctttataactacagaaattttcagctcaaaggttttgcagtctttttgatgtaacctattaatttgtaagcggccagtacgcccctcccaaaccatggagacagtgtgcgtgcgtaataagcccaagcttcatcagctgaaattaaaaactattttctgttcaatgtaaaataacaatgaatcagctggcatttttatcggtaactgctttttggtccccttgtataagtaactatcgattttcagttaattcctgtgaagcccgtgaaaaaaaaaa

SEQ ID NO: 786 - DNA, 4188 bp, Pinus radiata
gtaatgaatcaaatcgacggtccctagagtcacaggcatccagggagtgtcggcattcaagttttgtaagtttgtccaagaacctgctgaattttttttttaatttatttattgaaggccttttgaaaatggatggcaaagcagggccacaagtggccacgccattttttcagcatcagttactctcgggtcctttatacgagccttcattgggggctaagcgttgcgttgagcctgcggattcctcttggactcgaacaaactggcagcatcagcaacagcagaaaagtccacctgtttatgaagcgccgaagccgaattggaacgtcaatgtttgggattgggacagcgtcaggttcatcgcaaagccggctgatttggcaaaccatcgcgagccgaaccccagcaatattaaaccgcaggcttctcccgaaatcttacgtctgggatccaacgacatagggtcgaatgtcgtaaatggtccttcgtttccagatcaaaaaaggaagcttgatgaacccccgaagccttttcttcccggcaaagattcgtctgaaaacgatccaggaaacctgacattgaagctaggaggaagttcatactcatacgcagatgatacaaatccttcccgtcaaaacaaacgtgtaagatcaggttcccctggtagtgcttatccgatgtgtcaggtggacgattgccgcaccgatcttaccagtgcgaaggactaccacaggcgtcataaagtatgtgaaacccattcaaaagcttccaaagcactcgttgggagccttatgcaacgcttttgtcagcagtgcagcagatttcatccgcttcaagaatttgacgaggggaagaggagctgtagacggagacttgcagggcacaacaggcgacggaggaaaacccagccagaggacgcattgccccggggattgttggctgctagccaggagaacggtggtttagggaatttagacattgtgagcctcgttagcatcttgtctcggcttcaaggaaacaacagttccatggagaaatcaaatggacagtcgtctttggatggggatcaggtcgttcaattgttgaataggatgaactcctcgttcccttcatctcaaaaagttgctccaccttctgagggttttgatctgaacattgctcaaaaccttcaatcccctagatcagaggtccccaaggcgaacggcagtccatccacaggtttgaccactgaattactggctatcctttcagccttgacaggtccctctcatgatgccctcgccttgctcagaaacagtctcgcgactaacctgaaaggtaatctcaaagcacatcatcaaaacgtgttacctccctcccctactcctgtcgcacagcaaaaacctcaagaacgcgacatacaaaaccagaaaacaaatcttattgtggactctggcgcaaacaaccgcaagattaatgccacttatcaagacaactctcgcacacatttgccgcttcgtctgttcaattctttggaggaagacaactcccctcctaacgcgtttactcggaagtacttttcttctgatagcagcaatcctacagaacgatctccatcttcatcacctcctgttgtgcaaaatttgtttcctttgcattctggagatgaaagcagagaaaatgattgtgtttctgtctgtaaggaagataacttgacactagaaacaagtccgagcaatgatagatgttcggcctacgaactctcaaagcttgaaagtagggtgcataatcagaatttcatgtcaggatttcttcatcaatcattagagtccaggacagctgttgtgcagcctagctatacttcctcctcaggatcggatcaatctcctgctagctccaattctgactcacaggagcgaacagggcgcattattttcaagctttttgggcagcatccaagcaactttcctgtggcattgcgtgcgcagattctggaatggctctctcacagcccgtctgacatggaaagctatataaggcctggatgtgtgattctctcgatatttgtgtccatgccatctgcgaactgggaacggctacgagaagatctgccacaacgcttgaaactacttgttgaagattccaggactgatttctggagatgtggcagagtattagtgcaagctgagcagagattagcctcttccaatgatggtaaagttaggttctgcagctcttggaggtcgtgggatgctccagaaatttactttgttcagcctgtagctgttgtagctggccaagagaccactattactttaagaggccataatttggctactactggcacgaaaattctttgtgcttacagaggaaagtatacctctattgatgttcttcccgaagaagaagcttcagaatgcataccgactgattctagggtgcagaagtttacattttcaggggggccacctaatgtcttgggccgctgttttatagaggtggagcatggtttcaagggcaattgttttcctgttattgttgcagaccctatcatctgtagagagctgcaaagccttgaatctgagattgaaattgagttctcgagtgacaaaacaagctccataaaagttgaacgttcacaagaacattttcaaggttacagtgcagcaacagctagggatgaagtaatccgtttcttaaatgagttaggatggctctttcaaaagagtagcgagcggcaagctgaactaaacgttgtgaaggatgcttcttttcttgaattttcatctgatcgcttcaagtttcttttcatatatgctgtagaaagggacatgtgtgctcttctgaagaagcttttggacatattttttgaaatgaatgctgggcaggaagcttcagctccagagtcatccaaaaacttgcttgaaagtaatttattgcacagggcagtgaagagaaattgtaaacagatggtagatttgctcctcaactatgctccctcaccaaataacatgaatttgctgcaaacaaaatctttcatcttccctccaaacctgacaggtccaggtggccttacaccattacatttggcagccagcatacgtaatagtgagcccttggtagatgcattgacaagtgatccgcaagatgttggcttacaatcttggagtacagcactggattcaagtgggcagactcctcacgcatatgctttgcttcggaataatcactcgtataacagattggttgaaagaaaattggcagacaggaaatatggtcaggtatcaataacaatttccaacaatgaaccatctttagatgggattgcagcagatgtaaacgggtcgcacacaggttcgtctgtgttgtctttgcagaagcttcctcaaagttgtgcgcagtgcatgattttcagtaacaaaagagtgagaaggataacaggtagtccaggagctttgtatcgtccatatatgcattctattctggcaattgcagcggtatgtgtatgtgtttgtctttatttccatggtccaccacatgttggttcgtctggaccattcaagtgggaaaatgttgatttcggtcccgcttgaagttgttttatatatagccttcgtatgattgctgtacatgatgttgtgccattggactcaatattccaccatgaaggtgttgctgttattcacaatgtgctatcttgtcaaaagacacggtagcttgaggcggcagttttatccagttctgtcctgtctggatacagcaacaagagactgcaaaaaatagagagattattatggaattgcatatcctttcggggttctactatgttaagagctcattcatattcagttattttggggcggagaagtggggcaggggagtatcaatttcttcttcatatcctagtgttttgttcctccacaaaaaaagattctgaccggtagtcaaagggagaacatacaactagggtctgctttcttgttactttggatgatgctctggaggtaactactttccctgtgcagaaaatcccattttacacgcctaccatggcaacatttacaggcagatgatgtttctaatttccatatatctgatatttatgtactactcgatgctggtgcccggggcattttggaaatttttggctaaataagcgtcttattccagtgaataaccaaaaattgtggctagttcataaaaaaaaaa

SEQ ID NO: 787 - DNA, 1641 bp, Pinus radiata
gtaacactacaggcagctgcaatatttgtttacaatattgatcatacctgcaggcgatacatgcagcaatggatgcagaaagaatagggttgcagggatcgtcctctatagcagaagacctagaaacaataagcggtgcgcccatttcatcttcgtgcacgggcaatgatttacagggaactaaccagcaggggattgcgaagaaaaagccatcttgcaaggatagacatacaaaagttgatggtaggggaaggcgaatccgaatgccagcggcctgtgcagctagaatatttcagctgactaaagaactcgggcataaatccgatggggggaccatacagtggttgttgcaacaggcggagccatcgatcatagcggccacaggcacaggtacgagtccagcttcggctgcagccatggcggggtctattggagagttgggcataaatgtactgaccgactcaccccatggatcgctgggactcacagtgcggggctgtggtcatggcgatattataatggaaaggaggtcattgttgcagggagctggggttcacgaagctgtgggccggtatcagaacgaaggatttgtccagaaaggcattcaattaggtcacatgcagcaagatgcggaactatcagagcggagggcgctcagtgttaatttgtctgttgcttcgaggcatttctctatgcagcaagaaaaccctagcgagggtttgccccacatatgggccgactcgcccatgtaccggatcacaccaccaccacctgcatcgatacaggcgggagccggtaatcttacttgttcgaatcccatgacgccgttaacgacctacatgttacctagcgccttgaatcggatgcccggaatgaatctgtcgggactcgaactgcagaccggccacatgggccacatgcctctgagcgccatgcttcagggatctcatcatgagcagcatttgctgggtgtccaggctgcaggcgaaggccaaattggaatcatcgcctcaaacagtgcgtacaacaactcagtgaggtccattacacaagactaccaacatcatcatcatcatcattatccccacgcagcttctggacaagaccatagctatgatcaaaaccagtaataatgaaccgaaagtatactatcttcaatcagttcaataaaatactgaacctcttttctcattttgtgtttggctccctacaaacgcttgggtatacagaacctgatgggaatatcaatccaagcaaattcaggaaagaatcaggaaagacgccattgattgattgatggagaacattcttcagacagttgcatattgttaggatcacaaagcactgagagaaagtgatggtgtagctgagtcaggtttattcccacaaccctaacacacattgcatatacatatatgcaatgtcactttgtgtgtctcatctgtgcattaacatggctaattttggagaaatgaagaggcaacggcaggatctcggtaaatagcaaggaaaatgttgaatgtactgattattcaacccatgcattcaggtacttttgactcttaggtttttgtttaattatatgcgtatatgcagatctaagacagaaatgatatagttctttcgaaaggaaaaaaaaaa

SEQ ID NO: 788 - DNA, 1846 bp, Pinus radiata
agcaggagggaacccatttgagtgtgggatcatttgcacagaccatggttactatggatggggtttctgggattggtccgcctgcaaattctccctcttcctcttctgcccagcagacggatgagaacagaagcttgacattgataaccggagtttctcagtctgttgaggtgaaacaggaagtgcagagggagggggacctgaaagatcagcagcaatcgattgtgaaaaaaacaccccccaagagatcttccactaaggacaggcatacaaaagttgagggaaggggaagaaggataagaatgccggccacttgcgccgcaaggatttttcagttaacgagagagttgggtcacaaatctgacggagagacaatcagatggctcctggaacaggcagagccagctatcattgaagcaacaggtactgggaccgtgcctgctttggctatgtctatgggtaactctgttagaagctctgctccctcgacgatggccagtagctccaccataaggcctcttgccatgggcctcagggctaaaactgagtgggatgagagtgaggacaagaagaatgtattggataggacaaggaaaatatcagcaggcccagatgcttcaggaggatcaagaattgtgcaagagggccagacaatggaagggggcagcgtcaagaagagagctagagggttggtggtgaagaaggagcatgacccgctgactgcatcggcgcctatcaatgctgtccctgcgaagcccgcacctacagcgaggcagactcctctgcagcccccacctcaagcacaggcggcaccattgtctcagaacactacccttccacaggcctcaggccttatgtccatgtgggcagtggctccagacagagcgggttccatgcctggagcattctggatgcttcctgtcacggcaagctcagcctcagctcctggtattgttggtggaggtccctctagtcagcagatatggacttttccttctggttctgtaggtcccatgtacagcatggctgctgctgctgcaggggcggcggctccttctggctccaacaacccctcttctatcaccaatcctggagttatgccacttacatctgtcttgcccagtggcatgattatgcccagactcaatatacccggaggaatgggattggaattcccaggtgggcacttgagacatatgccgttgacctccatgctgttgcaagatacgtcacaggctggaactgggttaggtattggggctgaaggccatttgggaatgcttgctgcactgagtgcttacaataagagtactaaatcagaacaccagttcatgggttccagtcatcaacaacagggtgaaagcggtgatgatcctacaaactctcaataggaatcccaactctacacttccacaactcctggtggcattgcattgcgcttgctgtggctggtgtcattgcttagcttcaaattgtaaggaactgctactcaaggtgaaattggtatatggtcctgtgctccaggacttgtcctgggtctgtctgccatttttggatgtacggaaaagatcctggatcaggcttcctttctttatttgtatgtatctgcttgtcatttgtgaattttgacttcacatctgtaaggaccatgtattttgttctcatggtgatctacgcttggggtagagacatgctgtcatggtgatctacgtcagaaatatatgcatgtgcaagaagctcaaatcagatgctgcgttgagagaaagtgctgaaattttttaggtaattgttccattgttccacgaattgtaattgagttccatctacctctgatctaaaaacaaaa

SEQ ID NO: 789 - DNA, 1876 bp, Pinus radiata
ttgcagctcctttcgtatgatcaagaagagcaaaggatggtgggttataatgttcagaatactgcggctaacaggcagaatcaagatgaccatggtcgttcgggtttgggttcttctgggtatttgcaggcgcaggcggctttggtagcttcatcgcaggtggattcttctttggctatgtcagccgccaagttgtatagtaactctgagagtactgcaattattatccccaagtcacatgagcagcagaagaccggtggtggtggcggtggtggtgttgctgttaccgaagacgctgcaaagaaaccgctggccaagcgctcgtcgacaaaagatcggcacacgaaagtggacgggcgcgggcggagaatccggatgccggcgacctgcgcggcgagagtttttcagctgacacgagagctggggcataaatcggacggagaaacgatcgagtggttgctgcagcaggcggagccggcggttattgccgcgacggggacggggacaattccggcgaatattgcttcgctcaatatctcgaccaggagctcgagctccagcatctcggcgcccttgaaaccgccctattttcattctggttcgctgactctgaacgcgaatttcgctgccaggttggaccagcagattcggagtaggaacgagtgggagcgggtacaggaggagaggtcgggaatgaatactggattaggtattgggcatcatcatcacactgatagcagtgggctgacacaggcattgattcatgagcagaacttgataaatgacagagctgagattaatgacctaatgaattctgattgtgggaattcaaggaaaagattgagggaagaacaacaacaacagcagttcaagaacatgcaacccatgtgggcagtgacccctgcaactgggttgtctagtagtggacaaaatatgcctgggaccttctggatgttgccccctaccccaggtgttatgggtcatgctggtccaggttctgatcccatttggactttcccagcttcttctggtggagccatgtataggacctctatgtctagtgggcttcacttcatgcctaggcctattaatctcaattcaagcagtacaagcatgggacatgttcagtttggttctatgttaatgcaaggcccagcaggatcaggatcaggatcaggaggggcaggaggaggagcaggatcagggtcagcttcccaacagttgccacaaactggtcttggcttgggaggtggaggaggatcaaatgaaacacatttgggtatgctggctgctctcaatgcagcctacaacaacaggagcatgaataataattcagaacaccaatccatgggatcatcaggccataaccatgctgacagtggagaagaccgccgagataactctcaatagatacttgttttcatgaaggctctctcagatatttgtcatatgggattcttccctgcagacatgaaacttggtttacaagggtcaggcagaattcaaaccagctggaatatgttttttttttccttttctttttttctctacatattgatcgatctgcattggtcaaatgctttgcttgcttgctactgagaggtccagttgtagtgatcacaactcagatgtgaatttagttaaattgtgtaaggttttgaacaggtccttttgctgacgatttttacccactgattagggatccagatttattatttattggctttagattcaatgaattagctgggactgctgctgctgatagagatttgtatagggagatgtggaatagcctagagctgtatgtgtgcagtgctataattgtttttttctcttgtgttgaaaatagaatgaattcgggactgtaaaaaaaaaa

SEQ ID NO: 790 - DNA, 2098 bp, Pinus radiata
aggtgcgttatggctttccataatttgcgtcagtctctagcttttcctgcaacgttcacagtcgctgatggagggcctcccgcagcaactgttctgtgtctgctctggtctttcttcatgatatggtttttgcgcaagagaagaactagtgccaggctgccaccaggaccctatgcatggcccgtcataggaaatctcccccaattaatactgcccgctcaccgttctcttagaggccttgctgacaaatatggtcccattctctttctgcgcttaggctctgtccctaccgtcgtcgtttcttcttctgagacggccaaagagtttctcaaaactcatgacttgatttttgccagccgaccccgaacagccgctgggagattgatgttttccaactctaaagatgtggtgttcgctccgtatggagatcactggaggcatttttgtagagttatgggagcccgatgaacgttcagatcgaggtaagtccgaacagagggattccggcgggtgtgagatctcagagttgggtggtctgcagcggtctttggtacagggttatcatgggtctccggcttcgtcgagagtaatggaagcgcagcaccctggattgcagctaggacgagggagccttgtgcaggctatgcaggcggcaatggctgggagcaatagaattgaagggggcagcagggcattgggagcgtatcgcgattattcgggtaaagaacgggcggatcagcaaatgaatgctgcgagcgtggctttggttaccgtcagtagggctgtggaggagacgaaggcggcggtggcgccgcaggttcaaaacgctgtagtggcagctacgagcagcggcgccgccagcgaacagggaggggagattaagaaggttccgccgaagaaaccgaccaaggataggcatactaaagtggacggcaggggcaggagaatccggatgccggccacatgcgctgcgaggatctttcagctgacgcgagagctgggccacaagtcggatggagagacgattcagtggttgttacagcaggcggagcagtcgataatagcggtaaccggcaccggaacggtaccggcgtcggcccagaatatttcgggttcgatgcggagctcgggaagtatggtggccagcgggcgcccttcgacgtcctacggtccgatggggttggctctccgtggggctggatcagagccggacatgagggataattctgaaatggcggagcggagatttatggaaggcctggcgggcgcttcgttgggtttccatcacgagggcttcgtcatggggtccgtgccgcctgggaagggggaacaacagtccgttggtcacatgcacgatgaatcagaacgcggaaccggtttcttgacgagtgcgacggcgggttctaagtatggccccggttctactagcctctctagccaggctgcgggtctcatgcctcctcctgccgccgccgccgcactgtggaccgtggcgcctaccagcagccgatcgccaaccatatggatgctccccgtaaccgccggctccagctcgaccccaccctccagtgttgcccttaatcaatcccaagaacagttatggacctccggctatcgtttagcagctcctgcaagcacttcgattcatctcggcacgggaagaggcggagatcataacaatctgcaatcatcttcgaatcccatgatgcctctccccacccagatgctgcccagtggctttactctcatgcccagaatcaatctctcggggctcgaactccagaccgcccatctaggagcccacatgcccatgagctccatgcttctgcaacaaggctccccgcagcatcccggcatagggctgggcctcggaggggaagggccttatggaatcatcgcacctctcggcgcatataatccggccggaaggcccatgagcagccctgatcagtatgatcaccagagggcgcagcagcaacaagacaccagcaacgacgatcagcaacccggccaacagtagttagacaaattttttaacagtgtgtgcattatgagtcgggaggcagtcagttaatccttcttcacgttgagtcgcaat

SEQ ID NO: 791 - skipped

SEQ ID NO: 792 - DNA, 1721 bp, Pinus radiata
ctggattcgtaaaatgccatttgattcttctagctctcaaattattcctacaaaacctaacagcacgattcaagttttacagactttgctgaggtagattatgccagcaatcattcctgttgcatatcttctagggcatgtaccaagttaaaaagttttcaacgtctggcatgactcctcaaagggttcaaggacaccagcaaaggggatctggtccttcagacgtatcttctaactctgatggtagtcctgttacggcatgtggtggaggatcagcaaaacaacgcttacgttggacgactgatctgcatgaccgatttgtggaggcagttggtcagcttggaggtgctgacagagcgacaccgaagggtgttcttagggttatgggtgttcaaggcctcaccatctatcatgtaaaaagccatttgcagaaatatcgactcgcaaagtatgtacctgagtttcgagaaggggaaaaatctgataagagaaaagcctatgaagtgataccgaagatggatgctacatcgggcgttcagattacaaaggcgcttgaaatgcaaatggaagtacagaagcgattgtatgaacaactcgaggtacaaaggcagttaaagttaaggattgaggctcagggaaggtatttggagaagatcatagaggaacatcaaacaggtgctactaagtgtcaagctccttcttcccctgagtcatcttctcatttctcagaggaactgcatggaaatacaaaaggatttttgcatgattctgaagatcgagcacagaatgactcgcaacttccagcctctaggtcaagtggagctatgactatgacatcaagtaatatttctcaaaaggttgaacatccagttatatcttctgcaatcatggacaaacaacagaagataccatcatttacatatagtggttatgatcacgtctcatgtttagcaaacccagagtttaggtcaccttcaaaacggataagagtgaatgatagtataggacaggtaaaacaggagacttttgcaggtcaatctcaagaccaacaacagttgccaacaaacgaataccagaaacatctatctgttcacacaactggagaattatcaaacccaaattaccaaagtaggcttgcatgttcaactggccatgttgagtctcctggatcagtccatctttcctctgaatcccaacctcaacactcagagggtggtcgatattctgaagaagtttatcaaaagcaatcagcagcaaaggcatcgctgggattttctcccacagaatcccaatatcgtattccaacgtacttgcagtctatgaattccccctttctatcacagtctgagttttctagtgctttggatagcatggacagtcaccaaaacatgccattacaagctagactgtttcaatcatggatgtaactcagtctatgtcagaatttgaacagaatggtcttgcgatagcctataggagggcttaaaatgatcaagtttgttgagcagagaatatagttatcataaacattgctctttctttcataattcacgcaattcaagagcgttgatgacatctggataatggatggtccttatggatcattggttgaacacaaatgctttgttataacttataaacatcgccccttgtttaatggtgcatgaaatgaaggaactttaatgtgatttagtaaagcttttattgttttaaaaaaaaaa

SEQ ID NO: 793 - DNA, 1386 bp, Pinus radiata
cgtctgttgctgttggccgaatttggtccttcatgtcttgttccacttcgaccattggccgtcgtccttctcatctgccacaggttttgctttccaaagagcagggcacgagagccattcacggcgaagacgaagaggacttttgggttgtgtgtgcacagaagcaaaatcacgcaaaatacccttgaaatgagttgggagctaacagaatagaagaggagcagcagctagaatcaggatggaggagcctctgcaaattataaattcatctccgatacagcagcagcatgatcatgatgatgatgatcatgggcatgggcatgaggaggaggtaattccccaccctctgcttccccctcctggcgacacttgtattgttccatacatcatgcccgtttccacctctaccgcagaaaaacaccctccccagccaaccaatatcgcctttaacggcccggaaacagaggaagacgacaagaaacgggatagagagcacaagaagcggtccaagaactggaccagggtcgaaaccctcaagcttataaagcttcgaacagaatttgagcccaggttttctcgcagcggaagaaagacggaactctgggacgaaatagctgagtctctgcgaaaagaacagtttttcagggacgcccagcagtgcagagacaaatgggagaaattaatggcgggttttaaagatgttagggagggtttgaaagataggaacgataacccttattatgaggatctccatcctttgctctccggcaaatgcctgcgcagggaaaacctcaagaaggaaggagattctacccataacgagaagtgggacaagttgatggctgcctataaggatgtcatagatgggaaaagagaagaaggcgatctttcctattttgtggaactgagggctattgttggagggaggcctgatgaggggaaagttcaaatagagtcgatgccttgacatatgaaccggattgtatctgttatctggcatatttgatcaatatctccttggattcagctaaatggtagctctatggcctagcacggaggctccttgcgcatcaagcctggtatgcaattactcagagttttctttcttcttgtgccatcaattgttattgtaaggagcatgaatccttccatgggaaacctcttagtgatttatttagaaagtgttaaaaatttcatgcaattgcagttatcaagatatatctctgtgaattatttagatggagggtaggccgctctgctttgtaaaatagtactatatttctgtatttccgggttcaaggccatgctgccaaatccacactctgtgtatattcaattggtatttgcttcaaggaccctactttcttattcttcttaaaaaaaaaa

SEQ ID NO: 794 - DNA, 1395 bp, Pinus radiata
aaattgtcgaccaatctacagagattaaaatctgatattggcaacgttaattgtctgtaattgatattaatccattagagctttgcgtggaatcttgtgttgtgttaaagaagaggattcaaacatgggagtatggtgcttttcttaaagcaggacgagcagcggaggttaaatgcaaggggacaacatgactacagtggctgcattgccactgcagtcaccttcaatggaggcagagatgaatcaagctcaattgaagaggaaagatgacagaatccctcaatggggtcatcaggagacgagggaatttatcgccatcagggcagagctggaaaaggatttcacgcagacaaaaagaaataagaccctgtgggagattatcgcggggaaaatgaaggccaagggatacagaagaagcgcagagcagtgtaaatgcaagtggaaaaatctcgttaaccgttacaagggcaaagaaacctcagagccggataatggaagacagggccctttctttgaagaactggatgcgatatttaaggaacgggagagaaatatggacagattgctattagagtcaaaggctggcatgaaacccaaagaaaaagtgaagagattcaaacgcttgttgggggaaaaatcttcggatgattattcagaagacgaggaagaggaagaggatgagagtgaagatgagaagattactaagagaaagaaaagtaaagccgataaagaaagacagagagttacggaccgtgcaaatagtatgcaggaggtgcttgaagatttttttcagcaacagcagaggtttgaggagcaatggagggaggcagtagagggaagggaggaagagaggagattaagggaacgagaatggaggatagcaatggagaaattggaaaaggaacgggcgatgaaagagcaggcttggcgcgagagggaagatcaaagacgagcacgagaagaagcttgggctgagagaagagatgagctttttgctgctttagttaacaaactcacccaagaagaaaggtctcacatctaaacatggtaatgggcggaatatcctccaacgttttgttcccaaagttcttttggaatatgaacagaaaatgtaaggatagcctactgatatttcacatgcaaggagtgcaattagattattgattttagttttgcctagacaaaaagtcaagggatagatggatgcagatggatgtaattacttgaacctgatgatttagaaaactcttgattgaagtcagttgcagctggattcagtggtgtattcatgtagagaaatatttaaatatggtgctgatcttttcatagaacgtgtggaaattcaaaggctcttatccaaaagagtctgtttattggattggtggaaaaaaaaaa

SEQ ID NO: 795 - DNA, 2496 bp, Pinus radiata
attacatagatcgataggccactggaggtttcagacattcgaggaagagtttgagttttagtatttgtcagaaacaataaaagaaaacgagcgaaaatgatgatgggcggtggcggagaggttgaaggcatgggattgggagtgatggccgccctgcctctgcagttaactcccactgtggcaatctcatctggagatcaccttggtgggcctaatagtagcaacgttgtgacaaacaatggtggtggtggtcttggcagcagcctcaagaaggatgataggattcctcagtggggattcacagagaccaaggaattcattgccatcagggctgagctggagaaggatttcactcaaacaaagaggaacaagactctgtgggagcttatctcttccagaatgaaggagaagggtttcaggaggagctcagagcagtgcaaatgcaagtggaagaacttggtcaatcgctacaagggtaaagagacttcagatccagaaaatggcaggcaatgccctttctttgatgaattgcatgcaatattcacagaacgtgccaataccatgcagcgactgatgctggaatctgagggtggaaacaatcaacccaagaaaaagcttaagagattgaaaggcttacaaggggagaagtcctcagatgagtattcagatgatgaggaagatgaggaagaagacagtgaagatgaacgtattgtcaggaataagaaaagaaaggctgaccgtgaacgtcaaagggtgactgctgagaagagtcgggcaaatagtatgcaagaagttctccaggattttttccaacagcagcagcgtattgaaatccagtggcgggagtatattgagaggagagaacaggagaggcgtttagttgaacaagattggcgtcaagctgtggacaaactggaacgagaacgtatactcatggagcaggcttggagagagagagaagagcaaaggcgtgctagagaagaagggcgtgcagaaaagcgagatgcccttcttcacactttgctcaacagacttattcgtgaagacctatagtaaattattcttaggaattacttctcttttcctgcaatattagaaggttctgcccacaattagtttatgggttctgacagcgatttaatatgcaggtctacccacaacttaaattgtgggtgttacctgcagtttaatttgatacagaatacacaggtcgtataagcaaagaggtagtctgacttttagaagcggcagaagcaaaagcgaaataaccattagagtgaaccacaagtcttcaaagaatctttgtattttaattagaaggatatgtaactggagggttttccatgggaattcatcgttgggttctgattgtatactgtagttgggctcattgcttaaactgtttcacagagctttgctctttgaaatggatgtcaagactgaagtctacaaattggcaatatcttttttagttgtactaattaatatttgttttctcgtcaaagccttcttatataaagtcagcagcttcaactgttgtgaaaagaccattggctcaacatacacctgagcttaccgccatggtcccagcttctgttcttttaaggagagaatctgctcaaaaggtgaaacccaagtcaatagttacttctagttctttagctcctgtatctaaaacaaaatcagattctgttcagacagttgctaaaccacaaagcattgatgattcatatgtggcatttttggaagacatgaaagctcttggcgcacttgatgaagataaatgatttggtgtgtgtagagagtgcttttccagttccaatttatgattgtggaattggttagtacaaaaggatgtacaggttgctgacacatgcagtaccattatctcatggggttatctggtatctcttcaaaattatcatcttgacaatatttgcagcatctatttcttagatcttgagcgttcaatttcattgcactaaactcattcattcatcgttttccatgggctgaaatacaattgaaggacactttggatctgtcttgtgctacgctgacggatagctgtagtgatgtgaattgcaacaactggaacttgctttaaggcattcaaattcaatattgggcaattttattcgatttgaccatctctatctgtgctatgttttgcacagctcttgttttactcagaagtaatcctggcattgttaactcattaaagaggagtggatctgtgtgaaccttctgagcatcactaccgtgttaagaaaatggtgacattaaatatttccggttaataacaatagtgataagaaattgtgtatgtagataatctagcgagggcacaggagataaatgtaaattctatattctactatacacgcttataaaggcatgcacatttctttctgctgtccttgtactgcctggcagcctacgttattatgcctaagaactttttgggaaacttaagggtcttgtttaaaaaaaaaa

SEQ ID NO: 796 - DNA, 1737 bp, Pinus radiata
gcgaaagttagctcaatcatggatattgggtacagcccgaggatccatccatacacaagttgtgtacttcttttaattaaagatttgagttactagttgtgtacttgatttattaaagatttagagttacacctctgctgcaagcagcagctgtaacccagtagaaaaatgggtcgcgacagcagccgaaagaagtgtttttattaaagatttgagttactagttgtgtacttgatttattaaagatttatagttacacctctgcggcaagcagcagctgtgacccactagaaaaatgggtcgcaacagcagtcgagaagaagaagcagcagcgatttattaagtccccaattcgacttcgaggccacggcttccagcgattttagcaatggaaggatcccatcactatgtgagtcattttgcaaaaacccaacaggaagaggggcaaccagcttcatctattgaagagatggaccccactcttcaagaggctgtacggctgtcaagttctcacagcactcgtttacaggtggctcccaggtggactctcactgagatgcttgttcttgttagagaaaaatgggcagttgaaaatgagcttcaactttctccttccaaatcacaattctctggtgtttcagacaaatggagcattatatccaaccgttgtgcagcatcccatgtacaaaggacagcaggtcaatgccgaaagaagtgggaattacttatttctgactataagaagataaaggaatgggagcgccagtgtggggtagaatcctattggaacctcagtcatagtgccaagagggaacataagcttccattttacttagaaagggagttgtttgatgtgatggatgcaaatctagataaaacaccaactgcatgtcctgatgctacctttgacagcatggatgtggcggcagatagtctttttacttccaatgatgactcacaagatgagatggtcaagatgcaggatccaacggcttcaggaagtggtaatgaaccactagattctaccgtaaggcataagagaagaagatgttcaattgaagatgatagggagcatgacataattagtgtacttcgtgagaattgtcagaatatacaagcggttatccgcgaaacaactcaagcacagatgtgctccagccagctagacagggacatgtattggaagggtattgaggtaaataaacaagtgcaactacaaaccagtgagcttgatagagagctcaagagaaagcaaggtcaggatttaatagatgttcttggaggacttgtaaatgctgtgaatcgcctcgtagacacaattcagaacaagagttctcaacaattgaatggaccatgaacctttagggacatacaagtgggttttgatttgtctgaaatatctgtaagcacttctagaattccagaaaattttcaatcaatcttcaatcatgtcttggcttgacgattttcaatatcttgcagaacttgtatccaaaggttgctagtcaacagggcacaatatcatccttactggcattctttaaatctcagagagccttgtctctctgatttcagaggcatttggatagatgaccaggcaatgtatatcctctgagaatgtcatttcaatttagattgcacattgaaacatgatagtccctttcatggagctgcctaaagtaggttatttcctataaattctctcaatgataatatttttatgtgacaaaaaaaaaa

SEQ ID NO: 797 - DNA, 1421 bp, Pinus radiata
gagatcacaggtttacaggctttcaaggagctttgttgtttacaggtgaagtaacggcctgtgagcatctctcatcatctactgtgatgatagtattctcattattattaagacgacggagagaatccattgacaaaagtagaagacaatggaggttgtgaccaacggcatgcagttgcaggcacaggtgcagcagcatcatcaccaccaccacatgcttctgtcaagtgacattaacggcgaagatcatgagataaagactacacccaagaagagggcggaggtatgggggcatgacgagattcgagctctgattgctctgagaagagagattgatggtcttttcaacacctccaaatctaacaagcatttgtgggacaagatttctctcagaatgagagagcggggattcgacaggtctcctacaatgtgcacagacaaatggcgaaacctcctcaaggaatacaagaaggccaagcaccaccatgacagccacgatggatccgccaagatgtcttgctacaaggacctggaagaattgcttagagaacgggccaaggctgctccttatagaagccccaataaggtcgctgaccttgactcttatcctcatttctcccccaagggaactggcaggtctccattcaatatggaacggagattggatcatgacagacttcccctggccatgccattatctgatgcaactgctgccaatggcacgcctccctggaattggagggatgccgctggaaacgggggagaaaaccacacaccttacaatggaaaggtgattctggttaagtggggtgatatcaccagacgaattggtattgatggaacggctgaagcgatatcaggggccattagacctgcttttggactacgtactaaaagggctttttggttacaagatgaggatggagttgtgcatagccttgacaggaatatgcctttgggaacctatatactttgtcttgatgagggcttaaccatcaaggtatgcacttacgatgagtctgacagtttgacgtgtaccactgaggagaagaccttctatactgaagaagattttcgctatttcctcacacaacgtggttggtctggattgcaagaagttggtggatttaggactgttgattctctgaatgaactttgcccaatgtgcgtttatcaacgagcagggcccctaggatagtaatcatgtttcagagttcttctcagcaggctaacaggatttgttagtgcagacccaaatttgaactactcttggatactgcaaggcaagtttgggactcgtgcatgacattgtatactaatgttttgaatagtagtttttttgaagtgtctagtttcgtacataaaccaagtgaggccgtaatgccatatataaattttagattaagttgataaaaaaaaaa

SEQ ID NO: 798 - DNA, 1582 bp, Pinus radiata
gtttttagtaatctggcaaggaagaaggcatcgcaaaggcaacgggaaggggcccacaaaacgtacacgggcacttctaagtggatttgttgagtcaatgtattcaactttcctgtgctggacatacaagattcctgtttcaggtgtctccataacatgccattgaaaatatctagtccttgggagacaaaatgttggccgagtctttttcagagggtctttgtatcccaccaatgggaccagatgatccaaatggtgttattcataaagatgagatttcagagcaacaggttaatcactccatggcaactgtagcagatgtaatctgtttaccatctaaccaggaaccaagggatttgattccgcatgaggtacggggaaagagaaagctgtcatctgaacacaagggaagagttcggtggacaagttcagatacccttgtacttgtgaatgctaaactagttgagaaaaatatgcactctgctggtggtgcaataaagaggacgaaatcagccattgagaaatggagaaccatttcagctcattgtcatgacaatggccttgaccggaatgccactcaatgtcgggacagatggaaacatattctacctgactataagaagattagacattatgaaagaaatattccaccaggtcatgtcagctactggaacatgacaccaaaagaacggatggacaagagactgccgactaattataccaaggaactatatgatgcaatgaataaacattttggccagaaaggaaatgatgttggagatatgattattgatacatccgcatcagatcatggaacatttgaagattgccttacacctgcaaagaatgtgataatgcatgaaaatacaatgcctgagacaccacttcagagccctggtgatacctctactgatagagataaacaatatccagggaaaaagcgaaaatcatcatcaaaaacagccggcattaaggcaaccttgtctgagaacaataagatgatcatttcaaaccttaagatggctgaggagggacggatgaaacgtcatgaaaaatattgtaatctgtttgaacggagaatggagatggatgagaaatatctgaaccaccatgcaatgaatgtgcaacggatgatcaatgttgaggagcagaaggtgaaagcacaacgtgacttggtatcggcattgaatactattggtcaagcaatgttgaagatttgtgagtcccttgatacgaaaggttgattgtctttctattctctttatgcatgcatatctgcccctgtttgtaacggatgaaatagaatttcttctgcagccttagcagcgtcttttaatatctctgcttctgattcatgtgcttaagagctctgcaacggctcagatgctatcgttgcaaacaatattagttcttcgaaaatacttattgtaatttttcaggaattcataccattgtagctctaacagtgttctcttgaatcactggagtaacttttatgtatttatttactatttcgtattgcttaaaaggtttacattgttaccttacgtaaagtttttgtatatccactacaaaaaaaaaa

SEQ ID NO: 799 - DNA, 1711 bp, Pinus radiata
gcgaactcctaattcaggttcactaactagggtatgctctgcactgctctgtggagagtctatttttcattcctttctgtgcccggtcaccattctcggcctctaaattcttgacaaattaaacccagcagtaccctgttcgcacccaattcgagctaaagattctaacctgtgacctacctgtggcctacgccatggaagcgattcccaatggcgtgcccccgcttccgctgaccatgcccttccaacaacaacagcagcagcagcagcaccacatggtcctcactgagagtagcggggacgaccacgagctgagggcccctaagaagagggctgagacatgggttcaagacgagattcaaaacatgctcgcctaccgaaaagagttagagagtctcttcaatacttccaagtccaacaagcacctatgggagcagatatcgcagagaatgaggcagaggggttatgacaggtcccccaacatgtgcaaagacaaatggcggaatctcctcaaggattacaggaagctcaggcaccagcagaagcctgacacgcccaaggtaggatattataaggatatcgaagatgtcatggtcgaaagggccaagcatacgccgcatcggagccctgtgaagtacgaatctacgattcagatggtgcccaaagattttgacaggcctgctttaaatatcgaccaaaggttggataatgacagccaaacaacgtctttgttgtcacatgagtcgccattggcaaatgggatgagtccatggagttggaggggggatactagtgccaatggtttacctcagtggaatacgggaatggatcgcagtatacctgcagggagggttattgctgtaaaatggggtgatgtaacccgaagagtaggtattgatggttcagcagaagccattaaggatgccatcaagagtgtgtttggattgagatcgaaacgagcattctggctagaagatgaagatggtgttgtccgttgctttgatcgtgacatgcctctcagaacttacaatctgcatattgatccaggtgtgacagtgaagatttgttattacgatgggtctggtcgaccaacagtgaccaccgaggagaagactttatattgtgaagatgatcttcgtgaattattagcacgacatggttggcaagcattgcgagaagtaggtgggtacaaagacattgacacgattgaagagctccaaccaatgtgtgcctaccagcagggtggattaggcttgtatatgccaaaggttgaatgatgattacttgaatccttatttgtacgtcattcagtaagctattttatcagatctttatgaactgacccaaacacgcaagccttctggcatcgtaagctacactgcctaggcttttatcaatgccaattttgacttggaatcaagaggttatctgttcaccaacatcatggaggcatccctactgattgttacacatttctgctcagttgaagccatttcaactacttgttatatctttctgctcagacgaggcatcccaaccgattgttgcatatttgtactcccatgattatttgtgttcacatgagtatgtatgtaccatgtgattggagagctttagatagataaaagttcattacgtacttcaggtacaggaaaatgtgtaccacgttacgatataagttaatttctctactgcaataataaaaaaaaaa

SEQ ID NO: 800 - DNA, 2238 bp, Pinus radiata
gtcagtggtctgagaagtgatgggaattgtaaagcaaagcacacagagtagtactcatcatcttctcccgtgcatttcattcgaccaaaggtatttgaattggccatggcgatagacgaatttcagttaaattcgttgaacgatccgtgtatggatttcggcttcctcaatggcggccaaatttgaagccaggaagatccaagttcttggtccaacaaaccctccagaggcggggttttaccggtcattttggtgcgccttagggtctgcgccattgaattttgtttctgcaggttttgttctcattaacccttaaaaaacctacgttcaagcgcgccctggggtcagggattgcgaagattctatgtatttattggataatcacaggcaaatagaggaagacggagaggagagggacataataatggaggttgtgacgaacggcttgcagccgccctcgatgcactcggcggcccagcagcagacgcagatgattttggcggacagcagcggggaggatcatgaggtgaaggccccgaaaaagagggccgagacgtgggttcaggaggaaatcaaagctcttattgccttgaggcgtgagatggacagcctatttaatacttctaagtcgaacaagcatctctgggagcaaatttcgctgaaaatgagggaacgagggtttgataggtcgcctactatgtgcactgataaatggcggaacttgttgaaagagtacaaaaaggtaaagcatcaggaccggggcggcggatctgcgaagatgtcgtgttacaaggatttagaggaattactgagggagagagccaagaatgcggcatacaagacgcctccggccgcagctgctgcaaagatggacacttacattcatttttcgcccaaaggaagtgggaagtcgtcactcaatctagaacgcagattagatcatgatggacatcctttggcaatagcatcagttgatgcaactgctgccaatggtgtaccaccatggaattggagggatgccactgcaaatggtgatcatcaaacatcttatggagggaaggtgattgtggtaaaatgtggggaatttacaaggaggattggtgttgatggcacagctgaagctatcaaagaagctgttaaatgtgcatttgggttgcgtaccaggagggcgttttggttagaagatgaagatggagttgtgcgttgccttgacagagatatgcccttggggacatatatacttcatctggatgatggtttgactatcaagatctgcacttatgatgaatctgatcgtctgacgggtgccactgaagagaagaccttgtacactgaagaagattttcgtgattttctcacacgacgtggttggtctggtttgcaagaagttggtggatttagagcaattgattctctggatgatcttcgtcccttatgtgtatatcaacgtgcggggttgctgggggagtagtttaaattggcatctgtttgtgcacaaactagcagggtatgcagatgatccacatgcaaacctaaacttgctttggagactgcaatgtaagcctatgcctcctgcataagacattgtacactaatgatactcttaagaatatgagttttcgatagctcacatgacttctagcgcattcaggtgagcatccagttatagacagctataaaattaagatggagattgttcagcgctgtacagcaaccgcatgcttatgttacttgcagactgaatggaagagcatttctttccatgtaggttctagtgtattattataggattgcaaccagcaaagcatttacaaggatttgaatgcgatgtttctgatttgagatgtagccattatctcatcttctgtcatttcccaggcagaaagggctcatatatatatttatgagaaaccatgtcatacagtaaaatgattagttttgggaagagagaagttgagaagagtgattggactgctttttcattctgcagtttatatactgcgtaaggcattggaatcttaagggaaataataggtgcctgggatgccgcacttgcaacatttaggattatttgctaaatcctctcattctagtgcaagctttcatactacagtgaagctgtaaactagtaaaaattacacagcttgaaaaactatgagagcacagtcaaacttgtaatgtaatcttcattgtacttgttgaatgatatatattcttagtataacctcaaaaaaaaaa

SEQ ID NO: 801 - DNA, 1690 bp, Pinus radiata
gctctgaaacattctctgagcctgtttgccttgtaaagagtgtcaaaaggagacagccctccaaatcgaaggacaggaccttgctttgggacgcccgtcccgccgtgcggccgacccccctgcggatcctctgcaattttttcctgtcccgatgcctttacccgtctgagtccggagcttcaattctcgggggaattctccgttcttatgacagaattccttccccgtcccaattacgctgcgatggccgtggaatcaaacggcttcgcattcaaaagcccacccgacctgttactctcgtctcctcgcaaccccaacggtaaggccagcgcgaatgaagcaaaaattccggccggaatccccaaaccccacgcaatcagcaaggaggaggccaccgccaatggcagcagcaatccgtctattgtcgaccatgccggcggcgacggcagcgacggtcaggacaagacgcctcgcctccctcgctggacgaggcaggaaattctggtcttgatcgaaggaaaaagagtggtcgagagccgcggcaaaaagtccagggtaacggtcgatggtcagaacggtcaggtaaatacagaatccaagtggtcttcaatttcatcttattgcaagcggcatggggtcagcagggagcctgtccagtgtagaaaacggtggagtaatttatctggggattacaagaagatcagagattgggaaaacagtcatgttgaattgcagtccttctgggccatgaggaacgatatcagacgggaaaacaagcttcccgggttttttgatagagaagtctacagcatactggataagttcattgggaaacaagacggtagtaaagaggcgatcagggtgatgcaagaacccatctttgacagcgggcggccttgtggtggcggcgaagataccttgttttctgattttgagcattcggccgaggaagaagttgcaggcagccctgaaaaggaggcggcagtgatgctcgacagccccactaccacggctgcgacgccaccccagccccatcggcaaggtgttaggactgagaaggtgccaactccagttgctgagaaaggaacgacctcttgtgcctccgggcaaaagaggaagcgaacttcttctgaaggagaaagtgatagtgacctgaaagatcaattgattgctgttttggaaagaaacagccgggtgttgagtgcacatgtggatgcacagaatctgaattgccaattggatagaaatcagagaagggaccatgcagatagtttggtgggagttttgggaaagcttgctgatgctttgggaagaatagctgacaaactatagttaatttatatgatgggccaatggagtaaaatcctatgggtattttatcacgatatcaacattacagataccggtgacctttgggctgagagtgcattgtacagtttacatatgagattgatatagagttccaatattttttcacccttttagctggattgaaatattcattccttattctgaatttatgtacagttattaatttatactctcatgttgaggggaatataggtaagcttaccaaaagtggttcgagagtaatatggaaaagacaatgtaataattcattatatgagacttgtacagactacagagtaaatgttagcctttgtttgatgcttttgcttcaaaaaaaaaa

SEQ ID NO: 802 - DNA, 2875 bp, Pinus radiata
ccaggttttaattaaaggcgtatgtgatttgattggaaaagcagtttgcgtattaatctgtggattgcaggttttgcttttgaattggcagggttcctctaaattagaggaagaaagccagtatttgatccttaaattggattagtgcggataatctgcggagaagccgaaatttgagctgggattgattgtcgtgcagatgcaggcagttcgtttggagtcttctactcctcagcaaactatacgatttcaatttgccggcaacaatgagggaaaatcgtggctttgacaggaatcctttgagcaaaagctgagtcaatacagccgttgtcgttgggcgttttgggaattatgagcgacggggaagaggagaagaagaaaatcaattctatggctctggttgcgtgcgttccgccgtcttcgtcatccacggacgccggggacccgtctttgctgcaaaacgcgacattcggtcggatgtcgacgggaattttcccggaaacggaggacgagaagaaacaacggcagcagcagcacaagaagaggtccaagaactggacccgtcaagagactctgcggcttatcaggttgcgttccgagttcgaaccccgattcgcacggagcggcaggaaatcggagctctgggacgaaatctccatggcgttgcagcaagagagcatatgtcgcgattctcagcagtgcagggacaagtgggagaaattgacggccggatataaagaagtccgtgacggcatcaagaaccggcaggacaaccctttcttcgacgagctccagccgctgctctctgccagaggagcggcggctaaggttaaagacggcgccgagccggcggccgtgggagtcacaaatggcggcgacagcaaaaccgacgaggaggagggccacggagagggtgagggcgagggcgaggaggagacggaagacgggtctccgcccgggaaacggcggtgccgttactggacgggaacaggaactaataacctggacgcggtattagagaatttatttgaccgccagcagaagtttttccgggacttgctggattcgatggagcggagagagcagatgcgggagcaaattcgtcaagaaaaggaggacaggtggcgggcggaggagcgggctcagagatgtagcatgagcgaggccatgattcgtctctcgaggaagcttctccagcagcagagccaagaattcacggcacataacggagtaggagtagtcagtgtaaccactacgaataataatagtggtggtggtaatccgaagaagaggtctaagaactggaagagggcagaagttctcaggctgattaaattccgcggggaaatggagaccaagttcatgaaatctagccggagagctgctctgtgggatgaagtggcagggctgctggccagagagggcataagacgggatgggaaacagtgcagagagaaatgggacaagttggttgcagagtacaaggaggttgttgacgggaaaagggaccgcggagagagcccgtattttgcagagctgacgcccattgttgggcgcccgcctgcagaacaacaggttctccatcagcagcagctgcagatagagaccactgcgaccagctaaccggctggaagggttgatcaggaccttatggcagcatcacaggatctacaactcacaccagctctttagatagtttgatcaggaccttaggattgatcagagctttcagtactggtagcatcgcaggagctgcagctcacaccagctctttagatggtttgatcatggccttagggttgatcatagctttaagtactttattggttaggactacttattggaagggttgatcaggatcttgttggttaaggccacttttttaagggttgatcactaaattacaagctaagattacttattagaagggttgaggggaacttacagatgaagacaacctatcagaagggttggtgaagaccttactagtgtagactacttactatcgatcaaaatagacttcactggttaagatgacttacttattatagagcagggtgttactggctttttagatgactacgttgatagctctttcacttgcttgaagggctggtcattattttactggaaaaacgatttgccattgttaggcttgcttcaggatgtctctggctctttaaataggtattaatcagatgtgggggttttttagatggataaaacgcttgatgaggatctggttctttaaatggttattcatcagatgtggcagactttgcatgaggatcttgtgggctctataaggaatgatctggaccttattagataaaatgatttgccctactatgacttatttatacatggttatccgatgtggctggctctttagatgactaaaagtattgatgaagactgcactggaaaaactattcacctttatccctactgggttagagaaatcctcccaaaatctcttgcccagctctgagataaaactgttctgataataattaactgttgtttgaaggcttgataagcaccttaagggcacttacattacagcaagtgattgggcttctagctggctcttggaaacatcatagaggcgtgtgacttactttatcaggctttacaggcttgcaacttgcttctgttttaactaattctcattagaagggtttaatgactgattaaatatcctatcaggttgatcaacctttgactggtttcatgtcagctcatatggggcttctactgggttgaccttggaaaggattctacttggttgacacaagaggagggggacaaatcttttgattcgtcgttatgtgtcagcactatcagatatcaatctgccatctgtacatattta

SEQ ID NO: 803 - DNA, 2792 bp, Pinus radiata
tgccgatagatgggtgttggtcttgtgggttgggagtgagggttgaaggagggaaagaacggaatgttgtgttcaacggccaccaaccaatgtcgttacgccattgccaattctgatgttgggtgatcttggtgagcagtgcgcgaatggaaacggaaatggtttctttctgtatttgtgccggagaactaatcttcatttagtgtgcattttcttgaggattgtgcaggcagcgcagcctatttatcttcttcttccataaggattttgcagtgtgctcttttggggaggcggccaagatgcagattggcgagcagtatgggctggcggagttgcagcagttgatggctgggcgcggtcatatgctcacgctagcccaggaaatgcctccagagattcaacttcaataccaccatcaccaccagcagcaacaggcgcagcagcagcagtttcaggcggcgtttcaccagcgccaacaaattgaagcccatcaccagcagcagcaacagaaccatgggaatagagtttaccaggcttcttctcatccactccagcatgaggaaaataggcaaaaccaccattcttacaaccaccatgtgcatcagaggcctggcaataacggtattgcacagcaattgagtttgagttcggattctccacggccgccgtctctgtctgtttcgccgccctccaagcggacaatatctcccccgggaataattagcaagcagcagcagccgccgcctgtaaatgtcaatgtgaacggcgtgccgagggaccagcagacgtttgaagattatgatgaagggtttgacgagggggacaggagcggcagcggaggaaacggcaggtggccgaggcaggaaacgctcacgctcttaaagattagatcagaaatggattctaagttccgcgaagccacccacaaaggtcccttatgggacgaagtctcaagggctcttgcggagcacggttaccagagaagttccaagaagtgccgggagaaattcgagaatctttacaaatactacaagaaaacaaaagaaggcaaagcaggaaggcaagacggaaagcattaccgtttctttagccagctcgaagctttgtacggaggaacaactattgatgctgccgacagttgttttggcgtaacaacacggacaaatttaaccgaaagtccaggcctggactttaacggagacggagcctcgcagaaatacgctgacactcaccacaacagcgagggctttagtttgtcttcggattcttcttcggatgacgagtacagtcacgatatacaggagaatcacataattagccgaggaaaaaggaaacggaagagctggaaatcgaagatgaagatgtacttcgacgcgcagatgaagaaattcatggacaggcaagaagcctggctcgagaaagttctagatacattagaacaaagagagcaagaaagagttagcagagaagaagcatggagacgtcaagaagcggctcggttggaacgcgagcaccagctctggtccaacgaacgagcccgtgcggcgacctgcgatgcggcatttatttccgctctgcagaaaatcaccgggcaaaatctacagctcccggaaatattcacactgccgcctcctcagaatagcatgaatcctgaagctcaggaccagctggacttggttaacagagaaaaagaaacttacgatccgaacaacaaacgatggccgaaacctgaaattatgagcttaatccgcctgcgtacgaacatggaacgcaggtttcaagaagccggcgccaagggccccctctgggaagagatcgcctcaaacatgtctcgtctaggatacgaccgtagtgccaagagatgcaaggaaaagtgggagaacataaacaaatatttcagaaaagccaaggacagtaacagaaagaggcctgagaattcgaagacctgcccttattttcaacaacttgattcactctaccgtcagggagctctgggattctcaaacggcggaagcagtaccactgccacgtccactagtacgaaactatcaaacccgccggacggcgtccatgaccagaccacgactgacgaactcgtattgcaaccctgcacaagtagtcacgagaacgatgagcaccgagaggctgtggagatcttaggacagctcatgccatcatctgaaggcggttgtactcacaataatatcaacaatgataataacaataatggcagtaacggccacccaacacccggagcttcttccaataataataactgcgtgcagttcttctcgggggcagcagaaaatggatgcaattgggagggctatccaatgaagctcaaaatcaagcagcagcagcagcaacagcattaaagtacgactctgccaggcgtgcggaaacgacagccatcgccattaaaccactctgtgagacttgcatacattctagctagctattttttgcttaatgtattttccattgctcgctgcaatatcatttgtgtttctttatttccttttgagaattatcttggacgaagtaatttgctcgcagtcggagcatatatatttaggaagtaggcagtagatgatgaaatatagcaatataatgcatgtgtacttaagtccttcgttttgtattattcccaatgaattagtcattatccttcttgaaggacaaattatgattttgtatggatgaggatgcttccattagcgaaagcttccatgttttctttaacatattattcctcttcaattattaactgttattctggcttaaaaaaaaaa

SEQ ID NO: 804 - DNA, 2453 bp, Pinus radiata
tcgaacttgtgacgtacgtattaactgcgatgcgatccatcttttctcgttctgtggcatattttattgcgatacccgtaatggtgtgtagaatattggtgtattttagctgcaagaacagctcattcttcctcatcttctgcgctttttacttggaggggaattataaccgtattctgatgggtgccaattcattcgcgaatggaggaggtcgagggggaggatgaaggagaagggagaaggtagtgaaattattcaagctggtagaccccagcagtttggtttgccgcagcaccagtccgactcgatgcttcctcaatttctcgcttctctgactaaagaatctcctcatttccagacttcgcaaacatatgagaatgagtcccagcagtccagggatcaaaccccgctccaaccgaccaccgcagacaccaagccgaaggacattggtgaattttcgtcggatttaccccacctggtagcctcgcctatttccagcaggccgcctgcggtgactggaaccgatgtcgtttttaaacaggcgatacacggccccgacgagaacaacaacaacaataacgcggcggaccttggagacgatgacgcttttggcggatccggagggagccgatggccgaggcaagaaaccctcgcccttctcaaaattcgatcagaaatggacgccgctttccgcgatgcatccctcaaggctcctctctgggacgaagtttcaaggaagctcgcggagttagggtttcatagaagtgcaaaaaaatgcaaagaaaaattcgaaaatgtgaacaagtattacaagaggactaaggcgggaaggtccggccgacaagacgggaaaacctataagttcttcaaccagctggaggccttatatggcaacaccgacgacaccgccattgtggacaacaatacaagcagaatcaacaatatcatggccgcttctgtatccagtcgcgagtttcaggctacgcccagtcctcctcctcctcctgctgctgttactacgaatagatcagaagagacgcaagtcccggaagagaagaaacctcctgctcctacagatttgagtccgatgagtttttcgactgagtcatcggatgagacgcatgatgataataatatttcagagactcggagcagcagaaaaaggaagcggattaccaccaagaaaatgatgagatttgtcgagaaactgatggaaagagtcatggagaagcaagaaatgatgcagcagagatttcttgaaatgatcgataagcgcgagcaggataggatgatccgtgaagaagcttggaggcggcaagaaaatgtcaggttgagtagagaaagcgaactgaggtcgcaggaacgagctctcaccgcatcaagagatagagcactaattgcctttctccaaaaagttacaggtcagacactgcatcttcctgatcagtttcctgttaattcgcagcctctctccccagcgctgcctcagcaaattcatccgcggcccgaggagataaataaagataataatgatactgacagcttggatccaaacagcaagcggtggcctaagcaggaagttcatggactaatcaaactgaggagcgcactggaacctaagtttcacgattctggacctaaagctcagctgtgggaccaaatttcggcagaaatggcagctatgggatatcatcgcagcgccaaaagatgcaaggaaaagtgggaaaatatcaataagtatttcagaaaggccaaagaaagtaacagagaacgccccgggaataacaatacttgtccatatttccaccaattggacgcgctctacacgaaggggattctcagatattctaattcagaaaagttcaacaggactcgagaccaggaccagcagcaagaggagcttcttgagcaaaccacctgcggaagtagcagagacgatcagagtccgggccacgacggtgacaatgaaatcctggccatcatgccgccaccatccatcactaccgctccgcctgcatctaatttcttctctacagatcaaccagacggtcacgtcaatggcagccaagctccggctccaatgaaggtaatgttttcttcggtttcggaaggattattaggaaatagccctcccaagccagatgcaacgacaatcatgatgtttcaaaacagctcgcaatcagctccaccgctctccacaaccataacagttgaagatgataagaacaagcacgagaaacaggcagatctggatttaccttatggtgtctttaatgacaggacggttaactccgcctccaatgtatccagagattcctcttcgacattcatggcaatggtcgtggatccgccacagttcaacattcctggatcatcccacgccgactaaatctatttaaatgatttgtcgatgaatgaaatgtttgtattgaggttttcctgtaaaaaaaaaa

SEQ ID NO: 805 - DNA, 2444 bp, Pinus radiata
aagcagtgagtgtgagggcgagatcgagatctggggttggagtcccgtggaagatgcacagagtggcagacgggcgtttggagcagtcaagaagtattcaatcgggtaggaatctttcgctttcgttgtgtgcaacttgaattgtgatcgtgaacaaattttgaggcgataatgctaggagggaagacagtttgaaaatcgctagggtttgcgagtggcatccatcaattgaccgtccaaaccctatatgttttctgttccttgtcctccattgaccgggagacgtccctgtttcctatttctaatgctccatggctgattcctccatcattgtttatattctttagacttgtctcgttttgtcgaaagcacgttcagatcagtcgatttgaaggtttagttgccaaaacttattatgaggcgacggcacatggcaggcacaccaattacagtggaggtattagggttttgagggtgtcgagggttgaagatggctttgaagtacataattcaggaaatgagggatgggatggagagtatttccaggaggagctttgaaattaagctttacagaggccgatctcagagtagtgttagggatgagatggtacaaagggaggcagagacagagaaggacgaagagcaacagcatgttaattggtccaacatgcttcccgagttactgactgaaatgattcagagagtggaagagagcgagggagcgtggccaggtcgcaaaaatgtcgtatcctgcgcctctgtttgtaaaagttggagggatattaccaaggagattgttaaagcacctgatctgagtgggaagctgacttttccctcttctctgaagcagcctggtgcacgtgaccctccgatgcagtgtttcattaaaaggcgcaaagaaacatccacatattacttgtatctcgggcttacaccaacgtttatggaaaatgggaaatttctattggctgcaaggaggttcaggcatccaactagtactgaatacataatctctcttgatgctgatgatctgtcccaaggaagcaatgcttatgtaggaaaactgagctctgatttcctgggcactaaatttactatctatgatagtcaaccaccacataatggcgcacgactctcaagcaatcgagctggtcggcgggtagcatcaaaacaagtctctcctcgagttccagctggaagttataatgttggacaggtagcttacaagtttaatcttttgggctcaaggggtcctagacggatgcaatgcctacttcattctgtacaattctcaaccatggaacacataggaaaagtttcgacttgtaaagaagtctcagattccacaattgataaatcaatatccacattgaatggagaaggatctagtaaattttcagaatcttctgacattcctgttggaaaatgtgcacctataattttgaagaacaaggctccaagatggcatgaacaactgcagtgttggtgtttgaattttcatgggcgtgtaactgtggcttctgtaaagaatttccagttagttgctgccatagaccctagtcggccaggagcacaagttgatcaagatgcagttcttctccagtttggtaaggttgggaaggacatgtttacgatggactatagatatcctctgtcagccttccaggcatttgcaatatgcttgaccagctttggtactaaacttgcttgtgaatgagaccatatttgtgatgtagcttctcaagaaagaaaaacataattgacaaaaatgatttggggttgcttatgaagatggttgtcatctgatgtgttaatgaagggtttaagcaagattattcactagaagcttgctatagggatattatgacccacgttttttactcagagatctcagttaacagaggaagtgttgtgtatttgtcctagtataaactgtattattatcaaattgtgatctagtgggcccagttgaggttaatttcctggagacctcatttgcatcatacagcagatttccaagttcctagcaaagctgaatttgctactgttttgaaaaactatttagctgatgattgggattgaagttgtttatgctttaagcttgtactggtcatctggaagattggttcctcattcatttggtagctgcaggagaagaaaaactataggatatacactccttggtagaaaaaaattgtgtagcttctggtttaaaccagctacaaaccagcaattcccaaagttgcatgctcaaaactgtggccatatcaactcccttatataccttattaacacagtccagcatgataatgagttgttgtagttgtgttggtgaatgaattgccaaagaggtttggagcatctatctttgctgaagatatcttccaatgttcagtgttgtacttatttaatgaatccctattgtttctcttggaaaaaaaaaa

SEQ ID NO: 806 - DNA, 1501 bp, Pinus radiata
atttgatacttggaatacgactttgcattttaatttctagatgagatgtctttcaaaagcattgtccgtgacatgagaaatgggattggtagcctttctaggagaagttttgaagtgaatttgtcacatattcacaggacaaaatcccaaagtgcagtttatgaagagcagattcatgcttctcctgtccagcagagttgctgggccaaccttcctccagaactattgcacgatgtgattcaaaggttagaggctagtgaagaaacttggccagctcgcaaacatgttgttgcttgtgctgccgtttgcaggtcttggagggatataagtaaagagattgtccaaactccagagaagtgtggaaaactcacatttccaatatcacttaaacagcccgggccacgagaagtacccatacaatgctttattagacgggatagagcaaaatctacataccatttgtacatgggtttaacccctgccatgcctgctgaaaatggcaaatttctccttgctgccaagaaaatcagacgtactacaggcacggagtacataatttctctggatgcagatgaaatttctcgaacaagtagtacctatgtaggcaaattaaggtcaaacttcttgggtaccaagtttgaaatatatgacagtcaacccccatacagtggtgcaacaccaacatctggtcgaaccagtagaaggttttactctaaaaaagtctctccaagagtcccttctggtaattataacatagctcacattgcatatgaacttaacgtatttggtacaaggggaccaagacgaatgcgatgcacaattcactccattccagcctcggctattgaggatgggggaagtgcaccaaccccttcagaattaacccgttcattagagcgctctttttcctcatctttttcaaatgctatggagaaaattgtggagttcagtagctccagcttaacagaagttcctgtgggtagtcagagtaaaggtggcccccttattttgagaaataaatccccaagatggcatgaacaattgcagtgttggtgccttaatttcagagggcgtgttacagtggcatctgtgaaaaactttcaacttgttgcgaataaagaaccttctccaccagtgacacagagtgatcctgacaaggtcatacttcagtttgggaagattggaaaagatattttcaccatggattattgctacccactctctgtatttcaagctttcgccatatgccttagcagctttgatgcaaaattggcctgtgaatgatgcacagtaaaatttgggtgcttcgtaaaagaaattgtaacacatcccttgcttaggatttttgaggtgcaggttgctggaatgttttaaaatgcaacacattccttgggtaggatgtctggataagacattgggagttttaagcatgataaaactttcagctctaagctttgagatgatcaaagccttaattgtgttaaaaaaaaaaaaaaaaaaa

SEQ ID NO: 807 - DNA, 2181 bp, Pinus radiata
cgcagacacgcctgagcggttgaacaggatttggagacagtatggttgattttgggatttgggtgatggctttatagcgccaggttgttccaaaacaaggttcttcgcagaccttacaagggtccgtgacttgcgacattgaaagcgcagttttctttgctgtatttttgacatgcagtacagagcccagaactctgtgaactgatctgttttgattctggtttggaggggaatttaggtttttagggtttgaatgccaattctggtgttcttaaagaattgattgctagtagaaatgtctttcagaagtattctccaggatgtgagagatggtatcggaagtatttccaggaggagtttggatgtgaagttttcgtatagtttgagatctcggtcgcatagtgctgtgcatgacagccattacaggagtcaggtttcgctgccgcagagctgttgggcaaatatgccgcccgagctgctcagagatgttatttcgagaatcgaggcaagcgagggtgcttggcctgcgcggaaatacgtggttgcctgttctggggtttgcagaagttggagggcaataacaaaggagattgtccagacaccccaactctctgggaagctcactttcccaatttctcttaggcagcctgggccaagagacttccttattcagtgtttcattaagcgggacagagccacatctagctatcatttatacttgggtttaactgcaacactttctgagaatggaaaatttcttcttgctgctcggaaatcaaggaggcccacatgcacagattatattgtttcccttgatgctgaagacatgtcaagaggaagcaacagatacattggaaagctgagatcaaattttctagggacaaagttcacaatatatgatagccagccaccttgcactggtgcaatagcatcaacaagtcgtggaagtcgacgggtgggctcaaaacaagtttcacctagggtcccagcagggagctatgttgttgcccacattgcatacgaattgaatgttttgggaacaaggggcccaagacgcatgcaatgcctgatggatgctgtgccggcttcagccatggaagcaggagggagtgctcctactccaaccgaatgcccattgagtagtttagattcgttggcaaccctcccccatcttggcttaaaatcagaggttattgagaccagctttttctctggacccatcatcaatagcaactggaaggagggtccattgctcttgaaaaataaagctccaaggtggcatgaacagctacaatgctggtgtttgaatttcaaagggcgtgtgacagttccttctgttaaaaattttcaacttgttgcagctactgagcccactcaacctgcagctcaaagtgaccatgacaaggttatactccaatttggaaaagttggaaaggacacgtttaccatggattatcgttatccactctcagcttttcaggcgtttgccatatgtcttagtagttttgatacaaagctggcctgtgaatagtgagggtccaaagccatgggcattcattccaactccagcaagtgagaaatcgtaaatcacttgctgccgccactccgcttggtaattgcttgtggactgtattttttatacacatccacttagcttttctcatttccttgtgttcacaatgccccagtggttgcaaggtttgttactgttaaatgatgttttcagtagagggtgcgccaacaattagttgcaggcaattattagaaatgatgtgtaagggtgctgttagtccaattgatctcaagctatttgttgtatattacttggatgtacataaagttttcagggaggcacgtgagattctaatgcagcagaggcaagtttcatttgtcatactgatgtttggatgatcattggaattgcattcacaagttagagattcagagaacactaatgtacgaagaactgtttaggctaagtttttgttttaattggctttagtgataatcagttgtgaaagcacatctgcagctttgagacggtttcacaactaattatcaatcgaacgcttgaatggaaaagacgagacaatggagtgtgtaattctgtatgggagtttcccattcctctgcgacttattgatttcatattgtatttgctcatcaagccgtgtgatctgt

SEQ ID NO: 808 - DNA, 1887 bp, Pinus radiata
gttagaagtggacggtaatcgtttctatcttcacttaataatcgtggccctattccttcttatctcttgagtggttcccccaccccaccattcggcggatttcgacaaaaccacctgttacgcggtttcgccagaggtgtttctacctgttctgctgcgcaagggttggagagcaggcatgcattctttcattcacaatggattacggtcttgatgacgaaacacagggcacttggaagccttaaatgcttgagatccaggcgaaaatggcctccggcaaccccaaaccagcggaattaccgaccttttgagcctgcctaccctcgaatcggtcgattccgtgctgtatcggtacattaacaccctgccagcgcggagattcatctcgcgcattgaagctttaatctcgtggccctttttgcaaattatgctgtttctgaaattacggggaacggaagcttaattttgaaggctttgaagcgtccagattgttcttgatgcctccgatcaagaatattatccaggacatgaagggcggcatcggaagtatttccaagaggagcttcgatgtgaagctctcctacaaccgcagatcgcggtcacactcgcacggcgtcgcggtgacctctggtgatgagaatcactgcaaaacagccgccgatgttttgcatgagagctgctgggcgaatttgccctatgagctgctcagagatattattgagagaattgagagcagcgagatcacctggcctgcacggaggaacgttgtggtttgtgctggcgtgtgcagaacgtggagggaaattatcaaggagattgtgaaaccgccgctgctgtccggagtgctcacatttcctgtgtccttgaagcagcctggaccgaaagattctgctgtgcaatgttttatcaagcaagataggactgcatctgcttattatttgtacttgggtttggcttcaacgatttgtgaaaatgggaaatttcttctcgctgctcgaaaattcagaaaggctacaagcactgattatatcatctcgtttgatggagaggatatgtcaaggggaagcaatacctacgtaggaaagctgagatcaaattttcttggaaccaagttcacaatatatgatagtcaaccttctcatagtggtggtgtagctacaagtcatgcagggcgacgggttggttcaaagcaagtttctccaagagttccagctagtagctataatgttgctcacattgcctatgaattgaatgttttgggtacaaggggtccaagacgaatgcaatgtaccatgcattctataccagcgtcagtcgtagaaggaggattgaacacttcaacttttgaaattccatcaagtactctagtggagcctctagcatctttccgttcctctcggtccaagtcagtcattagtgaaagtaatgctttttctgggcctctcaatagtgggaacttgaaagatgatccattgatcttgaagaacaaagccccaaggtggcatgagcagcttcaatgctggtgtttgaattttcaaggacgggtgacagttgcatctgtaaagaactttcaacttgttgcagctactgagcctgcacaatctgtctctcagagtgatcaggttaaggttatactccagtttggaaaggttggaaaggattttttcactatggattatcgatatcccctgtcagcttttcaggcatttgccatctgtcttagcagtttcgacactaagttggcttgtgaatagatggactatgatgctgaggtttgagcgtatgtggtgaccaatatgcctagaaagaattaaagggtctcaaatgcttagtagtgcatactggtttgttttataataatcctattgcattaaaaaaaaaaaaaaa

SEQ ID NO: 809 - DNA, 1923 bp, Pinus radiata
ctcaaacgtgattttctgatttgcgggttttttcgacaccactggtggttttctaactggcagttttttttggaaaccacgattgacacagatcgtctacctaatggctttaacggcggaaaacgaggtttttgtaagctctgccatggcgattccagtacctcaaaatggatggaatctgtacagaaatagcctctagcgacggcagagtcgtcagagattcctctattgggtatcctaaaatctcgaaatccagccgctttgttaagaattcggccatgaacggccgcctgtagcgcagaaccagggtttcaacgaggccggcagtgctatttttgttatttttattatttctaacatcattactatgaccgtgaaaaacatttttcaggacatgaaaggcagtatcgggagcatctccaggcggagctttgaagtaaagttccttagatctcgttcacagagtgctgtggacgatttacattatagaagcaatgcgaataataagaataatagtaataatggaggcttgcagtgcagtttgtgggcgaatatgccccctgagttgataagagatgttattcagagaattgaggagagcgagagcagttggcctttcaggaagagtgtggtggcatgtgctggggtttgtatgacatggaggcaaattacaaaggagcttgttccgatacctgagctatctgggaagcttaccttccccatttctttgaagcagcctggatcaagggagccctctgtacagtgtttcatcaagcgagatagggctacatctacctatcaattgtttctctgtctgaatacaacactttctgaaaatggaaaatttcttcttgcggctcggaaattcaggcgggctacaagtacagagtatattatttctcttaatgcagacgatatgtcaaggggtagcaatacatatgttggaaaattgaggtcaaactttcttggtactaagtttacaatatatgatagccaacctcctcacagtggggcaattgcatcaacaagccgtgcaggtcgacgggtaggagcaaaacaagtttctccaagagttccagctggtagctataatattgctcacattggctatgaattgaatgtcttgggaactaggggtccaagacggatgcaatgcatcatgcattctattccagcttctgctgtgcagccaggaggcagtgccccaactcctgttgaaccttcggtcgctagtctagaccagtctcttgcatcttgtcctacttttggctccaagtcgtgcattttagaaagttcatctatctctgagccacttaccggtagcaacttgaaagatgaaccattggttttaaaaaataaagcgccaaggtggcatgagcagcttcaatgttggtgtttgaatttcaaggggcgtgtgactgtggcttctgttaagaattttcagcttgttgcagcacctgagcctaatccatcggtttctcagaatgattgtgataaggtcatactccaatttggaaaggttggaaaggacatgttcacaatggattatcgctacccgctctcagcttttcaagcttttgccatatgccttagtagttttgacacaaaacttgcttgtgaataggggaagatcagtcagtttgttgacaaataggctcaggttgatgcaatatagttacttaaaagtctgaaggttggctcgtattttgtataatcatcagtgtttcatggtgtttagctactagttaccacaatttataacgctcatgagcttggtgatttagaaataaggtaggcaggcttctgctacccctagttgatgcctttatgctaccagtagcaactgaaggtagcatatactgttgatgtatgaggagccaccactaagtttcatgtggaggtgtttggcatattctgcattat

SEQ ID NO: 810 - DNA, 1020 bp, Pinus radiata
gcttagtggcagggagggttttcaattctaagccagctttacagatatggataactggggaagcaatggtgacaatgttgagaacagtcagtgtggtgataaaggcttggattccttcaattccttgctttggtataatcctttggctgctaatgctttgagtgcattgaaccagcagttgaatgtcccagtagagggtcaggctcagggtcagggtcagaaagaagcatggacccaatttgttgtggaagataaggcagagatgaaaacagaatggattgccaacagtccagtggcacaatctattcggagtcaagaggatcagcagtctgagatctgtaatgtggaagaacatgtttcagagatttcggataacaaggcatctgtggaaggagatattgtagatagcaagatcatcaaaaagaggaagataaagactgaaaaggggcctagatatgccttcaaaactagatcagaaactgatgttttggaggatggctacaaatggcgcaagtatgggagaaagattgttaaaagtagccctcatcccagaagctattacagatgctcggaaagcaattgcagcgtgaagaagagggtggaacgtgacccaactgatcagggactgctcataactacatatgagggcacacacaaccatgaaagcccctcagtaatctactacattggaaaacccataattttaccgcagcaaggttcgaagcctgccatagtccttgtcaacgccagcttatgtcctgaaccagtcatcaagtatgcatcccaccaagctttgtaaatatggccattcaatctgcaagccacccctctaatcttggcttcttgcaacccacaactcgaatgaatggtccactgaactatattgttaccaaataccagcgtgatgtttatcattatggaaactcatgtttttaaggctctatacgtttacacaaattttctgtgaaaagggcacttgtgctttcttcataatatatatatatacttgtaaaaaaaaaa

SEQ ID NO: 811 - DNA, 1650 bp, Pinus radiata
aagcacttgaacaagaaaatcaagaaaaatcaagaagccgactgatctcgattgcaatctttccctcatattgatcaccaatcttcatcatttcccagctcgatctcaatctgtactcatccccgtcacgaaattttcattttgtcagccatttctgtagatctctgtcaccacttatcactttacagtcaggcaaacatctcctcatagatcctgcaagtacccaataaaccctctccccttctctgctctgttcttcccagaatctgaggtccagggttcgattcacaacaggaccaaatgcacacgtcgttcaaaagggcatgatctcgttgttgcagcgctgatctttctcaacatcttgaacctttagtggccctaacagcaaatatgccggagagttatggtcagataaatccttttgtttcagctgagtgtatgcaaggatatttcctaactaggcctcagcatgagctagttcattcaatgaattcatttcaggagacttttcatgaaagaaatggcgtacaagagggtgggctgcagccatctaattttgcttctcagagtgataattctgattattgttttctccggccaggccatctcaagctttctggagagtattctgctttctcaaatagggtttctcaagatcaggccctgctaatcaattcaacagaatttaatgacactcaacgtggtatgatctcatcacctcttggccatgctggtgatcaggttaactttagctgcacagatacaatatcccacatggagtacagaaataatctgccagagataagtctcttgagatcaacagatgatcaaagctttgaatcaagcgtcccagataacgcaaaaagaacagagggcctaaaaaatttgagtaacctatggtggggatcgtcgtctagttgtgatgtgaagatgaagaaggtgaaagtgagaagaaagctgagggagccaaggttctgtttccagaccatgagcgatgtagatgtactggacgatggttacaaatggagaaagtatggccagaaagttgtcaagaacacccatcatcccagaagttactaccgctgcacacagaataattgtcgtgtaaaaaagcgagtcgagcgtttagctgatgatccccggatggttatcacgacatatgaaggcagacacacgcactcgccatgcagtgacacacagtccgaacaacacgattttctaagctcactctaagaagttgatagctgggagaaggatttaataagagtcgaatatatcttccagctcatatacccatgagctctcaaaatggttttacatcgatcatttaattcatctgtcaatagaagctaggaaacaaattcaggacaaggaataaaaataataattattctgtttttaagtagcatttctttttttcaagctttctatacaccgtaattcatatacgtccttcagtggcacttgtaaaccaaacagaagatttgtttctgctgggttggcaaataaagaattatgagaatgaagataagtgtaattgcgcatgtaaacaatataaaaatattagttatttcgtagttttacaatatgagaggcgataagtgtattactacaaatgaattcagggtttaattttcagcaaaaaaaaaa

SEQ ID NO: 812 - DNA, 1147 bp, Pinus radiata
agacgacgtaggggccgaacccattcggctctacatctaattcgcaggcaggttgtaaacattggagatgatatgaaatggaaggtaacatgaataagatggcaaaacttgtggccgacataaatcacttgaaggagaaaaaccagaggctcaactctaagttgaaacgcatgatcagtaaatataatgacctgcggaagcatatcgggcttctcatgcaacagaggagagggatcgatggaagccaggtctgcaatccagatcatcgaatcaaagaccaagtgtgcgcaaagtacttcaccggatctgatcattgttgggaacaaggtgaagaaaaagagaagaagaaggccaaatttatggaagatcagcagctgcattcaaagaagacgaagattgatgataacccttgctgtgatgacaagttaacgaagaaccagaatcaggtgctgagcaggagctccggcgaagaggcagtggccgcaccaaaaagaatcgtatctgtgcagacaacatctgtgacatctctggtaagcgatggctgccattggcgaaaatatgggcaaaagatgacaagaaacagtacactcccgagatcttattacaaatgtgctatggtgcctggttgcccagttaaaaaacaggttcagaggtgcgccgaagaccccacgattgtaataacaacctacaaaggcgaacacactcattctctgagtcctctggctattgctgtcatacatgcctcgaccaaccaacccacgacttgcacctcgtctcccactatcactctcgacctcgcagataaccaactgaatccagcattctacttgcaccctgcacatttaacagctggcagcttccagcaattgactccattgtctagcgatatgggtcagatactggataatcagagtcaagtgggtcaatcagcaatcatggaatctgtggcttctatgaaggcagatcccaatttcactaaagcgctggctgtagccatagctggttctattctcaaattgggttctccaatcgaggggatgcctcaacatcctcctccaacgcattacactaatgattcaacaactagcgttaacactagtgtagagtaaccctttccaaagtagttattttcactacaaaaaaaaaa

SEQ ID NO: 813 - DNA, 1689 bp, Pinus radiata
ctggcatcctgagtttttctttcctttcctatcctcttttctgtatttgtcctttcctgagacatggggatttgagtttgctagtgaacccagatgcctttttatcctttttcttcttttgtttgaaagaggacatgggcaagatttaaatctatcattaactttcatggattgtcagatttatctctaatgatgatttagacaattatgttaatggagaattcagacaaattcctctcctccaccttggaggtcaatctttcaattcaggaggctgttagaagtggcctgcaaagtgcttatcaagtgctcaatatcttagcaaaacagaatcaacaatgcccctttgaaaaaattcaagaagatttcagttgggcggcagaggaagccttgtcaaagtttagaaaggccgtctccctattgggcaggacagatcatataaggatcaggaagagtcctgtccttcctgtatcaggcaatggagagccatttattgacgcctttaatgttattccaccacttaattcaaatcccgttgcccatcacgtctcttccgcattgctcgatgtgccttctcatgcgccttctgatttgcccattttacagaaagtaagacagttgttttttcccaccaatgggaacaatcctcagttagctggtcatcaagctcaaaataatttttctgaagtagatataatgctaaaaaataatttcaggatattcgagaattcaatcaattgcacagggaatcttcctcagtcttgtacaaaatcatttgtttcgtctgtaagcatagagagcagtgtgggtgatgatagacatatgacactgcaatatccccttgctgtctctaatgaagtaaccccttctttatattttaagaggaagtgttctggaaaaggcgacgagcctggtggaaaatgttctagtagcggaggctgccgctgctccaaacgaaggaagttaagaataaagcgaacaataaaagtgccagccattagcagtaaattggcagatatccctcccgatgattattcgtggaggaagtatggacaaaagccaatcaagggctccccacatccaaggggctattataagtgcagcagcatgagaggttgtcctgcccggaaacatgtggagcggtgtccagatgaaccttccatgcttattgtgacttatgaaggagagcacaaccactcaaggatactacctggtggtccaaatctggtattgcatacttaggtcctcctacagttttccagttattgatagtagatactgctacaaggcaaaaaagtgatcactcacacatatgattttccttaatcagctagcataaaagtttgctatccttgaggagatatgatcccttggtagtttgctaaattggatgttgaagacactaatcttggatgtatatttacaggctaaaggagatatattatttaatgtatttattctagtttcacattcatgtattttatctagaagaatttaccaagtgctttatcagcttagaaggtatttcaatttaaggttcatggctatgcccactgctatgctcagcatagctttgtctgttcatgctgtgtctgataactgcaagtgcacaacctgtaattagaattgagcaaggaataatatgaagttgtatatgcatcttgaagatatttttgtttaaaaaaaaaa

SEQ ID NO: 814 - DNA, 1823 bp, Pinus radiata
cggcaaggaagacaccgaccggccgtagggcggagagcgaccgggctagccggtacggattccagtcaaatcgtctgactttacttcaaccggcaattctgtcgctactgtcgtgacgtgtacgaagtcgattggtgggacctttgacttggtaaagttggaatcctcgggttctgagattttgactcgggggtttgaagttgcagtaaattggggaatttgctctggctgcaagaagaagataaggcacgggcacccgttagtggtggctgctttatgcggagggatgaattccgggggcttcgccgagaattgcaggggattttggccggagagttgctgaagattcatgaagttctggatggcgtttattgaaatgtccatgcccgattctgtctgttgggtttggggttagaaagattttttaaaaatgggtctccttgagtgaaaagatatggccgtagagatgctggactccaggaatttcatggaccgcgacgtgcaccaggcggcttctgcaacgctggagagcgtgcagaatctgatacaattaatatcccggcaccgggaaatgcaagatgaaagagaaagccagtgcgggtctgctgcagaaatggccgcaaatcgatttaaaagggttgtttccatgctcggaaccacgacaggccatgctcgcttcagaaaagctccagcgggaacttcagttccggctcccaaaatttccccctctttcgaacacggccatgcgaatatgtctgctgctgctgctgttgcatcttgttcttctcaagaacccttgaaggattctgaaggttttatctcccctgcgccattgaataacaacaccctgttccgtcccaccccgttgcacgtccaggcccctgcacagaaccctgttatggactcaagccctcagcagcccaagatttcattagtgccagtaaattcagattacagcttcatgggttccaggtcctttaaagagtcagtgatctcttcccccccattatcctccactaactccttcatttcaacactcacagcatcggatccgtgcgataaaacttctatactggttcgatctctcagcccaacagccgtaggccgaccgccattatcgtcctctaagaaagcttgcatccatggaaaacctgacgatctctcaggaaagtgtaacactacaggcggacgctgccactgctcttcaaaacgcaagaagtccagagtgaaaagaactatcagagtacctgcagtcagtgcaaaattggcggacattccatctgatgaattctcatggcgaaaatatggacagaagcccattaagggctctccacatccaagaggctattacaaatgcagcacagtgagaggttgccctgcaagaaagcacgtagaacgcgccctggacgatccaaacgtattgattgtaacatatgagggcgaacacagccattctcattctggatctgaaaacacaggcctggtactggattcgtgagacccacatacagacaaagacattattctagttttatattacgctacagaatccgccattattacagcgggatggtgactgtttttagcgcaatctccatgggcgttgcatccccactacagtgttttttgcaatttggtacgagacaagattaatgcaaaatccatggaaaacacgaagggcccttctacgtaacaaaccatcctaattttgtagattcgccgaatatatcaatttattttctctctgctactacatcatgtgctgtacattttctgtgaaaattctatataattttatcacagttcatggtttaaaaaaaaaa

SEQ ID NO: 815 - DNA, 1556 bp, Pinus radiata
gagttgcagtaaattggcgaatttgctctggctgcaagaagataaggcacgggcacccgttagtggtggctgctttatgcggagagatgaattccgggggcttcgccgagaattgcaggggattttggccggagagttgctgaagattcaagaagttctggatttgagtgaaaagatatggccgtagagatgctggactccaggaatttcatggaccgcgacgtgcaccaggcggcttctgcaacgctggagagcgtgcagaatctgatacaattaatatcccggcaccgggaaatgcaagatgaaagagaaagccagtgcgggtctgctgcagaaatggccgcaaatcgatttaaaagggttgtttccatgctcggaaccacgacaggccatgctcgcttcagaaaagctccagcgggaacttcagttccggctcccaaaatttccccctctttcgaacacggccatgcgaatatgtctgctgctgctgctgttgcatcttgttcttctcaagaacccttgaaggattctgaaggttttatctcccctgcgccattgaataacaacaccctgttccgtcccaccccgttgcacgtccaggcccctgcacagaaccctgttatggactcaagccctcagcagcccaagatttcattagtgccagtaaattcagattacagcttcatgggttccaggtcctttaaagagtcagtgatctcttcccccccattatcctccactaactccttcatttcaacactcacagcatcggatccgtgcgataaaacttctatactggttcgatctctcagcccaacagccgtaggccgaccgccattatcgtcctctaagaaagcttgcatccatggaaaacctgacgatctctcaggaaagtgtaacactacaggcggacgctgccactgctcttcaaaacgcaagaagtccagagtgaaaagaactatcagagtacctgcagtcagtgcaaaattggcggacattccatctgatgaattctcatggcgaaaatatggacagaagcccattaagggctctccacatccaagaggctattacaaatgcagcacagtgagaggttgccctgcaagaaagcacgtagaacgcgccctggacgatccaaacgtattgattgtaacatatgagggcgaacacagccattctcattctggatctgaaaacacaggcctggtactggattcgtgagacccacatacagacaaagacattattctagttttatattacgctacagaatccgccattattacagcgggatggtgactgtttttagcgcaatctccatgggcgttgcatccccactacagtgttttttgcaatttggtacgagacaagattaatgcaaaatccatggaaaacacgaagggcccttctacgtaacaaaccatcctaattttgtagattcgccgaatatatcaatttattttctctctgctactacatcatgtgctgtacattttctgtgaaaattctatataattttatcacagttcatgggttactaaaaaaaaaaaaaaaaa

SEQ ID NO: 816 - DNA, 1712 bp, Pinus radiata
tgaagattggcgaggttaagagtattctttcatgtgtgtgaggacgtttctttgcatagcagagggattttcatggagatgaccagagtaaatttgattgttgttttgcagatatctttcatatgaatcgctaacagtagcttctcctgaccgcatttttatggcaagcaagttatatatgaagcagaggataatggacccagtaaacatttccctttcccttaatatccagagggattgcgatgtgcaaataatgagtagagcaggtttagacagtgcgcagcgcatggtgagcattctatcacagaaacatcagcagaatcaacaagaacaggtccagcaagaattcgttttggctgcagaagatgctttatccaagttaaacaaggtggtatcgctcttgagcagaaaaggccatgcgcgggttagaaggggtcctcttcaaactcaatctgcttcaggatctggctctgaacaactatttatggatggcccaaacttcttggatttggaatcccctaaaactcacgcctctgcttctatttactcatcttcttcatcagattttgctctttcacaatgtgtcaagcagtttttaccttgtcagagctcgtcctcaggcgtcctaagcgcggacactaaccggcatcagcagttacatccgcagatgcactatccaccactgcagcttcaacatcttagtccacaagcggaagtcatgtttagaaatggttacatgcaattagacaactcgatgagctgcacagcaacaatttcttcaacaaagtcatttatgtcatctttaagcatggatggtagtattgctaatgacaagcaactgttgcagtaccagtcaatttctgcagcccaggaacggatccctggtgcctcctctaagaggaaatgttccggtaaaggtgatgacagcagtaaatgtggaagtactggaaggtgccactgctccaaacggaggaagctacgagtgaagcgtactattagagtgcctgctattagtagcaaattagcggacattccaccagatgaattttcctggaggaaatatggtcaaaaaccaatcaagggctctccacatcccaggggttattacaagtgcagcagtatgagaggctgccctgccaggaaacacgtggagcgttccttggaagatccttctatgttgattgtgacatatgaaggcgaacataaccattcacgcttgctatcatcgaattcaagtctgatagttcacccatagcttcccatgcagtattttgctattttggctgcataggttactcctgcaacaataacgtgaaggtggcaaatttctaatgtggatgttaaatccaatgtgggcagtacaaagtgcaatccttgaggcaaaattaacactgcaattctttgaaggaacttgcccatgggttaggaagtgattttcacaattttgatccacacattcactgttcatatttgatttgttaggacaaaggtacagtcaagacgtacaggatagcaaaagctttgtcagatacagactgcagtataatgtattgatgagttctgtaccttaaatgcaaggccttcgctgccacaagactttctgtccaaggtcctattgaatattggccgtctgaacccacatatttgtggttgtaaattaaagcagagtaaaaatgataaacttcctcttccttgcttttttaaaaaaaaaa

SEQ ID NO: 817 - DNA, 1508 bp, Pinus radiata
atgggttcaagaattggctcaggattgatgagtacagatgtggatgactttgcggggtttgagtctccttacatgagctttactcagtgtcttcaagcaggattgcagatgggtgaagcagattattctgccttatctaaatctttggcatgtggagaattaggggaccatgagcagcagcagcagcagcctgagtttcctgaatatgatcaagaaatcaaagttcaggccaattgcaagtcccaaaaccctagtgccatccaacttggtccatctatggcagaagcccaagtaggaagtcgatcaggggacatgtcaacggttccaggcacaccaaattcatcaatatcttcttcatccagcgaggggcacgaattagaacagtcgagcctcgttgcaccctcctcagtcaccacaaacagcactgcagcgaaaggacaagggcctgctgatactgagtctcaaccagacctaactgctgccgagaagccttcaatggagcccaagaaaccgccaagaaagaaaggtcagaaacgaaacagggagcccagatttgcattcatgaccaaaagtgatgtggatcatttggaagatggctatagatggcgcaaatatggccaaaaggctgtcaaaaacagccctttccccaggagttactatcgttgcacaaatggaaaatgctcagtgaagaagagagtggagcgttcgtcagaagatccaggaattgtgattacgacatatgaaggacagcattctcatccaagcccggccatattgcgtgggtcagcagaatcccaatcccacttttcagatcaaagattgaattctcccttcactcaaacgccattgatcagattccctccccacccaatgatgatgagtagtactaaccaggtcccagctgcttccccttcctctactaataattttcaccaccttgggtccatcaagtcctgcatgaaccctcatcttctgcctcagtcccaccatggtaattcccagcctcacccaactcatctaatgcccaccaatctttcccagcagccacttattgatcaaggtttactagaggatatcgtcccacctggtatgcgcaaattttgactcaacttatactactagaggtgcccttcaaatcagagaacagtttggagatcatggttattcattactatatagcaacaagaacaaggaaaaatatatatatatatctatatatatgggcgagagcaaggaaagaacgcgtgatgagctttttattgcttatgggacttcatggcttttttttttgtagatatggtaaactgtaaaaggggatcgaatcgaatccatttgaggtttgattgatattcattctttacatattactgttagaaattctcacaggtgaactgaggctgcaattgggcttatagatgcaactttatacttgtgttcccaatttcctccatcgttgtaagaattttatgtcatatctgcagcacacccaattatgttgaaaaaaaaaa

SEQ ID NO: 818 - DNA, 1909 bp, Pinus radiata
ggcagctgttgaggcctctgcacatatagccatctgggtttcttcttccgtcggagagcatttacagagcatctcgcggctcccggatccgtgcaggtttgaaacgggagggactcgaggcttttctgtttttcgtatttcagtttttcccatccatggcggtagagatgctggactacaggggaagttttcggaaggaagaagacctgaaggaggccgcctcggcgggcctcgagagcatggaccgcctcatcaggctcctggctcagcagcagcagcagaaagaaagttatagcagcaatcctcctgatgctatggatgtggattgctgcgccattgccgatgtagcagtgaacaagctcaaaaaagtggtgtccttgctgagcaggacgggtcacgcacggttcaggagaggtgccggcgtcgattctcgcagaccctcttcagtttccttgcagaatttcagcgacccacatgaaagaagcttcagtaacaacaacagtcctgataacaatgctgaaaatgctaatgctaacggtaccaatagcgctgctctgttatgtcccatggcacaacagccacttttgccccggcctcaagcccaatctcaatccctatcccaatcccaaacccaaactcagtcccactctccccatcctttcattaagaggagctcaagcaaacctgatgcatatttccctatgaattcatctaagcctattgcagcagatttctcaatgaattcatttaagcctgttgcatcagatttctctttgaattcatctaagccggtttcctctataaagccagcgaaggaccttactttcgaaggattgactggcgcagggccaacccagttaaaacccatgcaagagcttactttcaaaggattcacaagccaaggatctaagcctatcactgatttttctatggctttgaccaaccatgttgcaacaaccgatttttatggtcacaggaaagattctgtgtgttcttcccctcctctgtctaacaccaattctttcctgtcatctattactggcgacgggagcgttgtctctactgataaaagaccttcaatgctgttggcatcttttcctccatccagcggtaggcctccattgtcttcgtcgaagaagaaatgccacgggaagtctaatgataccgatggtggcaagcactgtggcccttcaggaagatgtcactgttccaagcgcaggaaatctcgggtgaaaagaaccatcaaagtgccagcaatcagtgccaagatggcagatatcccagcagatgaatattcgtggagaaaatatgggcagaaacctataaagggctcaccgcatccaagagggtactacaagtgtagcagcgtaagaggttgcccagcaagaaagcatgtggaacgttctttggatgatccatccatgctgattgtgacatatgaaggagaacacaaccattctcagtccatgtctgaaagcacaggattggtggtcgatccatgaggctttttgtagattgattcatgtgaaagcacaaaagatcttaatctgtggcaattgtttatgggcaatgggccacattctatggaatgccttgaagaacctctattggaaagcagccagctgatatcgatactaaacttttgtcatgcctctaaagaggttcttttggcaagatgatctcgtttgcataatgtgataaaaagagatccttgtggaggactatttcatagtccaggatatttaaatttcggtttacatgatgtacagactatgagactcttaatccgaatagaagagcatgaaagagttctctactggggaaaatttatattgacatgaatgatgactgccatttggttatacattaatggtgaaatttctgttaactgggattatgaaaaaaaaaa

SEQ ID NO: 819 - DNA, 2599 bp, Pinus radiata
tgtgtctttccatggagattccacaagcaaaaaccatcacaaattacagttagagaatggatacgcacacagattgacgacattaggcaatacatacccacaccgcctctttacatttaacaatactacttataattagtactggtatagattgtggtactatccccatttcctgtttttctacccacatggattatcagcaggaacagcatcctgtcacctcaagttcccatttttacttcccagatcaagatttggacatgaattccaaatccttttcggatcttctagctgataataatggagacagccttatttggggtgcgaatgagcagaaattggaatttggcgctgcagggggggtaaccagaggtgggaacagctttgccgaacgctttgctgcgaggggaggggagcccctgaagctgagcacagccaagtttaaaacgatgtcccccagctctcttcccatacccagatcgccctttctctcaattccccctggtttgagccctaccaccttgctggactctccggttttgctctccaccgcgcaggatatggaatcaccaacaacgggtacttttccattgcaatcgttttcatttcaaagcactgctgctactgcttctttagatattgtaaagaatgaggatggcagctgctctagctttgctttcaaacctcttgccggttccaaccctagttcggacatgcaacctttgggaaacctggcaacttttggttacaaccaccatcagtctctaaaaggggttcaggatgatgctcggatgtggacttcgccaatctttagccagacaaacgagacaaacgagactggggcaaattcttcatctgaaccaacaacgactggcactactgctatgcaagctgttcctcttcaggctgttcgttcacaggcagcttcttttgaggagcagcaacagaggccgctttcagactttaaccaaactgcaatagttccgcctactggaattgaaaggccttctgacgatggatacaactggcgcaaatatgggcaaaagcatgttaaaggtagtgagtttcctcggagttattacaagtgcacacaccctagttgtccaaccaaaaagaagattgaacgttctctggatggacatgtaacggagattgtgtacaagggtcttcataaccatactaaacctcagcccagtcgtcggatgggagctgcagcagctgctgctgctgcggccgctcgtcttgaagagggagaaagtactgaaggctgtggtgctcttgtcaaagttgaagatccatcgtctactccaccgcgaaggcaaaactctaatcacctggagtcactaggtacaccggagcaatcaatttctgcaagtgaagaagatgatgcaagaacccaagtggacaagttctctggtgatgaagatcttgatgaagaagaatctgattcaaagcgcaggaagaaagaagttaatacgatggatatcataggggcaactagaactattagggagcctcgtgttgttgtacaaacaacaagtgatatcgatatccttgacgatggatatcgctggcgcaagtatggacagaaagtagtaaaaggaaatcccaacccaaggagctactataaatgcacaaatgcaggatgttcagtgaggaagcatgttgaaagagcctcgcatgacccgaaggcagtaattacaacgtatgagggaaaacacaaccacgatgtcccagccccaagaaacagtagccataccaacgctggattagggagtggacaaccaccagtacctattttgcagaatagtgttgcgccctccacaaatggaatggcattgactgctcctggaactcaagagacattctcacattttgataggcatcctgatcttcataatggctatgggaacaacaattacatgtttggaagaattgcaaatgagagttataattctcaaaatgggcgtggattggggatgagccttggggcatttggtctagagagtaagcactcggaaatacagcaagcagaagctcccacttcttttccaatgcagattaagcctgcaagccatgaatattctagtattggttcaggtaattctggtcacatatattacaaccagcctaatgagagagatggactaatcaggcctaaagaagaacaaaaggggcaatttcttgtttgatacttcacattgaattgtgcctctaatatatacaaagagagaagggactaacgtatgtatgtgcctaccattctgtattcttttcgacattggtgagtgtggctccaagcaacgtatttttgctgtcatttgacgttgttggaggattagtgccaggtggtgcagccttagagtataactgaacagttgactgtcctgaccaagtttaaatatcttctcaagcaagctctctggaatattcttggcttcaagttgacataacatgtacatgtgaaatttttgacatgttaatttgtggggccaagtgagtcatgttgttttggactgcatcttgccgagaccgtttacagctttaacttttgacccctcatctgaaaggatcagcaagtgaattgttatattgagcc

SEQ ID NO: 820 - DNA, 2988 bp, Pinus radiata
ggccgggagcatgggtccgatggatagacattgtatataccaccgtgaacagattggaagttttgcgattttcaggggactctgttgagcatatagacagaaaaagcctctatatatacatttgatcgaaatcttttacgggttccgattctcaaaagagtgattggtatgcgaaactcctgcgaaatctatggcggggaacgaagaaaataacaagatggggtttctagattggggtcccttaactagcccaacaacgcttattgcctctatgatggcggaggacttcagttcccggtccttctctcagcttctcgcagcaccgcagatcgaaaccccgcagtcccaagagcaaaacctgaagccgttatcacctgcgggctttaatggcagcagcagcaggagcggtaaagagaatgatccttttagtatttcaggcggttttgcggccggatcggtgccgacgagcggatttgggcaggtccataaaccgccttcgaggaccggtggtggtagttttgcggagagattggctgcccgagggggattcaatgcacccagattgaatacagcccggtttaagtgcttgccttctgtttcttcacctggtggggtgagatctccttatttgaccatcccccccggcctcagccctactaccttgctggattcccctgttctgctctccaactctcaggcagcacagtctccaacaacaggctcattccctctgccgccttttttgtatgaaagttctttatctcctccagtaaattctggctccgatggtttaaaggataagagttatgaggatggtacctcgtcctcattcattttcaagcctcatgtgaaatctggcccttcttcttgcttgtcacctctaggaggcctggctacttttggctccagtcaacagcaagctgtaggtggattccaggttcagacagagtctcagacttggcctcaatttgattctcagatgcctagtcggtccaattcacaaggacaggcccaaacgtacacccaaattcaaactcaagcccatgctcaatctcatactcaagctcaaaatcggactgatgcccaagtcttcatgcaggctggaaataaggctcgttctcatgctgctgcccaagtcaaaactcaggcacaggatcagggtcaagctcatgttccagcccaaggtcaggcacagctttgggagcaggctgtagcaaactctactggaacaaaagaccttgtggcatattctctgcctgaatcaccagtgcctaacaatgttatcgaagaggcaaaatgtgttcctcctttacaagttgcccctcctttacatgttgatcctcaagattttccttcagaagagtctgttccttcagaggagcaagaacaaatgcacgattcagatgctcaactacagcttccagaaggggaccaaaagggcttagctcctcataccatctcagggagaccatctgaggatggtttcaattggagaaagtatgggcaaaagcaggtgaaaggtagtgagtatcctcgaagttactataagtgtacacaccccaattgtcaagtgaagaagaaggttgaacgttctcctcatggacaagtaacagagattgtctacaaaggtggccataatcatcctaaaccccaacctagccgtcggtctgcagttggatctgctcatatgattcaggaaggggcagaaagtactgaagctactaccaaagttgaaggtgggaatacatggagaaacacagaacttggtctcttgaaagataaagatgctgcaaattgctctaagacatggaagaatgaacttttggagaggtcctcatcagcttctgttgtaactgacctttcagatccatcatcaacagcccaagttcaaagctccagccgcctagattcactaggtactccagagatgtcatcaactatagcaagtgatgatgatatggaagatgcaaatgatagcaaatcagtgggagatgatggtgatgaaaatgaatctgattcaaaacgcaggaagaaggaaaacaatacagtcgacattgttgcagcatctagagctattcgtgaaccacgtgtagtggtacaaacaaccagtgaaattgacatccttgatgatggatatcgatggcgcaagtatgggcagaaggtggtgaaaggaaatccaaatccaaggagttactataaatgcacaaatgctggatgtccagtgaggaaacatgtggaaagagcatcacatgatccaaaagcggtgatcacaacatatgaaggaaagcataaccatgatgtgcctgctgccagaaacagcagccatgataatgctgcaaaagggaatggggcagctcctctagcaatgcagaataatgtcccagcgcctatgaatgctataccacgacctgttccccaagttcaggacattgtttctcggcctgttcctcaagttcaaggcattgtttcccggtttgatagacacttggatcctaggaatgaatatgtaaaacgtgcatattatgaaaaggttgtagatgagaacctacatttgcaagataagaatggtgggagtcttgacttgaaaatgggggcagggatgggttttgggatgtttggtttagctaataatcatactgataaaaggcaaattgcagaagggcatccaccatttccaatgcagatacatagcactacaagccatgggttacctggcatccaatttagtggaaagcctaccgttcccgttcagtcatattttggtcaagctaaagataatggcatgagattcctgaggccaaaagaagaacaaaatgacgattctggttttgggaacacattaactttcaatcccacgccaaacccatcattgtatcaacaaatcatggggaaactatcaatgggaccctcattgtgaattcttgtttagtcacaccagcttgcttgagaatacggtaatttttttgagcatgaaatgtgttttatgca

SEQ ID NO: 821 - protein, 921 aa, Eucalyptus sp.
MGSSQKCMNVLCEEKGSTEWKRGWPLRSGQLATLCDKCGSAFEQATFCEVFHSKDSGWRECASCGKRLHCGCIASRMLLELLDCGGINCATCAKSSGLLPIASDERPSEFGMINVRTGELQSSTTDNHFDSDEVDKLKLIRLRSSTDDSGLGQSLLTQYNDTNRSHEPTNREGVINTPSALEMGGSCYLLSSKASNGATHASQPDILKANIAAKEFDDPHARTDLSMTIGVPLGKSYPSLRDHSTTPSLSPQGPKSRHVLHKPPKPAFASGFESNASVVSQIRVARPPAEGRGRNQLLPRYWPRITDQELQQISGDSNSTIVPLFEKVLSASDAGRIGRLVLPKACAEAYFPPISQPEGLPLRIQDVKGKEWVFQFRFWPNNNSRMYVLEGVTPCIQSMQLQAGDTVTFSRMDPEAKLIMGFRKASTSMMQDSQLAAVSNGNHSSEALISGGFENVPMISGYSSLLHSFKGSTDPQLNALSKHWSSASGDISWQGTEKHGLPRDAFLLPGMSAPERKRARNIGSKSKRLLIDSQDALELKMTWEELQDLLRPPSVNPSIVTVEDHEFEEYDEPPVFGKSSIFILRSTGGQEQWVQCDSCGKWRRLPVDVLLPPRWTCAENAWDQSRRLCSAPDGLTPRDLENLLRLTKEFKKRKLATTVRPALEHESSGLDALANAAIVGDDGDPGTTSVAATTKHPRHRPGCSCIVCIQPPSGKGKHKPTCNCNVCMTVKRRFKTLMMRKKKRQSEREAEIAQRKQLWGSKDEIEVDSTSAHRSSHHNPSENESRIGNELESQSQTTNSANTFAETGKGQINLNCQLDLNCQPDRNEDLKLGSSQTSMMNLLRVASQPLETYLKQNGLASLVSEQQASPAGHVQLQGATTDNEGQPSEDHCADSEIQEMALEKDDTDEKDSTPDQGEGDP

SEQ ID NO: 822 - protein, 243 aa, Eucalyptus sp.
MMASSISSSSPRTVEEIFKDYNARRTALVRALTYDVDEFYSLCDPEKENLCLYGHATETWEVALPAEEVPPELPEPALGINFARDGMKRKDWLSLVAVHSDCWLLSVAFYFGARLNRNERKRLFSLINDLPTLFEVVTERKPIKDKPNMDSGSKSKNSTKRSIDGPTRSTPKPYEENYGEEEDEHSETLCGSCGGNYSADEFWICCDICERWFHGKCVKITPAKAENIKQYKCPSCSSKRSRQ

SEQ ID NO: 823 - protein, 247 aa, Eucalyptus sp.
MEGIPHPFPRTVEEVFSDFKGRRAGLIKALTADVEKFYQQCDPEKENLCLYGFPNETWEVNLPVEEVPPELPEPALGINFARDGMQEKDWLSLVAVHSDSWLLAVAFYFGARFGFGKNERKRLFQMINDLPTIFEVVTGNVKQAKEQSANQNSKSKSSTKMSDPQSKGVKMSPPPKREEESGEEEEDDEQGATCGACGDSYANDEFWICCDICERWFHGKCVKITPAKAEHIKQYKCPSCSTKKARV

SEQ ID NO: 824 - protein, 252 aa, Eucalyptus sp.
MDGGGQYNPRTVEEVFRDFKGRRAGMIKALTTDVEEFYQQCDPEKENLCLYGFPNEKWEVNLPAEEVPPELPEPALGINFARDGMQEKDWLSLVAVHSDAWLLSVAFYFGARFGFNKADRKNLFAMINDLPTIFEVVTGTVKKQTKEKISVSNHSSSKSKSGSKVRGSDSGKFTRTIQAKDEDDVVDGEDEEEHGDTLCGACGENYASDEFWICCDMCEKWFHGKCVKITPARAEHIKQYKCPSCSNKRVRT

SEQ ID NO: 825 - protein, 253 aa, Eucalyptus sp.
MDGGAQYNPRTVEEVFRDFKGRRAGMIKALTTEVEEFYQQCDPEKENLCLYGFPSEQWEVNLPAEEVPPELPEPALGINFARDGMQEKDWLSLVAVHSDAWLLSVAFYFGARFGFDKADRKRLFNMINDLPTIFEVVTGTAKKQVKEKSSITNNSSSKSKSNPKKVSESQTKYTKAVQPKEEEEEGLEEEDEEEHGETLCGACGENYASDEFWICCDICEKWFHGKCVKITPARAEHIKQYKCPSCSNKRSRP

SEQ ID NO: 826 - protein, 253 aa, Eucalyptus sp.
MEGAQYNPRTVEEVFKDFKGRRAALIKALTTDVEEFYQQCDPGKENLCLYGFPSEQWEVNLPAEEVPPELPEPVLGINFARDGMQEKDWISLVAVHSDSWLIAVAFYFGARFGFDKADRKRLSNMIHDLPTIFEVVTGTAKKERARSSGANHSGSKSKSAYKGRASDSRGKYTRELPEKEEEEELDEEDEEENGETLCGACGENSAADDFWICCDLCLRWFHGSCVKITPARAEHIKQYKCPSCNNKRARTGN

SEQ ID NO: 827 - protein, 254 aa, Eucalyptus sp.
MEGGSGPYNPRTVEEVFKDFKSRRNGLIKALTTDVEEFYQQCDPDKENLCLYGFPNESWEVNLPAEEVPPELPEPALGINFARDGMQEKDWLSLVAVHSDAWLLSVAFYFGARFGFDKNDRRRLFHMINDLPTIFESVTGIGKRPTKEKPAVTNNSSSKNKQSGKMRASEPPMKMSKTPPPRDEDDSLDEEDEDEHGETLCGACGDNYASDEFWICCDMCERWFHGKCVKITPARAEHIKQYKCPSCTNKRPRT

SEQ ID NO: 828 - protein, 147 aa, Eucalyptus sp.
MESERYDETTEKQRIRRRPHQKPYRGIRMRKWGKWVAEIREPNKRSRIWLGSYATAVAAARAYDTAVFYLRGPSARLNFPDLILHEGQDSLGEVSAASIRRRAAEVGAQVDAVQAAAPAESRPCRTPDLNEYPQLEDLGEIDHESVF

SEQ ID NO: 829 - protein, 156 aa, Eucalyptus sp.
MESERYDETTEGQRIKRRPHQQQQQQQQRRQKPYRGIRMRKWGKWVAEIREPNKRSRIWLGSYATPVAAARAYDTAVFYLRGPSARLNFPDLIWREGEDSLGEVSANSIRRRAAEVGAQVDAVQAAAAKSRPCCAPDLNEYPKLEDSEEFHRESVF

SEQ ID NO: 830 - protein, 177 aa, Eucalyptus sp.
MMVEEEAVSGVAGQESPAAAKKRGLNGRERPYKGIRMRKWGKWVAEIREPNKRSRIWLGSYSTPVAAARAYDTAVFYLRGPSARLNFPEFLGAAAAEGGGGGGSCGDMTAAFIRKKATEVGASVDAALNSGGHGSVLKNGGSGLGHEYKGCGGFLQRVVDLNKVPEPEDSDGEFEKA

SEQ ID NO: 831 - protein, 181 aa, Eucalyptus sp.
MVPPFPTAELPLNENDSQDMVIYHVLNEAMSQNNSSLPHPNQSGSPSSGGSLEPSRGITKKHYRGVRRRPWGKFAAEIRDSLRHGARVWLGTFETAEEAALAYDRAAFRMRGAKALLNFPPEVVAASMPMERYDPSRSQSPGSANSDTRGQTHRSDSEVGIAGGASRDVATEHLEKVLDVF

SEQ ID NO: 832 - protein, 186 aa, Eucalyptus sp.
MARPQQRYRGVRQRHWGSWVSEIRHPLLKTRIWLGTFETAEDAARAYDEAARLMCGPRARTNFPYNPNMSQSSSSKLLSATLTAKLHRCYMASLQMTKSALQVQEPQKPPSSHFVNANGIFERNNDMGHQKMQFQLQESESWVIKKEKVEEAETQQFKPLEDDHIQQMIEELLDYGSLEFSSSIAS

SEQ ID NO: 833 - protein, 191 aa, Eucalyptus sp.
MTRTQQRYRGVRQRHWGSWVSEIRHPLLKTRIWLGTFETAEDAARAYDEAARLMCGPKARTNFPYNPNEPQTSSSKLLSATLAAKLHKCHLASLQVAKKSAKKEIDDSHPGHFRREGDRTSSQRNGDQRAGGWSEEKPTVVQWHEMNWDSDEGHGDNSVQQFRPLEDDHIEQMIEELLDYGSIELCSAIQT

SEQ ID NO: 834 - skipped

SEQ ID NO: 835 - protein, 208 aa, Eucalyptus sp.
MTKRSAAKAAAVHEGEGARSELKFRGVRKRKWGRWVSEIRLPNSRERIWLGSYDTPEKAARAFDAAAFCLGRPAAKLNFPGSPPEISGAASLSPDEIQSAAASYANFGAVAVPARAELPRPGSPAPSPSLSASEASSVLTTESDLTLDLSFLDFLDDSGPVSGEPHIGKFPGVEEAPDVFYHMQFPSVESAGLNLDTLLASDSFPWRI

SEQ ID NO: 836 - protein, 222 aa, Eucalyptus sp.
MAPRERPNAVTVAVSPRPQGGAKEIRFRGVRKRPWGRYAAEIRDPGKKTRVWLGTFDTAEEAARAYDTAAREFRGAKAKTNFPTADELVVAVAAAARSPSQSSTVDNASPPPPPAPPALDLSLGGFPFAAAYAAPAACFPVIPVARPVFFFDVFARGGQVGDSFPRDCKPLRPAVSEFFPTVGSGGVKSESDSSSVVDSDVTPRSRSFLDLDLNQPPPAEAA

SEQ ID NO: 837 - protein, 224 aa, Eucalyptus sp.
MVTTLTQVMDTTATNTTNLPSSAYSSVESTTTTLVFDSPQPSQNQENSRMTRRHYRGVRQRPWGKWAAEIRDPIKAARVWLGTFDTAEAAALAYDNAALRFKGTKAKLNFPERVQGNTSTSIPRNVYPPRNLSSLSGQSINAMPFNPSVTTTASSHEAYPHLIQYAQLLSSSDAEFPIITSTLLGQEHFGSPSSMSSPRQDEVARSSSYDFQDAEEYKPGDRSK

SEQ ID NO: 838 - protein, 225 aa, Eucalyptus sp.
MEPLINTKCIEAQTSTSYSSNSPSGSSSSCSKKAGAAGSGSSDSSKQKESSDGPNYRGVRRRQWGRWVSEIREPRKKSRIWLGTFQTAEMAARAHDVAALTIKGRSAHLNFPELAELLPRPASKSAKDIQAAAALAAAISFPGGDGAAAGEAGPSRPHSPNATAESFDTQESASSPLDNEDDTFIDLPDLLVGFGNRMEELCMSFAWQDEDGTRFSHGDDPFLWN

SEQ ID NO: 839 - protein, 226 aa, Eucalyptus sp.
MRRGRCAAAAAKREAAEIAPPPVPHAAAAAAAEPRYRGVRRKSLGRYTAEIRDPGTKKLVRLGTFGSPEEAARAFDAKAVAFRGVKARTNFPVAPSSFPPAASRDLRAPLIESRKFGRRGARDLRGDHHDVSPQRPTSSSLSSTVVSSSGPRPSPPPETAKRRTRTPPPPPPPPEDCRSGCGSSSTVIDDEGEDFASSSRREPLPFDLNLLPPPEIDDFQFTSLRL

SEQ ID NO: 840 - protein, 228 aa, Eucalyptus sp.
MKTVQSKKFRGVRQRHWGSWVSEIRHPLLKRRVWLGTFETAEEAARAYDQAAILMSGRNAKTNFPTSQTTNGDPAAANSLSSSKHLSEILHAKLKKCSKTPSPSLTCLRLDTENSHIGVWQKGAGQRSDSNWVMTVQLGNKNTDSIGESGDHLPLPHPPSTSSSSCCSSSSSVPSPLLPPQPPPSELMARGTMEEEERIALQMIEELLNRNSATPTFENPEEEDSFFL

SEQ ID NO: 841 - skipped

SEQ ID NO: 842 - protein, 239 aa, Eucalyptus sp.
MIPSRAAAAPDDVPEVAGSAPKGHVQQQQQPQQQVGAGEPKYRGVRRRRWGKYTAEISDPVKKARVWLGTFASAEEAARAYDLAAVRFRGSKAKTNFPASLYDRDDAQAQAPARIRRHAAAREDPQQGRRAFPQRPTCSSLSSTVESFSGPRPPPSAAAAAPQQQPEKRYRRSPPVEPEDCQSDCDSSSSVVDDCGGGVEEGSSSTSWFRRRGPLPFDLNLPPSSGGVDLDGEDLRLCL

SEQ ID NO: 843 - skipped

SEQ ID NO: 844 - protein, 249 aa, Eucalyptus sp.
MAMKEKAGSGGGARLAVREAHYRGVRKRPWGRYAAEIRDPKKKSRVWLGTFDTAEEAARAYDSAARDFRGSKAKTNFPLPSERPVLLLAGAAGGAAGAAGGSGGGGKGCNSRSPSQSSTVESSGHDPAAAAAAAPMVDFSAQLDLNLAYHHGGAGAGAGAGGAVGFRFPHQVAAAGPYGPFYMEAMAARAGAMNNQLYQRIIFDRRAADGSRSDSDSCSVVVDASDRGQKPAARVLDLDLNEPPPPESA

SEQ ID NO: 845 - protein, 250 aa, Eucalyptus sp.
MLLRPVLWPASMANQPPGEPQPNPPPPPPPAPAIQIPDQPPHNSPSSSSSSSSSLATTGDRGGSSPRPMLSPSGSSPLAQSTGRHPLYRGVRSRSGKWVSEIREPRKTTRIWLGTYPNPEMAAAAFDVAALALKGSDAALNFPHDVPNYPVPNSVSAADIRSAAASAAASRGARTEAEGKEDPVGRPESASEISQEPGQEFMDEDELLNMPKLLDDMAEGMLVSPPRTQMASENDSPEDSDGGESLWSYP

SEQ ID NO: 846 - protein, 264 aa, Eucalyptus sp.
MSDPSSPKDEAHVVQSSAELDPPPPQPLPSPSPPPPPPLALHALDQTLHSFPAYAGDAPSPKGKSPSPRHLQRSSPRSNPSGSASSGGKHPFYRGIRSRSGKWVSEIREPRKTTRVWLGTYPTPEMAAAAYDVAALALKGGDAVLNFPHLVKSYPVPASTAPTDVRRAAAAAAASRKAETSGGTDDTALLGQEGDEGKTRKDHRPDLSSKPPEAEFIDEEALFDMPNLLVDMAEGMMVSPPRISSPPSDDSPDNSDMESLWSYP

SEQ ID NO: 847 - protein, 275 aa, Eucalyptus sp.
MRRLRLPESAGQPPSPPPRRLTHEQELSIMVAALKNVVSGSTPSDPVPYLPPTSASATTAGDNYYWGSDFVALSDLETCQVCRISGCLGCNFFTPVADQADDRNSSGNSTKKRQSSSSRVAGKKKYRGVRQRPWGKWAAEIRDPRRAVRVWLGTFNTADEAARAYDKAATEFRGARAKLNFPHEDHSLLLPPPPPPPPAPLPQRQDPMASSSDNNSSAMRSNSEENKGKGKVETEADDFWNTFNNDEMERQWTMWMDMGGDSSDSNGPAVRSFDS

SEQ ID NO: 848 - protein, 278 aa, Eucalyptus sp.
MSLNHPLSTSDGTPNTLWWTTHPTMFRQHNLLLNFNPTDDDPQDEGSPPPPYVLRGAPPPAEPSPAEKEPMFEKPLTPSDVGKLNRLVIPKQHAEKHFPLVGEATQQLSFEDESGKWWRFRYSYWSSSQSYVLTKGWSRFVKDKRLDAGDVVLFHRDRADAERLFIGWRRRGESSPGASAVAAETRVGGGGGGFYAGRPYPGHNDGPSQPGSYTHGQAGGAPAAGNNPRRVRLFGVNLECQLDGDEESELPGSSHSPTGHGLSSNSSNYTPSHGLHFI

SEQ ID NO: 849 - protein, 279 aa, Eucalyptus sp.
MYAQSFQESDLALLESISRHLLLDDSESRLLSSCPNGAQSWTAGLGGDPCPYVAENYWGGLPLREDDPDDVVLYRLLNEPASFGWAPPGSQEARLPGFAAQVSVKPEPESFPTWSPECVATRPPPVAVPATGRHYRGVRRRPWGKFAAEIRDPAKNGARVWLGTYETAEDAALAYDRAAYRMRGSRALLNFPLRINSGEPEPVRVTVKRSSPKRPSPESSASSSSSLDNDAGKRRKKAAGPSVAPAAARVATPENETKGFQVGRQVGTSTNGEQLLVSL

SEQ ID NO: 850 - protein, 281 aa, Eucalyptus sp.
MSQSTMLVAEETIFSPPPLYNQRNHPHDGASGLNPFLTQEHWGDLPLQLNDSDDMLIYNSLHDALHSGWSPFDSVITAVHPEPQPHPLLPAASVPTSFASDDALSLHNAFASYNYPIEVAGGVVNSERRESDFARDYGFHRSSFCKGRHFRGVRQRPWGKYAAEIRDPAKNGARVWLGTYETAEEAALAYDRAAYRMRGAKALLNFPHRIGSGEPAPVRVTAKRKDSEAKGAVAGSAKKPKGTPTAPAAEADGGAGLRREGERLDAFQQGLLRLSEELLVS

SEQ ID NO: 851 - protein, 286 aa, Eucalyptus sp.
MASTQQQSSTLELIRQHLLIDFSSVDTFLTSLDACTSKVAPVPAAAAASSPSSGSNSPQTSFSFQPNPAPLPPKPPKPSSSTLSSRRPAIQVAVPAATSFLAAPAVPRAEPSGSAGGDDDKHYRGVRRRPWGKFAAEIRDPTRKGTRVWLGTFDTAVEAAKAYDRAAFRLRGSKAILNFPLEAGRDEPTSTEPSLAPADASRKRAREEAAAESAESEMSAGGCYKVVKKEQHADVASGRDTCPLTPSSWRGFWDIGEGNKESIFSVPPLSPLSPHPCFGYSQLMVI

SEQ ID NO: 852 - protein, 289 aa, Eucalyptus sp.
MNIHTQLPSDVRVPTPAQSSSPSPSQSSQSESSASHAACSDEEPAVALASSRPKRPAGRKVFKETRHPVYRGVRRRNRGKWVCELREPNKKTRVWLGTYPTAEMAARAHDVAALALRGRHGVCLNFADSAWRLPVPASREAAEIRRTAMAAAEAFRPAEAEEAVSSCGEASGGSVCPGQVASVHIVHDKKVKQERESDCMEIEESTSFDMKAWLERPLLSPTPHDASVRLKQERASGCVKIEEMTSLDMKAWLECPLLSPTPHDAGVPLSCDFDADGDDPDVSLWSYSL

SEQ ID NO: 853 - protein, 309 aa, Eucalyptus sp.
MCGGAIIAEFIPRNRRRVTSSDLWPDSLFLKPSNGLDDPLPPKQHPCLASGGAQEEKAPKKPRKNLYRGIRQRPWGKWAAEIRDPRKGVRVWLGTFNTAEEAARAYDREARKIRGKKAKVNFPNEDDAFSTIPRAHQTQHHHPQVPDYPPLYQPNWNNNGAPAKTLDLAFAYDLNQTGHFPANGYAPIHAEPVAMSSEEISGSGSEDTHASSTAALLGANYGAAEAKVKAEGEVGKKKEEDEESEVQKLSEELLAFENYMKFYQIPYLDGQSAAAPPNPAQDSVVGELWAFDDDNDNASGVTAVAPAAL

SEQ ID NO: 854 - protein, 317 aa, Eucalyptus sp.
MPEPVIQPLDHNNLLKKPRKMTRITVDSRRVRKIRIFCRDPEATDDSSSEDESDHHRKGDAKLFVREINLPLVSTHRASDLPSESSCQDSNNGFKSLEKKRKASPKGAAGTKRRACNSPYKGVRQRKWGKWAAEIRDPRRKGSRIWLGTFDTPQEAAKAYENKRLEFEAAKAEEASFSHSLNRPSTSEDTESVLSHTSPASVLDLDTTASNSTKEATADANEENMERPCLELIEEEPLISLDDVAIQDFYPGEDIDSLFKDDFGGFVDDDIWGFGDIPLCGFDKNKLIELPDYDFELEDDEFGHWIDEPPPLNIACP

SEQ ID NO: 855 - protein, 319 aa, Eucalyptus sp.
MAVEMFQEPESAFLDSVRRYLLSEDSECRFFEPPPPPTRNFCGAGAPVICGSSSFSSLYPCLTENWGELPLKEDDPEDMVLYGVLRDALTVGWAPFQPSGPPGPGFGASQVVKRELDSLPAPASSPESAAAAAAAAAAAVPQTEKAAQAVPAKGKHYRGVRQRPWGKFAAEIRDPAKNGARVWLGTYETAEDAALAYDRAAYRMRGSRALLNFPLRVNSGEPDPVRVTSKRSSPEPSSASPSSSSSSSLSSESETSKRRKKAAVPAGRAAAAQFGSERVGNADAVNGSLQVGQQVGMWTSGQQLMVSGCRQTVKCETTC

SEQ ID NO: 856 - protein, 339 aa, Eucalyptus sp.
MATTMEFYSSRSALPSYRISNGGDELMEALCPFIGGYGASTSTPSLSSPSSSSSSLFSFEPVSFSDGCSTSPDPLGFELPGPIGLNHLTPSQINQIQAQIQFQSTNLPSYHGHGYHPSMLLGPKPVSMKISGSAGKPATKLYRGVRQRHWGKWVAEIRLPKNRTRLWLGTFDTAEEAALAYDRAAYKLRGDFARLNFPHLKHCAASDVGDGRVSPLHSSVDAKLEAICQTIAEKKADGAKKPPASGRSRAAAAAAAAAAAAAAAAAAAAREVSSPEEASEVTEVTEVKGSEPESEGSAESSPLSDLTFDDFAEATWECVSLPEASTLMKYPSEIDWDAI

SEQ ID NO: 857 - protein, 349 aa, Eucalyptus sp.
MAKTSLPRQGQEEASDPKKDGGGAKSAAAKAKAKRTRKSVPRDAPQQRSSIYRGVTRHRWTGRYEAHLWDKHCWNESQNKKGRPVYLGAYDDEEAAAHAYDLAALKYWGPETVLNFTLSAYEEELKEMEGQSKEEYIGSLRRKSSGFSRGVSKYRGVARHHHNGRWEARIGRVFGNKYLYLGTYATQEEAAEAYDMAAIEYRGLNAVTNFDLSRYIKWPQPGAPDSSAAELSNSQQSPTAGGGGAAAAVAEVPAAHDPQGGGSASSALSLLLQSSKFKEMLERTSSAEDQGAGSTTSSESEAPRRSFPDDIQTYFDCHDVSGGLDDDGIFGDLNSFGSPIFHCELDLSS

SEQ ID NO: 858 - skipped

SEQ ID NO: 859 - protein, 656 aa, Eucalyptus sp.
MANRGGGEDDLYTELWKACAGPLVDVPRAGERVFYFPQGHMEQLEASTNQELNERIPLFNLPPKILCRVMYIQLLAEQETDEVYAQITLLPEAPQSEPMSPDPYLPEPPRPRVHSFCKVLTASDTSTHGGFSVLRKHATECLPPLDMNQSTPTQELAARDLHGYEWKFKHIFRGQPRRHLLTTGWSTFVTSKRLVAGDSFVFLRGESGELRVGVRRMARQQSTMPASVISSQSMHLGVLATASHAVQTQTLFVVYYKPRTSQFIISLNKYLEAVNNKFSVGMRFKMRFEGEDSPERRFSGTIVGVEDISSQWTDSKWRSLKVQWDEHASVPRPDRVSPWEIESSVPSIPPSMTESAVAKKRPRPPAELPALDTAGATLHDVGLMQSCDSTQPTVFIEGKRSDNHGIWHHKQTSVNTGSNSISWPQTEGDRQFSPSVCGWPLLSSSTMHSPKPRNEPKVELAEKPERPTSCRLFGIDLINHSSNSQQVDRLTVQPLDGSAGINETHTPGNAPAADSQQKSVVLKTSKEIIPKQSVVSPKEIRSKQSCSTTARSRIKVQMQGVAVGRAVDLTMFEEYDQLIDELEEMFEIKGELRPRNKWEIVFTDDEGDMMLVGDDPWPEFCNMARRIFIWSSQDVKKMSPGSRLPVFSVEEEGSLA

SEQ ID NO: 860 - protein, 675 aa, Eucalyptus sp.
MASHPSNHSCGRPHQGAFADALYKELWHACAGPLVTLPREGERVYYFPQGHMEQLEASTNRGLEQQMPSFDLPSKILCRVVNIQLRAEPETDEVYSQITLLPEPEQKEVTSPDPPLPEPPRCKVHSFCKTLTASDTSTHGGFSVLRRHAEECLPLLDMTQQPPWQELVATDLHGNEWHFRHIFRGQPRRHLLTTGWSVFVSSKKLIAGDAFIFLRGEDGELRVGVRRLMRQQSNMPSSVISSHSMHLGVLATASHAIATGTLFSVFYKPRTSRSEFIVSLNKYLEARAHKLSIGMRFKMKFEGEEVSERRFSGTIIGVGDSMSSGWTNSEWRSLKVQWDEPSSIMRPDRVSSWELEPLVVTAPSNSQQVQRKRERPTVLPSSSVQELSVFGGPKAPEYSSDFLHGDSQRGRDVYLSPKFSPSARSKSLNYNGNGSPAALSGYTVNWPSHMETITDPCTPVNGKESSEKRESGGSGCRLFGVQLLDSAKKESLSVTLAAGQRDDDKTALSVDDDSKEHQEPSCVNHFDNPSACYDPEKSCPNSSQDLQSRQIRTCIKVHMQGIAVGRAVNLAQFNRYEDLLMRFEEMFEIGGELCGSMRKWQVVYTDDEDDMMMVGDDPWNEFCSMAKKIYIYTTEEVKRLLPKIKLPVEDVGPANGGSDVAVNTDDRSSVVGSGC

SEQ ID NO: 861 - protein, 723 aa, Eucalyptus sp.
MIDLNTVEDDETPSSGSSPASSLSSAISASNINSNPAYPTSSSSSSSSCSPLCLELWHACAGPLISLPKRGSLVVYFPQGHLEHVSDFPTSVFDLPSQIFCRVVDVKLHADASTDDVYAQVSLVPEREQIEHKLREGDNEIDLDEDEIEPAVKSSTPHMFCKTLTASDTSTHGGFSVPRRAAEDCFPPLDYNQQRPSQELVAKDLHGLEWRFRHIYRGQPRRHLLTTGWSAFVNRKKLVSGDAVLFLRASNGELRLGVRRAIQVKGASAFPSLCIQTLNQSALMDVPKAVSLGSAFSVYYDPRASSSEFLIPARRFFKSLNQTLAPGMRFKMRFEAEDTAERRHSGLIANISDMDPVRWPNSKWRCLQVRWDDVEPDRGSRICPWEIEPSGSVSSPIGFMMPGSKRTRFGIPSMKPEYPVPNGIGASDFGESFRFQKVLQGQENLGFGTPYDGIETQSHRLSEVRRHHPDDSGGSEAAATRNGITNPSVNASVTYKGMGFGESFRFREVLQGQETFANPPYTRPWFTSGAQGNGAFGVRDGFQMVPSRNGCSALSQGSDNRFGLPVSSVQVSSPSSVLMFHQPSRKSSNRSSLCNTLPWDEKLSSPMKVSFGGTSPLGLLNEENRLSFPHSSILLPSEGVVSEDMAPPLKSSCRLFGISLTEGRDVSHKEVSMSSSRLNGEPLFGHIGENFHPKANVSRVVGSNCTRVLDLPPVSDVLFDVAS

SEQ ID NO: 862 - protein, 723 aa, Eucalyptus sp.
MIDLNTVEDDETPSSGSSPASSLSSAISASNINSNPAYPTSSSSSSSSCSPLCLELWHACAGPLISLPKRGSLVVYFPQGHLEHVSDFPTSVFDLPSQIFCRVVDVKLHADASTDDVYAQVSLVPEREQIEHKLREGDNEIDLDEDEIEPAVKSSTPHMFCKTLTASDTSTHGGFSVPRRAAEDCFPPLDYNQQRPSQELVAKDLHGLEWRFRHIYRGQPRRHLLTTGWSAFVNRKKLVSGDAVLFLRASNGELRLGVRRAIQVKGASAFPSLCIQTLNQSALMDVPKAVSLGSAFSVYYDPRASSSEFLIPARRFFKSLNQTLAPGMRFKMRFEAEDTAERRHSGLIANISDMDPVRWPNSKWRCLSVRWDDVEPDRGSRICPWEIEPSGSVSSPIGFMMPGSKRTRFGIPSMKPEYPVPNGIGASDFGESFRFQKVLQGQENLGFGTPYDGIETQSHRLSEVRRHHPDDSGGSEAAATRNGITNPSVNASVTYKGMGFGESFRFREVLQGQETFANPPYTRPWFTSGAQGNGAFGVRDGFQMVPSRNGCSALSQGSDNRFGLPVSSVQVSSPSSVLMFHQPSRKSSNRSSLCNTLPWDEKLSSPMKVSFGGTSPLGLLNEENRLSFPHSSILLPSEGVVSEDMAPPLKSSCRLFGISLTEGRDVSHKEVSMSSSRLNGEPLFGHIGENFHPKANVSRVVGSNCTRVLDLPPVSDVLFDVAS

SEQ ID NO: 863 - protein, 797 aa, Eucalyptus sp.
MEIDLNHAVSDVENASNACCDGHCEKGNGCLHCLSSTSSNSSSSSSSSAVPCSIYSELWHACAGRLTSLPKKGNVVLYFPQGHLEQVASASPYSPMEMPTFDLQPQIFCRVVNVQLLANKDNDEVYTKVTLLPQLELVGLDSEGRALEELGVDENDIGGSPPRSTPHMFCKTLTASDTSTHGGFSVPRRAAEDCFPPLDYKQQRPSQELVAKDLHGVEWRFRHIYRGQPRRHLLTTGWSVFVSQKNLVSGDAVLFLRGEDGELRLGIRRAHRPRNVLPGSTVGEQNMCPAVLSAVASAVSTKSVFHVFYSPRASHAEFVVPYQKYLKSINNVICIGTRFKMRVDVDDAPEKRCTGVVTRIGDLDPYRWPNSKWRCLMVQWDDDITNGHQDRVSPWEIDPSVSHSPLSIQSSPRLKRPRTSLPTMPPVPGGGVRLLDFEESLRSSKVLQGQEKLHLVSPVYGRDTLNCQVDFEQSPAHQGLASVVVEKANNINEYMRANAPSYAGFVESDRFPRVLQGQEICTLKSLTTKPEYNLGTWGKSSLSCSSFGVHQAPKYHFDQVKSSESLQKVYFPYNDILKSSQDRTRCSDSTNFLREVASVRSLRVQNEAIERTKVDVRNLESICTSPNFGDSQRAQANGSIDSLLSGCKLFGYPLTAEAPTSTLQNSGKRSCTKVHKQGNLVGRAIDLSRLNSYQDLLNDLERLFSMEGLLRDHDKGWRILYTDSENDVMVLGDIPWHEFCDVVTKIHIYTQEEVEKMTTGMISDDTQSCLDQAPLMMEASKSSSVGQPDGSPTVVRL

SEQ ID NO: 864 - protein, 830 aa, Eucalyptus sp.
MRDLCLDQREMASGSSRVEARADAEMALYNELWQACAGPLVAVPRQGERVFYFPQGHIEQVEASTNQVANQQMPLYNLPSKILCRVINVQLKAEPDTDEVFAQITLLPEANQDEDSLDKEPPPPPPPRFKVHSFCKTLTASDTSTHGGFSVLRRHADECLPQLDMSKQPPTQELAAKDLHGNEWRFRHIFRGQPRRHLLQSGWSVFVSSKRLVAGDAFIFLRGENGELRVGVRRAMKQQGNVSPSVISSHSMHLGVLATAWHAISTGTMFTVYYKPRISPAEFIIPYDQYMESLKKNYSIGMRFKMRFEGEEAPEQRFTGTIIGIEDADPKGWRDTKWRSLKVRWDENSAIPRPERVSPWNVEPALAPLALNPLPVSRPKRPRSSILPSSPESSVLTREVAADPSSSNGHSRILQGPESSTLRGIATDNDLDVVEKSVMFTPSMEEEKIDMLSASKRHGLDSWMTSGRRGPTCADLLSGFGGNTDVSHGFSLSSEQSSAANPARKHLVDQGRKFHIIGNSWSMIPSSLSLNLSESNRNSSLHGNDMHSPQGIGKYSGSKEYPVVHGQRVEQPHQNWVMRPPMSPHFNFPHASESISKSPYAQQHEAIKAKGGNCKLFGIPLVSNPVMAKSAVSVRSATNVFTDHVDSPSCQAHGFRLDQPTEPLNAANGGDDLVANELEKEKLFQNSQPHNRDVHHRVQASSTRSCTKVQKQGIALGRSVDLAKFSNYDELRAELDQLFEFGGELMNPRSNWLIVYNDDEGDMMLVGDDPWQEFCGIVRKIFIYTREEVQKMKPGTISAKDEDNLMVDEGVFSKKMTSDTLPSASDPKNC

SEQ ID NO: 865 - protein, 870 aa, Eucalyptus sp.
MRLSSSGFNHQSPEASNAGEKKCLNSELWHACAGPLVSLPPVGSRVVYFPQGHSEQVAASTNKEVDAHIPNYPNLSPQLICQLHNVTMHADVETDEVYAQMTLQPLSPQEQKDLYLLPAELGTPSKQPTNYFCKTLTASDTSTHGGFSVPRRAAEKVFPPLDYSQQPPAQELIARDLHDNEWKFRHIFRGQPKRHLLTTGWSVFVSAKRLVAGDSVLFIWNEKNQLLLGIRRANRPQTVMPSSVLSSDSMHIGLLAAAAHAAATNSRFTIFYNPRASPSEFVIPLAKYVKAVYHTRVSVGMRFRMLFETEESSVRRYMGTITGISDLDPVRWQNSHWRSVKVGWDESTAGERQPRVSLWEIEPLTTFPMYPSPFPLRLKRPWPSGLPSFHALRDGDMSISSSLMWLQGVGDQGVQSLNFQGFGMTPWLQPRYDTSMAALQTDVYQAMASAALQDMRAVDPSKCASQSLLPLQQSQNVPMGQASIIQRQMLQQSQSQNSLLQGFQENQATAQGQVLQHPSYNDQRQQQQQHQQQPQQSQQFNHTSLQQQMPNIITTLPQYGSIGQSQSSSLPAISQSQQNIFSDGMENPIVASDVSPMQSILGSISRDGASQLLSVNGSDSMISSSLLKKQNSVEPHLLSEAAHCILPQVEQLATTHTNVSEFANYLPPFPGREYSAYPGATDPQSSLLFGVNIDSTSLMMQNGMQHLRNIGSEHDSLSVPFGTSNFASVAGTEFPHNSDMATSSCVDESGFLQSSENVDQVNPPTRTFVKVHKSGTFGRSLDISKFSSYDELRSELARMFGLEGQLEDPQRSGWQLVFVDRENDILLLGDDPWQEFVNNVWYIKILSPHEVKQLGKQGINPANSVPRQAL

SEQ ID NO: 866 - protein, 897 aa, Eucalyptus sp.
MRLSSAGFSPQAQEGEKRVLNSELWHACAGPLVSLPAIGSRVVYFPQGHSEQVAASTNQEVDAQIPNYPSLPPQLVCQLHNVTMHADIETDEVYAQMTLQPLSPQEQKEAYLPAELGSPSKQPTNYFCKTLTASDTSTHGGFSVPRRAAEKVFPPLDYSLQPPAQELIARDLHDNEWKFRHIFRGQPKRHLLTTGWSVFVSAKRLVAGDSVLFIWNEKNQLLLGVRRANRPQTVMPSSVLSCDSMHLGLLAAAAHAAATNSRFTIFYNPRASPSEFVISLAKYIKAVYHTRVSVGMRFRMLFETEESSVRRYMGTITGICDLDPVRWPNSHWRSVKVGWDESTAGERQPRVSLWEIEPLTTFPMYPSPFPLRLKRPWPPGLPSYGLRDDDMGIASPSMWLRDGDRGMQSLNFQGMGLTPWLQPRLDASMLGLQPDMYQAMAAAALQEMRAVDHSKLATASLMPVQHVQNITSASASLMPSQMLISTQPQQSLLQGSRESPHHSVSQDQVQSHLLQRQLQHQNSFTNQQQPQQEQLRQQLVNQEQIPSASSPSQFALASQSHTASLQTMPSLCQQLSFSDSTGNPVTSPVVSPLQTLLGSFTQDGSTHHLNLPRTNSSVSPSSWPSKRAAIESLVPSGPSQRVLPQMDQLGPPQNNLSPSSVSLPPFPGRECLDQEVTDVQSHLLFGVNLEPSSLLMQNGISSLRAVGSESDSTSMPFPSNYISNSGADFAPNPSVAPPGGIDDSGFLQSPENLNQVNVPTRTFVKVYKSGSFGRSLDITKFSSYNELRSELARMFSLEGQLEDPVRSGWQLVFVDRENDSLLLGDGPWPEFVNSVWCIKILSPQEVQQMGKQDLELLNSIPVQRHSNGGCDEFTNRQDSRTINSGIPSVGSLDYGTL

SEQ ID NO: 867 - skipped

SEQ ID NO: 868 - protein, 472 aa, Eucalyptus sp.
MASTSGGNQSPMSPLKEQMQTSGYHPYPPPLAEYDDVVASPSLFMTTLEKLHSTMGTKFMIPIIGGKELDLHRLFVEVTSRGGIEKIIRERRWKDVTAIFNFPSTATNASFVLRKYYVSLLHHYEQIYYFKADDFLVLGTLQSPPVPTFLAQQMEAMHPAQETKVPMTLQPRTTASDLPRAGTTSPANSPVVGVIDGKFESGYLVTVTIGSEKLKGVLYQTPQSAAGKMPQQFNFSINNNNVAGSSGIQRRRRRKKSEIKRRDPAHPKPNRSGYNFFFAEQHARLKPLHPGKDREISRMIGELWNKLNESERTVYQDKALKDKERYKMEMESYRERLRMGQVVSDAVPLQQRLPELDVDMADVDANPEETEEGNSPQTQDNESSTDKSFSEEDDKDTEKELDVEASPVCAAVLESSNLDVNEAHPQMDVANVEEGREKQDIAIDNVEVAESVRDGIENVEDVDKEKLGQSSS

SEQ ID NO: 869 - protein, 189 aa, Eucalyptus sp.
MEGSKSNGYGECDQANLKATELRLGLPGTEEEPPLKVESPSFNSRKRALADDAESVLQDGRKSTSGVPPPSKAPIVGWPPVRSYRKNIYSSPAEVAEGGAGAGYLKVSMDGAPYLRKVDLKTYKSYQELMESLENMFNITIGDCSDKGSDYAPTYEDKDGDWMLVGDVPWNMFTSTCKRLRIMRGGSRS

SEQ ID NO: 870 - protein, 204 aa, Eucalyptus sp.
MEFREMERGVGDGVFGKDLLNLEETELRLGLPGTEESGQKKSRTGKRLFSESSDVSGSSKGSCVAPHHDEDHESAPAPKAQIVGWPPVRSYRKSALQPKKAEAEGPGIYVKVSVDGAPYLRKIDLKVYGGYPELLKALENMFKLTIGDYSEREGYKGSEYAPTYEDKDGDWMLVGDVPWEMFILSCKKLRIMKESEARGLGYGV

SEQ ID NO: 871 - protein, 215 aa, Eucalyptus sp.
MGLEKAKESPEVDANPGSSLEEITELRLGLPGENRGKSGTKRGFSKTVDLDESAVGRDDEANNSPVGGARVKDEVSGAAKPPAAKTQAVGWPPVKAFRKSVMKSCKYVKVAVDGAPYLRKVDLEAYDSYQQLLAALEKLFSCFSICNYASERKIVDPANGAEFLPTYEDKDGDWMLVGDVPWKMFVESCKRLRFMKSSEATGLGPTTQSACTSSS

SEQ ID NO: 872 - protein, 266 aa, Eucalyptus sp.
MEAPPARGREAAAPKRDSAGEEAELELGLGLSVGGGGGGGERAGAKRGRILTARDFPSSVGTKRTADESVSQEGGGGSPTSASQVVGWPPIRAYRMNSLVNLAKAPRAEDNMSPNEKSKSKDGSEDNTRTGGMTDVDGREQKHIGFVKVNMDGIPIGRKVDLNAHACYETLAQALEDMFFRPAKTIDLTGAEENRQVKKSSKLLNGCSEFVLTYEDKEGDWMLIGDVPWGMFLTAVKRLRIMRTSEVNGIAPRFQQKSERQMRKPI

SEQ ID NO: 873 - protein, 271 aa, Eucalyptus sp.
MSAETAERFTIDFEETELRLGLGRPAGVSSNGEGATRSGGKRVFLETVDLKLNFSSKEDGGSVEKIRASAPAEKKMNSSDGKEKSVAAAAAAAAAPPPPSSSSEVAKPPAKAQVVGWPPVRSFRKNIMAVQKSGSHEAEKGGSSGNGAATSGAAFVKVSMDGAPYLRKVDLKLYKSYQDLSDALAKMFSSFTIGNCGSGGMKDFMNESKLIDLLNGSDYVPTYEDKDGDWMLVGDVPWDMFVDSCKRLRIMKGSEAIGLAPRAVEKCKNRS

SEQ ID NO: 874 - protein, 279 aa, Eucalyptus sp.
MMEVGLKMGGKLMQSEERDQKKKHEDAEAEERETELRLGLPGGNNGGSGSDQAPDLQVVVGARKRGYAETEVDLKLNLNLSSSSSSGSPPPSSGSDPNDQTNSLPGRLDKRNLLPCPTSDIPVKPPAKAQVVGWPPVRSFRKNMVAAQKSSTEDMSSGGAASFVKVSMDGAPYLRKVDLKMYKSYQELSEALCKMLSSFTIGRCESQGVKDFMSESKLRDLLNGSDYVPTYEDKDGDWMLVGDVPWEMFVESCKRLRIMKGTEAVGLAPRAMEKCKSRS

SEQ ID NO: 875 - protein, 329 aa, Eucalyptus sp.
MERVSRNGEASQLLDFVAKEGEWLMKRLQEQRRGPTPPEDKALELKLGPPGDEDRSKKDFTMKYKLEKDESLLSLGYFNGGNQAQAQNLAPYLQLSPSIFRTQLPVLAKDKSSETVDLQNNNDAAEKKRAFLPASAAATTAVPNSSQKRTAPAPVVGWPPLRMFRKNLTSSDGHGKPAPKTHQNMLSSKIVSEKPAESSGKGLFVKMNMDGVPIGRKVDLNAYDSYEKLSAAVDELFRGLLAAQRDSSGCDIKSTQEEEKPITGLLDGRGEYTLVYEDYEGDRMLVGDVPWHMFISTVKRLRVLKSSEISVLSAGGQKQDKMSSDSAMQ

SEQ ID NO: 876 - protein, 342 aa, Eucalyptus sp.
MSTPLVHDYIGLKEASLMSRSSEKALPSSSAGEDEKKSALNLRETELRLGLPGSLSPERKQALGVPLFGKDLESKSGVLGFALSPSKNSVSGAKRVFCDAIDGCPSKWVFSASNGKSEVDLAKGGPVLSSPRSGKESDNGVNALQSCVPKPAMTEGLGGVPQSPKPEQEERKNQGAGGSEHGSAPAAKAQVVGWPPIRSFRKNTTASTLAKNCDDAEGKCLYVKVSMDGAPYLRKVDLRTYGSYSELSTALEKMFSCFTIVSGHCDSRGPLGQESLSESRLADLLNGSEYVLTYEDKDGDWMLVGDVPWEMFTDSCRRLRIMKSSEAIGLAPRATEKCKSRD

SEQ ID NO: 877 - protein, 359 aa, Eucalyptus sp.
MSPPLLSVGEEECESNVTLLASPSSLGSVCQNAELKERNYMGMGDHPSADGSVIPNAFDGCKITLNLRATELRLGLPGSQSPERDADFCTISSAKLDEKPFFPLHPSNDGHYSSQKIVVSGNKRGFADAMGGDSEAKFMANPEANVVLSPRPSPNLGLKNGSGLESFGSRPAKVKEIPTAQVAPEKPYSTKETQPNNGSRSNNAGSPAPKAQVVGWPPIRSFRKNSLATTSKNAEEVDGKLGSGALFIKVSMDGAPYLRKVDLKHYSAYQELSSALEKMFSCFTIGALGREMLSESKLKDLLDGAEYVLTYEDKDGDWMLVGDVPWEMFLDTCKRLRIMKSCDAIGLAPRAVEKSKNKN

SEQ ID NO: 878 - protein, 365 aa, Eucalyptus sp.
MSPPLLSVGEEECESNVTLLASPSSLGSVCQNAELKERNYMGMDDHPSADGSVIPNAFDGCKITLNLRATELRLGLPGSQSPERDADFCTISSAKLDEKPFFPLHPSNDGHYSSQKIVVSGNKRGFADAMGGDSEAKFMANPEANVVLSPRPSPNLGLKNGSGLESFGSRPAKVKEIPTAQVAPEKPYSTKETQPNNGSRSNNASSPAPKAQVVGWPPIRSFRKNSLATTSKNAEEVDGKLGSGALFIKVSMDGAPYLRKVDLKHYSAYQELSSALEKMFSCFTIGEICPHGALGREMLSESKLKDLLDGAEYVLTYEDKDGDWMLVGDVPWEMFLDTCKRLRIMKSCDAIGLAPRAVEKSKNKN

SEQ ID NO: 879 - protein, 377 aa, Eucalyptus sp.
MSPPLLGVEEGGGNTSTVATSPSIDGASHDCLGLKERNYLGLSDCSSVDSSAVSSLSDENKSNLNLKATELTLGLPGSQSPEREPKLCLLSSGKLDEKPLFPLLPLKDGICSSSLQKNIASGNKRGFSDTIDEFSELKSSKYPDGNWMFHATGPAPETAQCGGQGKFPGNAGMKAMLPSRTSGAQATVPKEALPKPAPECPRALNGAGVSQTRASNNAPAAKAQVVGWPPIRSYRKNTLATTSKDNDEVDGKPGPGALYVKVSMDGAPYLRKVDLRNYSTYQELSSSLEKMFSGFTIGQCGSNGTPGREMLNESKLRDFLHGSEYVLTYEDKDGDWMLVGDVPWEMFIESCKRLKIMKGADAIGLAPRALEKSKARN

SEQ ID NO: 880 - protein, 377 aa, Eucalyptus sp.; identical to SEQ ID NO: 879

SEQ ID NO: 881 - protein, 237 aa, Eucalyptus sp.
MVSPEHTNWIYDCGLIDDIAAVADGDFQVSGSGYTWPVQPLNGSSIFSTEIDGSFGESDGVKENGSKKRVRTESCGTSSSKACREKLRRDRLNDKFLELASLLEPGRPPKADKAAILIDAVRMVTQLRGEAQKLKDSNSSLQEKIKELKAEKNELRDEKQRLKAEKEKLEHQLKATSAQPNFLPPPPAMPAAFATQGQAPGNKLVPFLGYPGVAMWQFMPPAAVDTSQDHVLRPPVA

SEQ ID NO: 882 - protein, 238 aa, Eucalyptus sp.
MDDSDFEVLSDDPRVEPGIRALQRNGSSSYSSLVLDSERGELVEASVSAKRKTPPAERNVDALKNHSEAERRRRARINAHLDTLRGLVPEAKKMDKAALLAEVVNHLRKLKGNAEEAMQQYVIPTDADEIKVEQERGEVVDLEFETIKASLCCDYRPGLLSNLRRVLVDLGLIVLSAEVATLEGRMKSIMELTSHVGDKTLCQVLSSSLRLALCSMVDQFSTSEESPRPSVSDKRRRA

SEQ ID NO: 883 - protein, 239 aa, Eucalyptus sp.
MVSPEQANWIYDCGLIDDIAAAAADGGPFQVSGSGFSWPDQPLNGSSIFSAEIDGSLGDSDGVKENGSKKRVRSESCSASSSKACREKLRRDRLNDKFLELASILEPGRPPKTDKAAILIDVVRMVTQLRGEAQKLKDSNSSLQEKIKELKAEKNELRDEKQRLKAEKEKLEHQLKAMNAQPSFLPPPPAIPAAFATQGQAPGNKLVPFIGYPGVAMWQFMPPATVDTSQDHVLRPPVA

SEQ ID NO: 884 - protein, 242 aa, Eucalyptus sp.
MDNNVEEYQNYWETTMFYQNEELDSWVDEAISGYYDSSSPDGAASTAASKNIVSERNRRKKLNERLFALRAVVPNISKMDKASIIKDAIDYIQELHDQERRIQAEILELESGKLKKGSGGYDFDQDLPAYLRSKKKRTDAFYDSGGSRISPIEVLELRITYMGEKTLVVSLTCSKRTDTMVKLCEVFESLKLKIITANITSFSGRLLKTVFIEADENEKENLKTKIETAIAALNDPQSPMSI

SEQ ID NO: 885 - protein, 243 aa, Eucalyptus sp.
MGGGAWPFLVGGAICLVNSDNDIAAAAADGGPFQVSGSGFSWPDQPLNGSSIFSAEIDGSLGDSDGVKENGSKKRVRSESCSASSSKACREKLRRDRLNDKFLELASILEPGRPPKTDKAAILIDVVRMVTQLRGEAQKLKDSNSSLQEKIKELKAEKNELRDEKQRLKAEKEKLEHQLKAMNAQPSFLPPPPAIPAAFATQGQAPGNKLVPFIGYPGVAMWQFMPPATVDTSQDHVLRPPVA

SEQ ID NO: 886 - protein, 244 aa, Eucalyptus sp.
MVMDISNDDRYLNEEIGGPKDALDDGTQPNNKRKRGRAPKRAMKAEREKLKRDHLNELFDKLGSLLELSEPNNGKASIINETIRLLKDMISQIQSLRKENTTLLSESHYVAAETNELKDENFALEAQIKNVQRELEDKLGHSKPDLNVTPPECWQAEMGSHFLGNHHPQLPPTDPSTQQPPILGPMYVIPMNPDYQSVQKADTTSDQPIPVRKPHPRYPTPADSWPLHVLSKQHHDLARGNGGT

SEQ ID NO: 887 - protein, 248 aa, Eucalyptus sp.
MDLFFHEEVQSDIFWCDQLVEPPPPPPPPLPPANPSAFSPYTNRLPSQDRGFMPNPGNNMNKRVMEFLRRSWAEPSQIQEFDRERGFRHMLSERMRREKQKRSYSALLSELPHGTKNDKNSIVQTACMRIKELVKYKQELERQNGELKSGLNEKSGGDKAEGTKIRVKIANPTSGIDSMLEVLKCLDNMGLKATAIQTQCSADQLFAVIEVENEIEAADVEKVIQWTLLEAERKLLPNSYEGKLDWLS

SEQ ID NO: 888 - protein, 254 aa, Eucalyptus sp.
MDNNVEEYQNYWETTMFYQNEELDRSSHQKSLENYGSWVDEAISGYYDSSSPDGAASTAASKNIVSERNRRKKLNERLFALRAVVPNISKMDKASIIKDAIDYIQELHDQERRIQAEILELESGKLKKGSGGYDFDQDLPAYLRSKKKRTDAFYDSGGSRISPIEVLELRITYMGEKTLVVSLTCSKRTDTMVKLCEVFESLKLKIITANITSFSGRLLKTVFIEADENEKENLKTKIETAIAALNDPQSPMSI

SEQ ID NO: 889 - protein, 260 aa, Eucalyptus sp.
MALYSNYCDGLHGSDPHQMFDPLLRANGSAPAMDTPQSLVLDGEKSELVIKAPNRAAKKNVPEEKALAALRNHSEAERRRRERINSHLATLRGLVPGEDKMDKATLLAHVIEEVKELKKTALEASKGLLVPLDADEVKVEPLDDATGNGTFSFKASICCQYRPELLSDLRQAINALHLKIVKAEISTLESRLRNEFIFLSGKEQFSYNWSLQRQLLASSIRQALCSVLAKTSISSEYSPRTTLPSKRRRVSFLNSSSPSL

SEQ ID NO: 890 - protein, 269 aa, Eucalyptus sp.
MENLNWLSEWSGEADWVHSDEQLNRGSYPIPSQAAMFNPIQVCDENFPWLIPIGGVMADDRATSASASASASASVSKSHSQAEKRRRDRINAQLATLRKLIPKSEKMDKAALLASVIDHVKDLKRKASEISKSITILPSEVDEVIIDCEDPELNKGGNDSGAVLIRVSICCDDRPELLSELTRVIKGLKLTTVKADVASVGGRIKSVLILCGDTADGGGGGDRGACLSSLKQSLKVVVSRIACSSMAASNCRIRSKRQRFFLPCQSPLP

SEQ ID NO: 891 - protein, 273 aa, Eucalyptus sp.
MALEAVVFPDDPFNYYNCKEVQSLLGECWSFDFGDQEQCENSHFLSTLEIQTEDHECSGWNDQSNVSSKALIDRPKRCRYKRRKNKKEMESQRMAHIATERNRRKQMNEHLSVLRSLMPDSHVQKVDQASIIGGAINYVKELEQQLQQLGAHKEMEGQSSKCEDDISSPPFSEFFTCPQYSASPGQGNDSVPMNEWTSLTQSAIADIEVTMVETHANLKVRSKRRPKQLLRLVSGLQSVGLTVLHLNVTTAEPFVLYCLSLSLSLSLNSIFSE

SEQ ID NO: 892 - protein, 273 aa, Eucalyptus sp.
MDAPLVNASSFSAANPSAYSLAEIWPLGGDTGIVGPGLRAGNLDGSVEESTVTEQSGSGRRRRRMKDASSEDESSKMVSSSCVVGSDLNNSNGAKRAKIAGSRDENGSSKAEVEANSVACNKSSAEQSAKPSEPPKQDYIHVRARRGQATDSHSLAERARREKISERMKTLQDLVPGCNKIIGKALVLDEIINYIQSLQHQVEFLSMKLEAVNSRMDMSPAVEGFVPKDLMSQHFDGTGMMFASQAARDYLQGSQAQPDWLHMQTGGGFKRET

SEQ ID NO: 893 - protein, 277 aa, Eucalyptus sp.
MDPPAAMINGGGSFPGGDPVPYNLADMWLPPAGGGLGLGRHPGARGIAQFLNGSGPNLEASGGDPAVSAAEARCGGGSRKRRDAEDESAAGSLSTSNGVPNGADGEKRLKTSGCKDRSGDSKAEGQPSSAKPTDESKPQPEPSKQDYIHVRARRGQATDSHSLAERARREKISERMKILQDIVPGCNKVIGRALVLDEIINYIQSLQHQVEFLSMKLEAVNSRMNPPIEVFSSKEFGQQPYDTGGMPFGSQAPREYSRGSSPDWLHMQVGGGFDRKI

SEQ ID NO: 894 - protein, 277 aa, Eucalyptus sp.
MDPPIVNESSFSAANPSSYSLAEIWPFNGEPGNGGLGLRMGNLSGFLDGQMNRDGSAEVSTVTEQSGGGGIGRKRKDVSSEDESSKMVSTSSANDLNMSNGKRIKSLVSRHDNGGSRAEGESSSAAGDKQAGQIAKPSEPPKKDYIHVRARRGQATDSHSLAERARREKISERMKILQDLVPGCNKVIGKALILDEIINYIQSLQNQVEFLSMKLEAVNSRMNINPTIDGFPAKDLGGQPFDATGVMHASQAARQYSQGSQSEWLHMQLGGGFERPM

SEQ ID NO: 895 - protein, 306 aa, Eucalyptus sp.
MRSGKGSQEYEDFEEEDLNSKRDGPSSNVSNSSNSANPKDKSSDKAHAIRSKHSVTEQRRRSKINERFQILRDLIPNSDQKRDTASFLLEVIEYVRYLQEKVHKYEDSYQGWSSEPTKLMPWRNSHWRVQSVVSPPQAMKNGSGPASSYPGKLEDNSTGTTPNMLASSQNTSEIDPGRDLSSKFMVQQSERPFPDAQPMECTADTASDQQEDLTIEGGTISISSVYSQGLLNSLTNALQTAGVDLSQARISVQIDLGKRANRGVLATGTSIPMDHGSPNPGNSTMAHVTDARGEEGLDQVQKRQKT

SEQ ID NO: 896 - protein, 317 aa, Eucalyptus sp.
MHHPPNPDSLSLLQSARTPNAPPEHPVPSTSRRDEVAVLKSQKAGREKLRRDRLNEHFIELGNTLDPDRPKNDKATILSDTVQLLKDLTAQVNQLKAEYSTFCEESRELTQEKNDLKEEKASLKSDIESLNAQYQQRARAMFPWPIMDHSVVMAPPSYPYPVPVAVPSGPIPVHPPMQPYPFYATPNSNVFPNSHSTLLPFATPNMQFEQLSGHYAHPLMQMGNQSLVSSNKNDKGKERKHEKSGSSNDVTTDLELKTPGSATENDSSSPHRSSMKSMRKDDDTAERSSSTHSSSPHSVQDSSSSSIAGGSNSRAND

SEQ ID NO: 897 - protein, 320 aa, Eucalyptus sp.
MAGSNPQEGLGDEFFEQILAVPPGAYSGGSTPMVLQLGSGRGGVEDGGGRGGGGGLRGMGVMMPLGLNLEQGGLFRHEDVENSTSASSTTSAINMEREAGVHHGNNMTSCLFPAFGQFQTHQSVQPPPPHPPPPQLHPAFLNQPAVGSPNQPAIRPRARARRGQATDPHSIAERLRRERINERMKALQELVPSCNKTDRAAMLDEIVDYVKFLRLQVKVLSMSRLGGAGAVAQLVADVPLSSAEGEIIEGGNNQPAWEKWLTDGTEQQVAKLMEEDVGAAMQFLQSKTLCIMPISLASAIFRTSQPDMPRSIKPESSAPS

SEQ ID NO: 898 - protein, 325 aa, Eucalyptus sp.
MDQWRTDLGASTSVHPQQHQHQHQHHPSSRLHASHDEPRQREEADVRDPVAARKVQKADREKLRRDRLNEHFLELGSTLDPDRPKNDKATILTDTIQVLKDLTAEVNKLKAECAALTEESRELMQEKNELREEKSSLKSEVENLNVQYQQRMRVMYPWAAMDPSIMGSAYPYPVPIPVTPGPMPMHSQLQPFPFFGNQNASAIPAPCSTFIPYSMPANPTVEQQSTQYASSSHVSNKKDSKSRSSDHQSGSNAEQDEESNDVATDLELKMPGTSSQQDSGEKKGKQTQRKEISITDGSSSSKFSSSQAFPDSSSNSVSDNPKSSR

SEQ ID NO: 899 - protein, 330 aa, Eucalyptus sp.
MALEAVVFPQNPLSNYTSRELYNLLESNWGSFDFGLDRNEHGEFLDYPTEKDFPCGEWNNNSCSSDAGNNTAQCHLNNDNSNDGSSSHRAAAVGRTKRRRTKSRKNKEDIESQRMTHIAVERNRRKQMNEYLSVLRSLMPESYIQRGDQASIIGGAINFVKELEQKLQLLGVQKEMECLKSDDDHDDKPVSPFSEFFTFHKYNNSNSSNNSSSSPSPSTATTTTAYYGSTDETAAGNKRLSAIADIEVTMVESHANLRIRTKRRPKQILKVVSGLHSLRLTVLHLNVTTVDRVVLYSISVKAEDDCKLTAVDEISSSVYQIFVQIHEESI

SEQ ID NO: 900 - protein, 366 aa, Eucalyptus sp.
MKQGFYLQSSSPVQHMMSGNPNYWWNNINPPPPRSPFCHSSSSSPNLFLPYPPSSSLSSLFHLNPSWVYNNNVNQEQLPESLSQLLMGGLVGEEDKSSVMMNYLQEKRVEDWEEQQVLQQSPNDASVLDNQHHHLHVKQEDSASSYGVYGGAASDHHALQGTTNKSAWSQHHHHAMIPNSPPKSCVTTSFSSSMLDFSNKKPVNKRQTPPDLSSECNSNATGGVQKKAKVQPPSTSQSNTFKVRKEKLGDRISALHQLVSPFGKTDTASVLLEAIGYIRFLQNQIEALSSPYIGSASGKTRHHQSVRGERSPMFSEDSGQESINEEPKNDLRSRGLCLVPVSCTLQVGSDNGADYWASAFGGGGLR

SEQ ID NO: 901 - protein, 539 aa, Eucalyptus sp.
MSLWADYDHAAATDLSAFWPPPATPPPPAPAPPLSQESLQRRLQALIEGARGRDGEEGAGGPAAAWTYTIFWQSSGDYSGPVLGWGDGYYKGDGRARSRGSACSQAEQEHRKKVLRELNSLISGAPPADDAVEEEVTDTEWFFLVSMTQSFAGGVGLPGRAYFSSNPAWVTGAERLGNCGCDRARQAQIFGLQTIACVPVLNGVVELGSTEPIYQSSDLISGIRGLFNFHESEMGCGGRVLNSEHDPASLWICDPPVTMEINDRPMTFQIENPSSSSLTESPSAICAINDQQSDQNQQQNEGFFAKELNFAEYAINSSSRSNNGDSHPMKPESVEVLNFGDSGSGRLLSSHSQVAVAGETAKKKKRSATSIGSNEEEMMSFTSGVIVPSSGMLKSVSGAGDSDHSDVEASVVKEAESSKVVEPEKRPRKRGRKPANGREEPLNHVEAERQRREKLNQRFYALRAVVPNVSKMDKASLLQDAESYIREQRLMVALQELNLELQHASVSVVNELMIQQATVKMGSQLYTQEQLKAALLAVI

SEQ ID NO: 902 - protein, 637 aa, Eucalyptus sp.
MASGMENRGEIPANLKKQLALAVRKIQWSYGIFWSISTRQPGVLEWGDGYYNGDIKTRKTIQAVELNTDQIGMQRSEQLRELYESLSAGESSPQVRRPSAALSPEDLTDTEWYYLVCMSFIYDIGQGLPGRTLTTGQPTWLCNAHYADSKVFTRSLLAKSASIQTVVCFPFRGGVIELGVTEQVSEDPGVIHQVKGTLLEIQYPIASKKFSALIGDTIDQDDVDILDHDILDVKLVPVARELDMASPDTSSNGFEANQLPENSFVVEAINGVASQAQSWQFMDDEYSNCLHHSVNSSDCISQTIVEPTNLRSVQEDDKANDPQGCGYRKPTILENEIDDVHYQSVLSSLLRTSHQLIVGPHFQRGNRESSFVAWKKGWFPSRQTTQGGTPQGVLKRILFQVPRMYDNALQSPLEDGGENGVWRPEADEIGLNHAVSERKQKEKINDRLGVLKSMVPSVSKVDKLSILDDTIAYLRELQRKVEELESWGIGMEVEAKSRRKPHDMVERTSDNCGTHVTGSGKKPVRNKRKASNIDSMELETNSVVQRDVSADNLTVKINDRTVLIEMRCSSREGVLLEIINEVNNLHLDSHSVQSSTIDGILSLTIKSKFTGSTVMSAATIKQALWRFAQKCGNSSPY

SEQ ID NO: 903 - protein, 644 aa, Eucalyptus sp.
MATGVEGNEGVPANLRKQLAVAVRSIQWSYAIFWTLSATKQGVLQWGDGYYNGDIKTRKTVQAVELKPDKIGLQRSEQLRDLYESLLEGETDAQNKRPSAALSPEDLTDEEWYYLVCMSFVFNPGEGLPGRALADGQTIWLCNAQYADSKVFSRSLLAKSASIQTVVCFPYLGGVIELGVTELVPEDPSLLQHIKVSLLDFSKPICSEKSSSIPQNGDADKEPMCAKVDCGMVDELVLENLYSPAQEIKFDPEKISEFCESIPKELDMDSPDECSNGCEHNYQTEDSFMVDGMNGGASQVQSWHFVDDDFSNGVQGSINSSDCISEAIVNQDKYISSPRRENAKNSHLKELQECNHSKLSSLDLGPDDISHYRRTISAVLRNPDQLPETRCICSCGCKSSFLRWRMVEVHKPRAHQETLKKILFEVPLMHRGQALKSELQNGVESLLGDVDFCAGHILSTKKKEHEKFLVLRSMIPSIEEIDKASILDDTIMYLRELEARVEELESCMDSTDLEGKVTRKKFPDMIEQTSDNCKKRWINKRKASDIDETDAELDRNAQGDGLQTDVKVNIKEQEVSIEMKCPYREYLLLDILEAVNNLHLDAYSIQSSTLDGVLKLTLKSKFRGAAVSPAGMIKQVLWKITGKY

SEQ ID NO: 904 - protein, 682 aa, Eucalyptus sp.
MATPPSSRLQSMLQSAVQSIKWSYSLFWQICPQQGILIWGDGYYNGPIKTRKTVQPMEVSAEEASLQRSQQLRELYESLSAGETNQPARRPCAALSPEDLTETEWFYLMCVSFSFPPGAGLPGKAYARRQHAWLTGANEVDSKTFSRAILAKSARIQTVVCIPLLDGVVEFGTTERVQEDISLVNHVKTFFVDHHPPHPPKPALSEHSTSNPAATSSGHHRFHSPPVPSYAPADPPAAANQGDEEEEDDDDDDEEGESDSEAETGRQGAAAAAQNPHGAGPANNAEPSEFEMSEDIRLGSPDDGSNNLDSDFPMLTINSTAADHQRQVDSFRAETTRRWQMMQDPARSGLQTPPSVPPALDELSQEDTHYSQTVSTILQNQPRWADSTSYVSYSTQSAFSKWTSRSDHLLHVPAEGTSQWLLKYILFTIPFLHTKYRDENSPKSRDGDSSSRFRKGNPQDELSANHVLAERRRREKLNERFIILRSLVPFVTKMDKASILGDTIEYVKQLRKKIQDLEARNRQMEADHRTKEGELQRTTSLKDLRSAASSVERSSRASLPGSGSDKRKMRIVEGGSGAKPKAVESPPPPLPPPTSETSVQVSIIESDALLELQCPHREGLLLDLMQMLRDLRIETTAVQSSLTNGFFVAELRAKVKENVNGKKASIVEVKRAIQQLIPHTDS

SEQ ID NO: 905 - protein, 140 aa, Eucalyptus sp.
MMSLTQGSSGSDADVRYLGTDEKKRKRMLSNRESARRSRMRKQKHLEDLTREMGALERENREIIKAYKEKVHGHLGLQSENEALLAEKAALMNHLNGMESMIGSFNKSGPCQRFSSAVQEPWQAHSSSQQIVASASMSRI

SEQ ID NO: 906 - protein, 144 aa, Eucalyptus sp.
MASSQPTSSGSECNQRPVAVDERKRKRMESNRESARRSRMRKQKQVGDLLGQVSELQNANSQIAQGINATTQKYAEIENANNVLRAQLMELTDRLRSLNSVLQVVEVVSGLAIDIPEIPDPLMNPWQLPCPMQPITASADMLQL

SEQ ID NO: 907 - protein, 147 aa, Eucalyptus sp.
MGSVRRQASSGSDGDPRLGGVADDERKRKRMESNRESARRSRMRRQKQLGDLVGEVGQLQQANAQLAVSINAAAQKYAEVELANNVLRAQAMELTERLRSLNSVLEIVEVVSGLVIDIPEIPDPLMKPWQIPCPIQPIIASADLFEC

SEQ ID NO: 908 - protein, 159 aa, Eucalyptus sp.
MASSSGNSSSTARLQNSGSEGEPQQLRMDQRKRKRMESNRESARRSRMRKQKHLGDLTCQVTRLAKENNQILTGITVAAQHLTNVESENSILRAQVTELSHRLDSLNEILNSIYQSSGTADADQGLDLCSPYDGFFTSPVNLGCVSHQIMAASDVFECR

SEQ ID NO: 909 - protein, 182 aa, Eucalyptus sp.
MASSSGTSSGSTLIQNSGSEESLQALMDQRKRKRMISNRESARRSRMRKQRHLDDLMLVVAQLRKDNQQLRDNVNVVNQHYMTLETENSILRVQMNELTNRLESLKDILGILDAGDGGRPGNGGGSGYNGGGGWGNGGFGSPEEIGGGGGWTDQPIDYFFNPMSCAYAVNQPILASADMFQY

SEQ ID NO: 910 - protein, 185 aa, Eucalyptus sp.
MSAQRHGDGGKVDVASVQVGMEPTGSSSSSSWRTRQDGNDLTSPSCALKKKNKREENDEDLFTVPDMEARPAVNSTGNSNVHVSEQQEADQAQTAIPGKRRRGRNPVDKEYKRLKRLLRNRVSAQQARERKKVYVNELESKARELQDNNVKLEEKISTLMNENMMLRKVLMNTRPKVDESADSKQ

SEQ ID NO: 911 - skipped

SEQ ID NO: 912 - protein, 301 aa, Eucalyptus sp.
MENPDLPGDDLALEFDFQSLFDELSPDAAGLLDASDVDASSPGSLSSWIGEIEGMLMKDDEEAVAVEPSQEVFDRFFAGLLVDSPEGGPAEATDGASDKESNSSDGGGGGGGERDEKLVVGDNELSEDADDDDPVSKKQRRQLRNKDAAARSRERKRSYVKELEMKSKYMEGECRRLGRLLQCFVAENQALRLNLENGGAYGATMAKQESAVLLLESLLLGSLLWFLGIMCLFTRPVSLQPCPVAPPLENVGEKDLRSWAPRGIRGHAFEVSAAHSFVMTRRCRASRTKMKLCYLVPRALA

SEQ ID NO: 913 - protein, 327 aa, Eucalyptus sp.
MGTGEETTASKPSKPTSSIQEVPTTPSYPDWSSPMQAYYAPGATPPPFFASTVASPSPHPYMWGSQHPLMPPYGTPVPYSAIYPPYVHPNMAPTPVAAQTNVEPDGKGADGRDGASAKKSKVTSGNSSLVGGKAADGVKATSGSGNDGASQSADSGSEGSSEGNEDNSQQEFTAGKPGVPTPATNLNIGMDLWNASSAGGAAKIRPNPGAASSTLVPTGMMPDQWMQDERELKRQRRKQSNRESARRSRLRKQVECEELQARVETLSNENHTLRDELHRLSEECEKLTSENSAIKEELTRVCGPEAVANLEHDSTSALQSHGSEENS

SEQ ID NO: 914 - protein, 334 aa, Eucalyptus sp.
MGSQVGGFGGGIGGETAGRPLSRQGSLYGLTLDEVQNQLGGMGKPLGSMNLDELLKSVWSVEANQGLNMGAAEPESTQSGLFAPLQKQPSFTLSRALSKKTVDEVWKDIQQGEIDDGSNKSKKKKKDSGLGDQDAKPSLGEMTLEDFLHKAGVVAESPVINKNGNHVVDVDSVTSGGPQSAQWMHYQLPSVQPQQNVVPVFIPGHHVVQQPVPIITSPFLDSAFGDAAQMTVSPSSLLCTLSDTPTPGRKRVAPRDVVEKTVERRQKRMIKNRESAARSRARKQAYTQELEIKVLRLEEENERLRRKLEAEKVLPSAPPAEPKNQLRRTSSAPL

SEQ ID NO: 915 - protein, 356 aa, Eucalyptus sp.
MEMRDPPPNPSHSPHIPSPQNPRAAPAIAPPLAAPRGGHHRRAHSEVNFRIPEDLDLGPDPFENGPSGSFEDFGSEDDLLSTYMDIEKFGSKLDDGQGPSDPKPENAGGGGDVGEKSARPRHRYSNSVDSSSILESIEAKKAMAPDKLAELWTIDPKRAKRILANRQSAARSKERKARYISELERKVQTLQTEATTLSAQLTLFQRDTSGLTAENTELKLRLQAMEQQAQLRDALNEALKKEVERLKVATGEAMTPSDTYNLGLHHFPYAKPSYFPHQPQSGHVDPQNLQMTQFHMFQPNMAHQPLVAAAHSNAFSDMMQQESLGRFQGLDISNKGSQIVKSEAPSISASESSSTF

SEQ ID NO: 916 - protein, 362 aa, Eucalyptus sp.
MNSTTTQFVSSRRMGMYDPIHQIGMWDENFKQNGNPNAPPALIIPMHANLDNQSEDTSHGSQDTAGKYEQETSKPYDKVQRRLAQNREAARKSRLRKKAYVQQLEASRLKLVQLEQEVDRARQQGVYMASGVDSAYPGYGGCLNSGIVAFEMEYGHWIDEQNRQICELRAALNDHRTDVELRILVESGMNHYLELFRMKAVASKADVFYVMSGMWRTSSERFFLWIGGFRPSELLKVLMPQLDPLSDQQWAFVSNLRQACQQAEDALKQGLDKLQLNLAEAVASGHLGEGNYIPQVATALEKLEALVSFVNQADHLRQETLLQMSNHLTTRQAARGLLALGEYFQRLRALSNLWATRPREPA

SEQ ID NO: 917 - protein, 365 aa, Eucalyptus sp.
MNSPLAQLVNPRRMHTYEPFDQFPMWGDTFKADKVKNLEASSSVIVHAVDDGLDKKFEYVSHESAENSSSRSDQEANRPDKVQRRLAQNREAARKSRLRKKKYVQQLESSRLKLAQLELELGRARQQGLLLGNGFDATHFGFSRTVHSGIATFEMEYAHWVEEQQRKTCELRTALQGHVGDVELRFMVESSLKHYYELFRMKAEAAKADVFFLMSGAWRTSAERFFLWIGGFRPSELLNVLLPQIELLTEEQMLQLCNLRHLSQQAEEALSKGMEKLQQNLAQEVADDQLGAGNYSSEVAAAMEKLGALEDFVSQADHLRQQTMQRTYLFLTTRQAARALLILGTFWHRLRALSALWTTRPQDPA

SEQ ID NO: 918 - protein, 387 aa, Eucalyptus sp.
MVAVSPFSSKQMSDQITYLTASMNSPLAQLVNPRRMHTYEPFDQFPMWGDTFKADKVKNLEASSSVIVHAVDDGLDKKFEYVSHESAENSSSRSDQEANRPDKVQRRLAQNREAARKSRLRKKKYVQQLESSRLKLAQLELELGRARQQGLLLGNGFDATHFGFSRTVHSGIATFEMEYAHWVEEQQRKTCELGTALQGHVGDVELRFMVESSLKHYYELFRMKAEAAKADVFFLMSGAWRTSAERFFLWIGGFRPSELLNVLLPQIELLTEEQMLQLCNLRHLSQQAEEALSKGMEKLQQNLAQEVADDQLGAGNYSSEVAAAMEKLGALEDFVSQADHLRQQTMQRTYLFLTTRQAARALLVLGTFWHRLRALSALWTTRPQDPA

SEQ ID NO: 919 - protein, 409 aa, Eucalyptus sp.
MGNNEETKSSKSDKSSSPVPPQDQTGVHVYHPDWAAMHAYYGPRVALPPYYNSAVSSGHGPHPYMWGPPQPMMPPYGPPYAAIYSHGGVYGHPAIPLTPTPLAAETPKKSSANSDNGLVKKLKSFEGLAMSIGSGGDADSADDGTDKRSSQFVSSADSGDSSDEDQSGADKARRKRSREGTSSNGDGKSEVQGKAAGEVDAASENVSGGAIERPRATGKLAAPVNSPSMSSSLDLKNSCMDANANPVSILQPGVVPPEAWLQNERELKRERRKQSNRESARRSRLRKQAETEELAKKVDSLSAENRALKSEISQLTENSDKLRLENATLMERLENAQGVEKGVESLGKFNDNGLLSDKTENLLSRVNNSGAVDRRSEDEGEIYERKSNSGAKLHQLLDSKPRTDAVAAG

SEQ ID NO: 920 - protein, 409 aa, Eucalyptus sp.; identical to SEQ ID NO: 919

SEQ ID NO: 921 - protein, 413 aa, Eucalyptus sp.
MNSVFPVDEIGDSYWQPPPPPSSAADPAPGAMGRSQSEWALESFLAQVTCSGSISPSASSIAPPPTPGRPGEGGVLEDVVEIKKPNGQLAQLNQPQPPPPPQPQPQLQPQPKVPEGTMKPGEPIGYPKMPLQASISTQSDFQADGSGHGVPIPQGADSGSLGTSALPTIQRDSGVHVKQTTSESSREDSDDEEFEGDTGTTENKDPAEVRRARRMQSNRESARRSRRRKQEHMSELENQVGQLKVEHTGLLKRLTDMSQKYDVASVDNRILKADIETLRAKVKMAEETVKRVTGINPLVIAMSNLPSSDIPFGSSPMDSFTTAATPMQPNADHFFHHAAPNITSINPHHPRFDSSGFPRNNPLPVLTNIQADAISNNVAPVSSMQGVPGAPGAIPGWSSNIPPPLANTNIKHK

SEQ ID NO: 922 - protein, 419 aa, Eucalyptus sp.
MDKDKLTGHSSGLPPPPSGRFAGFSPNANAFSVKPEQPSAAASSSSFLPMAQGQNLVSDFSHDISRMPDNPPRNRGHRRAHSEILTLPDDISFDSDLGVVGAADGPSFSDDTEEDLFSMYLDMDKFNSSSATSSFQMGEPSSAPMAMPGAGDSGSGAAPSSAENVASGSTERPRIRHQHSQSMDGSTSIKPEMLMSGSEDASAADAKKAMSAAKLAELALIDPKRAKRIWANRQSAARSKERKMRYIAELERKVQTLQTEATTLSAQLTLLQRDTNGLTAENSELKLRLQTMEQQVHLQDALNEALKEEIQHLKVLTGQSMPNGGPMMNYPSFGSGQQFYPNNHAMHTLLAAQQFQQLQIQSQKQQHQFQQHQLHHQLQQQQLQHEQQQPAGDLKFRAPIPSPNQKDGNAAESNSSKME

SEQ ID NO: 923 - protein, 422 aa, Eucalyptus sp.
MGPQMNFRNLADVPAAERSTGGQPGIPLLSRQSSVYSLTFNEFQNTWSGLSKDIGSINMDEFLKNIWTAEESQLQLQDMAPSGNGGEGGGQVGNLLRQGSLTLSRTISQKTVDEVWRELFKETEDVKEGSREGGDINLPQRQRTLGEMTLEEFLVRAGVVREDTQMMARPGDNGVHEEMSQFTSNGLASSAAAGNDFIFSSKPAGSSLDFIGTRPTQLQQQPQPQPLEPPAPLFPKPETVSFATSVHLPNTAHIASPGSREAIGITHSSFNKALVHSGAMQAGGLCLGDLGRAGFAVESPAKLVSPDAISNNSTDVSSLSPVPYAFGRGRRSKDGLEKAIERRHRRMIKNRESAARSRARKQAYNMELEAEIARLKEINQELLRKQAEFMEMQKNQISQKVNGLYREDKRQCCLKRTLTGPW

SEQ ID NO: 924 - protein, 425 aa, Eucalyptus sp.
MASQFNFKGITDASQAEGVAGKSHGNHSLTRQPSIYALTFDEFQNTWGGLGKDFGSMNMDELLKNIWTAEETQAMTSTTGTGDGSVPGGNIQRQGSLTLPRTLSQKTVDEVWKDLLKESTVAKDGNRGGGFNMPQKQPTLGEMTLEEFLLRAGVVREDAQEVGRPNNSGFVSDFSLMSTSTGLGLNFQHPSQNNGFVMNQISENSKSIPGQHPNLAFNVGSIRSNQQQLQQQHDLPLLPKPATMPFASSVSIANNSQMPGLGLRGVIGMTDASIKSSLAQGGGLQTGVGMTGLDTRGVALQTVSPANHISPDVISRNTMDSSSLSPVPYPFGRGRKSGGALEKVVERRQRRMIKNRESAARSRARKQAYTLELEAEIQKLKELNQELQRKQDELMEMQKSQIVEKVNRQWGGKRICLRRTLTGPW

SEQ ID NO: 925 - protein, 426 aa, Eucalyptus sp.
MDRGFSVDEISDHFWSSPRPPPAAALTSSSSSSCRSQPPPSKMNRSESEWAFQRYLQEASVSAASSGRGDEGDVVEIKGPRPDRGRDQGPIRKQPPDPNAVNKDASEVSSASPPPPPPPAPYVDSIAPPPEPLPTNSEEYQAFLKSKLELACAAVALSQAPFVINQDSGTPADNSQASKASLVGSQAPSIGVGPELSKSQEEDAGGLVGIPSLPAMPKKSGIPVRSTTSGSSRDLSDDDEIGETATTDHLGPLDAKRVRRMLSNRESARRSRRRKQAHLSELETQVAQLRVENSTLLKRLSDISQKYNVAAVDNRVLKADVETLRAKVRFFIGSPSDTSADAAVPVRDDPKHQFYQTNSSNPASSADDMRTNNGLADIPAAENAQQNGAAKIGRTASMQRVASLEHLQKRIRGDSSPRGPPYDGEQ

SEQ ID NO: 926 - protein, 437 aa, Eucalyptus sp.
MGSNINFKNFSTDPTPTNNRPPGNTLLTRQPSVYTLTFEEFQNSIGKDFGSMNMDELIKNIWSAEENQSMASASGAGGGGGQDGIGVPGGHLQRQGSLTLPRTLSQKTVDEVWKNISKEDSVGKDGGLVTGGPVVPQRQQTLGEMTLEEFLFRAGVVREDAQYSGKPNGGGLFGELPRAGNNAGLEFGFPQPGKAENLMGMRNLEGGNLNSMHPLNMPVNANANGIRSNQQQLTQPQPQAHQPQILPKQPILPFSQQIPSPNNTQLNGHGFRGGLMAIPDQVMTNNLIQGGALHGGGMGMVGLGAGPAGMPTGSPANPVSSDGMGRSNGDTSSVSPVPYVFNGSVRRKCNSAVEKVVERRQRRMIKNRESAARSRARKQAYTMELEAEVAKLKDENEELRKKQAEIMEIQKNQVKEMMNTQRGAKKRCLRRTQTGPW

SEQ ID NO: 927 - protein, 449 aa, Eucalyptus sp.
MPSFVPATPASNSIGSEGNIVQSNQNTDFGSFEHSLGFRIEDAINLSRNPVFNQIKPNGRALGTDIQARAFNKSVVASERDQSSTASASQRIPLQKESQPNLLSIPGGCSENWGDSNMADTSPRTDSSSDDTDDRNQRLEAGPSAALGASDSSGRSKEKAVDQKTLRRLAQNREAARKSRLRKKAYVQQLESSRLKLTQLEQELQRARQQGIFISSSGDQSHSSNGNGAMAFDVEYARWLEEQNRHINELRSAVNSHVGDTELRIIVDNVTTHFDDIYRLKDTAAKADVFHILSGMWKTPAERCFLWLGGFRSSELLKLLISQLEPLTDQQMMGLYNLQQTSQQAEDALSQGMEALQQSLAETLANSPPGSTESSGNVANYMGQMAMAMGKLGTLEGFLRQADNLRQQTLLQMHRLLTTRQSARALLAIHDYFSRLRALSSLWLARPRE

SEQ ID NO: 928 - protein, 468 aa, Eucalyptus sp.
MGSRTRVGGGGDDGRVVNGMPSFVPQLPTSNSMGSEGNSIRSSRITDFGTLEQSLGYRIEDAVDLSRNPVFNQMKSSAQALGADVQFGSLNKSLSSSDRNLSVNIVGSQTLSMHRESQSNLVSIPGAHRENWGDSTMADSSPRTDTSTDDTGDKNHRFEGGQLGVAAASDSSDRSKEKATDQKTLRRLAQNREAARKSRLRKKAYVQQLESSRLKLTQLEQELQRARQQGIFISGSGEQSHSMSGNGALAFDVEYARWLEEHNKVVNELRNAVNAHAGDTELRTIVDNVAAHFDEIFKLKGTAAKADVFHILSGMWKTPAERCFMWIGGFRSSEVLKLLVNQLEPLTEQQLVGIGNLQQSSQQAEDALSQGLEALQQSLAETLANSTTATAGPSGNVANYMGQMAMAMGKLGTLEGFLRQADNLRQQTLQQMHRVLTTRQSARALLAINDYFSRLRALSSLWLARPRE

SEQ ID NO: 929 - protein, 577 aa, Eucalyptus sp.
MGDAEDSRNDTSRGLQSSFGTLQPKQAFSMNHLDIPHLSAPDMRAPMRQFAQSFVGGGDGNKRAGIPPSHPNQIPPISPYSQIPMPRPLNQQMGSSNFSHGPTHSRSLSQPSIFNFDNLPPLSPSPFRDSPSSTSISDHVSGDVSMEDRDASSHPLLPPSPFPRGNPSRIGESLPPRKAHRRSNSDIPFLSSLMQSSPPLIPSSSSKGLGTLERSVSGRESMSSAKPAQLVKKESSWDRGVYSNAEGMGERKSEGEVVDDLFSAYMNLDGIDALNSSETDEKNGTETREDLDSRASGTKTNGGDSSDNEAESSVNECGNSMQRLGMNSSSEKREGIKRSAGGDIAPASRHYRSVSMDSFMGKLNFADESTKMPPSPGVRPGQLSPGNSIDGNSNTFSLEFGNGEFSGAELKKIMANDKLAEIALTDPKRVKRILANRQSAARSKERKMRYIQELEHKVQTLQTEATTLSAQLTLLQRDSVGLTNQNNELKFRLQAMEQQAQLRDALNEALTAEVQRLKLATAELNSESHPSKCMVSQLPVSSQMFQLHQMQQQQQSQQQTQSQQQNGNTTTKSESNQ

SEQ ID NO: 930 - protein, 192 aa, Eucalyptus sp.
MANPSHGVQDSKGIKLFGATITLQGFRDQQVKSEAPISTEATTTMTTMTTTTKMATISTTNRNQDALAEAMKRPDKIIPCPRCKSMETKFCYFNNYNVNQPRHFCKGCQRYWTAGGALRNVPVGAGRRKSKPPCRGMDGFPESCSFEGSEVNHHQYYDLDYGVVENWHQLVPQGAFQHVVRVKRRRNGDQSY

SEQ ID NO: 931 - protein, 222 aa, Eucalyptus sp.
MNMMSSSSSSSSGFAPDHHHHLSSPTEQLCYVHCNYCDTVLAVSVPCTSLFKTVTVRCGHCTNLLSVNMRGMLLPSANQLQLGHNYFTPQNLLEEIRNAPPSLLINQLSPADSIMQLRGGAEQIPKPPVVNRPPEKRQRVPSAYNRFIKEEIQRIKAGNPDISHREAFSAAAKNWAHFPHIHFGLMPDQPVKKTNICQQEGEDVLRKDGGLFATANVGVSPY

SEQ ID NO: 932 - protein, 232 aa, Eucalyptus sp.
MKIQCDVCERAPATVICCADEAALCEKCDVEIHAANKLASKHQRLLLNCLSNKLPLCDICREKAAFIFCVEDRALFCQDCDEPIHSAGSLSANHQRFLATGIKVALRSRCAKDGDKTHSKPPNQSSQPVKTPHQQLSISTSPWGVDDLLQLTDFESSDKKEQLEFGELEWLADMGLFSDHVPQEAAEVPQLPMPQSSNYTSSRTSKFNVSHKKPRIEIPDDDEEHFTVPDLG

SEQ ID NO: 933 - protein, 262 aa, Eucalyptus sp.
MPSECADRKPAKAPHGGHLHAAGAGAAAPQPQEQEHLPCPRCDSTNTKFCYYNNYNFSQPRHFCKSCRRYWTHGGTLRDIPVGGGSRKNAKRSRTGASSSSSSSSAAVVLPGVAPQEHHLHAASLLLPFAGSHGGPVHLAGGDGDGKPGLNVCGSFTSLLNAHGPPGFLALGGFGLGLGPGGLDEMAFGLGRGVWPFQGVGDGVGAGVGSNGGPAGIGNAWQFEGGDEGGLVGGGGGGGGGGGDSCFSWPGLAISTAWSGLK

SEQ ID NO: 934 - protein, 281 aa, Eucalyptus sp.
MEIASSPRPVSVSLQEIKPTCGTTTTSRPHKDQALNCPRCSSSNTKFCYYNNYSLSQPRYFCKTCRRYWTEGGSLRNVPVGGGSRKNKRPSSSFSSSPSSKIIKLPDLVVGPSSLPQNPKTHEAQRDLNLTYPPDTTPTTDQQNPKSSSGIIASSSMGLSLSSFMPHMPVASDSSSNFYAAGGLNFQHLLGLKPTTSSFGSFSGHGFESGGFLGSLQGLQESGNGDDSNDGAKLFFPVEDGLKHQVTSTPRVDGQFGLQSRGQGDHSNGYWNGVLGTGGSW

SEQ ID NO: 935 - protein, 296 aa, Eucalyptus sp.
MKIQCNVCEAAEASVLCCADEAALCWACDEKVHAANKLASKHQRVPLSTSASQMPKCDICQETAGFFFCLEDRALLCRKCDITIHTANTYVSAHQRFLLTGVTVGLEPTEPHPSSSSINSRPGEKISEMKSKSSSLSNGGNQLPSHNEYNDIPSVHTDGVGSLINAKLPFSGGSAASSMPQWHLDELLGFSDFNQSFSFMGNGSSKADSGKLGDSDCSSIMRSSEETVDECLGQVPDAYWAVPQMSSPPTASGLYWPKSARRQLDAAVYVPDISSAPENDFLCQRNDRSIKRRRQS

SEQ ID NO: 936 - protein, 304 aa, Eucalyptus sp.
MDNAAPSQWTAQGFLGVINNNPPMEIASSPRPVSVSLQEIKPTCGTTTTSRPHKDQALNCPRCSSSNTKFCYYNNYSLSQPRYFCKTCRRYWTEGGSLRNVPVGGGSRKNKRPSSSFSSSPSSKIIKLPDLVVGPSSLPQNPKTHEAQRDLNLTYPPDTTPTTDQQNPKSSSGIIASSSMGLSLSSFMPHMPVASDSSSNFYAAGGLNFQHLLGLKPTTSSFGSFSGHGFESGGFLGSLQGLQESGNGDDSNDGAKLFFPVEDGSKHQVTSTPRVDGQFGLQSRGQGDHSNGYWNGVLGTGGSW

SEQ ID NO: 937 - protein, 304 aa, Eucalyptus sp.
MDTAQWPQEIVVKPIEDIVTSTCTAAATPKPSSSSVSERKPRPQKEQALNCPRCNSTNTKFCYYNNYSLTQPRYFCKTCRRYWTDGGSLRNIPVGGGSRKNKRSSSSASSSSSSFNSSSKKLPDLISTPASNPNNKVTLHEGQDLNLAFPNPHHHDFKSISELVQVPSLEASKNHHISANSSSAGASMAPPQLSALELLSGITSRGSFSSFMSMPVHDPGSVYTPGLFALPDFKPTLNFSLDGLGSGGYRSLPSVQEGGTNGGRLLFPFEDLKPVSSTSDMEQNRGDQGDSNGYWSGMLGGGSW

SEQ ID NO: 938 - protein, 315 aa, Eucalyptus sp.
MDPSSGTNQEMGAHSLESMLISPKPQQDQRKPRPQPEEALHCPRCESTNTKFCYYNNYSLSQPRYFCKSCRRYWTKGGTLRNVPVGGGCRKNRRSSSSSSSRRAQDQGGPISTLINNNDYDTPNPFTTLHSLTYDQSSDHMSLPFLGLHKFPYQLGPHELSHDILSYANRSKNGHGDMNGGFLDSLKNEFGLLENTQNNVHDSHHRQNLYYGYGSDGMHNNMGDPVDSGGAPSSCDHEMMSPAGSANEALGATSMKQELLCSDRDGENRVFWGCPWQMNGDQYRGNGVIGDVNSGRGSWNGLGSSWYGLLNSPLV

SEQ ID NO: 939 - protein, 360 aa, Eucalyptus sp.
MIQELLGSPALIGERKISMNHGAVILEGMPSPSPCFSPSPTPSPPSSSSSAITKTTAQATATATTTGNGTSTTTNSSNPENLRCPRCDSANTKFCYYNNYNLTQPRHFCKTCRRYWTKGGALRNVPIGGGCRKNKSSAVSSSASKSSASKFKNLSSEIGRSSFVSAFDPEISQSQVLWASPQSSHILALLRANQNPNPSSLGHQASPFMTLKEETNLIGNHMMPEPGIAESAMNNARNLGMIDPLIHVPSSCTSFLRGNHQQVPHQLSHHQQNGIILSGEAQNSGIQSLYQRLRASTGNNYGYSEHSPAILSSVASTPPLSSSLSSSILESVPATATSELGYWNPAFCVSDLPNANGSYP

SEQ ID NO: 940 - protein, 378 aa, Eucalyptus sp.
MTPPGTAPPKPPPMAGKEEAAPSSGSRKAASSSSSGKQPEQALKCPRCDSSNTKFCYYNNYSLTQPRHFCKTCRRYWTRNGALRNVPIGGGCRKNKKLKPSLASSRLFPGGGGDPKEYYSVAAAPPHPELGGFKLFHGLAPAVDFHLGGLSNFSKAVQNHNPPAPGIYSQFSSFSDASAIETAAAAPTSAATCFSLDQMAGPSGTILGFNNYHALPPFIAAAPGFGTSGALHEPGGSMKVDSNLASSIESLSSINQDLHWKLQQQRLAMLFSGDNNNNHNPKANNGGDVAASSINIATAPFEDQSQNLRQPVLFQNLDAAGSSRKEGSSVTEWFFGNAYASVTTPSPTNSSSNGNDNNNAGNWNSKGPGQGFQYTALP

SEQ ID NO: 941 - protein, 387 aa, Eucalyptus sp.
MLKEDTSGSGGSSGGGSGSGGNSWARVCDTCRSAACTVYCRADLAYLCSSCDARIHAANRVASRHERVWVCEACERAPAAFLCKADAASLCTACDADIHSANPLARRHHRVPILPISGCLHGPLAGNVGGPVMGHAADTEEGFLTPEDEEAIDEEDDDEAASWLLINPVKSNNSHTNGFIFGGEVEDYLDLVEYNSGAENQYVDQYNQHQQQQQQQQQQHYGVSRKNYGGDSVVPIQHSDCQRHNFQLNLDYEPSKAANSYTRSLSHTVSISSMDVGIVPESTPTDISISHPRPPKGTIDLFSGPPIQMPSQLSPMDREARVLRYREKKKTRKFEKTIRYASRKAYAETRPRIKGRFAKRTDVDIEVDQMFSATLMTENAYGIVPSF

SEQ ID NO: 942 - protein, 478 aa, Eucalyptus sp.
MQETQDPAIKLFGAKIPVSSAADGAALAAAKPEEREDGGGGGGGGGGEEEYDEDEGGGGGEEQEIEDAEQNASPEKASENMQEDCEPPPNSQELDPSRTSPDAVNPMTPSIQEESTTSHITETGAQEEHGTPKNSQDKTLKKPDKIIPCPRCNSMDTKFCYYNNYNVNQPRHFCRACQRYWTAGGTMRNVPVGAGRRKNKNAATRYRPITISEALQAARVDSPNGAQLPHLRTNGAVLTFGLDSPVCNSQSPIPNISEKKKVLNGYKNGFRDIENGDDSSTSSSVTISNSMNEKGLNFPQEQGMGNVNGFSTQIPCLPGVPWPYPWNSTIPSPAFCPSGCPPMSFYPAAFWACGVLPNAWNIPCMSPQSPFCNQKATTSGPNSPTLGKHSRESEPLKSDISLEQAEPPRQKNGSILVPKTLRIDDPSEAAKSSIWAALGIKAFEPKSREGKVKDAETLPHLHANPAALSRSLNFHENT

SEQ ID NO: 943 - protein, 516 aa, Eucalyptus sp.
MSGEARDPAIKLFGKTISLPDIPPGDAAAAAVDTGQVPSADPPSPAREDIGMAGVDGGEEEEGEEDEYEEDDDEEGRDDKETQDEKPAIAKLENGAQFMNLEEGTNRDAISVTNENPRTPSVDKESTTPRTSKSEEEQSDTSNSQEKVLKKPDKILPCPRCNSMDTKFCYYNNYNVNQPRHFCKNCQRYWTAGGTMRNVPVGAGRRKNKNSASHYRHLAVPEALQSVRTDFPNGVHHPPLKPNGTVLTFGSDAPLCESMASVLHLADKAMHNSRKNGFHKPEGVIMPSPCGSVRSGVETMNGSSATAANSNLAESKNGTKEIVMPNCQGFPPQLPCFPGAPWPYAWNSAPWSPPISPGPQTFCPPGFAVPFYPGPAYWSCSVPGAWNIPWVAQPTSPNHSATSSAPNSPTLGKHSRDEKIGKPNDSTEEEPKEANPERSLWIPKTLRIDDPGEAAKSSIWATLGIKNEASNSAGRGVLLKAFQSKSEEKNHVVEASSVLQANPAALSRSRNFQESS

SEQ ID NO: 944 - protein, 126 aa, Eucalyptus sp.
MCRGIGRESGPSGLFTKEEVPCKSPPGKAAVACELCGSRACLYCQADDAYLCRQCDRWVHEANFLAQRHIRCLLCTSCQRLTQRYVLGPSLVVVLPSMVESCADGEDSSDGQDKSSENIRTPFLFL

SEQ ID NO: 945 - protein, 211 aa, Eucalyptus sp.
MRTICDVCENAAAIFFCAADEAALCRACDEKVHLCNKLASRHVRVGLADPSEVQRCDICENAPAFFYCEIDGSSLCLQCDMLVHVGGKRTHGRYLLLRQRVEFPGDKPGRLESQTPNQNEVKREKDQPHKLAMKEVQQNHRASPVPVGDAISSGEGKMQDKMIDLNSRPQRTKGQTSMNEDMDVTNGSNLESAGVVPVGSFDRQPEMKQST

SEQ ID NO: 946 - skipped

SEQ ID NO: 947 - protein, 238 aa, Eucalyptus sp.
MKIQCDVCERAPATMICCADEAALCAKCDVEVHAANKLASKHQRLLLHSLSSKLPVCDICQEKAAFIFCVEDRALFCKDCDESIHPAGSLSANHQRLLATGIRVALSSSCTKEAEKTEPEPPSRNKPHTSVKSPQQEAPSFTSSWGVDDELLQLPDFESSDKKEQLEFGELEWLADMGLFADQVPQEALAAAEVPQLPLPPSSNCTSYRTVKSQMPHKKPRIEYVDDDDEFFTVPDLG

SEQ ID NO: 948 - protein, 311 aa, Eucalyptus sp.
MKILCDVCNKDEASVFCTADEAALCGGCDHRVHHANKLASKHQRFSLLCPSPKEFPLCDVCQERRAFLFCQQDRAILCRECDLPIHTANEHTQKHSRFLLTGVKLSATSEVYTSAASSASLSNGCDFVPDFKSEASSSFKKPVSVSAAISGPRKAAASAASAASAAAASAAAANNKDGNNNGMLASQESGSNGSTSSISEYLIEMLPGWHFEDFLDSCSASFGFKDDGLLPFTDNDNVSSFSSESLGIWVPQAPTPVPCNQSPYLNGGIIGGFKQTKEPATTRPGKRWNDDVFAVPEISPSSAGFKRSRPL

SEQ ID NO: 949 - protein, 330 aa, Eucalyptus sp.
MEKSENCTAGNTKKKKKKKKKKTAGSSRFGLFRSPSGGPTMKPTPCELCKEAASVYCPSDSAFLCRGCDARVHQANFLVARHVRNPLCSGCGSLSGHRVSGAGVGPRRPALCLSCSDRPSVDAGPLSGSSSSSACVSSTESSAVAPKKEGRCSSGGRKLQKTGVSSSLTDASGEGSDSPARFGGAAAFSGEVSSGKRSGGTDDRRAGAARFRETTRVDAKTEGVFAIWCKKLGLSGAEAFAVASRALRVIAGTPTALPLRVAMAASFWVAMRSCKGRGMSTWQNVKRVEEASGVPAKLILAGEARLVRRARGEKARREERLEEGWAECTA

SEQ ID NO: 950 - protein, 348 aa, Eucalyptus sp.
MASKLCDSCKSATAALFCRADSAFLCPSCDAKVHAANKLASRHARVVVCEVCEQSPAHVTCRADAASLCISCDRDIHSANPVAQKHDRVPVVPFYDSLPPNHHHHHHPAVAPPFAKPPAAGDFVLKSEDDVSREEEEEAASWLLPNPSKAAESPDVNSAHQFLFGDDDVDPYLDVDYGPVDPKFEPSGDQNSSGTADGVVPVRSEGVVHGPFVGEGGFDLELTAGSKGYGYSYGAPCLSHSVSSSSLDVGVVPDGSTVTDISNPGGRAVGVGFESLSRALQLSSVDREARVLRYREKRKNRKFEKTIRYASRKAYAETRPRIKGRFAKRADIEAEAERMFGFGVVPSF

SEQ ID NO: 951 - protein, 379 aa, Eucalyptus sp.
MAKGGGGKRPCDYCGGTTALLYCRADTARLCFACDREVHATNPLFAKHNRSLLCDACDSASASFFCEAERLLLCQNCDWDRHDGGGGGGGAAAVHNRRPVEVFTGSPSVGEILGILGVEDLGFKGPPLGGDEGGDDGGGGGGGGCGGGGDGGFSDVLLWDTPAFVTLDDLIVPREDACALRAVDVPPLPKNRNATCGLHMKEMLRQLRLLAKPEYNFNFEEGEIEPLDDFHLPVLTQALQPANIHTGCEDRDQVGFHKIEATDFQCFSNDGNTRNQAYDASSFSGGYKEERPTALDKYPNGSIPSSTNECHEVPSENQINPNPLPLVPLTSQERESAISRYKEKRKTRRYDKHIRYESRKVRAESRIRIKGRFAKTDRT

SEQ ID NO: 952 - protein, 380 aa, Eucalyptus sp.
MGFGGSWSVPAKACDSCKTAAAAVFCRADAAFLCLGCDARVHGAAKLSARHERVWVCEVCEQAPAAVTCKADAAALCVTCDADIHSANPLARRHERVPVEPFLDAAESISRAASAFNFLAVPTKTGSADTCGGGGGGFGGSCQNEELEEAASWLYTNATGASANKIVEGMDVKVAPGGGGDVFFNDVETFLDFECGNNSMDRFHGSATDSLVPVQTKPAPAPVVHPSSENCFDIDFCRSKLTSFSYLSHSVSSSSLDVGVVPEGNSMSDISYPFVQSMSGNSTDLSITNSAATTTTANQPTPMSGMDREARVLRYREKRKNRKFEKTIRYASRKAYAETRPRIKGRFAKRTEIESEVDNIYGTASAAFMADSRYGVVPTF

SEQ ID NO: 953 - protein, 400 aa, Eucalyptus sp.
MGYICEFCGEQRSMVYCRSDAACLCLSCDRNVHSANALSRRHSRTLLCERCNSQPACVRCAEERVSLCQNCDWIGHGASTSASTHKRQTLNCYSGCPSAAELSSIWSFVLDFPSGGESACEKGMGLMSIAEGNENAACIPPKDSSSQDASVCADDEAGNANAWVGSSSLPELKSASLNMGQLAASASTATPKACLPITRSPGLFEDDSFYEDFNMDEVDLDLENYDELFGVALTNSELLFENGGIDSLFGAKEMSAADSNCQGPVVIQPACSVASAESMMSSKTEPIICFSTRQPHSNLSFSGHIGENNTGDYQDCGASSMLLMGEPPWCTPGPENSFTSASRSNAVMRYKEKKKTRKFDKKVRYASRKARADVRRRVKGRFVKAGDAYDYDPLSQTRSY

SEQ ID NO: 954 - protein, 529 aa, Eucalyptus sp.
MGNEREGEKAGLLISSGSRQNHDTKKLKLMIQTKRSMEKVCEFCRALRPVIYCQADAAQLCLSCDAKVHSANALSSRHLRSLLCDSCQYRPAYVHCLDHKLYICRNCDRRIHDGSCQHRTQAIYSYMGSPSANDFAELWDLDLSQLGNLACTGPSDSSSHEFVDLGTITVDTSGSVYPGECNVGSRNRERAKTSCDGQQNQSSCFIMQQILDLRKLQLNEKKDSLPLICDQEQNDFSSSFSHSPRKFNENTDQSLRSCHDLSSERITLLQDLKAENSPSAFSTLGNLPSSSTSGTPSPWQSESIWQCRSPFQTSQFWTQNMQDLGVCNELACHDDFDIPEVDVTFQNYEELFGGEQDTIRALLDESKLEYSSLDKDVPLDDSENSHAELFEDISVATSVCFGATNVMDGNTVLKNQVNFIRQGTLDPCPSIRESYSTLSPSISRLNSESTGLDSLESRLSPSIIGGEQQCDVREEDIVKRDGRQTDMMNNIDREKPRRHEKRTQNASQRGKADARKRVKGRLKTGGYDS

SEQ ID NO: 955 - protein, 302 aa, Eucalyptus sp.
MGLSTKQVSNDGFDWNQSLLQDHHQTLEIPKSLPMKRPLQQQNQLNQPSEPLKCPRCDSTNTKFCYYNNYNKSQPRHFCKACKRHWTKGGTLRNVPVGGGRKNKRPKPSHPSSAAANSSSAASRRILTANTTTASDAPVQAREKIIRGLQSEVCDQKDLNEMFYQAFLFQPPPRENLCSNSNIFLGSSLSTPESANLHFPLLQSSSPLVRNTCSSTPISSFGFSSTVDGQTREYKPVLEESSTIITTSVMPTSTCTQPWNFGNIGMEVMNNTSHNWVWDDMDKLVSTNLSLPDWDNVETKPQ

SEQ ID NO: 956 - protein, 337 aa, Eucalyptus sp.
MAFTSLQVCMDSSDWLQGTLHDDSGMDTSSPNSGDMLACSRPLMERRLRPQHDQPLKCPRCESTHTKFCYYNNYSLSQPRYFCKTCRRYWTKGGTLRNIPVGGGCRKNKKASNSGSNSNNSASSKKLANNDHQGYGVPSHPGQSSASSSRGDHSTDLHLSFSPEVQLSHLHGLLGVHGAPFAGPGNNFSGLENPRPIDFLEGKVMSYDSNFMLSGDSPHPHMGVVGDLGGSTGMAPGFHGFCGPYGMAIDGGHSGNANSFMENCQRLNMLVPYDQGHDQEQINAMDVKPNPKLLSLEWQDQGCSDASKNGYGYFNGLGPSWTGMMNDYNASASNPLV

SEQ ID NO: 957 - protein, 350 aa, Eucalyptus sp.
MQDIHSIPGGRIFGAAAAASSAVGDRRLRPHGHHGHHHQHGHHPNHQALKCPRCDSLNTKFCYYNNYNLSQPRHFCKSCRRYWTKGGVLRNVPVGGGCRKSKRSSKPKSSPAAAAAPADPPPAAAAAAAEDPPKEPKTSSHSSSESSSLTATTTAVATEAVSAPSSASHQSSLLNISDYKSMMSQGMNANPSDAGYEHPGSAEGGLGLFSDIGSFTSLITSSSDGPLSYGFSAVMAQQNQDHQAQQNQWHQIAAGAGAGPGDEMKMPELGGGGGFLDQNVLVDLPTSTSQGNRPGGGGGGGGGGGFGALDWQPGADQGLFDLPNAVDHAYWSQSQWSTDGDQDPTGLYLP

SEQ ID NO: 958 - protein, 462 aa, Eucalyptus sp.
MVEMTSDPAIRLFGKKIPLSYTGESPEASSGDGVVYSGVNSEEDDEGSEKCHSIEHFAMEVQEDDDQVSPETVNPKTPSIEEESAKTKASGIDQEQGDSSNSQEKPPLKKPDKIIPCPRCNSMDTKFCYYNNYNVNQPRHFCKACQRYWTAGGTMRNVPVGAGRRKSKSSASHYRQITLSEALQAARIDAPNGTHLPNGKINGTVLTFGLDPSAGDSMAVALNLSNKEGSAMNRMQNGFCDFGRNGVSVPQRSGEKNDDCSSRSSVAISNLTDEGNGNSNLEGSSANGFHPQFPCYPGVPQPYPWNPAMLPPPFYPSGFAVPIYPAPLWNCGLHSSWNFPLLSPPSQKGSNSGPDSPTLGKHAREGEMVEKVDSVEDEPRKRKNGCVLVPKTLRIDDPSEAAKSTIWATLGIKKDWLGKDGLFQGFQSKGEEKNHVSETASVLCANPAALSRSIKFHESSCV

SEQ ID NO: 959 - protein, 269 aa, Eucalyptus sp.
MESLGFMDDLLDFPDLGEVVDEEDDLGKSSCSKAKAAAAAAAAATSLPDSASFDASSTPSLPEWEEELEWISNKDSFPSLESFVILPEQPGNNFKEDNLIPPLENSSSSSTTTSTHSSGNRSGTVTIASCCGGPPLPFRRARSKRARERRHGDLSVFAAERLLISRDQEKANKKTKLGGQGSVKIGRKCLHCGSEKTPQWRAGPQGAKTLCNACGVRFKSGRLVPEYRPANSPTFSSELHSNSHRKIIEMRRTKQMGGGGVKGVDIRVK

SEQ ID NO: 960 - protein, 288 aa, Eucalyptus sp.
MDGSRGGDDGMDVGDPTHDRHPMQPHYRHHHGLQAQPHLSNGNDMNDDHDGGGGGGGGGEGVEGDVPSDAGNDSDNRGGGDDADQLTLSFQGQVYVFDSVPPQKVQAVLLLLGAREVTPNPPAIPVATNQNQDLMGTPQRSNVPQRLASLIRFREKKKERNFDKKIRYAVRKEVALRMQRNKGQFSSSKPNNDESSSAVTTWESNQSWGPESNGSPHQEILCHHCGISEKSTPMMRRGPEGPRTLCNACGLMWANKGTLRDLSKAAHPGVQVSSLNRNEMQSANLGAD

SEQ ID NO: 961 - protein, 300 aa, Eucalyptus sp.
MYAHPHHVNLPKPIAGDEDGSGNSGGDSMEGSHIRYEPQALDDGATAGASMGGMIEDIPPDAVYVPGSGADMGMAGGEEASQLTLSFRGQVYVFDAVTPKKVHAVLLLLGGCELSSGTQSMDLALQNQRGVVDFPPRCSLPQRAASLNRFRQKRKERCFDKKVRYSVRQEVALRMQRNKGQFTSSKKSEGESGWGSAQDSGQDEAPQETCCTHCGTSSKCTPMMRRGPSGPRSLCNACGLFWANRGTLRDLSKRTQDHPLTSAEQCEGEVNNSDSGTGIHPNNSLVSFSKADSGALIAER

SEQ ID NO: 962 - protein, 333 aa, Eucalyptus sp.
MPGQNIMEEIDCGSFFDQIDDLLDFPSDDVEAGLPPIDHDSFPSFWSDQPQSLPGSGSGVGSVFEAHPGSDLSAHLSVPYEDIVQMEWLSNLMDDSFSSDPLTINDQDPSKAQPVSHAQFQTSSPISVLDSSSSCTDEKAAPRSPEAINLARCGRARSKRPRPRTFNPRPPVQLISPTSSVGENPQPVDSESHVESRPVIKIPRQVNPEQKKKKKIKFTMSTAAAAAASADTSQSSATAQAVRKCMHCEITKTPQWRAGPMGPKTLCNACGVRYKSGRLFPEYRPAASPTFIPSLHSNSHKKVLEMRSNVGDPEAMASPPELIPNRAVEMEYM

SEQ ID NO: 963 - protein, 372 aa, Eucalyptus sp.
MASADPEHLQARGPTRAEDDDDDDELENGGGGGGTDDFADKVEEAGRGYVDSVGDYEHRRRRGSSAGVGAGGGGVAPSRTSELTLSFEGEVYVFPDVSHEKVQAVLLLLGGRDIPTAVPTFEVPYAQSTMDVVDMSKRSNLSRRIASLVRFREKRKERCFDKKIRYTVRKEVAQRMHRKNGQFASIKEGSGAGSLDLAQSCHQDGTPPPETVARRCQHCGVSENATPAMRRGPAGPRTLCNACGLMWANKGTLRDLSKGGRNLSLDQTELGTPDVKPLIIDGQHFSSNKDDLSMQGISGETSTSDIKRLSDPSINPGGEVDNQMDFHGTAADLTSTLPMNIMHSSADDDEQGTLVELANPSDTDIDIPANFD

SEQ ID NO: 964 - protein, 545 aa, Eucalyptus sp.
MGKQGPCYHCGVTSTPLWRNGPPEKPVLCNACGSRWRTKGTLANYTPLHARAEPGDYEDHRFGRGKNISININKNKEVKVPKRKQYTDDMVFGGIMSDYNQGFQKFIDDDTSNRSSSGSAISNSDAQFGSADASDLTGPAQSVVWDSMVPSRKRTCVNRPKPSPVEKLTRDLHTILHEQQSSCLSGSSEEDLLLESEMPMGSVEIGHGTVLIRHPSGIARDEESEASSLSVDRKHYKRSEAYSRPASIPLYNNARMVSSPSAKPGMERSKNSSGQGMRVEHLRRDISQHEKLQGLGNHNSPLCHINLKELLNFEEFTRLLNDDERRQLLKYLPPVDNSQLPDSLEYLFDSPIFEENLSSFQKLLSEGVFDRSFLGVKAEDYKTLRRLALSSSMKCKWVECLQQLQDSKNTSGESTAGRYHANLARNLINGKRVRDIQSQNFPEAKMMMKSPKGGAWKGSCENKDLLDNDGSCFSPRSLFALPPDNSTLMLDSFPVIDESNDQDLLVDVPSNGSFAQAELLHPALSFGSQQASTGSSSGYPNALHP

SEQ ID NO: 965 - protein, 167 aa, Eucalyptus sp.
MEDKASMEVPPSEHLCYVRCNFCNTVLAVGIPCKRMLDTVTVKCGHCSNLSFLSTRTPLQGQCLDHPLSLQGFSSDFRRGQSSSSSSSTSGDQPLSPKAAPFVVKPPEKKHRLPSAYNRFMKEEIQRIKAANPEIPHREAFSAAAKNWARYIPHSPSGSAPGSSSHE

SEQ ID NO: 966 - protein, 191 aa, Eucalyptus sp.
MSVEMASERVCYVHCNFCNTILAVSVPSSSLYTMVTVRCGHCGNLLSVNMAGAVQSAPLPDTSQKQQPSSENMARGSGSSSSSRPNNNTSNKFSSFEPIEAEAPRMTPIRPPEKRQRVPSAYNRFIKEEIQRIKASNPDISHREAFSTAAKNLAHFPHIHFGLKLDGNKQGKADQAIAGDHQGTHKSHGFY

SEQ ID NO: 967 - protein, 214 aa, Eucalyptus sp.
MSSSSAFSPDPLSPNEQLCYVHCNFCDTVLAVSVPCSSLFKTVTVRCGHCTNLLSVNMRSLLLPPAPANQLHLGHSYFTPQNLLEEIRNVPSNMLMNQTIPNEPMMQLRGGIEDIPKPPPVVNRPPEKRQRVPSAYNRFIKDEIQRIKAGNPDISHREAFSAAAKNWAHFPHIHFGLMPDHQPVKKANLRQQEGEDVLMKDGFFTPTNVGVSPY

SEQ ID NO: 968 - protein, 172 aa, Eucalyptus sp.
MVKRDREDAEVEALAVANCLMLLPRVGESAVSNRESRSTERMFACKTCNREFSSFQALGGHRTSHKKQKLIPGGLFHLGCTADSSPAKPKRHECSICGLEFPMGQALGGHMRRHRAAMAEGLAAEAAKPVPVLKRSNSKRVMCLDLNSSLMEDDLTLRLGKVAPPLVLDLLL

SEQ ID NO: 969 - protein, 173 aa, Eucalyptus sp.
MVKRDREDTEVEALALANCLMLLSRVGKSADSPWLNHKSRPTERMFACKTCNREFSSFQALGGHRASHKKPKLSGDLFHLGRTADSSPAKPKTHECSICGLEFPLGQALGGHMRRHRAAMAESLATAEKPVPVLKKSNSKRVMCLDLNSSPTEDDLTLRLGKAAPPLVLDLVL

SEQ ID NO: 970 - protein, 265 aa, Eucalyptus sp.
MKPTIDLEVEAVSENDSEISSQVASNLSNQEPSMGPSNDSLANSSYLISPSAVGSGSETVFLDLSLGCSNDESSGRDSVGVAFSSTSECSNEPESHPAAAGPTTSRVFSCNYCQRKFFSSQALGGHQNAHKRERTLAKRAMRMGMFSSQRYSSLASLPLHGSPTVRDLGIKAHSSVHQVHQGMLQQTRPHDLSSGPRFGDGFLGVPIFIEDDDVELLWPGSFRQAAQAHAPQPSFVLTGGSNISFVGVNPPSDAGNSAPDLTLKL

SEQ ID NO: 971 - protein, 275 aa, Eucalyptus sp.
MALEAINSPTAASAPFQFMEEPLSSRFLEPLNKRKRSKRPHHPPSEDEYLALCLIMLARSGAAPKPNHHASPAPLPPPPPPAPTKPEEAAATATATAAPANNLSYKCAVCGKGFPSYQALGGHKASHRKSAAAAAAAAAAASSAGADEPSTSATNSGGGAAAASSSGGGRSHECSICHKSFPTGQALGGHKRCHYDGGASGSANSGVTTSEGVGSAAPPALGYDSGRRNFDLNVPALPEFPTGFIVSGDDEVESPHPSKKPRFSTPLKIKLSPEQ

SEQ ID NO: 972 - protein, 638 aa, Eucalyptus sp.
MAASSSSVPPFYRIQEGGDQLIQMEQHRHAQMEQHRHAPSAPLASSAAASAPPAPAPAPQKKKRNQPGNPYPDAEVIALSPKSLMATNRFVCEVCKKGFQREQNLQLHRRGHNLPWKLKQKGTNKEAVRRKVYLCPEPTCVHHDPSRALGDLTGIKKHYSRKHGEKKWKCEKCSKRYAVQSDWKAHSKTCGTREYRCDCGTLFSRRDSFITHRAFCDALAQENARHPPTLNSIGNHSIYGSTNMGLGLSQANRQIPSMMQGQGINHSNNNDISPLGRARSGQLFDHLLAPSIGTASSTFNQPLPSMGSPSPNSFLFQAQSNQSYNSQEQASPQQGLLQNKPFHGLMMQQMIPDHVKSNNNDPSPSSSVANIFNLGMLSSSSSNSNNNSSSTSSLLNSGLLVPDQHRFKSEIGSEGSNLLPRSIPGDHHQISSSGVPSLYSTSLLQTGNHHDFSPPHMSATALLQKAAQMGSSTSRTNTNNNASFLKTFASYSSSSGTKSDRSPLAPVSFTGIFGVDNNLQELVNCAFGGGQDHHQESAGDAYDGMYDNANKTGSEQSTTTHMGQHGLTRDFLGVGEIVRRVSNNVNNNGNNGGFMDVQREDDQRRQNQEKYGLMISDDKAISSSLDSAPTSQTFGDFR

SEQ ID NO: 973 - protein, 172 aa, Eucalyptus sp.
MVKRDREDTEVEALAVANSLMLLSRVGQSTDSNCKSWPTERMFACKTCNREFSSFQALGGHRASHKKPKLISGDLLRLGHEADSSPAKPKTHECSICGLDFPIGQALGGHMRRHRAAMLESLAAAATKPVPVLKKSNSKRVTGLDLNSSPMEDDLTLRLGKVAPPLVLDLVL

SEQ ID NO: 974 - protein, 175 aa, Eucalyptus sp.
MVKRDREDAGVEALARANCLMLLSQVGESTNSSSPNHKSRPTERMFKCKTCNREFSSSQALGGHRASHKKPKLISGDLLHLGHAAYSSPAKPKKHECSICGLEFPIGQALGGHVRRHRAAMLESLAAVATKPVPVLKKSNSKRVMGLDLNSSPMEDDLTLRLGKVAPPLVLDLVL

SEQ ID NO: 975 - protein, 175 aa, Eucalyptus sp.
MVKRDREDTEVEALARVNCLMLLSRVGESTDSASPDRKSRPTERMFACKTCNREFSSFQALGGHKASHKKPKLISGDLFHLGHAADSSPAKPKTHECSICGLDFPMGQALGGHMRRHRAAMLESLAAAAAKPVPVLKKSNSKRVTGLDLNSLPMEDDLTLRLGKVAPPLVLDLVL

SEQ ID NO: 976 - protein, 178 aa, Eucalyptus sp.
MALEALNSPTAAAPFGHDDADGHPWAKRKRSKRPRADPQDQPSEEEYLALCLIMSPAAAAAPGSSGRLHECSICHKAFPTGQALGGHKRCHYDGGSSSSAARAASSSEAGGPSHTTVSHREPIDLNLPALPEFWAGADESSNRDRKIQLSGEQEVESPHPAKRPRLFMDQEDVGSSQR

SEQ ID NO: 977 - protein, 190 aa, Eucalyptus sp.
MIFEKEDQILTIDERQDGLNPSDNYQEENEGDNQEEWLNLSLGTNSASTAGDSESQSRPASTKVFSCNFCMRKFYSSQALGGHQNAHKRERGAARRYQSQRMITMFGSHTNAPIIRSLGVRPHSLVHKPSRDGTAMVARFSDHNIGHAPGWPSFMFEDALDLMWPGSFRLDAQQSNPPSEPVKLDLNLRL

SEQ ID NO: 978 - protein, 234 aa, Eucalyptus sp.
MVAQLKNFDAALQELEEKKKNEVDPSSSIGSWMWNPSAAQEDDDSWEVRAFAEDTSNIMGATWPPRSYTCSFCRREFRSAQALGGHMNVHRRDRAKLHQSQFRPLANQNSPFASCSSPSSSTLLFPNQEFGYPGGGLCFLYQLPHPTGIFDPVKANAACLESTPAVLSISPYPPSPSVNFPMQSQGNNSSHHYSSSEAHSSAVVGSYNCRNTSSKCEDPENEEELDLELRLGHK

SEQ ID NO: 979 - protein, 241 aa, Eucalyptus sp.
MDLEYPEEFLGGAHDHHSQISKGKRTKRQRPASPSGGGCVGADAGVATGRAGFYVYECKTCSRVFPSFQALGGHRASHKKPKSTADPDQKIKPSTVVLGLDAIDDEDEGHSGKISPPLSAHVASHKGLHQASKPKIHECNICGSEFASGQALGGHMRRHRSAPPPTATSADATSPTNPPAAAAITTEKSRNILSLDLNLPAPTEEDHHHQAHRRRENSKFQFATSQQPIILASPALVDCHY

SEQ ID NO: 980 - protein, 246 aa, Eucalyptus sp.
MAELDYCQTKSRPGAAATRLKLFGFNVSDEEDSAVSDPITVGANGGGGGGGGKATPSGSPEGSVPVGGGGERKYECQYCCREFANSQALGGHQNAHKKERQQLKRAQLHASRNAAVSSLVRNPIISAFATPPHLLATVGPVVVTGGAPTSPSWVYVPRGAPPFQVSHGCVFTTGQGGGGRSPGGLVPYGGGAGDSTGSQVQNQVNGRAVLDGLSLSKFSKGSGGGGPGFDDALGLDLHLRLAPAAP

SEQ ID NO: 981 - protein, 247 aa, Eucalyptus sp.
MLPRNSDSGTENESSDFSTQVASDACVQEISVDPSKVTSATSLDQDDVSLDLTLFCHSNAPAEANAVGESNNTEAVDRASVVKLPRVFSCNYCKRKFYSSQALGGHQNAHKRERTMAKRAMRMGMFSNRYTSLASLPLHGATFRSLGIEAHSGVHHQNVVAPESRPAVLRGGAKFEKGCMGLPMFVEEDDVVPLFWPGSFRQLDTRDCTSDPSPSVDYVIKGSNVNFVQVTKLPQIETPSPDLTLKL

SEQ ID NO: 982 - protein, 267 aa, Eucalyptus sp.
MALEALSSPTAPSAPFQFMKDSSPAAAAAAASSSSSAYDLPLAEPWAKRKRSKRPHNPPSEDEYLALCLIMLARGGAGRTLPPPPPPAVSSEAAKVAYRCPVCDKGFPSYQALGGHKASHRKHASSASAAAGGDDQPTTSSTSAATTSSGVSGKVHECSICHKSFPTGQALGGHKRCHYEAPAPIPASFSAPSAAAAPAASGVSVSEGVGSTHTQSQGHREFDLNIPALPEFSPRFVVSGGVDDEVESPHPSKKPRFLAPAVKTEAA

SEQ ID NO: 983 - protein, 354 aa, Eucalyptus sp.
MGFRDYLATGKEEPCHQPPTFIEWLKPSISTSSPSSSSSSCLTEPVHLAKPSTFVDSPNSFHQQQQQEQRFLRETIQCLPLLSKLSETKPLKQEEGDEEEVTVVGEGRERQHGVGELRAANVAVGLHIGLPLGGVDCGYGDNLEKSKHGFDELLIKEAVHKRNLLHGYSGFNAESRFWIPTPAQILVGPMQFACAICSKTFNRYNNMQMHMWGHGSEYRKGPDSLKGTQPAAMLRLPCYCCAQGCKNNINHPRAKPLKDFRTLQTHYKRKHGAKPFMCRKCGKTFAVKGDWRTHEKNCGKLWYCTCGSDFKHKRSLKDHIRSFGRGHSPHPSLEGFEDEKECVTTGSEDELARS

SEQ ID NO: 984 - protein, 433 aa, Eucalyptus sp.
MIGNNAIISNPPSVPPPSDPFPDCLENNGNTTNKRKRRPAGTPDPDAEVVSLSPKTLLESDRYVCEICNQGFQRDQNLQMHRRRHKVPWKLLKRETPAVRKRVFVCPEPSCLHHDPGHALGDLVGIKKHFRRKHSNHKQWVCERCSKGYAVQSDYKAHLKTCGTRGHSCDCGRVFSRVESFIEHQDSCNMGRLGSDSHHNNLQPPCLSRTASSPSPSSDTNLNTPSWPTTRALALPKPAKDATIFSNPIVNKPSPKKDHHDDLHNLELQLSTSSNPTETISTNLPKRDEKYPPHLQLSISSLCTDCACERNSDCSRDQSTNQLRMAMAEKAYADEARQVAKRQIEQAERELANAKRMRQQAQAELQKAHALKEHARKKMSSAILQITCQVCKQKLQARELLRLAPGHESSLALSYMSSAITEGEVDNDINRVC

SEQ ID NO: 985 - protein, 471 aa, Eucalyptus sp.
MSGNGLFSVRDPVQEPKANPINKRRNLPGTPDPDAEVVALSPKSLMATHRFVCDICKKGFQRDQNLQLHRRGHNLPWKLKRRTKDREQPRKRVYICPETTCVHHDPSRALGDLTGVKKHYSRKHGEKKWKCERCTKKYAVKSDWKAHSKICGTREYKCDCGTVFSRKDSFITHRAFCDALAEESTKFNPSNFRNEPTLAPPPSAATIPDNFRILGPEFAIPHLNSCGFSGSSSSAFLASVFGSDRPEFVPTVPMSIFGSPSASFLGSGASVLELPQCVKEEEESKSSISDAVSSLYGSSDQNHPHQQSQGLMSATALLQKAAMLGATMANPPLLNDMGLGLMNSSSSYFPNTTNFCSLSQNLNESLLSSLSSTVTCSPGGDHVLVFGDSDSSSPTADTENTLSNMVMQANGNVSRPRVVQGKLNHALVEGNLTRDFLGVGGKPRTHVNQQGLADFASLGSLSADLSPVQFT

SEQ ID NO: 986 - protein, 493 aa, Eucalyptus sp.
MFHNSPPPNSPPSNAACSAVNPPEINAFSNSKRRRRPAGTPGNRRRQATAEKDGPGFTHQSSLFFSHDTIANQIKNTRSSNDLDLIKYFPLFFFPTDPDAEVVSLSPKTLLESDRYVCEICNQGFQRDQNLQMHRRRHKVPWKLLKRDRGAADQEQARRKRVYVCPEPSCLHHDPCHALGDLVGIKKHFRRKHSSHKQWVCERCSKGYAVQSDYKAHLKTCGTRGHSCDCGRVFSRVESFIEHQDSCTVRRAQPPEMQAAQPACSSQTASSTSPSSEANFGVPLSSFPGFRMPKPAEILFLNSDMYNPSTPSTHHNLELQLLPSSSLCGTRNLRENFADNLKLSIGTLSTDVNKDELAFTKRSSTMWDHYYGREPEMSEAASMREFASEQIKLAVAEKAFAEEARQQAKRQVEIAELELANAKKMRLQAQAELERAQLLREQATKKISSTIMQITCPACKRQFQTTSVGAAACDETSLAISYVSSATTEGEGE

SEQ ID NO: 987 - protein, 496 aa, Eucalyptus sp.
MVEMPNPSSQEVSSSDLSAPPAKKKRSLPGMPDPEAEVIALSPKTLLATNRFVCEICNKGFQRDQNLQLHRRGHNLPWRLRQRDSNAEPPRKKVYVCPEPGCVHHSPARALGDLTGIKKHFCRKHGEKKWKCERCSKKYAVQSDWKAHMRTCGTREYKCDCGMLFSRRDSFVTHRAFCDALAEESSRAQNNNSVQDEQNARRSGSAAAAASASSPPPPPLTPSTTVVSPVLSLQSSDLPENAIELVPSALASSSVAATATAPTGPDSSAVTGSNTAFTCIFPASAPPLPQASPSSLSLFLSSTASSLFSRPDQNQQHLYALPPQPAPTMSATALLQKAAQMGTAATNASLLRGLGLAISSPIASSSHEATLVTAGDGSTRWSSQGKVESSSEGAGLGLGLPSPPTLFGNRPMTVDFLGLGMGPAGGHTGRLSALLTSIDGGLSSDRGFSGGVPGVLFGGGGGGRERVDDLSRGSWEEFPESKPDGPDGPNGPPHYL

SEQ ID NO: 988 - protein, 519 aa, Eucalyptus sp.
MPTDLDNSSTASGEASVSSSGNQPPPQPPPPPSTTKKKRNLPGMPDPDAEVIALSPTTLLATNRFVCEICNKGFQRDQNLQLHRRGHNLPWKLRQRSGKEVKKRVYVCPEPSCVHHDPSRALGDLTGIKKHFCRKHGEKKWKCDKCSKKYAVQSDWKAHSKICGTREYKCDCGTLFSRRDSFITHRAFCDALAEESAKAQTQGQGPGQGSAPVKPNLQADPKVQKPASPPHPHPPPPPPRASAPPTVQSSAAVLSTVLADQAAGMQENPSQILEEPPVTSSLIGSSSSSTSSSSNSKTSTSVIAGLFASSTPSSSLQPPQQSTPYTDLIRAVAPPDRSDHGPASSVEPISLCLSTNHGSSLFGSAGQERRQYAPAPQPALSATALLQKAAQMGATATNASLLRGLGIVSSSTSAGQQENLQWNPNNVEHENASVAAGLGLALPCDGSSGLKELMMGTPTMFGPKHPTLDFLGLGMAAGGNPSGGFSGLMNSIGGSLDMAAAAASFGSGDFVGKDIGQSS

SEQ ID NO: 989 - protein, 585 aa, Eucalyptus sp.
MASTSSTQFFGLGDESQNQMMLQQQSSTTTSSTGPMQAPPKKKRNQPGTPNPDAEVIALSPKTLMATNRFICEVCNKGFQREQNLQLHRRGHNLPWKLKQKTTKDVKRKVYLCPEPTCVHHDPSRALGDLTGIKKHYSRKHGEKKWKCEKCSKRYAVQSDWKAHSKICGTREYRCDCGTLFSRRDSFITHRAFCDALAQESARHPSSLNTLGNNLYGNNIGLGLSHQVGSQLPILQTHNHPPSNMLRLGGASNSSNFSQPPHPMPPPPATFFKPEAADSLHDLPSHNPLSGLMQLPNLQGNSSASQSNLFNLSFFGNNAAAASDNATTATAAAANFPSQGFLGQFNGGNNGSNQPSGLFSDDRVGSGFSSLFNASAQNESVVAHMSATALLQKAAQMGSITSGNSSSLLGGLGSSSGGGGSAVNRQMGSVNFSGGSGSFPDSGGKLPPQMESESHLRGLISSFAGGSSSIFGGGGGHEHENSFSGFNESNMSLDHHHHHQDQSSASFCNVNDAKLHQNLTTSMGGSDKLTLDFLGVGGMMRKRTDGGFAHREQQQQQHGTINMSSLDRDRKSEQGSQPFGSSKMH

SEQ ID NO: 990 - protein, 384 aa, Eucalyptus sp.
MMLGEPHRPPNPTIDVPPWPILDDPTDDAVPHSPYSPYTLNAGYGGGCDSSPSAAGPGHFQDVMAALRRFLPSNRPDTDPDPDMTSSREADFPMDVYSCDNFRMYEFKVRRCARGRSHDWTECPYAHPGEKARRRDPRKYHYSGTACPEFRKGSCRKGDACEFAHGVFECWLHPARYRTQPCKDGAGCRRRVCFFAHTPEQLRVVTPQQSPRGAATQLPFMASPSTVSPEDSPPMSPMSAAVTHQSLSRSLGSSSVNEMVMASLRNLQLGKVKSLPSSWNANAHVTTAAATTASYGSPLRPGFCSVPTTPTRVPARPGIGYRDFWDQVEEEEEPLMERVESGRDLRAKMFEKLREESSLDRADPEHPSLGGGGPDVEWVSDLVN

SEQ ID NO: 991 - protein, 298 aa, Eucalyptus sp.
MDFGGGRKRGRLDASSNGNGGPKRSREEAETFSTGIGSKSKPCTKFFSTSGCPFGEGCHFLHYVPGGFKAVSQMLNLGGNPTLPHASRNAAPSYPEAPSPTAVKTRLCNKFNTAEGCKFGDKCHFAHGEWELGKPTGPSYDDPRGMVPPSGRYGGRNEPPPPGLAAAASFGASATAKISIDASLAGPIIGRNGVNSKQICRVTGAKLSIREHDSDPNLRNIELEGTFDQIKQASAMVHELIANVASASRPAMKNSAAHSAPRSNFKTKLCENFAKGSCNFGERCHFAHGTEELNKPGL

SEQ ID NO: 992 - protein, 336 aa, Eucalyptus sp.
MMIGESRHHPLHPTTVCIPPPLWPSLDDPADEISPAFDADHLAAVAAASSPYALQDIIAALRRHQSDPDSDGPDSPVDLYTSDHFRMYEFKVRRCARGKSHDWTECPYAHPGEKARRRDPRRHGYSGAACPDFRSGHCPMGDACELAHGVFECWLHPSRYRTQPCKDGLNCSRRVCFFAHTPEQLRVVPGQQQSPRSVESLSSSPPVSPMSLSLSRSPFRADPMGEMVASLRNLQLDKVKSMPCGGSTSGSPRASRIRPGFYSMPTTPTQSTPTARGLGCLDSWESPYEEEPAMERVESGRGLRVKMFEKLSKESSLDTARPESDPDVWWVSDLVK

SEQ ID NO: 993 - protein, 338 aa, Eucalyptus sp.
MADSGEAKQAEPGNLEETGDKQTSEQVCSFFRKPSRNKNIRKRMVEEDDDEDSKTESSVLHNQKKPQRTGNKLYFSTGSSKSSVSAESKVDSDKPIFQFESSKEIQVEHDSRATATLETETEFSKDARAIRERVLKQATNEISGKSKGTGDEKLYKGVHGYTDYKAGFRREQTISSEKAGGAHGPLRASAHIRVSARFDYQPDICKDYKETGYCGYGDACKFMHDRGDYKSGWQLEKEWDEAEKARKRNLALGGNDEDEEDVDQTEDEEDDELPFACFICREPFVDPVVTKCKHYFCEHCALKHHARNKKCFVCNKPTMGTFNVAQEIKKKMAAEGGK

SEQ ID NO: 994 - protein, 420 aa, Eucalyptus sp.
MMMMTMAAGGGDHHARSTPTVQIPPVWDPLDDPATGGCGGPYSPYSPYSPYSGGGNAGGAAGGGECCNDLTALRRFLPSNHHQDEEDEEDGRAPGEDGVLGCDEFRMYEFKVRKCARGRSHDWTECPYAHPGEKARRRDPRRFFYSGTACPDFRKGACKKGDSCEFAHGVFECWLHPERYRTQACKDGQSCRRRVCFFAHSPDQLRVLPAHQQQQQQQQQQQHSPKSATDSEFGSPVRPSAAAAAAFDSYFTKPWSASFISSPTSILTTSSPPISPPTNSPPMSPNQRGGCCGSPGSVSELVACMRNMQIAKMKMSPRGQMGGSLFGSPLRPGCHLAAPVTPRAESSPRYGQLGGGGGLFDLWESHRRCEEEPSMERVESGRDLRAKMYAKLSKENSLDGADLVGTGASPDVGWVFELVM

SEQ ID NO: 995 - protein, 429 aa, Eucalyptus sp.
MAFDAGIPMPRGSVADGPSLSPSDAMWQMTLRSNETIESGPYPERPGEPDCSYYIRTGLCRFGATCRFNHPSDRKLAIANARMKGEYPERVGQPECQYYLKTGTCKFGATCKFHHPRDKAGIAGKVALNILGYPFRPNEMECAYYLRTGQCKFGSTCKFHHPQPTNMMVSLRGSPVYPSVQSPTTPTQQSYPGVTSWSRASFIPSPRWQGPSSYTPLIVPQGMVSIPGWNAYSGQLGSVSSSDSQLIMMGQSQIFGSSGQSDSVNTGSPGAFSSYQSGSMPVGFYALQRDNIFPERPGQPECQFYMKTGDCKFGAVCRFHHPRERLLPAPDCLLSPIGLPLRPGEPLCIFYSRYGICKFGPSCKFDHPMGILNNLSASSPSGAPVRRMLASSSGTAALVLSESGPGNPRRLSLSETRQIPSDDNIDSDE

SEQ ID NO: 996 - protein, 522 aa, Eucalyptus sp.
MANHQLYGTAPPPGAAAKFNLAGLSTSPSTNLLLRKRMEMGSDPDASFLASSAFGGRSRSQSSADALPYSPADVVGYSSYAGGLGARSSWSHSHLHLHPDDVSPLLSGTKRPSQALYHQNVLDAQREIGQSEAWYSTNLLSKRPRLESASNLPIYPQRPGEKDCAHYMLTRTCKFGLNCKFDHPIWVPEGGIPDWKEAPLVTTVESLPQRAGEPDCPFFLKTQTCKFGLRCKFNHPRDKIIPSGTLDDTLNLPERLTEPPCAFYLKTGNCKFGATCKFHHPKDIKVAQVLQDTDAGELRDSLAENDRMVREVKLVKPLISLSPASSHNTKGLPIRPGEVDCPFYLKTGSCKYGATCRYNHPERNAIDLHVGIVPIVGASPARNPNFAAGSAASIYQAVDPILSQLMLGAGPTIYPQRPGQIECDYYMKTGVCKFGERCKFHHPIDRSAPTQAMANQSQQTVELTLAGLPRRKDAIVCPYYLKTGTCKYGATCKFDHPPPGELIAMAATQGQSASEGEEAKEK

SEQ ID NO: 997 - protein, 659 aa, Eucalyptus sp.
MCNGSSKGKLFPSSMGMEGEFHNKDGEAPRKCSALLELAASDDLSSFKSEVEEKGCDVDEASFWYGRRIGSKKMGFEERTPLMISALFGSTKVLKYIIETARADVNRSCGSDKVAALHCAAAGGSSSSLEIVKLLIEASADINSVDGNGNRPIDVLAPAGKSRCNSRNKFVRSLLKGENYVVEGDQSFDIEGEEKLVALPKEGGEKKEYPVDVSLPDINNGFYSTDEFRMYAFKVKPCSRAYSHDWTECPFVHPGENARRRDPRKYPYSCVPCPEFRKGSCVRGDACEYAHGVFESWLHPAQYRTRLCKDETGCTRKVCFFAHKSEELRPVYASTGSAMPSPKSFSANALDMTTLSPLSLNSPSLPLPATSTPPMSPLAASSSPKGMNLWHNKINLTPPSLQLPGSRLKTAMSARDFDFELEFLGLEKQASQRQQLIEEISRLSSPSHMWNSEFGRTAELKPTNLDDAFGSLDTSLLSPLQGSSMKTSTPTQLQSPTGLKISNLNQLRASYPSSSLSSSPVRKTSSFGFDSSSAVAAAVMNSRSAAMTKRSQSFIDRGAVGQRSGLIGPANSAPRMSNLSDWGSPDGKLDWGVQGDELNKLRKSASFGFRNNSMANPNNVASPSADEPDVSWVGSLVKDVAPPEGYPQYLYIEQEQMVA

SEQ ID NO: 998 - protein, 663 aa, Eucalyptus sp.
MEGESYFEKDEKYSNCSILLELSASDDLPAFERKAKEKGCNIDGASFWYGRRIGSRKMGLEERTPLMVASLFGSSRVVKYILESGKVDVNRACGSDKVTALHCAVASGSASAVEVVKLLLHASADANCIDGNGKKPIDVIALPLKSRGDSRRKLMELLLKGDNSDGEFESHEEKPIAAPQASKEGSEKKEYQFPVDISLPDINVGIYSTDEFRMYAFKVKPCSRAYSHDWTECPFVHPGENARRRDPRKYPYSCVPCPEFRKGSCQKGDSCEYAHGVFESWLHPAQYRTRLCKDETGCARKVCFFAHKPEELRPVYASTGSAMPSPKSYSSSGLDMSTLSPLSISSPSASLPVTSTAPMSPLAASSSPMSVNMWQSKANKLSPPMLQLSGSRLKTALSARDLDLEMELRGLESQMATQQHQLMEEISRLSSPSSCFSSRIGEVKPTNLDDVFGSPDPALLPQLQGLSRPSTPSQLQSPTGLQMRQNATQFRGAYQSNANALSSPAMKQAPSYGFDSSSAVAAAVMNSRSAAFAKRSQSFIDRGMACPGIANSSPMMSSAMSSWSSPHGKLDWGVQGDELNRLRKAASFKMRSSTGAGANTVSAAAMADEPDISWVSSLVKDVPSAEDAMFAAEKGQRTYGKDIRERITPWVEQLYREVPRMAM

SEQ ID NO: 999 - protein, 694 aa, Eucalyptus sp.
MSARQFSILLELSAADDLTNFKKAVEEDGYDIDESSLWYGRRIGSKKIGLEERTPLMIAAMFGSMSVLDYIIKSGRANVNKACGSDGATALHCAAAGGSVQSPEVVKLLLDSSANANSIDANGKRAGDLISEVSGSPFNSRRKTLDVMLTGGGTVEFVEETYNLPENLGSQIEGNEQRESPTARASKDGSEKKEYPVDLSLPDINNGIYSTDEFRMYSFKVKPCSRAYSHDWTECPFVHPGENARRRDPRKYHYSCVPCPEFRKGSCRQGDGCEYAHGIFECWLHPAQYRTRLCKDEIGCTRKVCFFAHKHEELRPLYASTGSALPSPRSFSPVAASLDMGSLSPLSLGSSSVRIPPTSTPPMTPSGASSPLGGSMWKSQINSTPPGLQLPGSRLRSALSARDMDLDVDLIDLENNYRLQKQLLEHFPDLSSPRGWNNSSSTTSAFPEYSGDMTGEISRLGVKPNNLEDSFRSLDLTLLSQLQGLSLDGAISQLQSPTGMKIRQNMTQQLYSNYTDKLSSSPRAMPSFGTDPSRASAAATLSSRSLAFAKRSHSFIERSTVNSQSGYSAGAASPTARMSSQNDWGSPDGKLDWGIQGEELNKLRKSASFGLRSSSNRFHASADSATATVGDPDMPWIQSLAKEAPSQNPGNFGAEHQQQQQQQQQQQYHLNSGGTELLPAWVEQLYADQEQMVA

SEQ ID NO: 1000 - protein, 704 aa, Eucalyptus sp.
MDAYEATRIVFSRIQSLDPENASKIMGLLLIQDHGEKEMIRLALGPETLLHSVVLKARKDIILPSNSPSTPSTPSSPSPFMSTNPISISSRPKGSNFSPSSLSNIPSPSSWGGGGGGGGSFSDLSSGDDLINSSSCLYGNGGSDTMIDELQLQDQLSFLNDNSPPLGPNSNPDMFCPQQDLLSSPTAVYGGAAAGWGAPVHRRSCSVSDVCSGSSEDPSCGVGWRPCLYYARGYCKNGISCRFLHSGGLGDAASVVGSPDGSASAVVGSPSKVDMMGQCHEAVLRSKSAQQQRLAAASQLIGSATFPYTPKSMNLLLHHQQNDAHRAAAAAALMMGDDFYKYGRSRLERSDFSVNGCVNPASRQIYLTFPADSTFKEEDVSNYFSNFGPVQDVRIPYQQKRMFGFVTFVYPETVKLILAKGNPHFVCDARVLVKPYKEKGKVPDKFRKQSQLVERGDFSPCGTPTGLDSRGGPFDLNLGARPFYNSQDMLWRRRFEEQADLQQALEYQSQRLMSLQLLDVKKHHHQRALSTGSPIPSPAQSPTLFNNPTFLNIPSVRSLGVTEENGSSPGLSDSQPLNYQSVIVSAGKDLTGSDKSNGNDKESSHTEDKGLAESLEHNLPDSPFASPTKASAEHFSSLTNVVSEAEKDGVGSASSSPNSNNPVSSPLIPGTSAMDMASFTSFNCQIPAIGMYAGAGGPTCPVGI

SEQ ID NO: 1001 - protein, 234 aa, Eucalyptus sp.
MDNAQQQPQPNSYPPPPPPQAVASGGPGAPPATPFHHLLQQQQQQLQMFWSIQRQEIEQANDFKNHQLPLARIKKIMKADEDVRMISAEAPVLFAKACELFILELTIRSWLHAEENKRRTLQKNDIAAAITRTDIFDFLVDIVPRDELKDEAAGLGAAAAMVGPPASGVPYYYPPMGQPAAPGMMIGRPALDPAGGVYVQQPPPPSQAWQSVWQTAAPDDGAYGKPGDLDGPGY

SEQ ID NO: 1002 - protein, 253 aa, Eucalyptus sp.
MDQQGHGQPPPIGVVPAAGQLPYGTMPYQPGQMIGPSSFPHIQPTSQPQPPGSQLAHNQLAYQQIHQQQQQQLQQQLQSFWANQYQEIDRVADFKNHSLPLARIKKIMKADEDVRMISAEAPIVFARACEMFILELTLRSWNHTEENKRRTLQKNDIAAAITRTDVFDFLVDIVPREELKEEGLGTVPGGVLPASGPVDGLPYCYVPPQQVCQAGPPGMFVGKGVVDPAMYPYMAQQMCPETSEQQQSPSDHQ

SEQ ID NO: 1003 - protein, 269 aa, Eucalyptus sp.
MLVMPGRAENIDPQLEQGTQSILHSSLYVQPWWHGARNSMSVTTEDGSNRQEEKHAKSVVSSMTLSTGEHLGVNSPRELVGHSIVLTSSLYSDPQFGGPLTSFYGPQAMVPHLYGVHGRMPLPLEMAEEPVYVNAKQYHGILRRRRIRAKAELDRKAVKGRKPYLHESRHRHAMRRPRGSGGRFLNTKRLDSDDSSFAAEKAVNSSVDLPTQFVKTSTAQGFQTRSMRADSTGSNGNASANGLSYQGISCLGAEKETLQLYEGPNGAYK

SEQ ID NO: 1004 - protein, 331 aa, Eucalyptus sp.
MQPKSKISNGVDAHPHSIQTSAVFTEPWWRGYNTISPADPGRNETHAPLGCINGGSESNGGQSQSNEERVEEDDDDDNVKGSGNPACSGAVGNQGQGPQNGHGAPTIITMRDDGLAQPPQLELVGHTIACASNPYQDPYYGGLMAQYGHQSMAYPFVGIPHARMPLPLDLAQEPVYVNAKQFQGILRRRQARAKAELEKKLIKVRKPYLHESRHQHAMRRARGTGGRFAKKSETDASNDAAEEKGTNSGPALSSQSASSSGSEPLAPDSSETWNSSSNHVAGRSQVHGTHRGHDYVNGNSQYKNHGHFQASAYSNERERDRFGQQPRERLL

SEQ ID NO: 1005 - protein, 156 aa, Eucalyptus sp.
MDPMDIVGKSKEDASLPKATMTKIIKEMLPPDVRVARDAQDLLIECCVEFINLVSSESNDVGNREEKRTIAPEHVLKALEVLGFGEYIEEVYAAYEQHKHETMQDSLKGGKWSNGAEMTEEALLAEQQRMFAEARARMNGGAAVPKQADVDSNVES

SEQ ID NO: 1006 - protein, 201 aa, Eucalyptus sp.
MTSSVHDISENGEADEQQKHSEQHESSPATGVPHPGVSLPNVQYATPPQLGAGHAMTPPAYPYPDPYYRSIFAPYDAQSYPQQPYGAQPMVHLQLMGIQQAGVPLPSDAVEEPVFVNAKQYHGILRRRQSRAKAELENKALKSRKPYLHESRHLHALRRARGCGGRFLNAKKDENQQSEVSSADKSQGNINLNSDKSDRSS

SEQ ID NO: 1007 - protein, 201 aa, Eucalyptus sp.; identical to SEQ ID NO: 1006

SEQ ID NO: 1008 - protein, 179 aa, Eucalyptus sp.
MAEAPASPMGGGSHESGGEQSPQSGGVREQDRYLPIANISRIMKKALPANGKIAKDAKDTVQECVSEFISFITSEASDKCQKEKRKTINGDDLLWAMATLGFEEYIEPLKVYLARYRELEGDTKGSARGGDGSARKDVSGGQPGQNVQYVQQASLNQPVGYMNPQFGQQGSVNYVNAHQ

SEQ ID NO: 1009 - protein, 772 aa, Eucalyptus sp.
MDTPEKTQIAAPPVSAHEDSPVFNFIRSLSPIKPVKSTHIAQTFTSLPFTALPSVFTSPHANFHKDPSFLRRHQSLDPSNPDCSSENHNIVCRNGDFINGISQRSKSSDKKVSVEVHAEPCKEHSDFATEFPQTSRCGFYNPEGNMTTCSAGAEAAVETAGMLTPIIPVAMKSSGKPLPEGEGQQQKEWPIDASDLFIFSSPNDVEAFRELVHRSPDFGTACLSSLMSRFTPDDVSGFERSQQVDLPSREQQQIEPPYPTDEAYGQKEAIKNLDYHNLDKFLDKYMSIQLDKNSHNDAGTCVPFDYTPVPNFHRGLRRRCLDFEIAELRKLSGDDSDYSHIALSQHDENTLVNDGQLPVESEGDPLRCTLPGIGLHLNALATTSNDYQSVEHGNLLSENQLMNTQISSSSLNLPNSHQSLHESLTSVASEDIGSADNGVLVVQDGSQSCAYPDSEELDHNSPQKKRRKAEHSEDTACKRCNCKKSKCLKLYCECFAAGVYCIEPCACLDCLNKPIHEDTVLATRKQIESRNPLAFAPKVIRASDSFPDTGDDSNKTPASARHKRGCNCKKSGCLKKYCECYQGGVGCSFNCRCEGCKNSFGRKDGSTLNGVEAEIIDEGKENIGKSVGNQRSLEVAKQRDPIQATPSAYYGPSIQTTYSAKNEPPRSTSLVTTSSSSVLHAGQNQGTHKHVAPQPEFEKHYDNDNNNSSNAGGKMPEVLRSNDTPNAVIKTASPNGKRVSSPHSDFGSSPPLRSGRRLILKSIPSFPSLTQH

SEQ ID NO: 1010 - protein, 793 aa, Eucalyptus sp.
MDTPERNQIAAPISKFEDSPVFNYINSLSPIKPVKSIRITQAFSSLTFGSLPSIFTSPHVSSSHKESRFLRSHQDSDPSNIGTSCKDENKIPTAERDVSDVAQLAENESELQENFDILVPIGESSVEPLDEHQEFALDLPQSLKYDCGSPNSDPTPCSTAADCTVSKSDAPVVEKNSQIDLPDGRSHQEGTSQQKNDTGCGWESLALESTDLLIFSSPNDAAAFRGLIQRSPDVEVGYFTSMVSNFPENEVSEELKKQLLYQLTFNEQHEAEEPSCQPVDPSEQKDTNTLPNGVAISNLDNHTGTYLSVNMDNEVGAHIPFANKPISDLPRGMRRRCLDFEMVGTQQKSLDSGSGGISSPLLKSDENDIPKNKQLVVVKGGGDSSRCIVPGIGLHLNALTSTTKDSRIVKHESLLSDVQALNVHMSTTSLQSPLTNQESLHKSLTLSNAEEMDHDNGLQVAEEVSQAPTDLNYEENGQTSPRKKRRRMENGGESETCKRCNCKKSKCLKLYCECFAAGVYCIEPCACQDCFNKPIHEDTVLATRKQIESRNPLAFAPKVIRSSESASEYGEDSSKTPASARHKRGCNCKKSSCLKKYCECYQGGVGCSINCRCEGCKNAFGTKDGSALRGPDCEEEEETEKCEKNKAEKIPWKMENENNDELNLASALPSTPSGFRRPLVQLAFPSKLKQPRSSFVTIGSSYALHSSQKMGKPDLLLPPPPKFEKLPLTNMEDEIPEILCSSSTPTASIKSTSPNSKRVSPPHSDFGTSPNLRSGRRLILQSIPSFPSLTPQH

SEQ ID NO: 1011 - protein, 368 aa, Eucalyptus sp.
MVIGSSSSNHNHQEDVERNPVAAAGATAGAAVPRSGGGGGSRSWGTTVSGQSVSTSGSMGSPSSRSEQAMATPASESTFLRMNHLDIQGDDAGSQGDVGGKKKKRGQRAAAGDKSGRGLRQFSMKVCEKVESKGRTTYNEVADELVAEFADPGNSAATPDQQQYDEKNIRRRVYDALNVLMAMDIISKDKKEIQWKGLPRTSLNDIEELKTERHGLRNRIEKKAAYLQELEEQYVGLQNLIQRNEQLFSTGNAPNGGIALPFILVQTRPHATVEVEISEDMQLVHFDFNSTPFELHDDNYVLKAMKFCETPGNDEMVPVFPSDGGEGSSMSGMYQPQPPYPPMSSAAGRPAASPPLPGILKARVKHEH

SEQ ID NO: 1012 - skipped

SEQ ID NO: 1013 - protein, 611 aa, Eucalyptus sp.
MMMFEDMGICGDLDFFSAPLGEGHGVAPQTEPEATVEDDYSDEEIDVDELERRMWRDKMRLKRLKEQNKGKEGVDIAKQRQSQEQARRKKMSRAQDGILKYMLKMMEVCKAQGFVYGIIPEKGKPVTGASDNLREWWKDKVRFDRNGPAAIAKYQADHSVPGKNDGCNPIGPTPHTLQELQDTTLGSLLSALMQHCDPPQRRFPLEKGVPPPWWPTGNEDWWPQLGLPKDQGAPPYKKPHDLKKAWKVGVLTAVIKHMSPDIAKIRKLVRQSKCLQDKMTAKESATWLAIINQEESLARELYPDSCLPLSSSGGSGSLVINDCSEYDVEGMEDEPNYDVQERKPENLNPPSHLGLERMRGPFVQQSPFPMKGEVVSNLDMARKRKPCNDLNMVMDHKIFTCEFLQCPYSELRLGFRDRTSRDNHQLSCPYRSNSSEFGGSNFHVNEVKPVIFPQGFVQSKPMTSTVNSASTPFDLSGLGVPEDGQKVISDLMSIYDTSIQGNKNMNPANDAIIEDQSRPQPKLQQQNEFVGSFFQQPNASANHHMFSREDIQFDRFKTMNSSFEANNHNHDNLQLMFGSPFDLSSFDFKEELPGGVMDPLPKQDVTIWFQQ

SEQ ID NO: 1014 - protein, 617 aa, Eucalyptus sp.
MGILEEMGFGSSIDFSSANPQEADAEQETEAVVEEEYSDEEVEVDVDELEKRMWRDRMLLKRLKEQSKNKEVLDGAKQRQSQEQARRKKMSRAQDGILKYMLKMMEVCKAQGFVYGIIPEKGKPVSGASDNLRAWWKEKVRFDRNGPAAIAKYRADHSIPGNGEDAATIGPIPHTLQELQDTTLGSLLSALMQHCNPPQRRFPLEKGVAPPWWPTGEEEWWPQLGLPADQGPPPYKKPHDLKKAWKVSVLTAVIKHMSPDISKIRKLVRQSKCLQDKMTAKESATWLAIINQEEALSRKLYPNSFPPVCSDSGFGSYVISDASDYDVEGADDEPKFEAEECKPFDPSAFGIGPRVSTGELLIHPLVSQIKGEVHETKTNSRLVSKRNQPSDEPKAKMDQKIYTCEFSQCPHSDHSFGFLDRTLRNNHQLSCPYRSKPIPSQAIGISNFQVNNGQQAAFLHSFAQPNPSPPPGTHTPSFNIRGIGLPEDGQKTISNLMSFYDVNLQQNSTSAGKLGAPSNEQQLLNVQHSMGDSLFAHGAFMGGKTHEEINLPLNHSVFPSMGSQHDQSKAFDSPFEFCLNDGTVDSRFGSPFSVTAAAADCNRMDLLPRQDGFVWYR

SEQ ID NO: 1015 - protein, 124 aa, Eucalyptus sp.
MEVGQMQRRLVEFTKSLFMEDSEKLLNDLTSALEQQNVDFKKVDAHVHQLKGSSSSIGAQRVKNACVVFRSFCEEQNLEGCMRCLQQVKQEFYLAKNKFETLFTLEQQIVAAGGSIPAMEITSF

SEQ ID NO: 1016 - protein, 149 aa, Eucalyptus sp.
MDVAQLKRQLFEYTTLLFHEGFLDEQFTQLQQLQDENNPDFVVEVVSLFFDDSQRLLNELAKALDQQNIDFKKVDAHVHQLKGSSSSIGAQRVQRVCIAFRNYCQDKNVEGCLKCLQQVKQEYSLLKNKLETLFNLEKQILAAGGSAPM

SEQ ID NO: 1017 - protein, 155 aa, Eucalyptus sp.
MEVGQMQRRLVEFTKSLFMEGFLDGQFLQLQQLQDESNPDFVVEVVSLFFQDSEKLLNDLTSALEQQNVDFKKVDAHVHQLKGSSSSIGAQRVKNACVVFRSFCEEQNLEGCMRCLQQVKQEFYLAKNKFETLFTLEQQIVAAGGSIPAMEITSF

SEQ ID NO: 1018 - protein, 155 aa, Eucalyptus sp.
MEVGQMQRRLVEFTKSLFRKGFLDGQFLQLQQLQDESNPDFVVEVVSLFFQDSEKLLNDLTSALEQQNVDFKKVDAHVHQLKGSSSSIGAQRVKNACVVFRSFCEEQNLEGCMRCLQQVKQEFYLAKNKFETLFTLEQQILAAGGSIPATEITSF

SEQ ID NO: 1019 - protein, 183 aa, Eucalyptus sp.
MGVTAASQFHVLAVDDSLIDRKLIERLLKTSSYQVTAVDSGSKALEFLGLNEQQPRNANATSVSPSYHHQEIEVNLIITDYFMPEMTGYDLLRKIKESNSYKDVPVVIMSSENVPSRISQCLEDGAEEFFLKPVQLADVNKLKPHLLRGRSKEHHPNSENRKDREEILSPERTRTRYDVPEVI

SEQ ID NO: 1020 - protein, 224 aa, Eucalyptus sp.
MGMAAAESRFHVLAVDDNIIDRKLIERLLKTSSYQVTTVDSGSKALEFLGLHEDDRSNSGSPSILTNNHHQELEVNLIITDYCMPGMTGYDLLKKIKESSSLRDIPVVIMSSENVPARISRCLEEGAEEFFLKPVRKSDLNRLRPHVMKAVSKDQKQEKHEEEEEEEKQEEKEIKSQKHQEQQQQQHQQQLSPRPSGNSKRKAMEENLSPDRTRPRYSDIAAVV

SEQ ID NO: 1021 - protein, 224 aa, Eucalyptus sp.
MTMAGEILRRQSPAEVDLCGGSGQELHVLAVDDSLVDRKVIEKLLKRLSCKVTAVDSGLRALQFLGLDGEKSSVGLDDLKVNLIMTDYSMPGMTGYELLKKIKESSAFRETPVVIMSSERILARINRCLEEGAEEFLAKPVQLSDVQRLKNFVMGGGEVCPDRRINKRRLEENNDNDDNENHAPSPVSPLCSRDWAVCSSSSSDSSSPSIAVSSSKRLKIHHQA

SEQ ID NO: 1022 - protein, 251 aa, Eucalyptus sp.
MARNGVASWRRRSSDQFDDPSPCGSEDVHVLAVDDSIVDRKVIEHLLKISSCKVTAVDSGIRALQFLGLGEEKAAGDFNGLKVDLIITDYCMPGMTGYELLKKIKESSALREIPVVIMSSENVLARIDRCLEEGAEDFIVKPVKLSDVKRLRDFMTRDVGDRVRSDREGTTHKRKLPESSDVSSSSPSVSSASSSSSSSLPTTPSRSPSPSPSVSLSEPSSPSPSTGSSGPCSPSSLESPTRRLKMTSCCD

SEQ ID NO: 1023 - protein, 309 aa, Eucalyptus sp.
MYQQKGGASSSLVPGNTMVHGQHLDSGANTMDSIGGGNNHSNNANLASKQRLRWTHDLHDRFVDAVAQLGGPDRATPKGVLRVMGVQGLTIYHVKSHLQKYRLAKYLPDSSSDGKKAEKKESADVLSDMDGSSGGMQITEALKLQMEVQKRLHEQLEVQRQLQLRIEAQGKYLKKIIEEQQRLSGALADGSADESGDKGQEDSKTDPPTPAPISESPIQDKSKDCAVAKSLSLDGSLSSHNHEPLTPDSGCNVSSPAESPDGERSAKKPRVTAGASHAKPEIVLHPIFESSLGYSYTNSSFKLPDQGSV

SEQ ID NO: 1024 - protein, 311 aa, Eucalyptus sp.
MFPRLIQPHEGLIGHPDDFVGGGGGGGGPGHRGDPCLVLTSDPKPRLRWTTDLHERFVDAVTQLGGASKATPKAIMRTMNVKGLTLFHLKSHLQKYRLGKQSGKEGADAPKDGSYLLENPGSGNSTPSLPSSDLNENYEVKEALRAQMEMQSKLHLQVEAEKHLQIRQEAERRYMAMLERACKMLADQFITSAIIDNENQKCQAYGVRMPRNPSIDPLGFYTHEVAAVHGTEDDLPPSLHSQRGDCSTESCLTSHESPRILALEESPAGGKKRPMGIDSTSAPLIWSEAKLKIQDVAVPQVSPHGLTGFGM

SEQ ID NO: 1025 - protein, 313 aa, Eucalyptus sp.
MREDDGGNWFTKWQVELPPPEELTPLTQSLITPDLALAFDIGRGPSSSNNSISVVGAKQRHLLPSPPPPPLPLPQQLSSSSRDSKTGAPAARQPGPVDFADSGDLGSGGGAGGGGDEPARTLKRPRLVWTPQLHKRFVDAVAHLGIKNAVPKTIMQLMSVDGLTRENVASHLQKYRLYLRRMQGLSGGGGGSSSADAATERLFASAPVPPHFLHPGRPSSDHFLALQHHQHLAAEAAAAAAIPQYHRQVGHFGLPPNGQFEHPLLQSRQGQIAHSMAAAMSMHNPIQSSVGESDSVKGSGERKVLTLFPTGDD

SEQ ID NO: 1026 - protein, 329 aa, Eucalyptus sp.
MYQQRSVPSSSLVRNNSFTEGQQLDCGADAMVPMNGGNSLSNNSNLASKQRLRWTNELHEQFVDAVAQLGGPDRATPKGVLRVMGVPGLTIYHVKSHLQKYRLAKYLPDSSSDGKNAEKKDSADIASNTDGSSGMQITEALKLQMEVQKRLHEQLEVQRQLQLRIEAQGKYLKKIIEEQQRLSGVLTDGSGLGDDCLESDKKSDPATPAPTSECPLQEKASEDHAPGKSHSIDESLSSHHEPQTPDSGCHVRPIAESPEGEKQAKKQRLTEDAAYAAEELFTPHPILDSGLNSYHQSHPAFLTREQFDPSLGISIANGEQPRKVSSGSL

SEQ ID NO: 1027 - protein, 341 aa, Eucalyptus sp.
MFHPKKPSGMNSHERGMCVQGDSGLVLTTDPKPRLRWTVELHERFVDAVTQLGGPDKATPKTIMRVMGVKGLTLYHLKSHLQKFRLGKQPHKEFNDHSIKDASALELQRSSASSSAMIGRSMNEMQMEVQRRLHEQLEVQRHLQLRIEAQGKYMQAMLEKACQTLAGESMVLHNSSGAGYHNHKTPSNMPNPMNSIGGGAPFVKDFGSSSPLNFPSFQDLNIYGGADQLDLHPNLDRPSLSLDSYHLPSNNNNSHDNSGFGKKRPSPFVTGGSGKNPLLWSADDLPEHGHDQIHTPEMVDSISVDIYEAKPPPALTGGGGGDEQKPLKPHRHDDHLFQQAG

SEQ ID NO: 1028 - protein, 353 aa, Eucalyptus sp.
MELFPAQPDLSLQISPPNAKSASWRRTAEEDVNLGFWKRALDSRSHHSLPSSMAAKNDARFDLSLSNPRAGHNAVGGNTIPEGNNNVSYNHLHQGGNHIHSFQNQSQYSNSNHHQHMHQHHHSVLQHQPQGLSQELGFLRPIRGIPVYHQNSSSAFPFATQLQHLDPSPIHHPNSSNSLTNTANSIASNLCHSHGLVRSRFLSRFPAKRSMRAPRMRWTTTLHARFVHAVELLGGHERATPKSVLELMDVKDLTLAHVKSHLQMYRTVKTTDRTAANSSGQTDVFDNGSSGETSDDLVIEVANPKRPELGRHDYQDTSQHGLWSNSSREAWLHGKPKDSGGSTPSVEVSIRKT

SEQ ID NO: 1029 - protein, 375 aa, Eucalyptus sp.
MRMELFPAQPDLSLQISPPNSKPTSTWRRSTDQEEANLSFWKKALDSRSSLSSMSKPDTRPELSPSSTTLFTGSGPDTHPLLQKRSSNSLVHRFQEKNHKTVYQQHLQHNPLGQEVETLRPIRGIPLYQNTSFPFSHHQQQQPLEVIANSSLSSLANNAAMSRSSSNRFHSHGLMRSRLASRFPGPKRSTRAPRMRWTTTLHARFVHAVELLGGHERATPKSVLELMDVKDLTLAHVKSHLQMYRTVKTTDKTAASSGQSEVLDNASSGDTSEDLVFEIGNSRGPETSIQQGELNNQEKDYYALKWSKSAREAWKQGKLPEDDFIGNCATYVEEDRNAKCPSNERISDVNSPNLSGTSNNMKPNLEFTLGRSSSH

SEQ ID NO: 1030 - protein, 419 aa, Eucalyptus sp.
MYHHNQHLGKNISPPSRMPIPSDRHMFIQGGNGPGDSGLVLSTDAKPRLKWTPDLHERFVEAVNQLGGADKATPKTVMKLMGIPGLTLYHLKSHLQKYRLSKNLHGQANSGNNKIGTVAVGGDRVPETNGSHVHNLNIVPQTNKNLPFSEALQMQIEVQRRLHEQLEVQRHLQLRIEAQGKYLQSVLEKAQETLGRQNVGSASLEATKLQLSELVSKVSTQSLNSAFPDLKELQGLCAQQIQTNPPTDCSVDSCLTSCEGSHKDQEIHNNGIGLRPYSGGSVLLDPKGITDEPRTEKIEFKWGGDPKEDRMFLSYGVKEMERSFPGGLGQGHLSMSIGLEGGLGCSEVKNKAKEVGGSVNFLERLHSRADSVNMDSNQRSCGNQLHYFEAKLDLNAREETDVASSGKQFDLNGNGFGWG

SEQ ID NO: 1031 - protein, 467 aa, Eucalyptus sp.
MLVVSPLRNPNDGSNNNQGEMESFSIGGGVGGSDDFPDFSDGSLLDSIDFDDLFMVINDGDVLPDLEMDPELLAEFSASCGEESGTGCSSISVEKAEVNNGSKREVDEDKASELDNISSVSRGEEIVSKRDDSVVVNPVPNNNEETDNKRKKSSAQSSKSNHQAQGKRKVKVDWTPELHRRFVQAVEQLGLDKAVPSRILELMGIDCLTRHNIASHLQKYRSHRKHMLAREAEAANWSQRRHMHGNGGQKMRPDTMLVMSHSTTPTNGSPWLAPATLGFPPVTPMPPHFRPLHVWGHPPADHSLMHVWPKHSPSLLPPPLPSAWASPPQGAAPYGHQRVPNPPMPGTPCFVNPPLPATRFGAPPVPGIPPHAMYKVERKHNNNNNNDNNNRGYGVPPPGPLASHPPFDFHPDYAFDEHSKETLDAAIGDVLAKPWLPLPLGLKPPSTDSVVGELQRQGVPKIPPSCA

SEQ ID NO: 1032 - protein, 557 aa, Eucalyptus sp.
MVCTASDLQEWKDFPKGLKVLLLDQDSDSASEIRSKLELMDYVVFTFCNEDEALSAIASKPDSFHIAMVEVSTSSNGSFEFLEAARDLPTIMMSNNHCLSTIMKCIALGAVEFLHKPLCEDKLRNIWQHVAHKAFNAGVSEVSESLKLVKETSVSMLQHQLKNEEQNNDESREMRKLSVHETDQEMSAASDKYPAPSTPQLKGGARLLDDGDCQDQTNGTVEKESGEQDGESKFVETTCDDSMSENIQEAQGQRDRDVLVKEEDDSANNSKCESMISPLSENKDRSHDVHGCNDNQSKASSLHNSARTRVNRKKMKVDWTPELHKKFVQAVEQLGVDQAIPSCILDLMKVEGLTRHNVASHLQKYRMHRRHILPKEDERRWPHSRDGVTRSYYPHRPIMAYPTHHPGHPLPPGAAYPVWGAPPSNHPAGMQMWGPPGYPPWPSPENWHWKTAYPAMQADVWGCPVMPSSHHGPSFAFPQNAPVCHPPDGLENSFAGNSFDYHPDEEVIDNIVKEAISKPWLPLPLGLKPPSTDCVLAELSRQGIPSIPPHADQLGPC

SEQ ID NO: 1033 - protein, 668 aa, Eucalyptus sp.
MSTLTSSCSWKAGDGVSDQFPAGLRVLVVDDDPTCLRILEKMLKTCQYQVTTCSRSDVALSTLRDNKNGFDIVLSDVHMPDMDGFKLLEHIGLEMDLPVIMMSADDGKQVVMKGVTHGACDYLIKPIRIEALKNIWQHVVRKRKNEWKELEQCGSVEDGDRPQKHLEDVDYSSTANEGSWKSGKRRKEEEDDAEERDDSSTLKKPRVVWSVELHQQFVSAVNQLGIDKAVPKKILELMNVPGLTRENVASHLQKYRLYLRRLSGVPQHQAGVNSSFIGTQDAGFGAISSLNGYEIQALAATGQLAPQSLATLQAAGLGRSAGKSGISIPMLDQRNLFSFDNPKLRFGEGQSQQNLGTNSKQANLLHGIPTTMEPKQLVNLQQSAQSFGSMSMPVHTHGAQSSSLLMPMGQPQARRHVISESGSSRPPVLQANMGQSIMSTGLVGQALGRSGTAENGRGLGHNTILQTSSAMNFPMNQVSDAPVSSFPIQSTFPTSKGGYPEDVNSSIIKGPGGGMPSYDILHDLQQIRSNDWEFQNVGVTFDTSQPGNSVQGNIDTSGLLLVHQGLSSGQSSNGHNRNISAAGKSLLSADGNRQVTTPNVGQPPTSLVDNPVQIKTEGFPDMSYQAVLYPEHYSQEDIMSAFLKQQQGIGPPDSEFEFDGFSVNNIPV

SEQ ID NO: 1034 - protein, 467 aa, Eucalyptus sp.
MTGMLHDEGSSPVTSSPLQIFSMMSLSPGIGSPYPLLREVSPEDRGLWLIHYLIGCANHVAAGSVDNANICLEQISHHASPDGDTMQRIAAYFTEALADRILKGWPGLHKALNSTKISPVSEEILVKRWFFELCPFLKLAYVITNQAILEAMDGEKMVHIIDLNSFEPAQWVNLLQSLSTRLEGPPHLRITGIHEQKEVLDQMALQLNEEAEKLDIPFQFNPVVCKLENLDLESLRVKTGEALAISSVLQLHTILAADDETQRRTSPSASNSSNSSHQQRALHMRQRTLGEWLEKDVVNLYCASPDSALVSSPKMGGFLTSLWGLSPKLMVITEQESNHNGTLMERYVEALYFYGSLFDCLESTVPRASVERQKVEKMLFGEEIKNIIACEGIQRKERHEKLEKWILRLELAGFGKVSLSYNGLLQAGRLLQNYGYDGYTLKEENGCLLLCWHDRPLFSVSAWRFRR

SEQ ID NO: 1035 - protein, 494 aa, Eucalyptus sp.
MDTLFRLVSLQSSDQSFNSSRTSSSSRSSRQNHHYHHQPEADEECLNIFMDEEDFSSSSSKHYSYPYHPATTSTTPTTTSSTHTPHTYDPADVSVSPARDLNFDFSSKWASDILLETARAIVDKNSTRVQHLMWMLNELCSPYGDIEQKLASYFLQALFSRMTDSGERSYSAWLAASDKTCSFESTRKMVLKFQEVSPWTTFGHVACNGAIMEALEGESKLHIVDISNTYCTQWPTLLEALATRTDETPHLRLTTVVVSKANGGAETSGVVAVQKVMKEIGSRMEKFARLMGVPFKFSVLYHSGDLSELNLDELDIKEDEALAINCVGALHSTTTVSNRRDFVVSSFRRLQPRIITVVEEEADLDVGVDGIEFVRGFQESLRYFRVYFESLDESFPRTSNERLMLERGAGRAVMDLVACPPHHSVERREPASRWSRRLRGGGFNPCLFSDEVCDDVRALLRRYKEGWSMTPCSDAGIFLTWKDQPVVWASAWRA

SEQ ID NO: 1036 - protein, 525 aa, Eucalyptus sp.
MQTSQKKSHLSMSNKICYQSALEIGTYCLPQFHTLDCYPSYCTLESSSASGGYAIYNPPSTISFSSDGSPVSLQDSVSYPPDALHSPDNTYASSISGSCVTDDANDFLHKLRELENVMLGPDSDISINNDRSFQKGIHVASPGSKLKDAIERKDLKRVLIASAKAVSENDLWTANWLMDELRGMVSVSGEPIQRLGAYMLEGLVARLASSGSSIYKALRCKEPESSELLSYMHILYEVCPYFKFGYMSANGAIADAMKNENRVHIIDFQIGQGSQWITLIQAFAARPGGPPHIRITGFDDSTSAYARGGGLEIVGKRLTKLAQLYKVPFEFHAALIPGSDLLLHHLDVRRGEALAVNFAFMLHHMPDESVSIQNHRDRLLRLVKSLSPKVVTLVEQESNTNTAAFLPRFIEAMDYYAAMFESIDVTLHREHKERINVEQHCLARDVVNIIACEGAERVERHELLGKWRLRFAMAGFTPFPLSSLVNGTIKTLLENYSHRYRLEERDGALYLGWMNRDLVASCAWK

SEQ ID NO: 1037 - protein, 548 aa, Eucalyptus sp.
MQTSHNRQNSAGIHGLYHQPVQDIDPYCSSNFQIMENNVSPDIGSQGTNFSIQGYDGQYFTLDSAPAVSSFGSYDSPSAVSVASNRSPFSTQGSHSYVSDAQHSSDYLYGSPISGSSVANGGPQMWDKLRELENSLLGPESDISDSCNCCLNSGSHQFPSTGQWNVNQMIEMIPKLDLKDMLIFCAQAVAEADMPKTAALMEVLERMVSVSGDPIQRLGAYLLEGLRARLESSGSIIYRKLKCKEPTGSELMSYMSILYQICPYWKFAYESANVVIGEAIKYESRIHIIDFQIAQGSQWIPIIQGLAGRTGGPPLIRITGVDDSQSAHARGGGLDIVGKRLEKVAELCGVPFEFHAAAMCGSQVEREDLRVRPGEAIAVNFPFVLHHMPDESVSTDNHRDRLLRLVKSLSPKVVTLVEQESKTNTSPFYTRFIETLDYYTAMFESIDVACRRDDKQRISAEQHCVARDIVNMIACEETERVERHELLGKWRSRFRMAGFQQFPLSSAVTDAVRNLLREYNENYRIEEKDGALYLWWRNRAMATSSAWW

SEQ ID NO: 1038 - protein, 628 aa, Eucalyptus sp.
MKRDHRDACSGGYGGGGGGEASGASKGEPPSSSSTHSLPGSGKAKMVMWGEDDQDPSGGGGGGMDELLAVLGYKVRSSDMAEVAQKLEQLEMVMGSAQEDGISHLSYDAVHYNPSDLSSWVQSMLFELNPPPPPQQVADAVLAAAESSSTIAQHHRSHLGSRSQTQTRTLSQTSAPTQTQSQVIFNDDSEYDLRAIPGVAAFPQGDSDFESAARKKMKTLNGGSNSLSSSSSSSAAGAAPSESTRPVVLVDTQETGVRLVHTLMACAEAVQQENLKLADALVKHIGLLAASQNGAMRKVATYFAEALARRIYRIYPNDGSLDSSCNDILQMHFYETCPYLKFAHFTANQAILEAFATASRVHVIDFGLKQGMQWPALMQALALRPGGPPAFRLTGIGPPQPNNTDALQQVGWKLAQLADTIGVEFEFRGFVANSLADLEPAMLDIRPPEVETVAVNSVFELHPLLARPGAIDKVLSSIKAMRPKIVTMVEQEANHNGPGFVDRFTEALHYYSSLFDSLEGSGVAPPNQDLVMSEVYLGRQICNVVACEGPDRVERHETLVQWQARMGSAGFDPVHLGSNAFKQASMLLALFAGGEGYRVEENDGCLMLGWHTRPLIATSAWQLAAATQ

SEQ ID NO: 1039 - protein, 672 aa, Eucalyptus sp.
MLAGCSSSTLLSPRHRLRSEPSAVAQFQACHFQLPSMSTQRLDLPCSFSRKENSRPQSLRPVSLSVEKTSIEATTTTCSLKQHIRLPPLATTSQGSIEGRREVKGEFWERGKSLKRFADRSSVDESYVSRAKRKRHGNSNEKPDYVGEGGENLSLGQLSGGSFWFQPSFSASPIPFSITCSQDDEERVCFVPSEVVSSPMPLSNNPWVESIVTKITDLGEKDVEISHGPVKEDSGSSASSDSQSLALRLNENMSEHEAGNGSGNPYPHEGFSLEASEENHHGEHHEFELVSLLTACVEAIGSKNIPVINHFIAKLGDHASPRGSTISRVIAYYTEALALRVTRLWPHVFHITTPREVDRVDEDSGMALRLLNQVSPIPKFIHFTSNEILLRAFEGKDRVHIIDFDIKQGLQWPSLFQSLASRSNPPSHVRITGIGESKQELVETGDRLAVFAGSFNLPFEFHPVVDRLEDVRLWMLHVKEGESVAVNCVCQLHKTLYDGSGGALRDFLRLIRSTNPVVLLMAEQEAHHNTSSLEVRVINSLRYYSALFDSIHSSLPLESAARVKIEELFAREIRNIVACEGSDRLERHQSFDEWRKLMEQGAFRCLETTERERIQSQMLLKMYDVDEDFIVSERGQDQAALTLSWQDQPLYTVSAWVPADVAGSSSSFSQPN

SEQ ID NO: 1040 - protein, 142 aa, Eucalyptus sp.
MKGGNSKSQSRNAALSVNKRKVTKKEKKVKDPNKPKRPASAFFVFMEEFRKQYKEKHPNNKSVAAVGKAGGDKWKSLSDDEKAPYIAKAEKRKVEYEKTMKAYNKRQAEGTKADEEESEKSMSEVNNEEEDEDGSEEDEDDD

SEQ ID NO: 1041 - protein, 142 aa, Eucalyptus sp.; identical to SEQ ID NO: 1040

SEQ ID NO: 1042 - protein, 154 aa, Eucalyptus sp.
MKGGKAKAETTRVDASLKRKGAGTQRAGKKTAKKEKAVKDPNKPKRPASAFFIFMEDFRVQYKQKHPNNKSVAAVGKAGGDKWKSMSEAEKAPFAAKAEKRKDEYNKKMNAYNKKSAEGTNGADDEESDKSKSEVNDEDDEDGDDSAEEDEDDD

SEQ ID NO: 1043 - protein, 159 aa, Eucalyptus sp.
MKGGKSKSDTKSARLSVNKKSTAKAGKKSGKAAKDPNKPKRPASAFFVFMEEFRELYKKDHPKNKSVAAVGKAGGDKWKSLSEAEKAPYIAKADKRKAEYEKNMKAYNKRQAEGPKEEDLESEKSVSEVNDDDDDEEEEEEGSGEEEDDEYEDSAGRIA

SEQ ID NO: 1044 - protein, 165 aa, Eucalyptus sp.
MKPTRSRAAARKGNKEAVKPVDDRIIGKRKAAIRADKSNNKRAKNVTSAKKDPNKPKKPPTAFFVFLEEFRIIYKQEHPKVKAVSAVGKAGGEKWKSMSHAEKAPYEAKAAKRKSDYEKVMAAYKKKQESTDDDEEAESETSKSQVNDKDDEESEEDDEEEEDDD

SEQ ID NO: 1045 - protein, 172 aa, Eucalyptus sp.
MKTTKGKGPARSSREALKPADDRMVGKRKAAARPESKRKVKKDKQAKKDPNKPKRPPSAFFVFLEEFRKTFKKENPNIKAVSAVGKAGGEKWKSMSQAEKAPYEAKAAKKKTEYEKLMNAYNKKQESVDEDGDEESERSKSEVNDEDEASAEEAQEDEEEEEEDDDDDDDED

SEQ ID NO: 1046 - protein, 242 aa, Eucalyptus sp.
MAGGGSSKSNAPKARKRVEVDAAAAAAAAASSSLVRGKDGSAFARCEECNKDVPVALISMHSCGLDAKIKMNLEAQVMERPAEAKKKPAVDRKRSSEPKAKKAKTEKKSKKGKDANAPKRPATAFFVFMDDFRKAYKEANPDSKGVKEVAKQGGEKWKSMSDEEKKPYLDKASELKAEFNKAMEAHNAGDGENEEGSDKEEAADEEAANEETAGEEAANEETAGEEAANEANEENEEVLEDE

SEQ ID NO: 1047 - protein, 418 aa, Eucalyptus sp.
MDSRDAPPPPGMVGVVGSTGSYPTGGPQQAPTQQQQQQQQPPQHLINPNSSAVMMQHRFPFNSMVASGPHPPPPPQQQQQQQQQHQQHQQAAQQEGGMDALGNAGGIYDGSSQSGLRPGGFSIEPAKKKRGRPRKYTPEGNIALGLGPASVHSSSGGDHHHHHHHGGGGGGGTSGGGGDGNLTGSSEPQSKKHRGRPPGMGKKQMDALGAGGVGFTPHVIHVDAGEDVASKIMAFSLQGPRTICILSASGAICNVTLKQPAMNGGTVTYEGRFEIICLSGSFLCPENESGRSRAGALSVSLAGPDGRVLGGGVAGLLIAATPVQVIVGSFLANSKKASSSALKSDASPTPQGPQSHMLNFGTAGTAVSPPSDGASADSSDENGNSPINHRPTGIYNNTSQPIHNMQMYHHLWAGQTPH

SEQ ID NO: 1048 - protein, 635 aa, Eucalyptus sp.
MTDGHLFNNISLGGRGGSNPGQIKIFSGGISWRRQGGGKAVEVDKSDIVGVTWMKVPRTNQLGVRTKDGLHYKFTGFRDPDVISLTNFFQNTCGLTPEEKQLSVSGRNWGEVDLSGNMLTFLVGSKQAFEVSLADVSQTQLQGKNDVILEFHVDDTTGANEKDSVMEITFHVPNSNTQFVGDENRPPAQVFRDRIMSVADVGAGGEDAVVTFEGIAILTPRGRYSVELHLSFLRLQGQANDFKIQYSSVVRLFLLPKSNQPHTFVIITLDPPIRKGQTLYPHIVMQFETDYVVQSTLSMNDDLFSTKYKDKLEPSYKGLIHEVFTTILRGLSGAKVTKPGKFRSSQDGYAVKSSLKAEDGVLYPLEKSFFFLPKPPTLILHEEIDYVEFERHAAGGSNMHYFDLLVRLKTEQEHLFRNIQRNEYHNLFNFISGKGLKIMNLGEQGADGVPGVLDVDDDDAVDPHLERIRIEAGVDESDEEDEDFVIDKDDGGSPTDDSGDDESDVSESGDEKEKEKYGKKESRKEVKASSSKKKAKAGDEEGSKKKKQKKKAPNAPKKAMSGYNFFLQTESEKMKRTNPGLSFGDVSREIADKWRGLSAAEKAPYTAKAEEDKKRYQEQLSGYKNTSQAMNVDSD

SEQ ID NO: 1049 - protein, 635 aa, Eucalyptus sp.
MTDGHLFNNISLGGRGGSNPGQIKIFSGGISWRRQGGGKAVEVDKSDIVGVTWMKVPRTNQLGVRTKDGLHYKFTGFRDPDVISLTNFFQNTCGLTPEEKQLSVSGRNWGEVDLSGNMLTFLVGSKQAFEVSLADVSQTQLQGKNDVILEFHVDDTTGANEKDSVMEITFHVPNSNTQFVGDENRPPAQVFRDRIMSVADVGAGGEDAVVTFEGIAILTPRGRYSVELHLSFLRLQGQANDFKIQYSSVVRLFLLPKSNQPHTFVIITLDPPIRKGQTLYPHIVMQFETDYVVQSTLSMNDDLFSTKYKDKLEPSYKGLIHEVFTTILRGLSGAKVTKPGKFRSSQDGYAVKSSLKAEDGVLYPLEKSFFFLPKPPTLILHEEIDYVEFERHAAGGSNMHYFDLLVRLKTEQEHLFRNIQRNEYHNLFNFISGKGLKIMNLGEQGADGVPGVLDVDDDDAVDPHLERIRIEAGVDESDEEDEDFVIDKDDGGSPTDDSGDDESDVSESGDEKEKEKYGKKESRKEVKASSSKKKAKAGDEEGSKKKKQKKKDPNAPKKAMSGYNFFLQTESEKMKRTNPGLSFGDVSREIADKWRGLSAAEKAPYTAKAEEDKKRYQEQLSGYKNTSQAMNVDSD

SEQ ID NO: 1050 - protein, 220 aa, Eucalyptus sp.
MNDLSEDDMALISELYPGVYMRPSPPPQEAKPPRRRRKKSRGLENPGEEGGGTGGEGRGKRKLTAEQVELLEQNFGDEHKLESERKDRLAAELGLDPRQVAVWFQNRRARWKSKKLEVEYAKLKSVHETVVVEKCRFESEVLKLKEQLSEAEMEIKRLSEKADLGLSGNSPCSSVTADAATDDPVWGDFGVAGECDDQDVLYYMPQNAYLQGLEWYNQYV

SEQ ID NO: 1051 - protein, 232 aa, Eucalyptus sp.
MKVHQFARGFFELEPTTLTLGCKRLRPLVPKLPHQTDVVSTAAFVDIKSFIRPESGPRRLGSSSDDKRDPPQVETHPGGTRWNPTQEQIGILEMLYRGGMRTPNAQQIEQITAQLSKYGKIEGKNVFYWFQNHKARERQKQKRNSLGLSHCSRTPTTAATIATVTLNTTKGSEGEIRGEEDSPYKRKCRSWAFDFSEVEEDVSRSSSSSFRDEDEAVHCRTLELFPLHPEGR

SEQ ID NO: 1052 - protein, 234 aa, Eucalyptus sp.
MFSTGEYSAAAFEGMDSLPSPRKKKNQLVNRRRFSDEQIRSLESIFESESRLEPRKKLQLARELGLQPRQVAIWFQNKRARWKSKQLERDFAILRANYNALYSRFESLKKEKQSLVTQIEKLNQLVEKPQGEGQSCGHDLATNSTDRESDNGVPKYEDSQPVFPDKLTRLMGIPCEDDYFGLEEEQSLLNMAEPDPEPAPADSSLTSPEPWGSLETDDLLNQSSGSSQWWDFWS

SEQ ID NO: 1053 - protein, 237 aa, Eucalyptus sp.
MGIDDLCNTGLVLSLGLETPFKIEAQRQAKQRLNFEPSLTLCLSGTTKATRDEQPPADHLYRQASPHSHNSLSAVSSFSSPRVKRERDLSSEEAEVETRVSSKASDEDDDGANARKKLRLTKEQSALLEESFKQHSTLNLTKLKQTEVDCEFLKKCCETLTDENRRLQKELQELKALKLAQPFYMHMPAATLTMCPSCERIGAGPSVDGAAPTKGPFSMTTKSHLYSHHFTNPSAAC

SEQ ID NO: 1054 - protein, 264 aa, Eucalyptus sp.
MGIDDLCNTGLVLSLGLETPFKIEAQRQAKQRLNFEPSLTLCLSGTTKATRDEQPPADHLYRQASPHSHNSLSAVSSFSSPRVKRERDLSSEEAEVETRVSSKASDEDDDGANARKKLRLTKEQSALLEESFKQHSTLNPKQKQALARQLNLRPRQVEVWFQNRRARTKLKQTEVDCEFLKKCCETLTDENRRLQKELQELKALKLAQPFYMHMPAATLTMCPSCERIGAGPSVDGAAPTKGPFSMTTKSHLYSHHFTNPSAAC

SEQ ID NO: 1055 - protein, 237 aa, Eucalyptus sp.; identical to SEQ ID NO: 1053

SEQ ID NO: 1056 - protein, 267 aa, Eucalyptus sp.
MEAGRFLFDPPALQGNILFLDKGSRSMMGMEESPKRRRFFCSPDELFDEEYYDEQMPEKKRRLTPEQVLLLEKSFEEENKLEPERKTQLAKKLGLQPRQVAVWFQNRRARWKTKQLERDYDYLKSSYDSLLSDYDSILKENEKLKLEVYSLTEKLQGKEVDGAPMTGPSEPAPLEEADVQAVQFSAKVEDRLSTRSGGSAVIDEEGPQLVDSGNSYLLCENYPGCVAQSEDDGSDDGQSYFPGVFAAATEQPHHEEEEEPMDWWVWS

SEQ ID NO: 1057 - protein, 267 aa, Eucalyptus sp.; identical to SEQ ID NO: 1056

SEQ ID NO: 1058 - protein, 276 aa, Eucalyptus sp.
MKRLSSSDSSDVWISMCSGKEEKVLKKSQGYSIEFQAMLDSLDQEDHSGEEAGLITEKKRRLSANQVKALEKNFEIENKLEPERKARLAEELSLQPRQVAIWFQNRRARWKTKQLERDFGHLKASYDSLKLDFDSLEQEKESLAAELTELKVKLRRETSESSNHCAVKHESPLSESSEDGKPGSCSGSVKEDPNPTPELPPSSAAPPLPLRYGSCSTSPPPPPPPPPPSSSRGTTAGRGYYHQVRMEENHPSGFISEESCNFFSVDQPPTLHWYFP

SEQ ID NO: 1059 - protein, 287 aa, Eucalyptus sp.
MMVEREDLGLSLSLSFSDSSRPSQLSASPFGFNLYKPSHRDCETFASLDRISEADARPSLRGIDVNRPPPSAADCEEQEEAGVSSPNSTISSVSGKRGEREMVSGGEDNEAERDCSRGGSDEEDGENSRKKLRLSKDQSAVLEESFREHNTLNPKQKLALAKQLGLRPRQVEVWFQNRRARTKLKQTEIDCEFLKRCCENLTEENRRLQKEVQELRALKLSPQFYMHMPPPTTLTVCPNCERVGAAAPPLPSAGGGGRPAHHREPVPMIPWAARPGPVSHGALRPRT

SEQ ID NO: 1060 - protein, 293 aa, Eucalyptus sp.
MAFFSPNFMLQSPHDQDHEHPHHQHQHQILSSCTPQDFHGVASLLGKRSMSFTGIDVGDDPNINNGNVNGEEDLSEDDGSQPGGEKKRRLNMEQVKTLEKNFELGNKLEPERKMQLARALNLQPRQIAIWFQNRRARWKTKQLEKDYDLLKRQFDAVKADNETLQAQNQKLQTEILALKNTREPAESINLNKETDQGSCSNRSENSSEIRLDMTRTPPVESPVSGHALPAAGRQLFPASMRPAASGGSVAQLFQNPSRPDLPMIVKEESSITNMFCGIEDHSGFWPWLEQQHY

SEQ ID NO: 1061 - protein, 308 aa, Eucalyptus sp.
MAGGGGCEGSAIASLLQNQRVSPSSDAFFFYGSSFSVGSRSMVSFEDASGANVSKNPFFQAFDPHEIGEEELDEYLHQPEKKRRLTTEQVHFLEKNFELENKLEPERKIQLAKDLGLQPRQVAIWFQNRRARWKTKHLEKEYEDLQASYNSLKADCDGLLKENDKLKTEVLVLTDKLLIKARGTQNSKLSNASSPGPPENPVACSKGEEERISTVPEDVCPGKSEISDSDSPNGGYSPLREHGDSSYAFEPDLSDSSQDEDYTRNENLQHLCVFPKLEETRDDYPILSTSSCHFGFPPEDQASWPWPY

SEQ ID NO: 1062 - protein, 309 aa, Eucalyptus sp.
MQEPNLAMMGGGGGGGGGGGGIVGGGGGGLGSEASFSGDHPQRQLKGEIASHPMYEQLLSAHVACLRVATPIDQLPLIDAQLAQSHHLLRSYASSVQHGHSSLSPHDRQELDHFLAQYLVVLCSFKEQLQQHVRVHAVEAVMACREIENTLQALTGMSLGEGTGATMSDDEDELQMDFSLDQSGADVHDLMGFGPLLPTESERTLMERVRHELKIELKQGFRSKIEDVREEILRKRRAGKLPGDTTSVLKNWWQQHSKWPYPTEDDKAKLVEETGLQLKQINNWFINQRKRNWHNNSQSVTSLKSKRKR

SEQ ID NO: 1063 - protein, 312 aa, Eucalyptus sp.
MGERDDLGLSLSLSFPQGHLHQQQQQQQRQSLQLNLMPSLVPSSASSAQSGFNLQKRSCNDAFPSSSDRNSEARSFLRGIDVNREPSAGAAADYGEDEAGVSSPNSMASTVSGKRSERDHQSQTNGDDLDNERASSRGGGSDEEDGDMSRKKLRLSKDQSAVLEESFKEHNTLNPKQKLALAKQLGLRPRQVEVWFQNRRARTKLKQTEVDCEYLKRCCESLTEENRRLQKEVQELRALKLSPQFYMHLSPPTTLTMCPSCERVAAPSPPSAVGRPLAAVPAHPRPVPLINPWAPAAAPLAHAPLDALRSCS

SEQ ID NO: 1064 - protein, 314 aa, Eucalyptus sp.
MAGGASASASAITTLLQNQRVPPPPPSDAFFLSGSSPFLGSRAMVSFEDAHRGNRLNRPFFRSIDPDENGEDDLEDYFHQPEKKRRLTVEQVQFLEKSFEVENKLEPDRKIQLAKDLGLQPRQVAIWFQNRRARWKTKQLEKDYETLQASFNTLKSDYDTLIKERNDLKAEVLNLTDKLLHKGNEKESSESSSKSQGLFQNPIADSVSEDEVSRVPIPTWPEDICSVKSDMFDSESPHYTDAAHSSLLEPGDSSYAFEPDHSDLSQDEEDNLSKSLLSTRNYPKLENSDYAILPPNSCNFGFHAEDPAFWPWSY

SEQ ID NO: 1065 - protein, 314 aa, Eucalyptus sp.; identical to SEQ ID NO: 1064

SEQ ID NO: 1066 - protein, 317 aa, Eucalyptus sp.
MAGEEPYSADTNSDTFADEETLIPSSSEALESAWVPTSSTAHHGSKSVVNFEDVCGGGDTNTAPRPYLRQIDLKEEAVEEDYGDGNFQPPGKKRRLSADQVHFLERHFEVENKLEPERKIQLAKDLGLQPRQVAIWFQNRRARYKTKQLEKDYDSLKARFESLKADHDKLIKEKENLKGEVLSLRDKLRSRAKGSEEGSLEADDSLRGATPKPTTPSTLDAVSYVDATILKQEDVSSAKSDVFDSDSLLEPANSSHVFEPDCSDFSQDEDDSFGKSLLPLDFLPRFDDGYAFQQNPPAISCNFAFPAEENPFWSWSY

SEQ ID NO: 1067 - protein, 324 aa, Eucalyptus sp.
MDEMYGLCGGGGGGGGGGGEEYSERALMSPENLVLPSEYQAWLCSAGFRDNRIPMYGFGSEEFVSSASGMSETASVTPDQEDAAETAIKSKIKSHPSYPRLLHAYIDCQKVGAPPEVVGLLDEIRPENGVCKRDAAVSTCLGADPELDEFMETYTDILVKYKADLARPFDEATTFLNAIEMQLTSLSTSTRTGASANEGDASSDEDFSGGEVEAPETQPRGEDRDLKDRLLRKFGNHISTLKLEFSKKKKKGKLPKEARQTLLEWWSVHNKWPYPTEADKIALAKSTGLDQKQINNWFINQRKRHWKPSENMQFALMDSIPGQY

SEQ ID NO: 1068 - protein, 343 aa, Eucalyptus sp.
MELGDQEQEREMPSSLGYTPPHKDSSSKFSAANRRDQTLDQPNHLYPQNHHPPNPHQLANKPRREYQETDQDPFAVASPSPIAVATGGTSVSIKPHTEPPSPPQGQLTQSPTPQPQSVTALISTSSIRYRECLRNHAASMGGHIIDGCGEFMPSGEEGTPGYFRCAACECHRNFHRKEVDGEPQYTPSLYYSSNKTNGQRAALPPPQHHAIPQPNPINLHHRFSYCISSAATTTTTMALNQPVMMAFGGGVPEESSSEDLTMIQHSDAMLRSTQLASSKKRFRTKFTQQQKDKMMECAEKLGWRIQKQDEQEVTQFCAEAGVTRKAFKVWMHNNKQAMKKQQR

SEQ ID NO: 1069 - protein, 343 aa, Eucalyptus sp.
MKRLGSSDSLGALMSICPPSEELQHSPRNGNPIYHSRDLQSMLELGLDEEGCVEDQSAGGGGHVGGEKKRRLSIDQVKALEKNFEVENKLEPERKVKLAQELGLQPRQVAVWFQNRRARWKTKQLERDYGVLKSSYEALKLSYDALKHDNEALHKEIKELKSKLREEDDNPESNLSVKEEVIIPGHDVSDKIRAADDGDDDTKRSPPPPITAPPRELSFNNGGLKDGSSDSDSSAIVNEENAATSSSSPNPAVQSHGGFLKFMGSSSSSASPPPPPPASFGGCFSFQFQRAYQPQPQPPHHHHHHSPYVKMEEHNFLGGEEDCNFFSDEQAPTLHWYCPDQWN

SEQ ID NO: 1070 - protein, 343 aa, Eucalyptus sp.; identical to SEQ ID NO: 1069

SEQ ID NO: 1071 - protein, 379 aa, Eucalyptus sp.
MEEYGQMNENSSTGSRGNNSFLYASPVLGPSSSGNSNYGRGNSSGGHFYSQSGDHCFQSEAPPHPVVKTEATTSHHGHAQKFHHYSLVRDHHDPSASHHHHHQHHQHQQLQTASESSREVDAMKAKIIAHPQYSNLLEAYMDCQKVGAPPEVVAKLSVARQEFESRQRSSVASADGSKDPELDQFMEAYYDMLVKYRDELTRPLQEAMDFMRRIETQLNLLSNNGPVRVFNSGVGSSEEDQDNSGGETELPEIDPRAEDRELKNHLLRKYSGYLSSLKQELSKKKKKGKLPKEARQKLLSWWELHYKWPYPSETEKVALAESTGLDQKQINNWFINQRKRHWKPSEDMQFMVMDGLHPQGAALYMDGHYIGDGPYRLGP

SEQ ID NO: 1072 - protein, 381 aa, Eucalyptus sp.
MEGGSNSTNSPSCLMAFGENGHHSGGGDGLCPMMMTMMPINTITSSSHPHPHPHHQHHHHHHHHHQNLNTSTHQYFLDQTARNSSSGSSPILDDRNNNSNNNAGGSGSGSGSGCFFMDNDVKAKIMAHPHYHRLLSAYVNCQKVGAPPGVVAKLEEACASAAIMAGNSGMSNTGCIGEDPALDQFMEAYCEMLTKYEQELSKPFKEAMLFLQRIECQFKALTLGVPSDSVALSEAFDRNGSSEEDDVNNFIDPQAEDRELKTQLLRKYSGYLGSLKQEFMKKRKKGKLPKEARQQLLDWWSRHYKWPYPSESQKLALAESTGLDQKQINNWFINQRKRHWKPSEDMQFVVMDATHPHYYMDTCSAIPFPWTSLRPCFEVYG

SEQ ID NO: 1073 - protein, 423 aa, Eucalyptus sp.
MAFHNHLSHQDLSSLHHFAADQQPPPPQHQQQQQHLPDSSSSVHHQLHHAAGPNWLNTALLRSDAAAAAAAAAGGNSFLNLHTSSDSAASPQAQQQPPATSASAAAGHHQWLSRQHSSLLQRNHSEVIDADSIIDSADLKESVSKGDGGGGGAAESNWENAKYKAEILAHPLYEQLLSAHVACLRIATPVDQLPRIDAQLAQSQHVVAKYSAMSQGLVADDKELDQFMTHYVLLLCSFKEQLQQHVRVHAMEAVMACWEIEQSLQSLTGVSPGEGTGATMSDDEDDQVDSDANLFDGSLDGTDSLGFGPLIPTETERSLMERVRQELKHELKQGYKEKIIDIREEILRKRRAGKLPGDTTSVLKQWWQTHSKWPYPTEEDKARLVQETGLQLKQINNWFINQRKRNWHSNPSTSTVLKSKRKR

SEQ ID NO: 1074 - protein, 606 aa, Eucalyptus sp.
MALAMHRECSSKQMDASKYVRYTPEQVEALERVYNECPKPSSLRRQQLIRECPILCNIEPKQIKVWFQNRRCREKQRKEAYRLQTVNRKLNAMNKLLMEENDRLQKQVSQLVYENGYMRQQLHSASTATTDNSCESVVMSGQHQQQHNPTPQHPEKDASSPAGLLAIAAETLTQFLAKATGTAVDWVQMIGMKPGPDSIGIVAVSRNCNGVAARVFGLVSLEPMKVAEILKDRPSWFRDCRCLEVLNVIPAGNGGTIELVYMQTYAPTTLAAARDFWTVRYTTTLEDGSLVICERSLTTSTGGPSGPSSSSFVRAEVLPSGYLIRPCEGGGAIIHIVDHVDLDAWSVPEVLRPLYESSKILAQKMTVAALRHIRQIAQESSGEIQYGGSRQPAVLRTFSQKLCRGFNDAVNGFVDDGWSVLSSDGVEDVTIAVNSSPNKFLGSQYNATIFPNFGRGVLCAKASMLLQNVPPAVLVRFLREHRSEWADHGIDAYSAASLKTSSYAIPCVRPGGFPSSHVILPLAHTVEQEEFLEVVRLEGHAFSPEDIPLAHDMYLLQLCSGVDENAVGACAQLVFAPIDESFADDAPLLPSGFRVIQLDPKTVKHP

SEQ ID NO: 1075 - protein, 659 aa, Eucalyptus sp.
MATYYTNSNQRDAAPALYLRESMHSSFPETPVLSGNMMLYMNPGPYADNPLGGNSQQQSNGMEVPSVGGIDSVQQQQQQQQEILSNFGGSRSGDQDFSLWRDGRNEMLLMPPLQSPHGQGLSLSLGTQIPSGIHMPSANLSSISFLGPIPMVSGDGGGRTGSERSRNADCAPAGFPGGDEDVNKGGDIPYGMSTIVRVIPNSRYLRVAQQLLDEIVNVRKALKRPDDANDQSRHENQRSPKDADGGSKNEASSNPQESASNSSELSAAEKQDLQNKLTKLLSMLDEVDKRYKQYYHQMQIVVQSFDTIAGSGAAKPYTALALQRISRHFRCLHDAITGQIQATRKSLGEQDTSNSNGISRLRYVDQHLRQQRSMQHLGIMQQHAWRPQRGLPENSVSILRAWLFEHFLHPYPKDSDKIMLARQTGLTRSQVSNWFINARVRLWKPMVEEMYKEEIGDPEMDSNSSSETAAKATGGDGRSSEDKGEDLQQSASSTATKRCGTGNFMDLKPPVVNPEMEISGPTFNSGTHGEVDAEYGFKLRGGHIPGGNDGILFSDSIVQSDGGNNRFMAAATAAYNVSNFGQFGGGTGVSLTLGLQHCDGGTLPLSNSMDHGIASMRGDGFYNAAASSVGAETMEFEGSSPGEQQHRLASNQLFHDFVA

SEQ ID NO: 1076 - protein, 758 aa, Eucalyptus sp.
MGVVDMSNNNPPTSRTKDFFASPALSLSLAGIFRDAGAAAAASASMDVEEGDEGSGGGGGRREDTVEISSENSGPARSRSDDEFDPDGDNDEDGGDGDKSKKKKRKKYHRHTAEQIREMEALFKESPHPDEKQRQQLSKQLGLAPRQVKFWFQNRRTQLKAIQERHENSLLKTEMEKLRDENKAMRDTIQKSCCPNCGSATTSRDTALTTQEQQLRIENARLKAEVEKLRTALGKYTPGTASPSCSAGNDQENRSSLDFYTGIFGLDKSKIMELVNQAMEELKKMATAGEPLWIRSVETGREILNYDEYVKEFKVEAPSEGRPKRSIEASRETGVVFVDLPRLVQSFMDVNQWKEMFPCMISKAATVDVVCSGEGPNRNGAVQLMFAELQMLTPMVPTREVYFIRYCKQLSAEQWALVDVSIEKVEDNIDASLVKCRKRPSGCIIEDKSNGHCKVIWVEHLECQKTTVHPMYRTIVNSGLAFGARHWMTTLQVQCERLVFFMATNVPTKDSNGVATLAGRKSILRLAQRLTQSFCQAIGASSYHSWTKVPTKTGEDIRVASRKNLNDPGEPLGVILCAVSSVLLPVSPHLLFDFLRDESRRSEWDIMASGSPVQSIANLAKGQDRGNAVNIQTMKNKDNSMWVLQDCCTNAYESMVVYAPVDITGMQAVMTGCDSSNIAALPSGFSILPDGIESRPLVISSRHEEKSSEGGSLLTIAFQILTNTSPTAKLTVESVESVNTLISCTLRNIRTSLQCEDG

SEQ ID NO: 1077 - protein, 837 aa, Eucalyptus sp.
MMAVTSACKDKMGIDNGKYVRYTPEQVEALERLYHECPKPSSLRRQQLIEKCPILSNIEPKQIKVWFQNRRCREKQRKEASRLQAVNRKLTAMNKLLMEENDRLQKQVSQLVYENSYFRQQTQNATLATTDTSCESVVTSGQHHLTPQHPPRDASPAGLLSIAEETLTEFLSKATGTAVEWVQLPGMKPGPDSIGIIAISHGCTGVAARACGLVGLEPSRVAEILKDRPSWYRDCRAVDVANVLSSGNGGTVELLYMQLYAPTTLAPARDFWLLRYTSVMEDGSLVVCERSINNTQNGPSMPPVQHFVRAEMLPSGYLIRPCEGGGSIIHIVDHMDLEPWSVPEVLRPLYESSTLLAQRTTMAALRNLRQISQEVSQPNVTGWGRRPAALRALGQRLSKGFNEAVNGFMDDGWSMLESDGVDDVTLLINSSPAKMAGVNISYASGFPSMTSAVLCAKASMLLQNVPPAILLRFLREHRSEWADSSIDAYSAAAIKASPCNMPGTRIGGFGSQVILPLAHTIEHEEFMEVVKLENMGHYRDDMIMPSDIFLLQLCNGVDENAVGTCAELLFAPIDASFSDDAPIIPSGFRIIPLDPGSDASSPNRTLDLASALDVGPTGNKAVGDNSGHSGNTKSVMTIAFQFAFELHLQENVASMARQYLRSIIASVQRVALALSPTNLGCHASLRPPPGSPEAHTLARWICQSYRSFLGVALLKNEAADSLLKNLWHHSDAILCCSLRAAPVFTFANQAGLDMLETTLIALQDITLEKIFDDNGRKTLCSEFPQIMQQGFMCLQGGICLSSMGRPISYERAVAWKVLNEEETAHCICFMFVNWSFV

SEQ ID NO: 1078 - protein, 837 aa, Eucalyptus sp.
MMAVTSACKDKMGIDNGKYVRYTPEQVEALERLYHECPKPSSLRRQQLIRECPILSNIEPKQIKVWFQNRRCREKQRKEASRLQAVNRKLTAMNKLLMEENDRLQKQVSQLVYENSYFRQQTQNATLATTDTSCESVVTSGQHHLTPQHPPRDASPAGLLSIAEETLTEFLSKATGTAVEWVQLPGMKPGPDSIGIIAISHGCTGVAARACGLVGLEPSRVAEILKDRPSWYRDCRAVDVANVLSSGNGGTVELLYMQLYAPTTLAPARDFWLLRYTSVMEDGSLVVCERSINNTQNGPSMPPVQHFVRAEMLPSGYLIRPCEGGGSIIHIVDHMDLEPWSVPEVLRPLYESSTLLAQRTTMAALRNLRQISQEVSQPNVTGWGRRPAALRALRHRLSKGFNEAVNGFMDDGWSMLESDGVDDVTLLINSSPAKMAGVNISYASGFPSMTSAVLCAKASMLLQNVPPAILLRFLREHRSEWADSSIDAYSAAAIKASPCNMPGTRIGGFGSQVILPLAHTIEHEEFMEVVKLENMGHYRDDMIMPSDIFLLQLCNGVDENAVGTCAELIFAPIDASFSDDAPIIPSGFRIIPLDPGSDASSPNRTLDLASALDVGPTGNKAVGDNSGHSGNTKSVMTIAFQFAFELHLQENVASMARQYLRSIIASVQRVALALSPTNLGCHASLRPPPGSPEAHTLARWICQSYRSFLGVALLKNEAADSLLKNLWHHSDAILCCSLRAAPVFTFANQAGLDMLETTLIALQDITLEKIFDDNGRKTLCSEFPQIMQQGFMCLQGGICLSSMGRPISYERAVAWKVLNEEETAHCICFMFVNWSFV

SEQ ID NO: 1079 - protein, 843 aa, Eucalyptus sp.
MAMTMVPHRESSSGSINKHLTDSGKYVRYTAEQVEALERVYSECPKPSSLRRQQLIRECPILSNIEPKQIKVWFQNRRCREKQRKEASRLQTVNRKLTAMNKLLMEENDRLQKQVSQLVCENGYMRQQLHTTSATTTDASCDSVVTTPQHSLRDANNPAGLLSIAEETLAEFLSKATGTAVDWVQMPGMKPGPDSVGIFAISQSCSGVAARACGLVSLEPTKIVEILKDRTSWFRDCRSLEVFTMFPAGNGGTIELVYTQIYAPTTLAPARDLWTLRYTTTLENGSLVVCERSLSGSGAGPNPASAAQFVRAEILPSGYLIRPCEGGGSIIHIVDHLNLEAWSVPEVLRPLYESSKVVAQRITIAALRYIRQIAQETSGEVVYGLGRQPAVLRTFSQRLSRGFNDAVNGFNDGGWSLMNGDGAEDVMIAVTFSKKLNTTSNPANPLSFVGGILCAKASMLLQNVPPAVLVRFLREHRSEWADFNVDAYSAASLKASPFGYPGMRPTRFTGSQIIMPLGHTIEHEEMLEVIRLEGHSLAQEDAFVSRDIHLLQICSGIDENAVGVCSELIFAPIDEMFPDDAPLLPSGFRIIPLDSKSSDVQDSLTTNRTLDLTSSLEVGPASTNCVGDVAPSHGARSVLTIAFQFPFDANTQDNVAVMARQYVRSVISSVQRVAMVISPSGLGPSINPKLSQGSPEALTLANWICQSYSLYLGTELLGSDLLGADSMLKTLWSHQDAILCCSLKSIPVFIFANQAGLDMLETTLVALQDITLDKIFDESVRKELSPEFAKLMQEGSAYLPSGICMSTMGRHVSYEQAIAWKVLSAEENTVHCLAFSFVNWSFV

SEQ ID NO: 1080 - protein, 304 aa, Eucalyptus sp.
MAQRSAPAPFLTKTYQLVDDPATDDVISWGESGRTFVVWKTAEFAKDLLPSSFKHNNFSSFVRQLNTYGFRKIVPDKWEFANDRFQRGQKELLSEIRRRKSAATPPNPPASGAAKSAAGAAGGQASPESSGEDMGSTSTSSPADSKNAGSVETAAVAAAAAATATATAAQFADLTGENEKLRRDNEALNSELAQAKKHCDELVAFLTECLKVAPDQIDRIVRRGCRGAAAFAAAGDGADGVDRDDDDDDEKAAAEVDGEKSTKLFGVWLNGKGKEARKRAREDKVGPVGMEFRQPLMKTSKVCN

SEQ ID NO: 1081 - protein, 329 aa, Eucalyptus sp.
MYTSVHGMEAAAAAANGDAIAPFVMKTYQMVSDPATDNLIAWGKANNSFIVVQPLDFSQRLLPAYFKHNNFSSFVRQLNTYGFRKVDPDRWEFANQWFLRGQKHLLRNIVRRKHSKGAYSQSKGGGDADMDEEELASEIARLRQEQRALEEEIRGMSKRLEATERRPQQMMAFLYKVIEDPELLPRMMGERDRNKRLAVASGDKRQRLMISSAAVSSSSSSGMGVSSSIKSEDDEEGTNFGVMSSPEVEGNLDISRFCDFAAVPASSSSASIDGGIGRNMAFSPPYNDVGGYGGVANNQFGYFTEMAVAGGEASPPTPPYPFSLLGGGF

SEQ ID NO: 1082 - protein, 341 aa, Eucalyptus sp.
MPGEQTGDSPVAGDSQRSLPTPFLTKTYQLVDDPGVDDLISWNEDGATFIVWRPAEFARDLLPKYFKHNNFSSFVRQLNTYGFRKVVPDRWEFANDCFRKGEKALLRDIQRRKISPTAAAAGAAAVTVAAVGVAGLTVSPANSGDEQVISSSSPPVALATAAVAAASPSVVHRSPSCTTAPELLEENERLKKENMQMSQELSQLRGLCNNILSLMANYVSRQSDSSSAAPEGQALELMPARQAEAAEDCAGPPSAAALEEDDDEEAATVAPRLFGVSIGGKRQRIEENSSNGGDEEMREADQAAPVPPDEREPGGEVKSEPLDGSRDHHGGEDPSWLELGK

SEQ ID NO: 1083 - protein, 365 aa, Eucalyptus sp.
MAQLMVDKCGEGLLVAVEAQKAVPAPFLTKTYQLVDDPSTDHIVSWGDDDSTFVVWRPPEFARDLLPNYFKHNNFSSFVRQLNTYGFRKIVPDRWEFANEFFRKGEKHLLCEIHRRKTAQPQLTHHHPHSASPLSGPTPAFFPFPSRLSISPSDSDDQHSSHWCDSPPPPPPPPLSSPRSGCGGHNNSVGPVASAANYNSSAVTALSEDNERLRRSNNMLMSELAHMKKLYNDIIYFVQNHVKPVAPSTYSWSPPSMVQKPSNQLLGYNNYANAIAAPNNNSCVVTNHVKPVVRSNSNVTQSSLTILEDPPVMNKMKLFGVPLLSKKRLHPEYNSSPVGYMETNKARLVLEKDDLGLNLMPPSTC

SEQ ID NO: 1084 - protein, 389 aa, Eucalyptus sp.
MEMKGGVVPKEEEASSDVGQPPPPPPPPPQPMEGLGEAGPPPFLTKTFEIVEDPATDPIVSWSEGRNSFIVWDAHQFAATLLPKHFKHGNFSSFIRQLNTYGFRKVDPDRWEFANEGFLGGQRHLLKTIKRRRNVLHSPRQPGGACVELGHYGLDSELERLRRDRGLLVAEVARLRQQQEQSRDHIFAMEQRIQRTERKQQQMLAFLAKACNNPSFIRQLMQRNARGRDIRGVEIGHKRRLTATPSLENLQDEDTVAALGRGGAGDSAIPMQEEMVTLESEMQTMFSAALDDESSSDVNELSAAPVLATRGGNTDAVNQTILEELLSEDLMTGNPEEEILVGDRPEIDMEAEDLVPGRRNASEESQDLSQLEAVTPSSSLRQDKFMEEW

SEQ ID NO: 1085 - protein, 393 aa, Eucalyptus sp.
MVKPSGGGGDRAPPLAPFLSKCYEMVEDEATDPIIAWGSAGDTFVIWDITQFTLQLLPHYFKHSNFSSFMRQLNIYGFRKVDSDRWEFANDGFIKDQKHMLKNIRRRKNVQVVDQKKSLQKQDNSVEEVDKIKIDGLWKEVENLKIDKTVLSLELGKVRQLQETSDNKLVLLRDRVQGMENNQQQMLSFLVMAMQNPGFLVQLVKLKDNHCRVTEMGNMLEPQGAENGSWISEGTIVKYQPPTDGKTNPELSPLSGLGETPKSGPSFDGTRDVLMNNDLMSMLMNEKFSLDTPLIFPDSPDDNAWEKLLLACPFIESASEKRQDNEGPNYLGMETEPAFSGASSVSTDFEALMRMMGNPQEAETESDVDGDDWEDAPNVDFLAEQLEYLASKA

SEQ ID NO: 1086 - protein, 484 aa, Eucalyptus sp.
MDAAPPGGGGGGGGPAPFLLKTYEMVDDAGTDEIVAWSSGKTSFVVWNPPEFARLLLPTYFKHNNFSSFIRQLNTYGFRKIDPERWEFANEEFVKDKKHLLKNIHRRKPIHSHSQPQGSMVDSERAAYEEELEKLNRDKSALEAKIVRLKQQQSIGKLHMGELFQRVGGMERRQEDLLAFLEKNLQNPNFVEHLTRKVKSLDLSAYKKKRRLPHTDHGRPGAENSLDTHSSSRLELGNIFQQDFSNKLRLELSPAVSDINLVSNSTHSSYEDGGSPRRITSESDPKDAPMGTESLLSAPEAVELSDTGTSFTFKMDSSMQRKPPVDESPRMHPLPMNLTTEEGDNNVSCQLNLSLASSLLQVDHSQQFNRLNVLGSETSKSPDARSNASITESGFGVLQKNKNSDEERTNSSLPEAQNNNQPIAPASGRINDVFWEQFLTERPGALENEEACSSYRENSYDVHGDQRPGPGMSRNSKSMERLTL

SEQ ID NO: 1087 - protein, 507 aa, Eucalyptus sp.
MALACRFPKPSSKNQVLSWKRQKPFAKSREEIASVAVLDGGDHGEIGSQSPLYLNLTRTDSPRSQSKPRAGELGCCGSLSHSGHLPEVAIGDGKIGAGSCLHSCLTRPEPCSALAVKAAKIKEEVEEEEVPTIADPRDATILLPSCSWQAVADGVAKPMEGLGEAGPTPFLRKTYEMVSDPGTDPLVSWGLRRDSFVVWDEQEFSKQVLPRYFKHSNFSSFIRQLNTYGFRKIDPDRWEFANRGFHKGKKHLLKNIKRRRRSNEHRETSSSTVTSDYQKAENEVELKTLKKDQEALKTRILKLREERENFQREIEHVTERVRHAECRNQQIFLFLTKAAKRPNFVQHLIQKKRQKRDLETCESSKKSKLLGPDAEATKCLNEAMDHMIQSPNVDCLRISDDLAQMEHWPNRVMPEDFDTIQMPNPWPSMDVEDFRVSLGQTPDQMARAGPSDLSSVFHEMSEKLLREDVVAGDDADNIEVEDHLTVNDMGIYLELEGLTDGLGTRVN

SEQ ID NO: 1088 - protein, 963 aa, Eucalyptus sp.
MKADDALPDHLRCNRTDGRQWRCNRPVMEDKKLCEIHYLQGKHRQHKEKVPESLKIQRRTGKSEGKVPALHNLKIRAQKIEKPGRRAVRMRRKNLARELVRIVVKREAEKRREVEGSGGEDMMRRLPNGVMVISQSAARRQQQQSGGANDNVGSQCDVKVGVDANVAPRRRFRSKNLEPLPIGAVQVMPYKRNVEKVGRKKCHWCKSSGATSLIKCSSCRKHHFCLECIEGRYFDTQEEVKMECPVCRKTCRCKACLAYKYKDSACQELSSDHSRADKILHSHHLISVLLPVLKEINEERSIELEVEAKVKGTEVSQLQVHQAECGFNKQYCCNNCRTSILDLHRSCSSCSYNLCLSCYWDFYRGILPKGVKLPNNKYDRKRKASVQGHKQLSAKSISKLEQKYGGKSLTVSMPLATSKACNGDDVSCPPWEFGCCDNARFNLQSFFPINWSKELEKKAEEVVCSYDLRENSDGSLCCPLCHGDNHEAVNTQLQQAATRRTSNDNFLYYPTALEVHADKCEHFQKHWVRGHPVIVRDILWRTSDLNWDPVAMFCTHLDGSIAKCENEKEASKASPCLEWSEVEISMRQSFIGSFRGKARESIRHEKLEIKSWLSSRYFREQFPAHYAEILSALPLQDYMNPDLGRLNLATMLPLENMSAEIGPYVYISYCSPNEHPSEHFGSKLCYDLCDVMMFRRTKLIESKLMRKRQAQDKKESTGAPNGELLGSDIENSSEVLDVSIEEMQIRKKMAKVTWLATASEESPCLIAQDNKQKQDHNSTSMEDIQQNLYENQTESHSHYMKKVGKSCGAQWDVFRREDVPKLEEYFRRYSAEFMQPCGSQKHVVHPILDQCYFLDEYHKLRLKEEFEIEPWTFEQHVGEAVLIPAGCPYQIRNPKSSVNVILHFISPESAAECIHLIDELRLLPEGHEARLDKLEVKKMAVSSLTRAIDEIRELTSVKDNAEA

SEQ ID NO: 1089 - protein, 91 aa, Eucalyptus sp.
MPFVPAENPKCPACGKSVYAAEEKVAGGYKFHKMCFKCSMCNKLLDSTNCAEHEKELFCKQCHGRKYGPKGYGFGGGAGCLSMDAGEHLGK

SEQ ID NO: 1090 - protein, 93 aa, Eucalyptus sp.
MPFKPADNPKCPKCGKSVYAAEERVAGGLKWHKMCFKCGLCQKLLDSTNCTEHDGEIYCKNCHGRKFGPKGYGFGGGAGCLSMDSGDHFKEAN

SEQ ID NO: 1091 - protein, 188 aa, Eucalyptus sp.
MAFAGTTQKCMACEKTVYLVDKLTADNRIYHKACFRCHHCKGTLKLGNYNSFEGVLYCRPHFDQLFKRTGSLEKSFEGTPKIAKPEKPVDGERPAATKASSMFGGTRDKCVGCKSTVYPTEKVTVNGTPYHKSCFKCTHGGCVISPSNYVAHEGKLYCRHHHTQLIKEKGNLSQLEGDHERETMAPES

SEQ ID NO: 1092 - protein, 188 aa, Eucalyptus sp.; identical to SEQ ID NO: 1091

SEQ ID NO: 1093 - skipped

SEQ ID NO: 1094 - protein, 196 aa, Eucalyptus sp.
MAFAGTTQKCMACDKTVYLVDKLTADNRIYHKACFRCHHCKGTLKLSNYNSFEGVLYCRPHFDQLFKRTGSLEKSFEGIPKIVKPERPLGSELLKQKPAAAKVSGMFAGTREKCFGCKNTVYPTEKVSVNGTPYHKSCFKCTHGGCTISPSNYIAHEGKLFCKHHHAQLIREKGNLSQLEGDHAGNEKVATREIAV

SEQ ID NO: 1095 - protein, 208 aa, Eucalyptus sp.
MAFTGTVDKCKVCDKTVHVVDMMTLEGIPYHKTCFRCSHCNGTLVMSNYSSMDGVLYCKTHFEQLFKESGDFRKNFHSAKSDKPNEMTRTPSKLSSMFSGTLDKCSSCNKTVYPLEKVTMEGECYHKTCFRCAHGGCPLTHSSYAALDGVLYCRHHFARLFMEKGDFKHVLDSATHRRNASSGTPPPEPAELVTETDTEMMQEVSPSA

SEQ ID NO: 1096 - protein, 205 aa, Eucalyptus sp.
MVRGKTQMKRIENDTSRQVTFSKRRNGLLKKAFELSVLCDAEVALIIFSPRGKLYEFSSSSLSKTIEKYQKRAKDMEAKTAEISMQPSKGNTLDMEKKIEHFEISRRRLLGEGLDSCSVEELQQTENQLERSLTKIRARKNHLIREHIERLKAEERKLLEEKRKLLQEIECGKGLTPVSSKPPREEIRAETMDVVTELFIGPPKR

SEQ ID NO: 1097 - protein, 206 aa, Eucalyptus sp.
MARGKVQMKRIENPVHRQVTFCKRRAGLLKKAKELSVLCDADIGLFIFSPHGKLYELATKGTMKGLIERYMKTTQSQAALTEEATPSQPLDAKEEINILKQEIEALRKGLGYMFGGGAGNMTLDELDVLEKQLETWIYHTRSTKMDIMFQEIQLLRNKEGILKAANQYLQEKIEENTAITNTAPMTTNYTYPLTIQNELFQDLLLV

SEQ ID NO: 1098 - protein, 210 aa, Eucalyptus sp.
MAKEKIKIKKIDNLTARQVTFSKRRRGLIKKAEELSVLCDADVSLIVFSATGKLYDFSSSRMEDTLTRYYGFHSNKVEKSVQPCLALEIENTNREMLHEEVYDRAHKLRQMKGEDLEGLNVEELDQLEKKLEAGLSLVIKNKEEKTWNEINKLQRKEAQLIKQNKQLKHEMKMILHQEKSVTVNSESVKDVYISRNSMPPLDGDSPNPSS

SEQ ID NO: 1099 - protein, 210 aa, Eucalyptus sp.; identical to SEQ ID NO: 1098

SEQ ID NO: 1100 - protein, 210 aa, Eucalyptus sp.
MVRGKIQLRRIENTTSRQVTFSKRRNGLLKKAYELSVLCDAEVAVIIFSQKGRLYEFSSNSEIQKTIDRYRRSTYDMDTYKTNLDQCILHLKQETTDMERKIELLEVSLRKLSGECLGSCSIDEIQMIGDQLERSLSSIRARKAQLFDDQIQHLQAKERSLKEENAKLLAKCLANPGQSTAHPRAAALHSRSSRSTDVETGLFIGLPELN

SEQ ID NO: 1101 - protein, 214 aa, Eucalyptus sp.
MARGKIQMKRIENATSRQATFSKRRNGLMKKAFELSVLCDAEVAVIIFSQRGRLYEFSSSNMQKTIERYHQYAKEDTGKKASMEQYMLHLKHEAADMSRKIELLEASKRKFLGQGLESCSVDELQEISVQLERSLSTIRVKKDQLFKEQIEQLKAKEVFLIEENSRLCEKYGEKGMPWQSTSSVQPKEARIHSLSSGSTDVETELFIGLPEMRC

SEQ ID NO: 1102 - protein, 214 aa, Eucalyptus sp.; identical to SEQ ID NO: 1101

SEQ ID NO: 1103 - protein, 217 aa, Eucalyptus sp.
MVRGKTLMRRIENATSRQVTFSKRRNGLLKKAFELSVLCDAEVALIIFSPRGKLYEFASSSMNETIERYHRHTKDTRTGNKSVEENMQHLKDEAANMMKKIELLEDSRRKLLGEGLGSCSIEELQQIEQQLERSVISIRARKTQVFKEQIDKLKEKEKMLTAENAILTEKCGIKPPQRANECRDSPLLRESSPSSEVETGLFIGPPETRSRRLPFQN

SEQ ID NO: 1104 - protein, 217 aa, Eucalyptus sp.; identical to SEQ ID NO: 1103

SEQ ID NO: 1105 - protein, 222 aa, Eucalyptus sp.
MAREKIKIKKIDNVTARQVTFSKRRRGLFKKAGELSVLCDAEVAVVIFSATGKLFEYSSSSMKDTLERYTLHHNNLENMDQPSLELQLEHSNNMRLSKEVAEKSHRLRQLRGEDLQGLNIEELQQLEKMLEAGLNRVLVTKEERIRTEITDLETKGAELIEENKMLKQTMTTLTKGKRHIVTEPDVALPEEGVSSESATNVCSCNSGPPLEDDGSDTSLKLG

SEQ ID NO: 1106 - protein, 222 aa, Eucalyptus sp.
MGRGKIEIKRIENTTNRQVTFCKRRNGLLKKAYELSVLCDAEVALIVFSSRGRLYEFANHSVKRTIERYKKTCVDNNHGGAISESNSQYWQQEAGKLRQQIEILQNANRHLMGDGLTALNIKELKQLEVRLEKGISRVRSKKNEMLLEEIDIMQRREHILIQENEILRSKIAECQNSHNTNMLSAPEYDALPAFDSRNFLHANLIDAAHHYAHQEQTTLQLG

SEQ ID NO: 1107 - protein, 222 aa, Eucalyptus sp.
MVRGKTQMRRIENKTSRQVTFSKRRNGLLKKAFELSVLCDAEVAAIIFSPTGKLYEFSTSSMSSIIERYQRKTKDPGCSEKTTEIDLQNMKGSSLDMAKMIELLNVSNSRLSGELSDTCSVEELQSTQNLLERSLSKIRARKNLLFKEQIMLLKQEEKKLLDENKKLRSKNEVRGPLKFVTEHPEVPRGQGLDVETELSIGCPQRHRLNIHPHEEGLSIHWL

SEQ ID NO: 1108 - protein, 222 aa, Eucalyptus sp.; identical to SEQ ID NO: 1107

SEQ ID NO: 1109 - protein, 225 aa, Eucalyptus sp.
MAREKIKIKKIDNVTARQVTFSKRRRGLFKKAGELSVLCDAEVAVVIFSATGKLFEYSSSSMKDTLERYTLHHNNLENMDQPSLELQLEHSNNMRLSKEVAEKSHRLRQLRGEDLQGLNIEELQQLEKMLEAGLNRVLVTKEERIRTEITDLETKGAELIEENKMLKQTMTTLTKGKRHIVTEPDVALPEEGVSSESATNVCSCNSGPPLEDDGSDTSLKLGLPF

SEQ ID NO: 1110 - protein, 228 aa, Eucalyptus sp.
MGRGKIEIQKIENDTNRQVTYSKRRNGIFKKAHELTVLCDARVSILMLSGNKKLHEYISPTTTTKRMIDDYQKALGIDLWTTHYDRMQEELRKLKEVNNNFRKEIRQILGHDLNELSYAELHSLEQTIESSVNSVRQRKYHVLKTQTDTHKKKVKALEHRYTELLLESGATYEDLQYGLSEDIEGDYESAVTNLSNHTGASAMYALRLHPSDHDLSSEGHFVPDLSLN

SEQ ID NO: 1111 - protein, 228 aa, Eucalyptus sp.
MVFPTQATPEESPQRKMGRGKIEIKRIENTTNRQVTFCKRRNGLLKKAYELSVLCEAEVALIVFSSRGRLYEYANDSVKATIERYKKACSDSSSSGSVSEANVQFYQQESAKLQQQINNMQNNNRQLVGDSIAGMNMKDMKTTEQKLEKAIAKIRAKKNELLFAEIEYMQKREIDLHNNNQVLRAKIAESERTQHADMNLMPGGTNYDFMQPSSSQPFDSRNYFQVNV

SEQ ID NO: 1112 - protein, 233 aa, Eucalyptus sp.
MARGKIQIKLIENTTNRQVTYSKRRNGLFKKANELTVLCDAKVSIIMISSTGKLHEYISPSTSTKKMYDQYQQALEVDLWSSHYEKMQENLRKLKEVNKKLQLEVRRRFGEGLNGMSLSELCGLEQDMDNAVSLIRERKYKTLGNQIDTARKKKKNAEEINKSLLQDWTNLIKHLREDDPHFGMVDNGRDYEAVIGYTDAAAAARLYTLRLQPDQPNLTSGGGSEITTYPLLE

SEQ ID NO: 1113 - skipped

SEQ ID NO: 1114 - protein, 241 aa, Eucalyptus sp.
MGRGKIVIRRIDNTTSRQVTFSKRRNGLLKKARELAILCDAEVGVVIFSSTGKLYDFASSSMSKVIERYDKLKEETDQSASPMAELKYWQREAAILRQQLQHLQENHRQMMGEELSGLSIKELRNLENQLEMSLRGVRTKKDQVLMEEVRELNRKGNLLHQENLELHKKENLFKQENMELYKKVYGTRDANNINGAHASLLPNKPSNDEDAQVPIHLQLSQPHHQNCETSSRTTNLGLQLH

SEQ ID NO: 1115 - protein, 245 aa, Eucalyptus sp.
MGRGKVELKRIENKINRQVTFAKRRNGLLKKAYELSVLCDAEVALIIFSNRGKLYEFCSSSSMMKTIEKYQKCSYGSLETNCSINEMQNSYQDYLKLKTRVEVLQRSQRNLLGEELGPLNSKELEQLEHQLENSLKQIRSAKTQFMFDQLAHLQHKEQMLVEANRELRKKLEESNTRIPLRLGWEAEDHNNISYSRLPMQSQGLIFQPLGGNPTLQIGYNPAGSNELNVSAADQHPNGFIPGWML

SEQ ID NO: 1116 - protein, 245 aa, Eucalyptus sp.; identical to SEQ ID NO: 1115

SEQ ID NO: 1117 - protein, 245 aa, Eucalyptus sp.
MGRGRVQLKRIENKINRQVTFSKRRCGLLKKAHEISVLCDADVALIVFSTKGKLFEYATDCCMERILERYERYSYAESQVLTNNAETNGNWTLEHAKLKARMEILQKNQKNLMGEELDSLSLKELQNLEHQLDTALKHIRSRKNQLMYESISELQRKDKALQEQNNMLAKKVKEKEKALAQQTQWDNPQDDGLTSSSVILSQSLQPVNIGGPYHPSGIEEGAALGPPQHRNATLLPSWMLSHLQE

SEQ ID NO: 1118 - protein, 246 aa, Eucalyptus sp.
MGRGRVELKRIENKINRQVTFSKRRNGLLKKAYELSVLCDVEVALLIFSSRGKLYEFGSAGPSGINKTLERYQRDNFTPQDNVAEHETQNWFQEISKLKAKYESLQQTQRHLLGEDLGQLNVKELQNLEKQLEQALAQARRRKTQLMLEQMDDLRKKERQLGDLNKKLKSQLEAEGLNLKAIQALWTSTSDAAGTSSFHVHHSQRIPLDCEPQPVLQIGYQYAQAEGSSVTKSGTGETNFIQGWVL

SEQ ID NO: 1119 - protein, 242 aa, Eucalyptus sp.
MGRGRVELKRIENKINRQVTFSKRRNGLLKKAYELSVLCDAEVALIIFSSRGKLYEFGSAGMLKTLERYQKCSYVLQDATVSDREAQNWHQEVGKLKARVELLQRSQRHLLGEDLSPLSIKELQQLERQLEVALTHVRSRKTQVMLEMMDELRRKERILQEVNKSLRKKLQEAEGQAFNAMQPPPHAWDSHAVANNAYAMQHPSNAVDCEPTLQIGYQYAPPESSMPRHEQAQNNYMQGWMV

SEQ ID NO: 1120 - protein, 249 aa, Eucalyptus sp.
MEFPSEFSEASSQKRIGGRGKIEIKRIENTTNRQVTFCKRRNGLLKKAYELSVLCDAEVALIVFSSRGRLYEYANNSVRGTIERYKKASSDSSHPQSVSEVNTQFYQQEASKLRRQIREIQVSNRHILGEGISDLSFKDLKNLESKLEKSISRVRSKKNEMLFAEIEYMQKRGLVQEIELQNDNMYLRAKIAENEGAQQQQQQGSDHHFNMPGSSSVKPAYDRNFLQVNVLEPNHQSYSRSDHTALQLV

SEQ ID NO: 1121 - protein, 249 aa, Eucalyptus sp.
MGRGRVQLKRIENKISRQVTFSKRRTGLLKKAHEISVLCDADVALIVFSTKGKLFEFSTDSCMESILERYERYTYAERQQVATDSPQVQGSWSLEYPKLVARIEVLQRNIRNLSGEELDPLSLRELQYLEQQLDTALKRIRTRKNQLMHESISQLQKKEKSLQEQNNVLSKKIKENEKVMRESGQWEQQTPAPTTSSFMLQPTLPLPSLTIGNTFQTPHVLGGAEQEERSQARPANTLMPPWMIRRSNE

SEQ ID NO: 1122 - protein, 249 aa, Eucalyptus sp.; identical to SEQ ID NO: 1120

SEQ ID NO: 1123 - protein, 255 aa, Eucalyptus sp.
MGRGRVQLKRIENKINRQVTFSKRRNGLLKKAYELSLLCDAEVALIIFSSRGKLYEYCSSSSMMKTLERYQKCSYGAQLNPSRSIDETQSSYQEYLRLKARAEVLQQSQRNLLGEDLGSLDSKELEHLESQLESSLKNIRSTKTQSMLDQLFNLQNRVLLETNKILSRKLEEVSPQIPFQLAWEVGGQGGGGGNGGGGGGGGIPFSLFPPQSEGFFNPMDGNLSLQIGYNPTCLDEMNASVSSQNVAGFIPGWML

SEQ ID NO: 1124 - protein, 242 aa, Eucalyptus sp.
MGRGRLQLKRIENKINRQVTFSKRRAGLLKKAHEISVLCDAEVALIIFSAKGKLFEYSTDSCMERILERYERYSYSEHQVLASETESIGSWTLEHAKLKARLEVLHRNYRHFMGEDLDSLSLKDLQNLKQQLESALKHIRSRKNQLMHESISVLQKKDRALQEQNNLLTRKVKEKERALAQQAQWEQQDHALDSPVVLPHYLPSLDINGSYQARHNGHDDGENLTQPRAGTLLPPWMLPRLN

SEQ ID NO: 1125 - protein, 473 aa, Eucalyptus sp.
MGRRKIEIQPITHERNRSVTFLKRKNGLFKKAYELGVLCSVDVAVIIFEDRPGHSPKLYQYSSRGIQDIVQRHLHHDGETDNRGPGDFSGAGGGKLDEVDEDDEEEEVPVRTKRKKDVGKLKPPSDMNITNDREYPRNPAPMNSSHSAGNNWRTLPASAQMPPPQPPQPSSHKRPRAELDDDGYGGYTHSTRPGGPPQPHHGYHQGHQYTPMFGTQHHHTPPPPPSFIPLHESDFPPQHDFHPAHRLMGGSHRHHDNEYPGGSGGASGGGAGRGEIFPFVEGDARSHQQPSGRGPGLALDWPVHSPAPPAAVQHGHRNGPQQQNQNGNPSWFDFLSNTASTPNTALSWERGGGGSGGAGGGSNRGLNDRGNDIAAVLGVGGNTSEERYLRTMALPVGDAGGSRTPSLPPGDDHDGPKSRQMESIGRGSGTPNPGPGTNGSPSVSGTPTIAPKALREGEDSEEDQGNGKKMDVS

SEQ ID NO: 1126 - protein, 80 aa, Eucalyptus sp.
MASNSLTSSSWTPKQNKMFEKALAQYDKDTPDRWQKIAKAVGGKSADEVKRHYEILIEDVKHIESGRVPFPNYRSSNNSG

SEQ ID NO: 1127 - protein, 82 aa, Eucalyptus sp.
MADSGLSSSHAATTSADFRGDGSRDSKLPHFSEDEETLIARMYTLVGRRWSLIAGRIPGRSAEEIEKYWTSRYIRMVNEQRN

SEQ ID NO: 1128 - skipped

SEQ ID NO: 1129 - protein, 186 aa, Eucalyptus sp.
MRKPCCDKQDTNKGAWSKQEDQKLIDYIRKHGEGCWRTLPKAARWSLIAGRLPGRTDNEVKNYWNSHLRRKLINMGIDPNNHRLNQTPPRLESSNNVSVSANSSGLKTRQSPRPKSCGGDKDQVSDAGSCLEDEPSRLPDLNLDLTINIPSPSPAKIEKEQKPCSYKHDMLRDSDIATSPALVLFR

SEQ ID NO: 1130 - skipped

SEQ ID NO: 1131 - protein, 195 aa, Eucalyptus sp.
MPTTPTRSRCSKRDANRGAWTAEEDQKLAQVIETHGPRRWKLVAAKAGLNRCGKSCRLRWLNYLRPNIKRGNISDQEEDLILRLHKLLGNRWSLIAGRLPGRTDNEIKNYWNSRLSKKIKQKESQSKFLEPDQSQDPRNNPSAMHSVADNDGGTSKREEEMKSDVSRDDFLDNFNEGPLNLEWMSKFLEVDESWF

SEQ ID NO: 1132 - protein, 232 aa, Eucalyptus sp.
MYGRAAEWSRYEDKVFEHALVAVAEDSPDRWQLIGNRLNRSASQVFEHYQRLVEDIDAIESGRVEPPSYRDDHPASCGQIAFETKPRIKEAEKKKGNPWTEEEHRLFLLGLQTYGKGDWRSISRHFVLTRTPTQVASHAQKFYMRQMSLGKKERKRNSIHDITTVDTPPVPASVNDSFNPPQAGNAQDDPSYDYPKANNFQQMQPCQPAPFMNQLLDQGGGSIGYENLSYFL

SEQ ID NO: 1133 - protein, 250 aa, Eucalyptus sp.
MARTPCCEKMGMKKGPWTPEEDQILISHIHQFGHSNWRALPRQAGLLRCGKSCRLRWINYLRPDVKRGNFTDDERDTIIELHQVLGNRWSAIASRLPGRTDNEIKNFWHTHLKKRVPHSLPNSTPFTINPTRCTTLDPSFQKPTSAPPTQKFQEPLTTSESESGPSIAVRANIESSSQAVPSSRASQKLEKTKKDLIAGSAPAFPIAAGSQCGGQGVLSTKGDKDMEFWYSLLVRAGDGHHQVGNAAGTL

SEQ ID NO: 1134 - protein, 263 aa, Eucalyptus sp.
MCTRGHWRPTEDEKLRELVERYGPHNWNAIAEKLQGRSGKSCRLRWFNQLDPRINRSPFTEEEEEKLLASHRIHGNRWSVIARLFPGRTDNAVKNHWHVIMARRSRERSRLYAKRAAQTLMEERTRYSSPSLANKQQDVQMMNMMMSASATANYQLASSFVDNFSGLGQCAFAHAGLPLTKQFHTDHQISPDIPVREDKLQPTEFYDFLQVNTDSNKSEVIDVVHARRDDEEVDQEAANDSADNQAKGGSVPFFDFLSVRSSC

SEQ ID NO: 1135 - protein, 278 aa, Eucalyptus sp.
MGNPKQKWTQEEEEALRAGVAKHGTGKWKDIQRDPEFNKFLFSRSNIDLKDKWRNMIGGASGQGQRDKSRAKAKASSDAPSTLPSLPNAPNVPVSDEATAEPATDGAQRIADDGKNTPRYNAMIFEALQTLKDPNGSDTAAIFNYIEKRQEVPQNFRRLLSSRLRRLVAQEKLEKVQNCFKIKEIASFETKTPAPKEQDVRPKQLQPVVNANFLETVDEAAVAAAYKIADAENKSFDAAESVKEAERISKMAEDADAMLQMALGILEKCSRDEMVLVA

SEQ ID NO: 1136 - protein, 281 aa, Eucalyptus sp.
MSWVAMTGNFGWGSNSMEEAWRKGPWTAEEDKLLIEYVKLHGEGRWNSVARLTGLKRNGKSCRLRWVNYLRPDLKRGQITPQEESVILELHARWGNRWSTIARSLPGRTDNEIKNYWRTHFKNKAKASPTNPERSKAARLLRRQQFHHHQQQQQQQHQQMQQQQQQQLPQLQQHPQLTQVDMKSIWSLLEENDHHRVPYTPQIRPEIAGAYPNSSGYDQCLFYSVFNANNASLPEASSSTSTDEDVLWDGLWTMEDVHGINCGAPYATSKASMHNLVAPFC

SEQ ID NO: 1137 - protein, 287 aa, Eucalyptus sp.
METLYSPSCMSNSAWLSTSWTKEENKRFESALAIHDTDTPDRWDKIAAIVGKSVRDVANKYRELEEDVCEIEAGRDPIHGYLCSSFALESFDERDFDACRKKSSAGRGADHERKKGVPWTQEEHRRFLMGLLKYGKGDWRNISRNFVVSKTPTQVASHAQKYFMRQVSGVKDKRRPSIHDITTVNLTDPASSSENNRVSSLDQLNALSSQQKLIGAPELALDHSLPNYGGFMFFDSSHGHLLMPDAYGFGLNGKRWQEKDNPDGVYPGAGFRSSLIGIHSSRHQIQG

SEQ ID NO: 1138 - protein, 287 aa, Eucalyptus sp.
MSSDARAASGATAAGAGEFMLFGVRVVVVDPMRKSVSLNNLSEYEQPQDAAPGGGGVGKDDAGAAASGYASADEAVAHGSKGGAGRERKRGVPWTEDEHRLFLLGLQKVGKGDWRGISKNFVKTRTPTQVASHAQKYFLRRSNLNRRRRRTSLFDITTDTVTAGTMMEEQAPPVDVATESYPAPPTPTVPLESSNISGFSMMPPTVHVVLPVPAENPVENLSFGPGGQFDNSPAKLVRPVPILPAPAVHDLNLSLASPSDQSEPSRRPSAFQMTPSFGKGDNMISVA

SEQ ID NO: 1139 - protein, 295 aa, Eucalyptus sp.
MTVDETTSDCSWSREQDKAFENALATYPEDSADRWEKIAADVPGKTVEEIKSHYEILVDDVNSIESGCVELPPYSCSPEGSTSHGGDEMNSKKGSHVGNLHGNLNHEGKASRSDQERRKGIAWTEEEHRLFLLGLEKYGKGDWRSISRNFVVTRTPTQVASHAQKYFIRLNSMNKDRRRSSIHDITSVDNGEVSTPQGPITGQTSSSVAGVSSSKPSKQPFQPPTGPASIGVYGAPMIGQPIGGPLVSAVGTPVNLPGPSHMAYGVAPVPGAMVPGAPMSVGHVTYPMPHASAQR

SEQ ID NO: 1140 - protein, 296 aa, Eucalyptus sp.
MGRKCSRCGNIGHNSRTCTTFMGAASACGLKLFGVQLDLSSSSPPSSSASSGSAHPYSLVIKKSLSMDRLSSSSASSSSPSSSLSSPRVLADEHCNKTSLGYLSDGLAARSQEKRKGVPWTEEEHRTFLMGLEKMGKGDWRGISRNYVTTRTPTQVASHAQKFFLRQASLNKKKRRSSLFDMMGRCSTFREQSEPPRLIRTESSLRYEVVPLLAMSTFKPGDEESDREPHDSISRPPSLCDLANPLELKPSPVNPIKNPSLSHAAPDLELTLAAPMPLDQNETSPSSLFVGSISVT

SEQ ID NO: 1141 - protein, 299 aa, Eucalyptus sp.
MRNPSSSSGGTKTPCCSKVGLKRGPWTPEEDELLAGYINREGEGRWRTLPKRAGLLRCGKSCRLRWMNYLRPSVKRGQIAPDEEDLILRLHRLLGNRWSLIAGRIPGRTDNEIKNYWNTHLSKKLISQGIDPRTHKPLNPETQNSSSNPPAKPPPSKAAPRPRSPNPSPISSGLEETSSGSPAILKENDQIQSADNTEAVYQNGTATAHGGEASYLPGTQHYHVMGLRSSHGLSNEEEEDLNCCGDDVFSSFLNSLINEEAFPIQHQLQQQAVGSSPDSDSLIPMAAAPAFGIAAGWDS

SEQ ID NO: 1142 - protein, 299 aa, Eucalyptus sp.
MTVDEAVSPSCSSWSKEQDKAFENALATHFEVSPDWWEKVASDVPGKTLEEIKLHYEDLVEDVNRIEAGRVPLPSYSSACSDGSASNLGEEESRKKGGGGSGESNQGGKGSRSDQERRKGIAWTEEEHRLFLLGLDKYGKGDWRSISRNFVVTRTPTQVASHAQKYFIRLSSVNKDRRRSSIHDITTVGSGDLSAPQGPITGQNQTDGSAGGVSSGKSNKQSPQSPAVTSGVAVSGPPPSIGQPVGGPFVSAVGTPVNLSTAPHMAYGVRGQVQGTVVPGAPINMGSVTYPMPHASAHR

SEQ ID NO: 1143 - protein, 300 aa, Eucalyptus sp.
MGRSPCCSKEGMNRGAWTVMEDKILTSYIKAHGEGKWRNLPKRAGLKRCGKSCRLRWLNYLRPDIKRGNISLDEEELIIRLHKLLGNRWSLIAGRLPGRTDNEIKNYWNTTLGKKLAKTDRSSSSPPSLKDINHPSSKSRSKRPVSKSSCLFPTKATRPRVTRYKPLEGTKVHASPGSSLPSKNQSLYSITQEYPPYLQANYRPSGSTCQQGLDSESPRSHRVHCGAHDDRLQKNFVGDFGLINFGYGDEFNAANVMCADQPLTVEQEMLENWTASFCVEEKDTLDLDSLAYLLNSEEWP

SEQ ID NO: 1144 - protein, 301 aa, Eucalyptus sp.
MGAPKQKWTAEEEAALKAGVIKHGAGKWRTILKDPEFSSVLYLRSNVDLKDKWRNMSVMANGWGSRDKAKLTVKRVHHVPRQEESSAAARNAVQSDEEMVDMKDLSISGDALHIDGPKRSIVRLENLIIDAINSLKEPSGSNKTAIATFIEEQYWAPPNFKRLLSAKLKYLMSIGKLVKVKRKYRIAPGPGSLARRRTSSMFLSDGWKLPPKVDRNDDDDDVLTAAQVDLELAKMRTMTPEEAAAAAARAVAEAEAAIAAAEEAAKEAEAAEADAEAAQAFAEAAMKTMKGRNVPKVMIRV

SEQ ID NO: 1145 - skipped

SEQ ID NO: 1146 - protein, 302 aa, Eucalyptus sp.
MKWETGVPLPPCASSANWFFNEEGRTAKWTPAENKMFEKALAVHDQDTPDRWDRVASMIPGKTVEDVVKHYQDLEVDVSNIEAGLIPIPGYSTTAPFTLEWANGHGYDGFKQSYGLGGKRSSSIRPPEQERKKGVPWTEEEHKLFLMGLKKYGKGDWRNISRNFVITRTPTQVASHAQKYFIRQLSGGKDKRRASIHDITTVNLTETRTPSPDDKRPPSPDPSSMVARHPTPVTAPRTPFLWNQPSNGGSMTFHATQGDMSMCPHFGVNSFGLKFQGQNTHRGTFIQNPVFHMQAGQSYPHG

SEQ ID NO: 1147 - protein, 305 aa, Eucalyptus sp.
MGRSPCCAKEGMNRGAWTAMEDKILTDYIKANGDGKWRNLPKKAGLRRCGKSCRLRWLNYLRPDIKRGNITLDEEELIIRLHNLLGNRWSLIAGRLPGRTDNEIKNYWNTTIGRKLQSSSSNSGFVSSRPSLSSFQGSPKSALEKLTIDDTLMPVEPRVSHAKAPACPKALLSPASCQDREAQAPDMVDDKDQSSDRYEDQVTTVRASDGNSNVSCNFMADFELDANFLEAFLESELATDTQQSCFVNSGLDDSHKRELPPLKSSRDSQETLAFIDPGETILSEPDLQCMASLLEDEIDGFNTTS

SEQ ID NO: 1148 - protein, 314 aa, Eucalyptus sp.
MGHHSCCNQQKVKRGLWSPEEDEKLIRYITTHGYGCWSEVPEKAGLQRCGKSCRLRWINYLRPDIRRGRFTPEEEKLIISLHGVVGNRWAHIASHLPGRTDNEIKNYWNSWIKKKIRKPSPASLTNVPPSTSSEHSLLSNSSNQLSCAMPDLMAAKMPVQETLFSSPCPLFMFDTASLEGLAESNEQQELFTEAVTVNSAGTWNLNHQQFHTTLLPPPPPYTSGSADANYLPPLIENVENMLNIGAQSSNIDEEGDRIALECFQRQELNEWVESHQCPNFLLWDNVEGPFGGEDIVPASSTAGASTMSSFPSSL

SEQ ID NO: 1149 - protein, 318 aa, Eucalyptus sp.
MLLASREMNRGIEILSPYLQNSNWLFQESKGTKWTPEENKRFENLLAVYDKDTPDRWAKVAASIPGKTVGDVMKQYRELEEDVSDIEAGLIPIPGYGGNSFTLEWINSNNGSDGLKQLYSTVGKRGTSTKPSDQERKKGVPWTEEEHRQFLMGLKKYGKGDWRNISRYFVTSRTPTQVASHAQKYFIRQGTGGKDKRRSSIHDITTVHLPDSDPPSPVKRQSASPDNSSTITKLPVQAQPHDHHPKIEEMSTDILCWNNQSNGGLATAYDQVGVDAALGPFRGISSYGNKLHEQRFLMSGLHGAQFDPYFQMQPMHYQ

SEQ ID NO: 1150 - protein, 322 aa, Eucalyptus sp.
MQEFEGERGRERALNMGRSPRCDKDGLNKGAWTAAEDQILMDYVKLHGEGKWSRLSRETGLRRCGKSCRLRWMNYLRPDIKRGNISPDEEELIIRLHKLLGNRWSLIAGRLPGRTDNEIKNYWNTNLAKKPEALRSIQFHHLHREPMVEPPATSQQELEQQRVPESNIRGVANPEPQVAQRNAANGEMRSSPDGNYLLKQMLSDSDMSDGSLSFNSEEESPDFMIDFNVDDISQFLDSDFYKLGPDQNGYSHDGERGSKCPPYLNQQLVPPEEAGKDLDNSLRIRDDSVSAFQSLASLFESDDEKWTGGGDKADFALPGKNG

SEQ ID NO: 1151 - protein, 374 aa, Eucalyptus sp.
MGRSPCCSKEGLNRGAWTKREDMILSEYVRIHGDGGWRNLPEKAGLKRCGKSCRLRWLNYLRPDIKRGNICPAEEELIIRLHRLLGNRWSLIAGRLPGRTDNEIKNYWNTHLSKKLSSQESQDKTSKNLSTSSKSPVPVQNRVFKATAVKITTAVRHCEIIRPNACNGDGCSNFIPGEALQLCNVENTTKSSSCGLLVNDSTTSKQPERNAFATTDNLVQTEATNCTSSMLNFGDQQSPYSDYFEGDAANLAESLLFLTDLSSPDCNLLASASDCSTDFASEDLYRGPAALPEETNGFEDMCSDQNNMQRVNSSSMDQELEEFYNNAQDEDWIHELDCLENSGAQPLSSLLLESENEWEERSIGKLALEDHVQI

SEQ ID NO: 1152 - protein, 328 aa, Eucalyptus sp.
MRKPSETMGMAMGIKEKASSNPHNHKLRKGLWSPEEDEKLMRYMLTNGQGCWSDIARNAGLQRCGKSCRLRWINYLRPDLKRGAFSPQEEELIVHLHNILGNRWSQIAARLPGRTDNEIKNFWNSTLKKRLKMNSATSSSNESDLSNPQDIAAGIMPSFHAQYDVLATCMDSSPAPFPPMDNISAPNQFDPFPTLNNRCDTWEGVGFFTFPSGIAPVSMGDDSSYLNLEHAKVGLLGSEFSVPPLASSTTTTEENNYRSIGCGMDGKGENSFSNNNDSCFSNTTTASFKAEDDMSGFGNNLQAANLRIGEWDLEGLMDDLPSFPFLDF

SEQ ID NO: 1153 - protein, 329 aa, Eucalyptus sp.
MGRSPCCESEHMNKGAWSKEEDERLIAYIKRHGEGCWRSLPKAAGLLRCGKSCRLRWINYLRPDLKRGNFSDEEDELIITLHSLLGNKWSLIAARLPGRTDNEIKNYWNTHIKRKLHARGIDPQTHRPLDYTSTAGAGAAAAHTICSNANNSGDKATPHSTTCEELSSSSTPPPLRAAKKRLNSLASAVVTVREEEESTNNSMSSDVTTTTTTAEEVQVQLINNKNGINMDEDGDANADLDLSLCLSVHRPKTIIRNNSTSSTASTELLRSPPPQPAHGHREVFLSLGFHPDARHACSGTSCSAPTATTLDLLSDPSSHPISGASSYWF

SEQ ID NO: 1154 - protein, 349 aa, Eucalyptus sp.
MARSSCNQKLRKGLWSPEEDEKLFNYISRHGLGCWSSVPKLAGLQRCGKSCRLRWINYLRPDLKRGMFSQQEEDLIITLHAALGNRWAQIATQLPGRTDNEIKNFWNSYVRKKLTKQGIDPVTHKPLRELNSMSENCVEIEAAQALQEFKGSRDISSLRAKEPAFPIDGMHGGPMESPVGEVFLNRALFDPSSSLEFHNAINPVLHGAKSRLVDPGYFEMNAAPFSSVSSSMEIDHENKNTSGNLVSRMSCLFFHEAKKYCSNSSNNISNNTEFQLNSAAENKDLPWADDEELDPLHQFQVNVTGSEDLKSISWQEEHLLAHAAVDFHGNHPSMSLSDDQILQAHFNIF

SEQ ID NO: 1155 - skipped

SEQ ID NO: 1156 - protein, 366 aa, Eucalyptus sp.
MTRRCSHCSHNGHNSRTCPARGGGGGGGGGGVRLFGVRLTDGSIIKKSASTSSLSSHHLLPPSSSPSPSPSPSPSPAAGSPPSGDHHYDHHHHQQRDPDGYLSDDPAQGACASDRRGERKKGVPWTEEEHRLFLIGLQKLGKGDWRGIARNYVTSRTPTQVASHAQKYFIRQTTAGRKKRRSSLFDMAPEMATDRPLIPKETTLPPFARDSDQPDSMPSLDLSLASESKPMETSSHETVKDVAKTAMVSDVFPCTIPGHFPTYYEQVPLSIWPSTITSVENKTAEISRHQVLKPIPLLHKEPVNVDELCGMSQLSLLESENGFKDRPVLSLNLLGEPLRQSAFHANAAPVASPDISNSKNSPIKAV

SEQ ID NO: 1157 - protein, 369 aa, Eucalyptus sp.
MIIHIFHFLYILLITKPGIYFDLASDVEEFPFGHAIMDSSGRANSGSGDDGKSAAACPRGHWRPAEDEKLRQLVEQYGAQNWNSIAEKLQGRSGKSCRLRWFNQLDPRINRRPFTEEEEERLLAAHRVHGNKWALIARLFPGRTDNAVKNHWHVIMARKQREQSKLCGKRIHQEYSLGDPTGLQGRKTHFQDELLGSQFRFDQGKGFFIFQSPSKERNFALPSSSSASWTFGSQSLAKSAHNSSSVDDLNRIERRDYYNRASNNYSGREGARSLSQPFHSHPYSSLSSAYSISQYQRVVPSPFGYVCLGDGCNDSNTMKKQEIVSFHDEMPRLEKTRLHVNSTHQEQADKSLKHKDVPFIDFLGVGISS

SEQ ID NO: 1158 - protein, 373 aa, Eucalyptus sp.
MTRRCSHCCNKGHNSRTCPVRGGGGGGGDGGGAAAAPSSSSPSTSSSGAAAAAAASASGGGVKLFGVRLTDGSIMKKSASVGCLSAAHYHSSSSAAASPNPGSSPIDGSDGYLSDDPAPGSRSSNRRVERKKGNPWTEEEHRRFLIGLQKLGKGDWRGIARDFVTTRTPTQVASHAQKYYIRQSNAGRRKRRSSLFDMAPDMATADQPSHPEETFLPPLVRLNDDTNSTTSTSMGLDLERTPMETSHPETSEGGGDVAMESIDQVPLVPCYFPYYLPLPFPMWPPNMAPPEDGRVVETSHHRVLKPIPVIPKEPLNIDQIVGMSQLSLAENEPAPLSLKFLGETSRQSAFIKAPSSVNESDLDNCKDGATQAA

SEQ ID NO: 1159 - protein, 398 aa, Eucalyptus sp.
MGRHSCCHKQKLRKGLWSPEEDEKLLNYIAKFGLGCWSSVPKLAGLQRCGKSCRLRWINYLRPDLKRGAFSQQEESLIIELHAVLGNRWSQIAAHLPGRTDNEIKNLWNSGLKKKLRQNGIDPNTHKPLSLFENSDQQKFHAIYEASVASTKPNLSQASSTSSSQNLRVTPSPELSFKRPGIVDDGSFITCFPPAGMVGELCFQHLKCSGTMGLLASSDTALHHDWNWSSSDISPTEVHSAPKPNRPSDSYYCNIDGGNSSHWSGIAPLQNVHTFENSPNSWLLADCGRVDKETETHPSVFDAEVAKWFEYLHRTPFVFNLSPSGASQLEHSDVTPSAGTCSVTGGGLVSNCPHDQILQASPGSDMYGKTLQVIAVSSGQNSPSSLEPVKNKFQDKKV

SEQ ID NO: 1160 - protein, 732 aa, Eucalyptus sp.
MDTYSSGEDLIVKTRKPYTITKQRERWTEDEHNRFLEALKLHGRAWQRIEEHIGTKTAVQIRSHAQKFFSKLEKEAIVKGVPVGQTLDIKIPPPRPKRKPSNPYPRKTGASTPTLSVGAKDGGILSVSPSNCEKLDSETASFLERASGGEKLANSKENQDDNCSEVFNLPQEAHCSSISSTNRSVVPTPVGIQNSCTFRMFVPSLKEGVQDNGPRKVSNSENSDRSHEKSVQCRMDGYDGPPADEMQTAHNFPRHVPVHVLDANHTKCTQAPLQDVSFQDSAFDPTGEVKARLNLFPNQTPSAAGENQKEAPRMDHQSFPAFHPPFTPVHHNEDDYRSFLHLSSTFSSLIVSTLLQNPAAHVAASFAASLWPYPNVENSVVDSAVCTQGTFPCRPSSSPPSMAALAAATVAAATAWWAAHGLLPLCAPLHTGFTCNPTSATAVHSLNTSQTPGVEKERRECTFENPCSQEHLDPEHSEALQAQNSASKSPLGALSDSEDSGGARLDTRSKAADHEKAAVETDSQQNQSKGGKPVDRSSCGSNTPSSSEVETDALEKQEKGNETLKDPDPNQSILEYFNRRCRSTSNVTDSWKEVSEEGRLAFQALFSRNVLPQSFSPPRDMKNKGQQKENVEEGEQNNGEVDKDVSTLDLNRNMCISCSFHQGPERSGVINGGEEGLLTIGLGQGKLRTHRTGFKPYKRCSVEAKETRAANVGSQSEEQGPKRIRLEGEPSM

SEQ ID NO: 1161 - skipped

SEQ ID NO: 1162 - protein, 229 aa, Eucalyptus sp.
MRKPCCDKQDTNKGAWSKQEDQKLIDYIRKHGEGCWRTLPKAAGLLRCGKSCRLRWINYLRPDLKRGNFAEDEEDLIIKLHALLGNRWSLIAGRLPGRTDNEVKNYWNSHLRRKLINMGIDPNNHRLNQTPPRLESSNNVSVSANSSGLKTRQSPRPKSCGGDKDQVSDAGSCLEDEPSRLPDLNLDLTISIPSPSPAKIEKEQKPCSYKHDMLRDSDIATSPALVLFR

SEQ ID NO: 1163 - protein, 233 aa, Eucalyptus sp.
MRKPCCDKRDTNKGAWSKQEDQKLIDYIQKHGEGSWRTLPQAAGLLRCGKSCRLRWINYLRPDLKRGNFAEDEEDLIIKLHALLGNRWSLIAGRLPGRTDNEVKNYWNSHLRRKLLKMGIDPNNHRLNQNLPRSQTPDASGSTSSSSMKTNMTLADKSSRSAGDHPEVFDAENVSGDIPRDLPDLNLDLTISVPSSSLTKVEEEEQNPYASKVATKVARDIENAESPTLLLFA

SEQ ID NO: 1164 - protein, 246 aa, Eucalyptus sp.
MARFPRVDKSNSKKTVKKGAWSAEEDQKLVAYIKRYGIWNWTHMAEPAGLARTGKSCRLRWMNYLRPNIKHGNITQEEEEIIINLHRVLGNRWASIASRLSGRTDNEIKNYWNTRLKKRFLMENLQMPTAWDVKVNSSHNDPLSCQDSSIALIDATKAQNLGSACGIDRVDETLVNGLVSPGNKIDKVEENIWEQLVALKDLCILEDFEGTCSNSGAKSPASECMYSEPMYFGESYEDFLIDLWGN

SEQ ID NO: 1165 - protein, 256 aa, Eucalyptus sp.
MGRSPCCEKAHTNKGAWTKEEDERLIAYIRAHGEGCWRSLPKAAGLLRCGKSCRLRWINYLRPDLKRGNFTEEEDELIIKLHSLLGNKWSLIAGRLPGRTDNEIKNYWNTHIRRKLLNRGIDPATHRPLNEPAQDATTISFAAAPSKQEPRDDAIAAALGYKNENNPTTTAATVQEKCPDLNLELRISPPCQQQHQPDASMGMVEGNHCFACSLGLQNSKECSCRRGASGGSSAHGGYDFLGLKTSVLDFRTLEMK

SEQ ID NO: 1166 - protein, 260 aa, Eucalyptus sp.
MGRAPCCEKMGLKKGPWTPDEDRILINYVQHHGHGNWRRLPKLAGLLRCGKSCRLRWTNYLRPDIKRGNFSREEEDTIIQLHEMLGNRWSAIAARLPGRTDNEIKNVWHTHLKKRLRKEHEAAVLDNVPSKRLVTMSHTNNEPHAKYESHGGPISSPQTQQSSSSVSLSSTTTEDNSGNDNKCIKEALEDAISGLIDENFWSELVSSDDNNSAMSDDFLAVSSEFQSSLSSNVGPWDMNGGGMVDCFWYDLLKGAELADV

SEQ ID NO: 1167 - protein, 269 aa, Eucalyptus sp.
MGRQPCCDKLGVKKGPWTAEEDRKLVNFILTHGQCCWRAVPKLAGLRRCGKSCRLRWTNYLRPDLKRGLLNEAEESLVIDLHATLGNRWSKIAARLPGRTDNEIKNHWNTHIKKKLIRMGIDPVTHKPLQEQANEQVPSKANEQAKFEVSNHETPVYPCDGSSDNFSSPIIDNFSTGKSPSFDPNISSFDDPWMNHVRWETFLGNPSSWNFMFEGDRQEDYGEFGVCPSAGGDPSWLFNRESTGVESFAQSGFGDIDMSEFARSANVRS

SEQ ID NO: 1168 - protein, 274 aa, Eucalyptus sp.
MGNQKLKWTKEEEEALLAGIAKHGAGKWKNILKDPEFAPALVNRSNIDLKDKWRNLSVGTSGQGSRDKQRLSKVKSLMAAPQSSTVPLNPQAHAASTDVALVNSSNSFQDGKNYSLDNTLIFDALSSPKGPNGSDIGAIVSFIEQRQEVPPNFKRLLSSKLRRLVSQGKLEKVEKYYKISRQAPLGTKTSVPEQKVVRSLPSQQLALSSHETMKEVAMAAAYNVVEAENKSFLAAEAVKEAERVSKMADDAVMTLQLVQEIYEQCLQGEFVLMT

SEQ ID NO: 1169 - protein, 294 aa, Eucalyptus sp.
MGAPKQKWTAEEEAALKAGVIKHGAGKWRTILTDLEFKEILKMRSNVDLKDKWRNINVTAIWGSRQKARLALKKNLLTPKHDSNTLALASARNDEEILDATPLAVSSETINNANPKERMKSRLDNLIIEALTNLKDPSGSDRAAIAAYIEDQYLAPPNLKKLLSAKLKLMIANGKLIKVKHRYRIAQNPKTMEARRGSSRSIVEGRPKDSFKGDKREVKIYTKTQIDAELLKMKSMTAQEAAAAAAKAVAEAEAAMAEAEEAAREAEAAEAEAEAAQIFAQAAINALKCGTLHA

SEQ ID NO: 1170 - protein, 298 aa, Eucalyptus sp.
MGRSPCCERKDLKKGPWTPEEDQILIDYISKNGHGSWRVLPKLAGLLRCGKSCRLRWTNYLRPDIKRGSFSLQEEKLVIQLHGILGNRWAAIAAQLPGRTDNEIKNLWNTHLKKRLLSTGLNPLTQDPFSPQGSMTKLPASSITRHMAQWESARLEAEARLSRETLLLNTLPLQQKTDGDYFLRVWNSEVGESFRSINRRSKSASLSAVSQASSCAECETSSVATIEIGTTYLGADADSTPNDHDNDADGKSSGAEYEALATSEYSGSSEFDSSTVTALEMLFDFPIDNDMSFLEGSA

SEQ ID NO: 1171 - protein, 299 aa, Eucalyptus sp.
MNSNASSNPQSMATSTTSATTPAAGGDGGKKVRKPYTITKSRESWTEEEHDKFLEALQLFDRDWKKIEDFVGSKTVIQIRSHAQKYFLKVQKNGAVAHVPPPRPKRKAAHPYPQKASKNVLVPLQASMAQPSSTNPAFTITPGNVSWDDASVLINNASSNNMLSQDEFSNFQADIGSKGSSRVSCSTAAGVRSSSRTPSSLEISKQKRQTPVMHGIPDFSEVYGFIGSVFDPNAKGHVQKLKEMDPINFETVLLLMRNLTFNLSSPDFVPVRKVLSSYDVNTKTVGAPLENVVQSDLTC

SEQ ID NO: 1172 - protein, 301 aa, Eucalyptus sp.
MGRSPCCEKAHTNKGAWTKEEDQRLIDYIRLHGEGCWRSLPKSAGLLRCGKSCRLRWINYLRPDLKRGNFTEEEDELIIKLHSLLGNKWSLIAGRLPGRTDNEIKNYWNTHIKRKLVSRGIDPQTHRPLNSAAPGVPPAATSPPSLPVTEISLISSSLDRRPHGNGYYGREKLEPKAEPLREDNHCTTSSGTTTDEELKAPRNRRQAQGGTELNLELSIGLAPSCRELNRNASSVTANTAESKLQEVPYPLLTVPTPAAAAAAAAATAVCLCCQLGSRSGGMCGNCQSNGGSFGYYAQLGS

SEQ ID NO: 1173 - protein, 303 aa, Eucalyptus sp.
MGRTPCCDKKDLKKGPWTPEEDEILVEYIRQNGHGSWRSLPKLAGLLRCGKSCRLRWTNYLRPDIKRGPFTPEEEKLVIQLHGILGNRWAAIAAQLPGRTDNEIKNLWNTHLKKRLLCMGLDPQTHEPFLTRGPMTNSPASTVTRHMAQWESARLEAEARLSRESNLFNPLPLQKADADHFLRLWNSEVGESFRKINMEMGRSPVSPASSCAKCESNSAISAEMGPSLGGSAAVTNDGDEDKECETYKSYFQQMAAGTESSGSSALEDSSDTALQLLLDFPINNDISFLGGDIDQYASSSGLV

SEQ ID NO: 1174 - protein, 305 aa, Eucalyptus sp.
MPGFTRARKMSMSGEEEGDLRRGPWTREEDNLLIHSITCHGEGRWNMLAKSAGLKRTGKSCRLRWLNYLRPDIKRGNLTPQEQLMILELHHKWGNRWSKIAQYLPGRTDNEIKNYWRTRVQKQARQLNIESDSERFLDAVRHIWMPRLLQKMEQASSSDQTTRTSDMSMNCSVSASPVHYPPSTSSPSKLTQNSNSSMEVSSYTMADADISPNFPITGQTPEIPEAFSNADVVGFGNSTAYNPLLAGDGYFGDGTSYDVNDYATMSALSACNGFPLQGHVEGGNWAVDDVADACWTVDDIWKFRD

SEQ ID NO: 1175 - protein, 310 aa, Eucalyptus sp.
MPPPRAATPDVAGDESSGADAGAGEIMLFGVRVVVDSMRKCVSLNNLSQYQHPQDANPPNASGGSGGNKEEAAKGYASADDAAHNPGGGRERKRGVPWTEEEHRLFLLGLQKVGKGDWRAISRNFVKTRTPTQVASHAQKYFLRRSNLNRRRRRSSLFDITTDSVTASMMETEHVPHQDNTYQMNPLPRHPLLQDTCNPNGYVAMAPFAMPIGPAAFPIPVQNQVPNLTLMQGGGLSDSKSKLVQPTPLVPIPHAPLTSDQSANSKSTMEPLSLSLNLSLPSDQGDSPSSRTSFQAMSGFRGGESIISVA

SEQ ID NO: 1176 - protein, 325 aa, Eucalyptus sp.
MGRSPCCSKEGLNRGAWTAQEDRILTNYIKAHGEGRWRNLPKKAGLQRCGKSCRLRWLNYLRPDIKRGNISPDEEELIIRLHKLLGNRWSLIAGRLPGRTDNEIKNYWNTNLGRKVQSNTPTNSQSRSGHVDQLSPNHQRDDDRPRKVKSPRHSETSKMSTDDNSASESPSSKPDARSVKTNAFKCSKVLIDPPPEQELHRNEDPINTDFAASAAVDPAPTGVLPPFTGNIPADLSMDDFEIGDICLSEFLNPDTSSIANQGQFNSNNSITISDDLFADDSQVQGLGWAALSSDSVPDNHQANAGPNFHQAFASFLDYNGGDQWL

SEQ ID NO: 1177 - skipped

SEQ ID NO: 1178 - protein, 328 aa, Eucalyptus sp.
MRKPDASGKNSSNSNANKLRKGLWSPEEDDKLMNYMLNNGQGCWSDVARNAGLQRCGKSCRLRWINYLRPDLKRGAFSPQEEELIIHLHSILGNRWSQIAARLPGRTDNEIKNFWNSTIKKRLKNSSSSSCRHSPNTSDSSLSSDVKDVMGGLISLQEQGLMPLYMDSLSSVQALALNQVIDPLLPSLNQGLDLPGLSGYCDANSNYCAVQGGVSGEFGRFGGVVGCGSNGDQLYVPPLESISIENVKTENTYDSEHNSSNDLSNFNYTTDDVVDNIGNFNDYGRIESMAGLGNLWNGGEEMKVGEWDLEELMKDVSSFSSADFQVIQ

SEQ ID NO: 1179 - protein, 329 aa, Eucalyptus sp.; identical to SEQ ID NO: 1153

SEQ ID NO: 1180 - protein, 335 aa, Eucalyptus sp.
MASRKEVDRIKGPWSPEEDEALRLLVQKHGPRNWSLISKSIPGRSGKSCRLRWCNQLSPQVEHRAFTPEEDDIIVRAHARFGNKWATIARLLSGRTDNAIKNHWNSTLKRKCSPPLSPLAEEGNNRAFDAAAGYDGDLSPRERPAKRSASAGPCLSPGSPSGSGMSDSSVHFVYRPVAKTGPVVPPPVEATAAAVSSTEDPPTSLSLSLPGAADACEVSTRVPAEPTQPATRPISLLPMASDPAPTPACAPPQAVALPEYPRYSGNNNSSSIFPYPPPSPRVGADFSPFKAEFMAVMQEMIRAEVRNYMAGMCSQAAAADIRNAVVKRIGIGKIE

SEQ ID NO: 1181 - protein, 339 aa, Eucalyptus sp.
MASSSSVASARKDADRIKGPWSPEEDEALQRLVQSYGPRNWSLISKSIPGRSGKSCRLRWCNQLSPQVEHRPFTPEEDEAIVRAHARFGNKWATIARLLNGRTDNAVKNHWNSTLKRKCSSACSAGGDDADALAEQQPLKRSASLGTPTGGNNAVSDLFFSPSSPSGSDLSDSGLPVGMPSPRVFRPVARTGPIMPALSGQHADASSSTTTDPPTLLSLSLPGSDMAEVSNHGSASGSVPTPDSRPSPTLFSARTQTMQATPPPPPPPVPPQPPIHHLGHYGDRMEAAAGYEKQFFNADFMAVMQEMIRKEVRSYMSGIEQGEAVRNVTVKRIGVSKID

SEQ ID NO: 1182 - protein, 343 aa, Eucalyptus sp.
MDAKGMIRGAHHSGSGGDSDSQEDDQQAIMEDLRRGPWTVEEDLTLVNYIANHGEGRWNSLARSAGLKRTGKSCRLRWLNYLRPDVRRGNITLEEQLLILELHSRWGNRWSKIAQHLPGRTDNEIKNYWRTRVQKHAKQLKCDVNSKQFKDAMKYLWMPRLVERIQAASASVSTATVAAAAMAAPPTMATTAASNIGGMAFPPALAGMGGDFRGGRLNVAPSYSTPENSCTTASSDSFGAQVSPVSDLTDLTEYYPIPAGDNPNPDYYQPNNNGQGCYQESSLTSPCAYFNNYGMDFQACMDQNNNQWLDDGGTSDNLWNLADDWYSQQQQQPHAASIINNNF

SEQ ID NO: 1183 - protein, 356 aa, Eucalyptus sp.
MKERQRWRAEEDALLRAYVKQYGPREWHLVSQRMNTPLNRDAKSCLERWKNYLKPGIKKGSLSEEEQRLVIQLQAKHGNKWKKIAAEIPGRTAKRLGKWWEVFKEKQQREQKENKGALPIDEGKYDHILENFAEKLVKERSTPALLMATANGGFIHTDSPALAPTLLPPWLSNSNGTPTLRPPSPSVTLSLSPATVPASQPIPWLQADRGLDSGSLSLTGLPNHGPLPTSGENILMSELAECCKELEEGHRAWAAHKKEAAWRLKRLELQLESEKACRRREKMEEIEAKINTLREEQKASLDKIETEYREQLAGLRKDAESKEQKLAEQWTAKHVQLSKLIEQIGFRPRIADHDRQ

SEQ ID NO: 1184 - protein, 356 aa, Eucalyptus sp.; identical to SEQ ID NO: 1183

SEQ ID NO: 1185 - skipped

SEQ ID NO: 1186 - protein, 378 aa, Eucalyptus sp.
MGRAPCCEKVGLKRGRWTAEEDAILLNYIKANGEGHWRSLPKNAGLLRCGKSCRLRWVNYLRTDLRRGNISTEEENVIIKLHASLGNRWSLIASHLPGRTDNEIKNYWNSHLSRKIDTFRRPSIDEALPMAMNLVKVSPPKRKGRTSRWAMKKNKNLLGPKKNPNKETSANFDMVSSPATQPVERERLSTTKASSEDRETKERESLATVNVASVPYSVGEGGTTSPLSSNNLSNPLMLSPSGGREDGTILGPLEGIDEELSLSFNDIVDYAPLLDSSGIMDVSIETSGDHEEAAAVGSGLERKSEGGEWFSCVEDDCVNWDWENHVVQGHGHDQTAEERDGQEMLAWLWETDGGEWGSQSFEEVDREKQNAMVAWLLS

SEQ ID NO: 1187 - protein, 411 aa, Eucalyptus sp.
MGRSPCCDKVGLKKGPWTPEEDQKLLAYIEENGHGSWRALPSKAGLQRCGKSCRLRWTNYLRPDIKRGKFSLQEEQTIIQLHALLGNRWSAIATHLPKRTDNEIKNYWNTHLKKRLAKMGIDPVTHKPKNDALVSSDGQSKSAAKLSHLAQWESARLEAEARLARESKLRSQSFQHHHSSSNSSQVYSAASALASTSAAPPGLVKKATAPLPPSSPQSLDTLKAWTGSSWPSTKSGEGSGGAGGSANGIAGDLESPTSTLTFSEPMNVLCENPKQMIEFVGSSGSSDSGMIKEEGEQEWKGLESSITLPEFKEGMGNNAVSFTSTFPEMTMSLEGPWTPESLRASSVHGNVENNDMEEGFTSLLLNSSGDQSLSDGGGESDKRSDYYEDNKNYWNSILNLVNSSPSESPMF

SEQ ID NO: 1188 - skipped

SEQ ID NO: 1189 - protein, 435 aa, Eucalyptus sp.
MGRHSCCYKQKLRKGLWSPEEDEKLLRYITQYGHGCWSSVPKLAGLQRCGKSCRLRWINYLRPDLKRGTFSQEEEDLIIELHAVLGNRWSQIAAQLPGRTDNEIKNLWNSCLKKKLRQKGIDPATHKPLSEVEHGGDDKSTTPKSHERAAFSGSSNGLSQTQQAPNSENTLLEHCSSSNANNSSKISNLMNSGLDKDCFPNGLLSSTSSCQPSDDLVGHFPLQPLGNYASISRLSEAISNHSPWFGQSGKSFSINTEFGCSTMPAILPHSNISFHHDPVGFRPAMTVPNDNYCFKPFTVDESRYWEVNAPTSSGAANAELLGSGSYFENSMLSWGLENCSTMGKEADMNNPPGGHIGDIKLPDYFHDPLLIGATSQHQAPQSLYNEIKPDTHFDTNYSSSAMWLQNQQDQGLLPSSDTSSCPKNIQRLTALFGHI

SEQ ID NO: 1190 - protein, 479 aa, Eucalyptus sp.
MQDMKMTTDTEDSKKKERHIVTWSQEEDDILREQIGIHGTENWSIIASKFKDKTTRQCRRRWYTYLNSDFKKGGWSPEEDVLLCEAQKIFGNRWTEIAKVVSGRTDNAVKNRFTTLCKKRARYEALAKENNTTFITPNSKRIISHNPSSVDRPAESAALAKRMRRAHIQNIAGDCNLKDRLHIQSGITYSQQQRAPFSTLAQNFRTSNSPPQQSESNQKEATDDAHGTNVQGTFLKKDDPKVTALIQQAELLSSLALKVNADNMDQSLENAWKVLQEFLSHKKDDDILQDCITDTDLQFEDFKVMVEDLRSSNEGSQTSWRPPDLCEESPASSEYSTASTISTHPVYDKAEEPQAEEVALHKVIETELQTNHSDEQGVVHNCCKGILSSSVTHGGTFQSCDEHVTATGVVSVSSNTECSSPVHVTPLFRSLAAGIPTPKFSESERHFLLKTFGMDSLSTSPPTNSAYQPPCKRALLQSL

SEQ ID NO: 1191 - protein, 489 aa, Eucalyptus sp.
MARKRKQEPTPSASADASQPPKRQQQQQLIKQEQQEAAAREQHAVDYIEVEVEEEVEEEVEEEVEEEEEEEEVEEEEEEEEEEVVEEEEEEGEEEDNQTANEDDDDDEPIQNLLEPFSKDQLISLLFEAAAQHRDVADRIRQMADVDPVHRKIFVHGLGWDATAETLTSAFKQYGEIENCKAVCDKVSGKSKGYGFILFKSRRGARNALKEPQKKIGNRMTACQLASIGPVPTHAGAQSAPLQLPQQQQQQVSEYTQRKIYVSNVGADLNPKKLTEFFAKFGEIEEGPLGLDKSTGKPKGFCLFVYKTVESAKKALEEPHKSFEGHVLHCQKAVDGPKPGKSQHTQHQNASNHSQRNDSAGFAGAAAAGLGQLNPAGIGFGQGAAAAQALNPALGQALTALFATQGAGLGLTNLLGTLGSATAVNPAMPPAGHGLQAAYGNQMNISPGLIGGGYGSQAGYANQQMGQGAGSRGHHAGQFSGSGPYMGGH

SEQ ID NO: 1192 - protein, 161 aa, Eucalyptus sp.
MICCNRKSFISVHCRQLKLDFECTGKALSNGSHYFYFSRMMNNRITENGYWKYLDMEEPVFGEAGEIIGMKKSLTFHIGEAPTGQETNWVMQEYHLVSFHELANSTQEPGSLVLSRVHESKTSHGQSLCSGGDEDSETDLSYMDEMFMLLDEDLDDISSGD

SEQ ID NO: 1193 - protein, 192 aa, Eucalyptus sp.
MGDNNVNLPPGFRFYPTDEELVVHFLQRKAALLPCHPDVIPDLELYPYDPWELEGKALSEGNKWYFFSRKTPDRITGNGYWKPMGDEPVFTSSSKRVGMKQSLVYYLGEAPGGTRTNWIMHEYRLSNGTNSGSSSSRSSKRKGYPKIDYSKWVVCRVYEHGDDDNDDNGAELSCLDEVFLSLDDLDEISTPN

SEQ ID NO: 1194 - protein, 204 aa, Eucalyptus sp.
MRDVKEKEEKDDGKMLKLPPGFRFSPTDEELVLHFLHPKKQQASLSPLYAHLVPDLKSHHHDPWDLHGKALSNGSHYFYFSRMMNNRITENGYWKDLDMEEPVFGEAGEIIGMKKSLTFHIGEAPTGQETNWVMQEYHLVSFHGLANSTQEPGSLVLSRVHESKTSHGQSLCSGGDEDSETDLSYMDEMFMLLDEDLDDISSGD

SEQ ID NO: 1195 - protein, 242 aa, Eucalyptus sp.
MEEYPTGFRFYPTEEELISFYLHNQLHGLQQDKIHRVIPVLHIFDTEPWNLPQLAGELCREDREQWFFFAPMQEREARGGRPSRSMTTGYWKATGSPGYIYSSDNKVIGVKKSMVFYVGKAPKGRKTQWKLNEYRAIELSPTNPNSSSSNISITKLKRELTLCRVYVVSGTSRAFDRRPLEAVVGETTIQGGGCATSSGGIGGGSGDISSSGIVAGDVGSSNQWETASLEEPTWDWDQLDWL

SEQ ID NO: 1196 - protein, 243 aa, Eucalyptus sp.
MEVPRFFASAAGIKLPIGFRFRPTDEELVVHYLRRKVLAVPLPAAVIPELDVFGTDPGGLPGNLRERRYFFSRRNRSSGGRECIRVAAGFGYWKYKTKSKQILASDGTGNQVIGMRKTLVFCEGKRSACDAAGARWILHEFTIAGTRENSKSTSMARAGDENWAVYRLFQKKTRPKRSDNGNGDFSHRKRKKSSSVIDLRSEAIAGDSPGTPPPPSSPCSSSITDNGSSCKALDQEDISSSSR

SEQ ID NO: 1197 - protein, 251 aa, Eucalyptus sp.
MDKLNFVKNGVLRLPPGFRFHPTDEELVLQYLRRKVYSFPLPASIIPEVEVCKSDPWDLPGDLDQERYFFSTREAKYPNGNRSNRATVSGYWKATGIDRQIVSSRGSQSQVVGMKKTLVFYRGKPPSGSKTDWIMHEYRLVNPEASVPPKIMNLNQTPVEPMESWVLCRIFLKRRSSKNEGETPVPCQNLKEAPKSRKNKPVFYDFMTRDLNLAPSSSSSGSSGVTEVSSHNNTDEHEESSCNSLRKALKH

SEQ ID NO: 1198 - protein, 255 aa, Eucalyptus sp.
MNHELPPGFRFHPTDEELIVYYLQNQVMSRPCPVSIISELDIYKFDPWQLTENAKLGEKEWYFFTLRSRKYLNGARPNRAAVSGYWKATGSDKAIYSGSKHVGVKKSLVFYKGRPPKGLKTDWIMHEYRLADSRTNVQHRSMKLDWVLCRIYKKQRSSKSLDRKVEDFHGQSNRTMTNEASDKQVMRLPNFCSLTPDLLQLDYFGPISQFLIGSSYHPTFDGQNIIVDGEAYGAEKKLQLHGNKVSCLYADQGKL

SEQ ID NO: 1199 - protein, 269 aa, Eucalyptus sp.
MEDLPPGFRFFPTEEELVSFYLRSKLKGTRGALHGLIDRVIPVLDIYEFNPSDLPQFAGDLCRRDPEQWFFFIPRQESEYRGGRPRRLTTTGYWKATGSPGFVYSNNHIVGVKRTMVFYTGRAPNGGKTEWKMNEYRAIEGEATSPQDISVLQATQEFSVCRVYKKTKTLRSFDRRPIGDIIGSSSHTFQQNTMPNDGRHPQDMTSSRRGSPPPTERASSSADSSSASGDHGTIPSQAGGLGSGIDIEMLPGESELSLQDWEQFWSGPN

SEQ ID NO: 1200 - protein, 282 aa, Eucalyptus sp.
MKGLSVSSGSGLPPGFRFHPTDEELIMHYLRNQATSRPCPVNIIPEVDIYKFDPWQLPDKAEFWENEWYFFTPRDRKYPNGVRPNRATVSGYWKATGTDKAIYSASKYVGVKKALVFYEGRPPKGIKTDWIMHEYRMTEVKGQAKKRSGSMRLDDWVLCRIYKKRATGKTLEPRIEESNHNVQATDKAYANLDATDPTMLKFPRTFSLTHLLEMDYLAPFSHILSDNPYSAIFDYQNTISSNNSANDSADQKPHGGHFPHHVAVQNSALNQNMIINPIFDLQ

SEQ ID NO: 1201 - protein, 283 aa, Eucalyptus sp.
MGLRDIGATLPPGFRFYPSDEELVCHYLYRKIANEEVLKGSLVEVDLHTCEPWQLPEVAKLNATEWYFFSFRDRKYATGYRTNRATISGYWKATGKDRVVHDPSTQEVVGMRKTLVFYRNRAPNGIKTGWIMHEFRLESPHMPPKEDWVLCRVFYKSKEDNAINTLPSPHYTFKEATAASSAPSANFDTSHYISSPNQAFSCGMMTYPQVASLSSTSSSLLSHKPHSTPNLPHQSKGASTKLIDDGYGFMWDMNFGDNSLVGDALPSNLDDMSIDMDGGSVFL

SEQ ID NO: 1202 - protein, 286 aa, Eucalyptus sp.
MKKAQLALPAGFRFHPTDDELVTDYLIRKCASQPISAPIIAEIDLYKFDPWDLPEMALYGEKEWYFFSPRDRKYPNGSRPNRAAGTGYWKATGADKPIGRPKTLGIKKALVFYAGKAPRGVKTNWIMHEYRLANVDRSAGKKKNSRLDDWVLCRIYNKKGTVEKHFPSALNKTAESPEMDTKPQIVMPAALNPYTPPQMTVDHMYMDSSESMPRLHTESSCCSEQVVSPNLSSCEKEVQSEAKWEDWENNLDFMDDFLDDPFPQGQLQSDQFSTLQDMSAYLQKPF

SEQ ID NO: 1203 - protein, 288 aa, Eucalyptus sp.
MKAELNLPAGFRFHPTDDELVNHYLLPKCASQAIGVPIIAEIDLYKFDPWQLPDMALYGEKEWYFFSPRDRKYPNGSRPNRAAGTGYWKATGADKPIGRPKPLGIKKALVFYAGKAPKGVKTNWIMHEYRLANVDRSASKKNKNLRLDDWVLCRIYNKKGQIEKHYVSDQKPVPFPEMEDKKPEPWMLNQSACSPLSQLVQSPMTNDLLHMDTSESVPRLHTESSCSEHTLSPDFMYEKEVQSSPRWNELDKSFEFINSYFLDEPFAAQVQYQPVQVSPLQDIFMKPF

SEQ ID NO: 1204 - protein, 293 aa, Eucalyptus sp.
MKRAQLELPAGFRFHPTDDELVNDYLIRKCASHAISVPFIAEIDLYKFDPWVLPEMALYGEKEWYFFSPRDRKYPNGSRPNRAAGTGYWKATGADKPIGRPKTLGIKKALVFYAGKAPRGVKTNWIMHEYRLANIDRSAGKKKNSRLDDWVLCRIHNKKGTIEKHSPSTLNETADFPEVEIKPQIVMPAALNPYTSPQYADSPMTTDHMYTDSSEFLPKLHTDSSCSEHAASPGSACEKEVQSEVKWDDWEKALDFQFGSMDDFLDDALVQGQFQLDQFSPLEDMSMYLQQSF

SEQ ID NO: 1205 - protein, 294 aa, Eucalyptus sp.
MKKAQMELPAGFRFHPTDEELVSDYLIRKCASLPISAPIIAEIDLYKFDPWDLPEMALYGEKEWYFFSPRDRKYPNGSRPNRAAGTGYWKATGADKPIGRPKTLGIKKALVFYAGKAPKGVKTNWIMHEYRLANVDRSAGKKNNSRVDDGVLCRIYNKKGTIEKHFPSAHDKPAEFPEMETKPQIVMPAAMNPYNTPPQYGSLMTMDHTYMDSSESMPRLHTDSSCCSEHVVSPDSACEKEVQSEVKLEGWEKALDFQFESMDDFLDEAFAQGQYQLDLFSPLQDASTYLQKPF

SEQ ID NO: 1206 - protein, 296 aa, Eucalyptus sp.
MTWCNNDNKSDEQRNESATSPPPSNNKAGVVAKRPPVFRTCPSCGHEFEIQDQTGIQELPGLPAGVKFDPTDQELLEHLEGKVRPDARKLHRLIDQFIPTLQGENGICYTHPEKLPGVSKNGMIRHFFHRPSKAYTTGNRKRRKVHTDEEGGETRWHKTGKTRPVFMKGELKGYKKILVLYTNYGKQRKPEKTNWVMHQYHLGNNEEEKEGELVVSKVFYQTQPRQCGSLMKDSSSLKLNGPSGHENANLKNNPALVEYYNSSYISFDQGSQNRASSQHQMIPRHFAVHGGSSFVS

SEQ ID NO: 1207 - protein, 297 aa, Eucalyptus sp.
MEQRDSSDTRLHDKKKNKDDEEEVVLPGFRFYPTDEELVGFYLRRKVEKKPLKIEFIKQVDIYKYDPWDLHDVSKMGEKEGYFFCIRGRKYKNSIRPNRVTGSGFWKATGIDKPIYSGKYPHNCVGLKKTLVYYRGSAGRGTKTDWMMHEFRLPPVEKGGDLSDANDTVTEEAEVWTLCRIFKRISSSRKYIATTECKETTFKQSSINSCSKSSSFESEYGDQCLSFGSDHSAVQPSDQKPATRHVEQAQLSWVNHCHSIPQAPVATPCLSLWNLNGDDIFANGINWDELRSIVHEE

SEQ ID NO: 1208 - protein, 302 aa, Eucalyptus sp.
MTVDMELPPGFRFHPTDEELVMHYLVRRCTSQPIAVPIIAELDLYKHDPWDLPGLALYGEKEWFFFSPRDRKYPNGSRPNRAAGSGYWKATGADKPIGSPKPVGIKKALVFYAGKAPRGDKTNWIMHEYRLADVDRSIRKKNSLRLDDWVLCRIYNKKGAIEKKQPHVQPQPPPVPAPAPAPVAIQSLGPAAASSFTEYEDEKPPVLTMPALPPPPPPVLNDLVHFDTSDSVPRLHTDSSCSEHVVTPELACEVQSEPRWKNEWESMLDFGGGCSYGYFTGGAAAGQMSPLQDMFMYLQKPF

SEQ ID NO: 1209 - protein, 305 aa, Eucalyptus sp.
MMSGTMIFEGDEQMELPPGFRFHPTDEELITHYLTPKVLDGSFRARAMGEVDLNKCEPWDLPGQAKMGEKEWYFFCVRDRKYPTGMRTNRATEAGYWKATGKDKEIRRMKKVVGMKKTLVFYRRRAPNGQKTNWVMHEFRLGDGYYQHHLSNSQKNDWVICRIFEKRPDGKKADQPETLPGGLERLSSFDNEPKASLLPLPPLVESSPFTTTSFSDRPEDRNVQKTSLFSSPSSSELDQSLGPTPSFGWSDTVFMHEQAILRMLLENSASNAKAEYADFSQARRQDREATMPTSFQCDVDCLWRN

SEQ ID NO: 1210 - protein, 313 aa, Eucalyptus sp.
MTWCNNSDPEGKAIQIVAGDASRGNCIIDPQGSAVRTVTCPSCGHNIELLDQGMIHDLPGLPSGVKFDPNDQEILEHLEAKAAADARKIHPLIDEFIPTLEGENGICYTHPEKLPGVSKDGQVRHFFHRPSKAYTTGTRKRRKVHGDTDGGETRWHKTGKTRPVLIGGAVRGFKKILVLYTNYGRQRKPEKTNWVMHQYHLGDNEEEKDGELVMSKVFYQTQPRQCGASVRDPSLDKRYTKEHQVLHGTSVVDYYNYSNPNFISNYDQVNPNRESPPQLIPNLVVQGDGSSFIQFTPDASKGKLVRNRDGGGG

SEQ ID NO: 1211 - protein, 320 aa, Eucalyptus sp.
MELESCVPPGFRFHPTEEELVGYYLSRKINSIKMDIDVIAELDLYKMEPWDIEGRCKLGYEEQNEWYFFSHKDKKYPTGTRTNRATTAGFWKATGRDKAVLSKNKIIGMRKTLVFYRGRAPNGRKSDWIMHEYRLQTSEHAPPQDEGWVVCRAFKKPCPSQRQGFEAWNHAYYVRDYMNPRPPPSLLPDASQAVSFSRHQFAPCQEPVSNHQSLWDSQLSELPQLDSPTLSTSLTTTNNYVSTHEEYDDGRSKNINNDGVQFINEWTSLDSLLTSHVNSSGNDYTTRLTEPSMHMQSSSLGFARETESQVGHFLGCFPDS

SEQ ID NO: 1212 - protein, 329 aa, Eucalyptus sp.
MKNCLQPNLPPGFRFHPTDEELILHYLRKKMTSTPLPVSIIAEVDLYKFDPWELPGKATFGETEWYFFSPRDRKYPNGARPNRSAASGYWKATGTDKIILDSSTGKNLGVKKALVFYQGKPPKGIKSQWIMHEYRLANSPVPIYSDKAIKLKELSMRLDEWVLCRIYKRSSAAYSITPMATASDDPEEEQRLTREDINNDNSTVDAIRPMMMMNGSSSFSNLFDAVDFSMLRNFLSDDYNGQCSNANDVRDVLVSTQSANQASLDQKMFQSLPQLTSYSAASQNPLKRKYSWNEDSDAANLVKRNLMSQTFLDQHVLLSPHLHHQFQGF

SEQ ID NO: 1213 - protein, 353 aa, Eucalyptus sp.
METMESCVPPGFRFHPTDEELVGYYLRKKVASQKIDLDVIRDIDLYRIEPWDLQERCRIGYEEQNEWYFFSHKDKKYPTGTRTNRATIAGFWKATGRDKAVYDKAKLIGMRKTLVFYRGRAPNGQKSDWIMHEYRLESDENGPPQEEGWVVCRAFKKRTTGLTKSTLEGWDTSYFYDEQSGTSSVIDPAECISRPVLGYMPNSSFVCKKEIEVAENLKLFNPDDSYFLQLPQLESPSLPLTKRPMSSVSLVSEINNNNHNSNNNEHLEEHNDDDSNKRVTDWRALDKFVASQLSQEERYEGDGITASFDQHDSSDMALMLLENARECEATKLSSFLTSGAGCDAGGICLFEKL

SEQ ID NO: 1214 - protein, 365 aa, Eucalyptus sp.
MEDEIVELPPGFRFHPTDEEIITHYLTKKVLNPNFNSCAIGEADLNKSEPWDLPKKAHMGEKERYFFNQKDRKYPTGMRTNRATESGYWKATGKDKEIFRGKSNLVGMKKTLVFYKGRAPKGEKTNWVMHEYRLEGKFSYYNLPKVSKDEWVVSRIFHKSTGIKKNESGLIPGLFPIDPSGDDELPNPSPSPSLPPLMDDSYFARPISSFPKSENDFPGMTSASAPRSAEGNYGDEMNGFHRFNPSNTNYQTDPSSSAFSSMFSGQLSFPISPYDGIDNPDFFLGFGYGGSDNTQAIIRGMAASQHETRGLEQTLIKGEQFAMSNNKSMVSHSQDTGLSTDANAETSSSAISKHEAGNFSDFLWE

SEQ ID NO: 1215 - protein, 369 aa, Eucalyptus sp.
MGDQQFREMENMARLGKEDDQIELPPGFRFHPTDEELITHYLQKKVGDTGFSAKAIGEVDLNKSEPWDLPWKAKMGEKEWYFFCLRDRKYPTGLRTNRATESGYWKATGKDKEIYRGKSLVGMKKTLVFYRGRAPKGEKTNWVMHEYRLEGKLSLNYLPRASKNEWVICRVFQKSSGGKKIHISSLVAAGSLENEMSSGLPPLTDSSPHDSKTESNPGSAYVPCFSSPTEFERNKENTNNYFNNPMFPISSNPTNTTPKISLLSPVYPHQAIPVPANWQHLGGSVFMPEHSVLRALLEGTGLNARQSARAEREAISISQETALTNDLNTEISSVMQDFEMGRRQFEDQQQVPSTLAGPMDVDLLWNYSS

SEQ ID NO: 1216 - protein, 371 aa, Eucalyptus sp.
MDGVCSDGRDGRIVSMADAASMYPGFKFSPSDAELISHYLTKKLEGIDKSVEQLIPEVDFSAHEPWDLPAKSIVPSESEWFFFSVRGRKYPKGSQSKRATEHGYWKATGKERNVKSSSAVIGTKRTLVFHLGRAPKGKRTEWIMHEYSMNAKSQNQQDSLVICRLRRSSQFQMGGASDLTQTSDVDRTDVSEGDNLAEGCARNCSGSYNSHSVEQIESSSNSSHQKNSDGNEDFYADILKDDIVKLDESSVSPTRDSLPTVPNNLEAELMSQDSQTLVQDFISPIPPFQGTANRRIRLRRHKPERSSKIVLEMKANDSSAEKAEPQTGSSGPSERRTRVIISRWLVYGILIGLTLLFVYLLGGFQLSIESR

SEQ ID NO: 1217 - protein, 383 aa, Eucalyptus sp.
MDMNLSINGQSQIPPGFRFHPTEEELLHYYLRKKMSNKKIDLDVIRDVDLNKLEPWDIQERCKIGSGPQSDWYFFSHKDKKYPTGTRTNRATAVGFWKATGRDKIIYGGSSRIGLRKTLVFYKGRAPHGQKSDWIMHEYRLDEGSNSSVGPSLVCESSPEDGWVVCRVFRKKSHQRTLESPKSTSTSSMDTEMLMNASADSSVLDQILSYMGRTNCESPENYQAPINISSMQTQLIHGKFLHLPRLDDSSHLGQETGLRTFYQKFDEIRIPGSDDPSSKHTSSDYEPKAGTAGINDWVALDRLVASQLNGQLEISAASKQSPYPGAPNPVLAGPAPGDHQVGQLSPLQLNRPNQIYSSESSFDWSFGKSSSVTPSNPLHHLSV

SEQ ID NO: 1218 - protein, 385 aa, Eucalyptus sp.
MIMKNPQSSLPPGFRFHPTDEELILHYLRRKVTSSPLPVSIIAEVDIYKLNPWELPAKAAFGEKEWYFFSPRDRKYPNGARPNRAAASGYWKATGTDKVIVTSSSSASAHQHHEKLGVKKALVFYKGKPPKGIKTNWIMHEYRLAESPAYNSRPNTNPLKLKDSSMRLDDWVLCRIYKKTNLSPTAGASVATPDQDLEEEEEEGLSNIHQNEMLKPFADIPNNHVQNNGGLMSQKSSSFSNLIDALDYSVLSSLLSDNTPQGVGVLGFDQLAPLIPNNSNHVDITDPHVFGSGTYNNGSSNCFPQKLPQLSPSSSAPFMEENRLKRHRSDADTAAYQAKKLLSHCSFTNTASQAADFPQYNLINSYPFLNQQLLLGPNNYAHFHG

SEQ ID NO: 1219 - protein, 397 aa, Eucalyptus sp.
MESRISPMNQQPAEKVVTEIALLLQQAIVGYRFHPTDEELINYLKSKVTGCRETFCIIPTLENIYEINPWDLPAKFDENSIVRSKDQEWWFICPQTQNQRISRKTPCGFSWKITGKHIDIKAKNDDKKIGSKITLVFIDGRNSKGTRSNWVLHEFHPHPDDTGFVIYCLKMKQYEKADTHAAVATNGDFSSTPQFQNHEVSFSELNEVIGKLSDEVYGQSDGSYQNRTKSLALIQEDNHYSSPNQERLEGTKDPSSTENSSGRGLAVPDPTNDELNFPHPFPNVDFCSANEAEKETINQLVAELFRSMEEEVDEMSGEQADKSCDSMDCDNPEQLPSAEHRVQEIQNQLRRLITNESSSSTEISSGSCHTVPANGVGLGPGCPLLVMLCFLMVTFFV

SEQ ID NO: 1220 - protein, 399 aa, Eucalyptus sp.
MNLSINGQSQVPPGFRFHPTEEELLHYYLRKKVAYEKIDLDVIREVDLNKLEPWDIQEKCRIGSTPQNDWYFFSHKDKKYPTGTRTNRATAAGFWKATGRDKIIYSGFKRIGLRKTLVFYKGRAPHGQKSDWIMHEYRLDESTHDPNALSPAGDASPEEGWVVCRVFKKKNYQKTLDSPKSPSSSTSMDSKAMQQMLAATANDGVLDQILSYMGRTCKVESETPTKLNLSHNNYNHNNNIKYPVSNTDLLHGKFMHLPRLESPILPLIPVASPPFDHQDCSFKLSYHSLDEMLAETSGHQGIGRSPTPDWVAMDRLVASQLNGQVAETPKQLSSCFSDDPGSDVGGLSMDDEVQFSHTKLSNKPSGQQSLEMYGCESNDLWSFTKTSTSSSDPLRHLSV

SEQ ID NO: 1221 - protein, 410 aa, Eucalyptus sp.
MEEEGMVVNQGREHQELMDLPPGFRFHPTDEEIITHYLTPKVLNSSFSASAVSEVDLNKCEPWDLPTKAKMGEKEWYFFCQKDRKYPTGTRTNRATESGYWKATGKDKEIYRGRGRLVGMKKTLVFYMGRAPKGEKTNWVMHEYRLEGKLAYYNLSRAAKDEWVVSRVFHKSTGVKKDPSPGLLTRINSYVDDFLDMSSPPPPLIDAPSSSRPSSSFTDGENELKGVINSGPRALDGNGSYFYFPADSTDNQNQVLLQEQGDRMNYCHVMNPSIDASHCPPQLSNHPPLFPSHGSTNPEEYLHQGPSDVGSSFGGTGFSCGSTDPALLRAIRANFGASNPQNNNQCKVEQFSSNHSMVSLSQDTGLSTDVNNEISSVPISKQEVGSCDAFEDLEGLSSVGPIQDFGFWDY

SEQ ID NO: 1222 - protein, 412 aa, Eucalyptus sp.
MGPETSTPSTSEISAPPSAQKTSSTALAPGFRFHPTDEELVIYYLKRKMCGKSFRFDVIADVDIYKTEPWDLAGKSKLKTRDQEWYFFSALDRKYANGARMNRATSSGYWKATGNDRNVQHESRVVGLKKTLVFHSGRAPEGKRTNWVMHEYRLVEEELEKCGNYKDAYVLCRIFHKANLGPPTGHRYAPFVEEEWDGKDNVVPSVETREEAVPQRNGMLQEMPSHVPPVCRNELPTKTQCLLAVCKSETMGETIDDPSAICPTNRETAPLLHYKRRRDIDLNSIDSTGSENSPKKTEGPSSSTITTARSAMNLTCGLSTLVEYSLMESLEIKEKPHLPLSTFAPANLNTTAPPECLDFIHSLREEIYKVSIERETLRLEMLSIRSMANVLQSKVEHLTKENEELKRKVQDA

SEQ ID NO: 1223 - protein, 418 aa, Eucalyptus sp.
MAGPSSREPQITMAASSMFPGFRFSPTDEELISYYLRKKLDGCEERVEVIAEVEICRHEPWDLPAKSIIKSDNEWFFFSARGRKYPNGTQSRRATELGYWKATGKERNVKAGSRVIGTKRTLVFHLGRAPKGERTEWIMHEYCMDGKSQDSPVICRLRRNTEFRINEGTDQASPSQRELSSVDDRNNVTSKGGIEGITLSEAGEGFARRCPSSYDSHSVEQTDSASESNQNLLNEGTMTESSIHQKDDTELPDVKFQDPEDDEEDFFADILKDDIIKLDESAVSPAPPPLPMVSRQLEAERRSQESIIASLLQVLNFPTEPGQRIDDPREPEQAITSALDGLELNKEYAADKDNKPSDEQSQTCLFTTIFSGKTFGRRLSAAVLAIAVLAGLLVLLLGGYPRAKTVARDFGFYVNFWK

SEQ ID NO: 1224 - protein, 429 aa, Eucalyptus sp.
MAGPSWLVDSHRIATKIRSASGASDPEKVKWKSNPTRACPNCQHVIDNSDVAKQWPGLPTGVKFDPSDSEIMHHLLAKAGFEGLKSHPFIEEFIPTVDEDDGICYTHPRNLPGVKQDGSVAHFFHRAIKAYNTGTRKRRKILGDDFGDVRWHKTGKTKPVMVDGVQKGWKKIMVLYTNLVRGGKSEKTNWKMHQYHLGTEEDEKDGEFVISKIFYDHQQQQLDQGEKNEQNNRERVDATTMKADPVSPKSATPNPPRTERRSCDSDPVQDSACGGPLAQHVETQCADLDGPLEIENPQHREQTISAPEMMVDGDQQAEEESKWWDSESQNLLDSQQLVEGLSLCDEFLQSQSPNRDDINHHVESKKRILLSDYAKLGPEDLKKDLEECHNLALDPANIELDTPPDFRLSQLEFGSQDSFLAWGGSKVVD

SEQ ID NO: 1225 - protein, 495 aa, Eucalyptus sp.
MAVLPLNSLPLGFRFRPTDQELIDHYLRLKINGRDREVRVIREVDVCKVEPWDLPDLSAIESRDPEWFFFCPRDRKYPNGHRLNRATPAGYWKATGKDRKIKLGRNLIGMKKTLVFYTGRAPKGKRTYWVMHEYRTTLEELDGTHPGQGAFVLCRLFRKQDETLECPTRDDAEVVVVSPTANSLPDDTESELVIAQDGPSVIAQDGPSSATQDKLPHEDCDLERRQCVLPKNEVNLPQESDLNLLGDAMTHPPLPLPMKEELETSFMHEVVNAISNHETGVQLQNDKNEDDISDFFNSIFNVDYEGPCDESGQCNLDFGSEIGKNGPIVEDSLLQNDLLQEATERQSGCQLEWNGAKDYEIDTLQMGMARGNFQMGFPDSNFHQDSSAAASLFGISDASQSDVRPNSIHLQDLGTSSTDLQSGNPFGTGIRIRSRSSQILQPQFDHGAQGSAPRRLRIQCKLQIGPLSCSRKPNDFISCDEVKKFKSINAEVRSS

SEQ ID NO: 1226 - protein, 505 aa, Eucalyptus sp.
MAMGSLGPGFRFHPNDDELVLYYLKKKVLGKRFLNEAIAEVDIYNFPPWDLRAHARLTRELKWYFFCPRERKYANGARTKRSTDYGFWKTTGKDKPVINNGKTVGMKRSLVFQRLGGEKKTERTDWMMHEYRLVEDLKLKGVAQDTFVICVIFEKDGPGPRNGAQYGAPFVEEEWEDDDNGEADVPSASGFTQEFILPDMQQHSERYCVGSTSNACPAGPSQMAPSVVNVPPPAPVNDVVMEDFQNPCDEYLHSNGIFVDDIPATSSENARVENFDNINLDGDHNAENKKDDTYEGLEDLSPYRCADDFSFINSDANICHPFEPFMELYDIAAPLTSTDGLGLSGHNNSEGFDHIIAAQGPWTSVSADDENCHGMGVKDLETAINCDSEAGQSNGVYFDSSISNLGGNNDLVTPGIISNPPIFAQPFCGSEVTCNAEDFPQFKWRPQSQGFEGCVDMHREGYGVECTNQEIVRYDAVAANSSINNPDLGCAHACENQGREHVGIF

SEQ ID NO: 1227 - protein, 654 aa, Eucalyptus sp.
MAMRSLAPGFRFHPTDAELVLYYLKRKVLGKRLHIEAIAEVDIYNFPPWALQGHARLSRDLKWYFFCPRERKYATGGRTKRSTAYGFWKTTGKDKSVINNGKTVGMRRSLVFQRLGGEKKTERTDWVMHEYRLVEDEDLKTKGAAQDTFVLCEIYKKDGCGPRNGAQYGAPFNEEEWDDDDVEADVPSASGFTQEFILPNMEQHSERYCKGSTSTACPAGPSQIVPSDVNVPPPAPANDITMEDTQNPFDEYLRSNGIFGDDIPPTSSEDDRVENFDNINLDGDHNAENKKDDTYEGLEDLSPYRRTNDFSFIHSDENICHPFEPFMELYDFAAPLTSADGPGLSGHNNSEGFDHFIAAQGPWTSVSADDENCHGMGLKDLETAINCDSEAGQSNGVYFDSSISNLGGNNDLVTPGIISNPPIFAQPFRGSEVTCDAEDFPQFKWRPQSQGFEGCVDMHREGYGVECTNQEIVNYDAVAANSSINNPDLGCAHACENQGRGEETIFCCMVRFLEYPSYPSSAVERPAPCIGAKRSDGHALFLLYGYSSFHIKAEVTLGGGGRGCTNDALSCGLEGFPFVTDREENGSGSGKGAANYGCGISSTLFLLTLRSPCCPPWGDVYYWRLTSWLSFLAAAWLIVHISVWFQLISTNSSV

SEQ ID NO: 1228 - protein, 670 aa, Eucalyptus sp.
MGVLEMEALPLGFRFRPTDEELINHYLRLKINGRHSEVKVILEIDVCKWEPWDLPDLSVIKTDDPEWFFFCPRDRKYPNGHRSNRATDAGYWKATGKDRTIKSRKSGGATASLIGMKKTLVFYRGRAPKGERTHWIMHEYRATEQDLDGTGPGQAAYVLCRLFRKAEEKPEVVKYDEVEQTGLSPTAKSSPDEALSDVVPETPVSNVQVKSQSDGIKRWLTDESDKMTPSTQMPVESCSNSYIASDVEDGNTDGTPLEVNPLLESGPKFYDLPCDPTDHKGLFPEQTQLKTGQAPYMDSPFACDFGNDLEGLLFHDAGEHEITLSDLLDEVFNNQDDSCEESTSQKNSVGSEIPFDPPFNLSQPVLGVKDNVWYDDLVDNNNWMDALPLWGPSGAVASNNMAESTGESFNSNGGTPIKIRTRDSQVLPHSSDYGAQGTAPRRLRLAVDRANQLPRSVKLEGADEGMRGTGSNAEEEVQSTAEESSVNHNDNTIVGTNIKIRTRQPRHQPGSENSIVQGIAPRRIRLQMNSQSGSTRDDEVKTSSFDEEVQSAPTKVKEETDNISDHNEPERDGQLPAHDKMTEIVEEPCTNLTLGSKTRWGIAQSCDGSSIFGNTFSTPCFSFPLIFTFRSRHVSCHSPGRSFLWWGTEIHQTGHCVEKEPFSIPSLHMA

SEQ ID NO: 1229 - protein, 751 aa, Eucalyptus sp.
MGAVIIPRNPPVGYGFRPTDEELVDHYLKLKVLGITGDVCIIPEVDICKWDPWELPKKFEEQSIIPPDDKVQEWWFFYLQTPRIQRSTPLGYWKKTGVDRTIKAGDRNRAIGTKKTLVFYKRHGSEGVKTNWVIHEYYLLTNNLNELFPHALTKSYVVCHLKHKGNEESDFSALQLNGGAISLMDLDSGLHQPAQNNSFPEPWSEAVGNSSISLADLDSNLHQPEHENLFPEPWIQAVENPSISLVDLQSDLRQPEPENSCPEPWILVDSATEPSLQQDNQVQVITSILPQTSFQSEIVDSQTDLHVRNFGSPSFADLPLDDDLVVYFDESNQLQVGYIDRDQIQTQYGPKCSPDDEHAVLRKSQRAKMIKSLHGVVSLDEKKGFIEHKFNGLHISSPKHMEPPKKPEIARTYSTDEESRVEKVEKLELAARNIKPECVTLDELEAKAKYGQTSSSRNAHAMVENWQTPTIETLHGQTSSSRNKNATEKTGQTLAIELPHGCREVPPEEKKSFDGNESNCSNVFPPKRMDPLEEPATVRIYSKGEKMRFLEVKKQELAAKNIKPNCALLDDLATKAKSHNEHVVRIGTVEPLNGVAPLHKKKGFDKNKFDSLHVSSTKHTELLEKLRKEDLATRNSKSVYIPLDESIAIAKHDQASRFHKGSILEENWLASTKKSLDGVLKGKKGFTESELDGWEIVSAKQTEHPKKAGNAGISCKYKDPRLEKLKMPEFSAREISNQKVHLWLNQKPDQR

SEQ ID NO: 1230 - protein, 892 aa, Eucalyptus sp.
MEDVAFTPNFTSESLLDSAMDLDLMDQLLLEGCWLETTDASNYPFRGIFQEEAGKDFAESPPSTCPRIEERLEMEQKNINPFEATASSSQSEGFQIEGTEVGRRCWIAPTANPGPSSSMKQRLMMVLGRLKECTKDKDVLVQIWVPVKKGGRNVLTTIDQPYVHNPNSKSLESYRNVSKTYQFLADEETKESVGLPGRVFLGKLPEWTPDVRFFSSEEYPRRDYAQQYDVRGSLALPVFERGSGTCLGVVEIITTSQKINYRPELETVCKALEAVDLRSSQTFRPPSAKACNQSHQAALPQILEVLTSVCRQYRLPLALTWASCLRKEACSEHHLLRGQGIVGRAFTINQPCFAADITAFSRKEYPLAHHARMLGLCCATAIPLASIHTGSVDFVLEFFLPRDCRDAEEQKQMINSLSSFVCQTLQNSQKEQKETLVSSTRYTGVNTSDKRIQVEETDKLLPSLNKRHPQEVSWIANMVEAQKNSKGISVPFEVQKEPKEEFTVTTKWEETEIGLQHGQFHPEFHRVQQNLENKPNVEGGDTLGQFPSIGGRKSGQRTRTKTEKTISLDVLRQYFAGSLKDAARSIGVCPTTLKRICRQHGITRWPSRKIKKVGHSLKKLESIINSVQGAEGTIRIRSFYESFPELNSPRHSEKGTFSSANLGNPLEQLNPQTENGLFSSGATTSNSPSSSCSQSSGSTTSFSTGTKQCFTAITALSSGDPVMSNNPSEVLKRTRSDAELHISTHEEPKPLIRSQSHKSLDEWGSLENVATLPKTNSPRITRDLGIYRIKAILGEEKIRFSLKPSWGLRDLQREVANRFNIEDIGTIDLKYLDDDQEWVLLTCDADLEECIDVYRMSRNHTIRISIHQSSHQNLRSLGGSSGEAQHRGHIHL

SEQ ID NO: 1231 - protein, 352 aa, Eucalyptus sp.
MDGISCTDESTTSSDSPSFSPPPAKPSPPPPGSLWRVGSAASTVLDPAPDGGAEAESHKKLPSSKYKGVVPQPNGRWGAQIYEKHQRVWLGTFNEEEDAARAYDIAAQRFRGRDAVTNFKPDGAMDPAEADFLAKHSKPEIVDMLRKHTYRDELEQSKRSYRGSAAERAGRGGFGPGRTEWSAAAREQLFEKAVTPSDVGKLNRLVIPKQHAEKHFPLPGGPAATMKGVLLNFEDVGGKVWRFRYSYWNSSQSYVLTKGWSRFVKEKSLKAGDTVCFQRSTGPDKQLYIDFKPRGQPPAGPAAPPPPPVQMVRLFGVNIMEVPYCGGGKRMRDVDLLSFECRKKQQMVVGAL

SEQ ID NO: 1232 - protein, 178 aa, Eucalyptus sp.
MEKGKHRAFLEEKLKAEPAAECEDGPGGGDGEDDDDSKRKKVPPSSGSRRGSGATSRNCQAEKCTADLTEARQYHRRHKVCEQHAKAPAVVVGGLYQRFCQQCSRFHELLEFDENKRSCRRRLAGHNERRRKNPAEPHIEGSSGKAGGSTQMKELVCGQVDNRGRIQENATYKHFQIR

SEQ ID NO: 1233 - skipped

SEQ ID NO: 1234 - protein, 377 aa, Eucalyptus sp.
MDSRRPLNHSASSSSSSPPTSASTDGPEIHFGDVGPGVQAKPGGSTSSRSGSQGTPPKKARGADGGSGGGGAHQPPRCQVEGCNVDLSEVKTYYLRHKVCGTHSKAATVVVRGLEQRFCQQCSRFHQLNEFDQGKRSCRRRLAGHNERRRKPPPGSAHYSRHSRFSSSIFDNSTGSAGLVMDFSAYPGPPPREAWIAPQASNRGPGNQTLGREKLQLHPPWQSSPESHQYNLFLQGPSPSVGGTSFPGPGIPPGESFNPSCALSLLSNQQPDSASQASGRALNSDVLSRQASVGAQVINPLDAAVGNFSSASWALKVNEAGGSTPDIAPDLGLGHVSQPLNGPFSSGLEFSLQSRRQNTDQDHSQDYNSTQQRHWSL

SEQ ID NO: 1235 - protein, 390 aa, Eucalyptus sp.
MDVGSGSWTTESGSSSPPPLESLNGLKFGQKIYFQNNNSSNNAAAPKHGSGSGSGSSSAAAPAPGSGTPPKKVRASAGGGGCGAIQGGQPPRCQVEGCRVDLSDAKAYYSRHKVCGMHSKSATVIVAGIEQRFCQQCSRFHQLTEFDQGKRSCRRRLAGHNERRRKPPPGSLLSSRYGRLQSSIFENTTRVGSFLMDFTAYPKHAWSAPRFSERTTPGDLVPGPGKVYPHPWQSSPENPPSDLFLQCSSGGTTAFPAPGIPPGECFTGVADSSCALSLLSNQPWGSTNQPSPLGTNHMVHPQGSTLAQSMPPHSSAIHFTGPGSAWAFKGNDAGGSSIGLAADLGLGQFSQPLNNQFSGDMELSQHSRRQFMELDPSRAYDSTHQTHWSL

SEQ ID NO: 1236 - protein, 206 aa, Eucalyptus sp.
MGSIVSPQDFPSSDQNSPPNLAAAAVEAPPPKPHRQVALSRKSTAAPARDRHTKVNGRGRRIRIPALCAARIFQLTRELGHRSDGETIEWLLRCAEPSIIAATGYGSMPADPITTTVGALPPSSTPASAPCPAQPLALAPPAAGHGAFPISPPPDCRLDLSQPNGFDFSAGGCATNGYRHMPFTALLLQPTATEEAEERQQREILG

SEQ ID NO: 1237 - protein, 358 aa, Eucalyptus sp.
MGMKSTEGEIVQVQGGHIVRSTGRKDRHSKVYTAKGPRDRRVRLSAHTAIQFYDVQDRLGYDRPSKAVDWLIKKAKAAIDKLAELPPWQPNSSSVPSTSTAPDSAAHNGNSAEMAVAEESESPKYNFQLHRQISANSRNATSQFLPPQLENDQSMLETMKSFFPTSSAASSINFSSYPSEIMSRSTQQNQDLGLSLHSLQSQSALIHQSDPQENEMSQTLFSTSAPMVYEPGFQRMMGWGTDPSGTDNRSGGRFLFNSPTPLTLPLPLLSQGSAAFPQRGTLQSSFAPTFRSLDEFSVDSADHHKSQVIHHPSSLFGNRFVSDGLPGFCISPQIQNNGAPHDVVSARPSSSASLSNGR

SEQ ID NO: 1238 - protein, 427 aa, Eucalyptus sp.
MEGGDHDHFHHHYHHHHRRPTFPFQLLEKKEDEQPCSTSNYPSLAMSSDDAPPNPNRSSSTSNTLQIVPAEDQQQQQTLAAAGADAGAAGAKKPPPKRTSTKDRHTKVDGRGRRIRMPALCAARVFQLTRELGHKSDGETIEWLLQQAEPAVIAATGTGTIPANFTSLNISLRSSGSSMSVPSQLRSSYFSPNFSLPPQRRGNPALFPGIGLSPESTTTLLNFQGSSSNLSSMLFQAKQELREASNLELSEGADHEGMSKKRRPDQLDLSANSQPQSHAGSYLLQSSSGVLPASHGNLPANFWMVTNPSNQVMSGDPVWTFPASVSNSAALYRGTMSSGLHFMNFPAPVALLPGQHLGSAAAAAGAGGGSEGQFNMLGGLSPYRPMSSSGVSESQASGSHSHHGGGGGGGGGGGDDRQPPFSDPGGD

SEQ ID NO: 1239 - protein, 409 aa, Eucalyptus sp.
MYLSEKPRPIDFYKEESAPRDMIIEVVSSNGDIPPHHPHPHPHPHPHQHQHPHPHQHPHQHQAPPAPPPPPPPQPHHQMILGESSGEDLEVKAPKKRAETWVQDETRCLIALRREMDSLFNTSKSNKHLWEQISSKMREKGFDRSPTMCTDKWRNLLKEYKKAKYQDRGSAKMSYYKEIEEILRERSKNNQYKSPTASALKVDPYMQFSDKGIEDAGMTFGPVEASGRPTLNLERRLDHDGHPLAITTAEAVAANGVPPWNWRETPGNGESQSYGGRVISVKWGDYTRRVGIDGTADSIKEAIKSAFRLRTKRAFWLEDEDQVIRSLDRDMPLGNYNLQLDEGLAIKVCLYDESGHISVHPEDKIFYTEDDYRDFLARRGWTCLRELDGYRNIDNMDDLRPGGIYRGVT

SEQ ID NO: 1240 - protein, 486 aa, Eucalyptus sp.
MEMEDHHQYTAADLRHLINARPPPPPPHIQSISPPELFCGGGGHRNPTQHLESMMMGGGGLHNGQRQGHNHQHHHQFGRDHSSPSSVAMAGAAGGLESENGGNGRWPRQETLTLLEIRSRLDSRFKEANQKGPLWDEVSRIMSEEHGYQRSGKKCREKFENLYKYYKKTKEGKAGRQDGKHYRFFRQLEALYGENANSNSILQAPSLPHSLHFHPPPNINDINQDASHHRHPHQLQRPCESLSLSNSSDFDTSSSDDNEEDVSVEKGKKVRRGKRGWKIKIKEFIDSQMRKLADRQEAWLEKMMKALEEKERERELREEEWKQQEMARIEREHKFWEKEKAWIEARDATFMDALQKLTGRDLKFVPSPNELLAAAEIQTHQSDGLTKWSKDFDNFKKRKDNSRWCHYPSGSDEVMYNQGGSNCEIIKEQGPESMTRSVQMNNGSSSPSNSNAGNAMQESCFRFMMVEGDNLWESYGMKLTKGDQNQ

SEQ ID NO: 1241 - protein, 403 aa, Eucalyptus sp.
MPIKSLIHDMRSRSSRAVHDGSAAAAAAAAAAEEAAARAAAEADGLSRSCWANMPQELLREVLVKIEASEGSWPSRKSVVACAGVCRSWRHLVKEIVKVPEVSGILTFPISVKQPGPRESLLQCFIKRNRSNQTYHLYVGLTNALSDDGKFLLAARKCRRPTCTDYVISLHADDVSKGSCTYVGKLRSNFLGTKFTISDGQPPHPGAKMPKSRSTRLVSSKQVSPRAPAGNYPVAHISYELNVLGSRGPRRMHCTMDAIPASAIEAGGVAPTQTELPLSSVEFFPSLPFFRTKSNRAESVSSGPLVSQKDGALVLRNKAPRWHEQLQCWCLNFHGRVTVASVKNFQLVASPENEPAGPQHEKIILQFGKVGKDLFTMDYRYPISAFQAFAICLSSFDTKIACE

SEQ ID NO: 1242 - protein, 408 aa, Eucalyptus sp.
MASFKSIIQDVKDEIGNISRKGFDHVKFGYGLRSRSHRVVQDSSVVVDALKQSCWASMPPELLRDVLMRIEKSESTWPPRKNVVACAGVCRNWREIMKEIVKTPEVSGKLTFPISLKQPGPRDSLLQCYIKRNRSNQTYYLYLSLDQALNEDGKFLLAARKLRRPTCTDYVISLNPDDMSKGSSTYIGKLRSNFLGTKFTAFDAQPPSAGSRVMKSRSTRLVNFKQVSPKVPAGNYPAVHISYELNVLGSRGPRRMQCVLDAIPASSIEPGGVAPTQTEFVSSTLDTFPSFSFFRSKSTRVENLESGRPMSAPKDGMLVLKNKSPRWHEQLQCWCLNFHGRVTVASVKNFQLVASPEQGVAGTEHENVILQFGKVGKDVFTMDYQYPISAFQSFAICLSSFDTRIACE

SEQ ID NO: 1243 - protein, 415 aa, Eucalyptus sp.
MSLKNFVRELRREMKDGIGNVSRRGSEGRRWCSRTRSHIAPDHAAPPSMSVEQGRWANLPPELLLDIIQRVEESETLWPSRAVVVACASVCKSWREITKEIVKTPEQCGKLTFPISLKQPGPRECPIQCFIKRDRATSTYLLYFGLVPSEDEKDKMLLAARKIRRATCTDFVISLVADDFSRASSTYVGKLRSNFLGTKFTIYDTQPPCEAAIQSNSRLNRRFNSKQVSPRVSACNYSVGTVSYELNVLRTRGPRRMHCEMDSIPISCLQEGGSVPTPSLFTHSFDEPSSLSPASKGKDKVTEFSSTSLLDIPVPVPGAGDPLVLKNKAPRWHEQLQCWCLNFRGRVTVASVKNFQLVAAVDPSHKISAAEQEKVILQFGKIGKDIFTMDYRYPLSALQAFAICLSSFDTKPACE

SEQ ID NO: 1244 - protein, 421 aa, Eucalyptus sp.
MHIKSIVHELREIRDRIKDIAGRKLERRHVHRQGRSHIVPETTVPTPSRPEAVQQGPWANLPPELLLHIIKRVEASQISWPSRRDIVACASICRSWREVTKEAVKTAEQCGRLTFPISLKQRGPRDFPIQCFIRRDTANSTFFLYLGLSPDLSEGTSKLLLAARKIRRALSTDFVISFIADDFSQAGTSYVGKLSRSNFIGTKFTVYDSQPPWDAAIQSNHKSYGRQNPKQVPPSVPSGKFSVATISYELNVLRSKGPRRMHCNIRSNPTSAIQEGGTAPTPTEFSRISVEPYLSPLPLPASNGKKQLNEHSSTSCKLLKSTHGAWDPLVLRNKTPRWHEQLQCWCLNFRGRVTMASVKNFQLVAALEPYQNIPTTEHDNVILQFGKIGKDIFTMDYLYPLSAFQAFAISLSSFGTKPACE

SEQ ID NO: 1245 - protein, 424 aa, Eucalyptus sp.
MSFRSIVRDVRDGFGSLSRRSFDVRLLGHNRGKSQGSVHELHDQPLLVQSSRWASLPPELLHDVIRRLEASESTWPARKHVVSCAAVCRSWREMCKEIVKSPELSGKITFPVSLKQPGPRDGTIQCFIKRDKSNLTYHLFLCLSQALLVENGKFLLSAKRTRRTTCTEYVISMDADNISRSSSTYIGKLRSNFLGTKFIIYDTQPPYNNAQLSPPGRSRRFYSKKVSPKVPTGSYNIAQVAYELNVLGTRGPRRMHCAMHSIPAAALEPGGTVPGQAELLPRSLEDSFRSISFSKSIDTSTEFSSSRFSDIIGPRDEEDDGKDRYLVLKNKAPRWHEQLQCWCLNFRGRVTVASVKNFQLIAANQPSAGAPTPSQPAQSDHDKIILQFGKVGKDMFTMDYRYPLSAFQAFAICLSSFDTKLACE

SEQ ID NO: 1246 - protein, 424 aa, Eucalyptus sp.; identical to SEQ ID NO: 1245

SEQ ID NO: 1247 - protein, 424 aa, Eucalyptus sp.; identical to SEQ ID NO: 1245

SEQ ID NO: 1248 - protein, 195 aa, Eucalyptus sp.
MENLSYSSSLLPCPPSPPLSSSSPSFLSLNPRLTGLGAYNAEFKGHGDNNIEQSGYLGLDMSNSSSLDHRRVPEAPAAVDENDAENALKAVKKKGGKKVRKPKYAFQTRSQVDILDDGYRWRKYGQKAVKNNKFPRSYYRCTFHGCNVKKQVQRLTKDEGMVVTTYEGMHSHPIEKSTENFEHILSQLQIYGASL

SEQ ID NO: 1249 - protein, 241 aa, Eucalyptus sp.
MEGERGSSSSSVPNYDLQVTFSGASHGIHEIGFVPFEDQNQVLGFLTPAPPLIAAGEGATAAATTTTSRVGLGHHNGLVARSSWNNDQVGAHDPKAVSDENCSANPSEGNNSWWRSSTAAAEKGKMKVRRKLREPRFCFQTRSEVDVLDDGYKWRKYGQKVVKNSLHPRSYYRCTHSNCRVKKRVERLSEDCRMVITTYEGRHNHSPCDDSNSSEHEGFNSFYYCPKTEPKKHCPGEFGGR

SEQ ID NO: 1250 - protein, 279 aa, Eucalyptus sp.
MDRRFYTNPFVHDQEEDPEPEQGPDSPSSGEDSKVNASEPSQKRRKSVKKRVVSVPIAGDPEGSKSKGEAYPPSDSWAWRKYGQKPIKGSPYPRGYYRCSSSKGCPARKQVERSRLDPTTLLVTYSSDHNHAVPSSSSSKNHHHLRAAAVSDSSASASASASASASAADPDDCISAMFEPDELAGFIGGATLLDPGFDWLADVASTSSFLQRPVYEGGGAEAAPVHRMRDEEEGEDPLFADLGELPECSLVFRRTKLLEPEGESRRRGLSAVPCVGNVV

SEQ ID NO: 1251 - protein, 287 aa, Eucalyptus sp.
MAVDCVKMVDNERAIQEAAAAGLKSMQHLISFLSSPPQPSSNPDPHHHHHLQQPSDSAAHLTDFTVSKFKQVISLLNRTGHARFRRAPQPPLPLDLVLESKPDPPKPATKPLSQAHPSLCQSQSLSLSPSQDFFSMSQPMSSATSSFLSTITGDGSVSNGKQGLSPPTMSAGKPPLASTHRKKCAEEALSAGRCHCSKKKKHRVKRVVRVAAETAADQYTWRKYGQKPIKGSPFPRGYYRCSSVRGCPARKHVERAQDDPRLLVVTYEGEHRHSVSNAISYGSMPDA

SEQ ID NO: 1252 - protein, 289 aa, Eucalyptus sp.
MAADSVAPKLDMDDPEGAKPEGQASKRRKLVHKTVVRVKIEANVVKQKNEGPPSDFWSWRKYGQKPIKGSPYPRGYYRCSTSKGCSAKKQVERCKTDASVLVVTYTSTHNHPGPDIHSLNPTVQPSEADDDPEETAVAVAVSPAVSAQEEVPEQDQDQEDQDQEQHLDLGDKQDRDRHTHVGIDEADRAREDNFHYLRSPTNCSSQDLVMEQDDTLAPQLQVYEEPLVSCSREDPSGVGAAPVPPEPEPEPKEGHDFFDELEELPVFSYFANLNRINHFIDDRIPVVPS

SEQ ID NO: 1253 - protein, 292 aa, Eucalyptus sp.
MHGSFQSGSFMTEHDDNGSSPENSIGESPPWPSRYGDTMKTGPTATSPKRSRRGMQKRVVSIPIKDVEGSRLKGEGAPPPSDSWAWRKYGQKPIKGSPYPRGYYRCSSSKGCPARKQVERSREDPTMLLITYSCEHNHPWPAAKNNHHHLNHQNSSAVTSAVEEKPKMLANLPNPEAEPEPKPEPELEPDPEPEEKFPDMSDESVLMCATDEFSWFMDMPTTSSTILESPIFTESGNNSASKGAAIDADMAMFFPMREEDESLFADLGELPECSVVLRHGRSGGVSTQVQIC

SEQ ID NO: 1254 - protein, 302 aa, Eucalyptus sp.
MGSNWIVDTSLELNTSYPKKEIVLENDNSRRGRPEEPVIKHEAGALMEEYRRVSHENRKLTEMLTLMHDSYNTLQNQLIVLENKTSDGELGASRKRKHEANIAAESCSYEEDRICKKPKDIFKPMITKLHFQTDVSDMSLVVKDGYQWRKYGQKVTRDNPSPRAYYRCSFAPTCPVKKKVQRSVHDPSVLVATYEGEHNHLSPSQPAIPLGSDKQGLNQGTRPIPSPSKSRSSSPRSTPDLIRLGCDTLSAKTGQEEEVTAAFQQFLVQQMASSLKTDPNFTAALAAAISGKLVDQARIGKW

SEQ ID NO: 1255 - protein, 315 aa, Eucalyptus sp.
MDSSSWITSSLDLSIRPLQVSEEPPTKVVESDFMELGRTGSGNKDESGALHEELNRLAAENKKLSQMLMTVCENYNALRNHVIEIVSKNAEREVSPSKKRKSESSTNDNGNEMVVNRASESSSTDDDDLYKKPREETIKAKITRVYYRTEGPGTSLIVKDGHQWRKYGQKITRDNPCPRAYFKCAHAPSCLVKKKVQRSAEDQSVIVATYEGEHNHPSSSLLEATCGSNARATLDSVPRSASLSSSGPTVTLDLMKPKQETDVKSSQPKVDSPELRQFLIEQMASSLTKDPSFTTALAAAISGKMVGPYPTEKWI

SEQ ID NO: 1256 - protein, 321 aa, Eucalyptus sp.
METFWLERSLSTNSSSKRRAIEELVDGRESAMRLKTLLRKPSGNNGSQPADELVVKILRSFTESISALSSCEESEVREVMSPQIGGFGAGCDDQGSEHSGESRKRPGLKDGRGCYKRRKESETRTTISPTKDDGHAWRKYGQKDILNSKYPRCYFRCTHKNDQGCRATKQVQKMEDDPKMYQITYIGNHTCREITRAPQMITDSDPWESSYTPSRNNSDTKPLTNSQQSFVLCSANNSIKKEEELAPVKEDTTTTSSDLTDNLSSFDSLLPPELMGFESSDPTAMYLSGVDDSPQSFLDMDTMGRFGFDGEFPFYENLQFS

SEQ ID NO: 1257 - protein, 324 aa, Eucalyptus sp.
MKERAKMENTDGSASLLFADHGHGGLSDFVFSEFDRSMMAGSSGFMELLGFHQDSSGPSLFDVPLQPPTSNAMESSSEVVNPPATPNSSSISSASNNDGLNNNNEEEEQQVKAKVEDEGVETQEQEEHQKTKKQLKAKKTNEKRQRQPRVAFMTKSEVDHLEDGYRWRKYGQKAVKNSPFPRSYYRCTSASCNVKKRVERSVTDPSIVMTTYEGQHNHMSPVMPRSILAGVTHPPAGAAATAFSVPAMPGASLTQHHALHYQLQSYANNWSMSNNSAVVPSSGSTNAAVLLNKRRFCSPGPYNFLADNGLFQDMVPFHVLKEEE

SEQ ID NO: 1258 - protein, 337 aa, Eucalyptus sp.
MEKVISWEQHNLISELVQGKDLAKQLRNHLVSPSSSRETHEYFVEKILSCYQKSLAMLNCDALAEEHRPAFSIGTSGSPKDEGDACKKRKTMPRWTEQVQLNSEAGLEGHHEDGYSWRKYGQKEILGARFPRAYYRCTHRNAQGCLATKQVQRSDQDPTVVEVKYRGRHTCIQARSSAISPDPIIKEEPPKATAIRQEQPKPSLDTLLSFKWGLNVKAENARQDDVFPLFTFSSPAVETENGERDYFADALMDDGFMDTFSSPATSGSNYFSLSLDHMANFCPPISVQTPESGLTEIVSAPTSVTNSPMGDAAFSAFSLGKDDFNLDCSFDGSEFLL

SEQ ID NO: 1259 - protein, 343 aa, Eucalyptus sp.
MAIELHLGFSKMEDHTAIQEAASQGLKTMEHLIGVLSRQNLHHPGAVDCTDLTDRTVSKFRKVISLLDRTGHARFRRAPLPSSSSSTSKSAPVASPVPPAVQSRSQPLAPTPIQAPTSSQPSPASFLHAQPKQSLTLDFTRPSILGPNSKGVSEIEFAKDSFSVSSNSSFMSSAITGDGSVSNGKLGTSMFIAPASGPASSAGKPPISSVPYKKRCHEHDPSDNISGKHSGSGSGKCHCSKRRKNRVKKVTRVPAISNKIADIPADEFSWRKYGQKPIKGSPFPRGYYKCSTMRGCPARKHVERAPDDPTMLIVTYEGEHRHSQPASQEIVPAGAMNLVFKST

SEQ ID NO: 1260 - protein, 344 aa, Eucalyptus sp.
MDYSSCISTSLDLNIRPLRPHDEAPKREPQETDFMDLGLNTSAKEETGALVEELNRVSAENKKLTQMLTVMCENYNHIEKPGDGLHEQDIAEKELSPSKKRKCDSNNNIGENNNNILANGASESSSTDEDSSKKPREEKITAKISRLYVRTEASDTGLIVKDGYQWRKYGQKVTRDNPCPRAYFKCSFAPSCPVKKKVQRSVEDQAVLVATYEGEHNHPTQMEETQGSSRCMAIGSVPCSTSLNSSGPTITLDLTKSKSPIVSPSSNNNNDNNNNNNNNNNNNSNSNSNNSNKITLKPKTESPEIQRFLVEQMASSLTKDPSFTAALAAAISGKIFHQNPTGKW

SEQ ID NO: 1261 - protein, 360 aa, Eucalyptus sp.
MDGGWSFEQKTLISELIQGMEFAKELRGHLTSAPSTEARDVLMQGILSSYEKALLILQWGGPMPQSQPVVAVSGIPESPLSVNGSPRSDEFEKGIGDHQQNRDISKKRKLMPKWTDQVRISSENGLEGPHDDGYSWRKYGQKDILGATYPRSYYRCTYRNTQNCWATKQVQRSDEDPTVFEITYRGTHTCGNSGPSVPSPASSEKQEQKQINHQSNHHQHLQQQQSQEMLSKFRAGLRVDTNNLDNNEKAYHPFSFPSASVGLLQIEHCSSSTLTNVNSSLFGSFSSTFFSPSTPESCYFSMHQANDLGQAHNMQHLESDHNEIISTNTSSTNSPIMDLEFSLDQVGIDPNFPFDTSFFP

SEQ ID NO: 1262 - protein, 400 aa, Eucalyptus sp.
MCSFSSRSRERGMAVELMMGYGSGGDGGVGFAVKKEETALREAASAGIQSVENLIKMLSSSPSPSPSGGGAGGGRRAGQDSPSPSSSSSGGPSPAVDIEAATDAAVNKFRKVISLLDRARTGHARFRRAPVADPLPENREAFTPVRPAENPVGSARLQSAEPVSAFKVYCPTPIQRLPPLPHNHHHHHNHNHHHHHHHQVQQNPIPVVPKVERKESATPTTINFSTSPPISAANSSFLSSLTGETDSVQRSFSSAGFQMTHHLSQVSSADKPPLSYSLKRKCSSMDDAALKCGSSSGKCHCSKKRKSRLKRVVRVPAVSSKMADIPPDDFSWRKYGQKPIKGSPHPRGYYKCSSVRGCPARKHVERALDDPGMLIVTYEGEHNHSQSVADVKAPLVLESS

SEQ ID NO: 1263 - protein, 448 aa, Eucalyptus sp.
MAIEESAPNETGPEGVKPENSPQNGGDTPQPDQKSNSKESPGCGVGLQGVQSKEPLASELTPESVKHGSQSGQEGSTPSISYEKSSEDGYNWRKYGQKNVKGNEFVRSYYRCTHPNCPVKKQVERSRSGRITDNIYLGEHNHASPQKHLPVAVSFAVSIVEEKPEKPSPISTQDKSSEVKREASHQVDDKKPPQLSVPTPADVKPVVPAIVKVQDEIATDEDSPGSKRRKKDSCNPDIPSGDKPTTEARVIVHTVSEVDIVNDGYRWRKYGQKMVKGNPNPRSYYRCSSAGCPAKKHVERASHDTKLVMTTYEGQHDHSVPPSRTIMPNPGGFNGHATTQSGDVNIKSPDGETVSHSVGENASSASGSKSTDQSNGKAEETSGTGDEVGDRTVLNNDLGPEDRISEQKEDLSSTKSGDRDPVHLDSVVNVMENSHPPQQPSNAAAVQS

SEQ ID NO: 1264 - protein, 467 aa, Eucalyptus sp.
METKETDRVVIAKPVASRPTSSNFQSFSELLAGAINSSPPNACTESAVATIRPKTVRFKPVPNRAPTAVNSSQAEVSGTATGNSNDKALKSDEKPTVIYKPLAKLVSRSTVSLLANMGSFNMAHHQTLSVAEARVKSQLQDKNNSRSQPIGNLHRSVSSQADMDGTSEPLRLASQNMEEDTRTSPALNMDRPSYDGYNWRKYGQKQVKGSEYPRSYYKCTHPNCPVKKKVERSFDGRIAEIVYKGEHSHPKPQPPKRSLSGTQGLGNVLEGSGLDSTNNRLNERDECSEDRVENKNLALTTYHGKGPLAYDPIANVASNAGGATPDNSCGISCEYDDGSKELEVEDDEPKNKRRKSDNQLNEPGISGEGIQEARAVQNSTDSEIVGDGFRWRKYGQKVVKGNPYPRSYYRCTSVKCNVRKHVERASEDPRAFITTYEGKHNHEMPLRSTNTAGSESDLQAASSKDKP

SEQ ID NO: 1265 - protein, 487 aa, Eucalyptus sp.
MAGKQPPPPLRPTISVPPRPPAAAMFGPCASPGPLTLVSSFFAESDGGSFSELLAGAMYSPLAVNAAGPSSFLWDYPRENPSREGEPRDGQAGLPVGAVKSPLFTVPPGLSPSGLLLSPGFFSPKSPFGMSHQQALAQVTAQAHVALARSHEHSQLEINPPSEASKEPLPDEPSLMPNEDSHQLSPSEATTSMAESSDFVSSSHKWEALPMVLEKPTEDGYNWRKYGQKQVKGCGFPRSYYKCSHLNCSVKKKVEHSLDGRITEITYRGQHQHEMPQAKRTSKDGNNLNRSTNSLAKSQAVLQGQSGRQSAPAMLRSGQDEESSQAIASNTSGLSNYVELDDAKSKGDGSDVDNDDVDAGDDKSNPKQKIVPIPSSKYVTEPKIVLQTRSEVDLLDDGFKWRKYGQKVVKGSSYPRSYYKCTYAGCNVRKHIERAALDPKSVITTYEGKHNHTAPSAGKRGRTVEATEFGDAQRPSVLRLKEEQVAA

SEQ ID NO: 1266 - protein, 598 aa, Eucalyptus sp.
MGSPPAPDFEPHEFQFRSAADPSPGGPFSDSDAGPLAGGGGGGGCGGGGGGARYKLLSPAKLPISRSACITIPPGLSPTSFLESPVLLSNVKVEPSPTTGSLIKPHMMNGLIGSNSDTRLANSGCPDNFDEGRSGIFEFKPLATSSMVPTEAKHQGSEQAVKVSGQRHSQPFASLSSVQSDLAVSSKELCLSVPTQAVRSGASPLAEADPDGLLGRKEQPNNVMQVTQLDNKGNGPSVMTERLSDDGYNWRKYGQKHVKGCEFPRSYYKCTYPNCEVKKLFERAPDGHITEIIYKGTHDHPKPQPSRRFTGGATMPIQEERSDRFSFIPAVESTSTVYGETSYNVETDGTPELSPVAENDETIEGAASLSNRIQNEVDDGDDDDPFLKRRRLDIGGEDVTPVVKPIREPRVVVQTLSEVDILDDGYRWRKYGQKVVRGNPNPRSYYKCTNAGCPVRKHVERASHDPKAVITTYEGKHNHDVPTAKSSSHDTAAPSALSGLPRTRSEGETVSLDLGVGRSAASEMASAEKQQILRPNPVQSRIHYASSALDAVQATPVTAYHGFLNGGINQFGYRENLTEGHSKSTEFLQNMGRILTGP

SEQ ID NO: 1267 - protein, 751 aa, Eucalyptus sp.
MSGADDNVAVIGDWVPPSPSPRTFFTAMLGDDIGLRSGLEASGNNKTGGLFLGSQERVTMGNFENKDTKRVGPSGGDHSSESRLAVEQKGYSRGCLGERLAARAGFNAPRLNTEGIRSADLSSNPDVRSPYLTIPPGLSPTTLLDSPVFLSNTLAQPSPTTGKFPFIHNNNSRSSGLMLDANTSKDNPFEENSSSSFAFKPLGEASSSFFGAGSKMNQATFPQQSYHRIEVSVQSENSVQSRNVEATKLQSQNGSGFQFQGDFSRSSAENVAGHDGVPSDQRNFSTVTGDPEHSPPLDEQQDDEGDQRISGDSLVGVNGGSPSEDGYNWRKYGQKQVKGSEYPRSYYKCTHPSCQVKKKVERSHEGHITEIIYKGAHNHPKPPPNRRSVIGGANPFGDMQLDNPEQMGLQNATDTDPAWANMQKTAGMGGSEWRQDNLEVTSSPSDGPEFSNAPTSLQAQNGGNQLESGDQVDASSTFSNDECDDEQQTHGSVSLAYDGEEDESDSKRRKIEAYATDMSGASRAIREPRVVVQTTSEVDILDDGYRWRKYGQKVVKGNPNPRSYYKCTSPGCTVRKHVERASHDLKSVITTYEGKHNHDVPAARNSSHVNSGASSAIPTQCTTSAIQTQVHRPEPSQVHSMMGRYEGPGSLGSFSLPGRQQLGPGPGFSFAMNPPRLANFAMAGMGPGQGNLPMLPVHPFLAQQHQVHEMGFMLPKGEPKAEPMSEPGPNLSNNSSVYQHIMSRLPLGPQM

SEQ ID NO: 1268 - protein, 176 aa, Pinus radiata
MAKSKSVAKKVLQSYSIKGTNKLVKAGDCVLMRAQDPEKPPYVARIESIEIDGKKKNVNVNVRWYYRPEESIGGRRQFHGVKELFLSDHYDVQSADTIEGYCKCEMPYNPDDLMVQCEACKDWFHPACLNMTINQLKTIEHFICQDCSDDSKRKPRNGAKDSSSLETKPETKRRRR

SEQ ID NO: 1269 - protein, 216 aa, Pinus radiata
MAKTRPAKKSLDAYTIKGTNKVVRAGDCVLMRPSDSDKPPYVARVEKIESDIRNNVKVKVRWYYRPEESIGGRRQFHGAKELFLSDHFDVQSADTIEGKCTVHSFKNYTKLESVGADDYFCRFEYKSATGGFTPDRVAVYCKCEMPYNPDDLMVQCEGCKDWFHPACMNMTPEQAKKVDHFFCPSCSSEDEDKKTRNSHVASPLAEAKLESKRRKR

SEQ ID NO: 1270 - protein, 233 aa, Pinus radiata
MEGGGFVRRTVDDVFKDFKARRAGLIKALTTDVEEFYQQCDPEEVPPELPEPALGINFARDGMQEKDWLSLVAVHSDSWLLAVSVYFGARFGFDKNDRKRLFNLMNELPTIYEVVTGTAKKQVKERSTVTNNSSSKNKSGGKVRSSESQPKMSKLPLSKDEEDILDEEEDDEHGETLCGACGGVYSSATAEFWIACDMCENWFHGKCVKITPARAEHIKQYKCPSCSNKRARV

SEQ ID NO: 1271 - protein, 246 aa, Pinus radiata
METAASISSNPRTVEEVFRDYRGRRTAIVRALTTEVERFYSLCDPEKENLCLYGYASEAWEVTLPAEEVPPELPEPALGINFARDGMQRKDWLSLVAVHSDAWLLAVAFYHGARFNRTERKRLFSMINDLPTVFEVVGDRKQTKEKTNSDNSGSKSKPSGKRVGDGQSKNLIKPKEEDDETYDDEEGEHSDTICGICEETYSNDEFWIGCDSCERWYHGKCVKISVAKAQSIRQYKCPLCNNKKVR

SEQ ID NO: 1272 - protein, 254 aa, Pinus radiata
MEGGGFVRRTVDDVFKDFKARRAGLIKALTTDVEEFYQQCDPDKDNLCLYGFSNESWEVNLPAEEVPPELPEPALGINFARDGMQEKDWLSLVAVHSDSWLLAVSVYFGARFGFDKNDRKRLFNLMNELPTIYEVVTGTAKKQVKERSTVTNNSSSKNKSGGKVRSSESQPKMSKLPLSKDEEDILDEEEDDEHGETLCGACGGVYSSATAEFWIACDMCENWFHGKCVKITPARAEHIKQYKCPSCSNKRARV

SEQ ID NO: 1273 - protein, 254 aa, Pinus radiata; identical to SEQ ID NO: 827

SEQ ID NO: 1274 - protein, 258 aa, Pinus radiata
MEGAAGPYNGRTVEEVFKDFKGRRAGMIKALTTDVEEFYQQCDPEKENLCLYGLPSETWEVNLPAEEVPPELPEPALGINFARDGMQEKDWLSLVAVHSDAWLLAVAFYFGARFGFEKNERRRLFNMINELPTIFEVVTGTVKKQTKEKPNVTNHNGNKSKPNAKVQRVSESQTKVPKLQPPHKEEDDTLDEEDEEEHGDTLCGACGENYASDEFWICCDMCEIWFHGKCVKITPARAEHIKQYKCPSCSSSTKRARV

SEQ ID NO: 1275 - protein, 262 aa, Pinus radiata
MEGGYIKSMEGGSGPYNPRTVEEVFKDFKGRRAGMIKALTNDVEEFYQQCDPEKENLCLYGLPNESWEVNLPAEEVPPELPEPALGINFARDGMQEKDWLSLVAVHSDAWLLAVSFYFGARFGFDKNERKRLFIMINELPTIFEVVTGAAKKQSKEKSTVTNNSSSKNKSGIKPRASESQTKPSKLLPPKDEDDTLDEEEDDEHGDTLCGACGDNYASDEFWICCDMCEKWFHGKCVKITPARAEHIKHYKCPTCSNKRPRV

SEQ ID NO: 1276 - protein, 112 aa, Pinus radiata
MKPMNRGRHYRGVRQRPWGKFAAEIRDPAKKGTRVWLGTFITAEEAALAYDRAAVRMRGARALVNFPLALNSSTENESAVGHMAHKRKRGKEETAEGGAACSRRSRGNGSGS

SEQ ID NO: 1277 - protein, 160 aa, Pinus radiata
MVKPLPKQSSPVRPENQSLMSRQFKGIQLRKWGKWVSEIRMPNSRAKIWLGSYDSPEKAARAYDFAAYCLRGSKAKFNFPDTPPEIPYGSSLSPLQIQSAASRFAAEEFRLPSRNDAGSSNSCSDAESSIDGQQISAEQGASFWDSLVLQDLDSAKMITL

SEQ ID NO: 1278 - protein, 166 aa, Pinus radiata
MATPSNQNGRMEPESHSQGTRRFRGTRMRKWGKWVSEIRMPNSTGRIWLGSYDTPEKAARAYDFAAYYLRGSKAKLNFPDCPPRIPANYSLSPEQIQATAGKFAAEESRLPSEDGAACSSSNSEAICHIDDRQIKAEQSPEFWDSLSLEDLDSYNSVSVDDFPGIF

SEQ ID NO: 1279 - protein, 178 aa, Pinus radiata
MRKALTEVAAVQGNSNEKGGKWVSEIRMPKSTARIWLGSYDSQQKAARAYDFALCCVRGAKAKLNFPLSPPEIPCASCLSPPQIQAAAARYAEEEFPLVLSLSTPHTPAVAARYAAEECRLLSEDVAFSSSRIEAESDQETSAFWDFVLEDMDSGGSLNCPPLDVLFQLTENWGYEGF

SEQ ID NO: 1280 - protein, 181 aa, Pinus radiata
MAKSSQNQNPRNRRENRLRKSRQFKGIRMRKWGKWVSEIRMPNSTGRIWLGSYDTPEMAARAYDFAVYCVRGSKGKFNFPHSLPEISCASSLSPPQIQAAAAKYAAGEFLLPSEDAAFSISHTEVECRNDGQEMLAFWDSVPEDMDNGESLTLEDFPPLDVPMDDFEVLFPMMENWGSGAF

SEQ ID NO: 1281 - protein, 181 aa, Pinus radiata
MEGSTPPLVAGKKRCGDEEQTISSTMNCAKPDDISGQHLTFSPEESSTVTHLQHQQSIREDDLRSKLKDEIQQPQNPTKKKRYRGVRQRPWGKWAAEIRDPKKAARVWLGTFDTAEGAARAYDDAALKFRGVRAKLNFPERVTLRDEDNPGVNIGKEENATITRLQCSSCTRNLLPICTDM

SEQ ID NO: 1282 - protein, 184 aa, Pinus radiata
MVKPLPKQSSPSGSENCQIKSRQFKGIQLRKWGKWVSEIRMPNSRAKIWLGSYDSPEKAARAYDFAVYCLRGSKAKFNFPDSPPEIPCPSSLSPPQIQAAAARFATEDFRLPSEEDAATSSSEAESGIDSQQISAEQRPTFWDSLLLEDLDSGESLNLEDFPPLDFSMDDFGFLFEQTKDWGLF

SEQ ID NO: 1283 - protein, 188 aa, Pinus radiata
MTKPSRNQSCRSNPKSCSLKSRHFKGIRMRKWGKWVSEVRIPNSSGRIWLGSYDTPEKAARAYDFAVYCLRGTKAKLNFPHSPPKISCASFLSPQQIQTAAAKFAAEECRLLSENGEASSSYGLEEECDINSEQIIWEEGATFGDSVAFESMENGGSFNVEDIPPLEGLMEDFGIPFQMPEDWELGIF

SEQ ID NO: 1284 - protein, 188 aa, Pinus radiata
MTKPVRNQTCRRSPKSCSLKSRQFKGIRMRKWGKWVSEVRIPNSSARIWLGSYNTPEKAARAYDFAMYCLRGSKANLNFPHSPPKISFPAFLSQQQIQSAAAKFAAEEFRLLPENGGTSSSYSLEEECDINSEQIIWEQAATFGDSVAFESMENGGGFNVQDIPPLDVLMKDFGIPFQLPEDWELGIF

SEQ ID NO: 1285 - protein, 191 aa, Pinus radiata
MTKPWQNQNRHNGTKSCAPKSRQFRGVRQRKWGKWVSEIRMPNSNGRIWLGSYDTQEKAARAYDFAVYCLRGSKVKLNFPDSPPEIPNGSFLSPEQIQAAAAKFAAEEFRPLSERGAASSSSCLNAECGIDGQQTTAEQSSAFRVSVPLERLASSESLNVEDIPLLDVSVEDFGVFFQHSKTNGQGVSNYF

SEQ ID NO: 1286 - protein, 196 aa, Pinus radiata
MAVETMRRARVGIGGHENESRALKETHFRGVRKRPWGRFAAEIRDPWKKARVWLGTFDTAEDAARAYDDAARALRGAKAKTNFALAADDNASAALARARNPRWVRTLHPQQQWPHDLKASALASFPSVPTLESSKRRKAGLASNCRPEFESRNNSPCSALSEQKTSSSPRRKTPFLLDLNFPPSAEQDNENESAAL

SEQ ID NO: 1287 - protein, 197 aa, Pinus radiata
MENFPEREPDNAISLPHEDRGSRQFKGIRLRKWGSWVSEIRMPRSRKKIWLGSYTTPEQAARAYDAAVYCLRGRNAEFNFSVPDIPTASPLSREQIQHAAAEYALGQAPSSFPSFVASPRHSSSVSEMELAGDNFQIYEERQDLALWWSMLAGSDGAGIPNLEIFPSTDEVSTLDFLPTEEEEQRYILTDLWNFQDV

SEQ ID NO: 1288 - protein, 207 aa, Pinus radiata
MEIRLQQENDQDIAPPHEDRVSRQFKGVRPRKWGIWVSEIRMPRSRQKIWLGSYKKPEKAARAYDAAVYCLRGSNAKFNFPNSVPDIPSASSLSRQQIQLAAAKYALDQSPSSPPSLNNNKEEPASPSQSSSISETDLSRDNPRISEERQDLAVWRSLFAASDGAALPNLEKMPSIDDVSMLDLVRISQQQQEEGYILTDLWNFQDV

SEQ ID NO: 1289 - protein, 209 aa, Pinus radiata
MARPQRYRGVRQRHWGSWVSEIRHPLLKTRIWLGTFETAEDAARAYDEAARMMCGPRARTNFPFNPNAPPSPSSKVLSSTLTAKLHRCYLASIQGPRSGSSKKDAMARADKNNNIHSSNQSLTCLRLDNERSNNIGIWQKKAGSKQSESNWVMKLELDHDQHGNSTLKRETDDDIAQMIEELLDCGSLEICSPMASADSSISSAESMLN

SEQ ID NO: 1290 - protein, 209 aa, Pinus radiata
MDMLELIRHHLLEVEDNIDIDIDIEGTSPLFFTPTAIESGDYINIDDHDDDTRANARATRASCQNIVSRTTLKENANEFTQQIHSSSSPRCSVMKGAEAFQVKQQPRERENGKKRETSARNYRGVRRRPWGKFTAEIRDSAAKGARVWLGTFNTVEEAAHAYDRAAYRFRGARALLNFPLSFACNSEKGSAVGNMAHKCKRGNTGSGAG

SEQ ID NO: 1291 - protein, 213 aa, Pinus radiata
MAPSNNRRDDNGARGVHFRGVRKRPWGRYAAEIRDPWKKVRLWLGTFDTAEEAARAYDTAAISLRGPKAKTNFAYSSPSSSSSLHNNQSSSQNSSTVESWPSAAPVTRSGDLELPASFLPRLGVSTGRRVLNGGNPRSGRRRSLSEKNSGRKAEGAEARTTLSDSDSSSSAVLDGETQALPPPPPPAAKKPFLLDLNLPPPLDDDEEPQQIGS

SEQ ID NO: 1292 - protein, 215 aa, Pinus radiata
MEDLDDHAHAPEEEVRGQKCRQFKGIRLRKWGSWVAEIRMPKSREKLWLGSYKKPEQAARAYDAAVYCLRGPNAKFNLPNSLPDIPSASCLSRRQIQLAAAKYALDQFPSSAPPLQNFNNKAMDEAASPSRPDPVSETELSSDSHQISEEGQLDLWESPIEVSGGNYEGRMNLNLQRMPSIEEVSALELIYSISQQHEEEEHINLFLDPTELWNF

SEQ ID NO: 1293 - protein, 216 aa, Pinus radiata
MQRPSPQEVEDAHVLEDEDRNQKCRQFKGVRLRKWGSWVSEIRMPKSREKLWLGSYPTVEQAARAYDAAVYCLRGPTSKFNFPNSVPDIPSASSLSRPQIQVAAAKYARDKLPSSPPTLQEKEIAREDAASPSRSASVSEAEGRSDCQQILEEDALNLWESGSDSRDSWHTLNLERIPSIDDALAMELNSCVWQEQQQQEEEHANIIVDPTELWNF

SEQ ID NO: 1294 - protein, 222 aa, Pinus radiata
MCAEVSQSAMAVHTMQMARMEMKREIGVCEQEASSAVKETHFRGVRKRPWGRFAAEIRDPLKKTRVWLGTFDTAEEAARAYDNAARNLRGAKAKTNFGPSPLHDGKPLFNNGFSAQKRDSLRRPGLCPKQEPGVPVLPSPDVQASTCVNIGNLSPNPAVEKQTVSNKKPMVLFGTHLSVSPRNLLLQQQQKEEICRSQGRRQAPLWLDLNLPPVANDLELLI

SEQ ID NO: 1295 - protein, 226 aa, Pinus radiata
MEVTQGMSTNILNVLEFIRHHLLEEEDELDIMHHLYDSGIECMSSSLSFSPGGDYLRATSSGSCQNMSSKSTSEENENEYTQAQDSSSSSSVCAVMRAEALNVKPQAREEQNGEMKQIRARQYRGVRRRPWGKFAAEIRDPAKKGSRIWLGTFDTAEEAALAYDRAAFRIRGARALVNFPLAIASNSEKGSAAGHMVHKRKRKTKRKEKETVKDKEKGEGNRDSTL

SEQ ID NO: 1296 - protein, 232 aa, Pinus radiata
MAVDTIQMARVGVKMKIGGGGCEEEASSAVKETHFRGVRKRPWGRFAAEIRDPLKKTRVWLGTFDTAEEAARAYDNAARNLRGAKAKTNFLLSPHNDISTKGSSSAALSSNSTTSAASGQIQNQWPLRPYFYSNQGPAIVSFSCAPAASLSPIDNNQGGGSSCVTRGSASRNSAEENQTVYNKRGKFLFGIDLMISCDSQQQEDDAEICSSARQKAPFLLDLNLPPAANDVE

SEQ ID NO: 1297 - protein, 235 aa, Pinus radiata
MLTQPKVAPKDVGSAYKEVHFRGVRKRPWGRFAAEITDPMKKTRVWLGTFDTAEEAARAYDSAARALRGPKAKTNFALVPPCDDRSTSLSSTVESWSSPKNNTNNNTRKNLSLNKADGITHKIDLNIAQEEFGRKGSVPYLEDKILNISKKQKTFKRSCAPDRAAEAYNWSRQQYPQMGFDPNACHSDCDSSSSVVDDDEVGTSSLRPQGVRLLPDLNLPPCDDEEDFSSMLLHL

SEQ ID NO: 1298 - protein, 236 aa, Pinus radiata
MVKPSQKQNIHVNGKPESRSLMSRQFKGIRLRKWGKWVSEIRMPNCRAKIWLGSYESPEKAARAYDFAAYCLRGSKARFNFPDSPPEIPCASSLSPSQIQAGAARFAAEEFQMPSDDDTASSSCGSEAESDLPPEIPCASSVSPPPIQAAAPRFAAEEFRLPSDEDTASSSCGSVTESNIDSQQISAEQGSAFWDSLFLEDLDNGESLNLEDFPPIDLTMDDLGFLLQPSEDWGIF

SEQ ID NO: 1299 - protein, 241 aa, Pinus radiata
MENLPNQQPDLEIAQTHEDPGSRQFKGIRLRKWGRWVSEIRIPKSREKIWLGSYTTPEQAARAYDAAVYCLKGPNAKFNFPETVHDIPSVTSVSRQEIQHAALKYALGQPPPSLQSLEGHAALKYALGQPPPSLQSLEGHAALKYALGQPPPSLQSLQGHASPSQSSTVSEIELSGEQQKISEECPDIALWRSLLGVSDDTGIPNSEKFPSIDEYFSATLQEQREEDYISTNLWNFQDQDV

SEQ ID NO: 1300 - protein, 245 aa, Pinus radiata
MVCRSKESECHQKVLVGSQQHSERRECQVSSKRRSRGSGQPRQYRGIRMRSWGSWVSEIRAPHQKTRIWLGSYPTAEAAARAYDAAVLCLKGSSAPLNFPESATTIHLPQSCQSPLMSPRSIQNVAAAAAYGYPSATIDLAGSSGVGCAAESLQDSFASNVKTAVGTETMPSTGHNNDNVGAVREENSWLEQLLESPSSVDNYGYDDEMICCAWLSSDLTPLSNWVDESYGPDHSQDFCSLWSFP

SEQ ID NO: 1301 - protein, 251 aa, Pinus radiata
MAASCQLTPSQIHFQLLQRQVDEIEQLQWFPSAIADPKPELAQRSSTMDHLGRRPWPMKHPAKRGLKPCSNQPTKLYRGVRQRHWGKWVAEIRLPRNRNRLWLGTYDTAEDAALAYDRAAYRLRGEYARLNFPGLKHQLQLSHDTDRPTPSSTSNQDSITAISNQSGQFSAQQTSVDAKLQAICERLSASNKPSHGEMLGHNFLNQKTITVTLSKENSLIEVKSESPDICNCEGNKTSVITALNSNSEMPC

SEQ ID NO: 1302 - protein, 274 aa, Pinus radiata
MCGDEADIIPLNRSRRVTPRDFDTFADLFINGGAVSESFKKSCSFDDEDKQKIEPGAVSESFNKSGSFDDEDKQKIEPSKSIFNFKHEFSSGGENEAIPSLKDFKIPPLKGFERSSAKGTGRKRTTLYRGIRQRPRGKWAAEIRDPRKGTMVWLGTFNTAEEAAKAYDAEAKKIRGKKAKLNFADHSCSVKMDTSKKMSRKKVNSCTENPDLLLGLNINSKVKPLYSRKPDLSGGLISVPKTQCFISNASTEQSMASCSLNFPKNYLRSNHTLG

SEQ ID NO: 1303 - protein, 303 aa, Pinus radiata
MAPRDELQNCGRGVGQTTAKEVHFRGVRRRPWGRFAAEIRDPWKKTRVWLGTFDTAEEAARAYDNAARTLRGAKAKTNFATPRDNQSSSQTSTVESWSSPKNVIVARSGPPSDASWRNFYSAKYLDAARVTGNANGNPCFKEAAAAAAWKTIYVNRGVESRAIDLNISALDFGRVDDAATINARAHESINGAVALRCPAVNPFDCPSQVALPGKLLLFDGIASRPEKRQKTCVRSGDEKLSLGQQWSVLNKSAGVGEEVETRNVQSDCDSSSSVVVDTEAPTEAKKTIPFLDLNLPASAEDDA

SEQ ID NO: 1304 - protein, 312 aa, Pinus radiata
MLRKKVKSCAKNPDLLLALNIKSTVKSSYSPKPDLLEDCYLQMERSLKDVRRSDLSIYGYDDMEYRDSQFINSPVPSQSNSNASAVQSSEHSHASQNSQKSFSCELCSLNYSEVSNFMFPAYGDTPKFEPVESSYPVGYFDSDHSSNSFDGEHFSWAHEMKTPEISSVYNDDGHESLFVDIKPPVHGVVKDRPVDTSINVNTGTESFGVDTSMEVNDGTECFAVDIPVEVNGGTGCSKTEDNILQLELSEKLSALEKYLGLSEGDTAGSFPDEWSLKPWFFDDVPISALPQSSPGDPGTSGSVYQSSAGFCF

SEQ ID NO: 1305 - protein, 315 aa, Pinus radiata
MNVLDQIRQHLLGESDGSPSFWTGSPAESCLTENYASSNSWNASEELDSGFVQSALVSDSVEEEQTASENQPCGGSGGTRFSRPVLSITVPRRECFEWERRSASWGADSRNFVTACCPASIRRCLSCDWGKLPLDENDSQDMFLYGVLKEATQKGWTPLTPKEIKNTDVKQINPRQETGREVSEKDQKSGGRHFRGVRRRPWGKYAAEIRDSARQGSRVWLGTFDTAEEAAFAYDRAAYKMRGTKALLNFPLDLVAKSMDSLSEVESCCRKRKLNGQAERGEEKRHHHGPNFEECGVESQESIVVEDGEQKRFRR

SEQ ID NO: 1306 - protein, 336 aa, Pinus radiata
MEHECSTSEPHGSGGGGGMKRSSTGAGGGGGVGGGGGGKGSPYRGVRMRKWGKWVSEVREPNKRSRIWLGSYSTPEAAARAYDTAVFYLRGPSATLNFPEEARKEQQSDLRLSQLGELSPSSIQRRAAEVGAAVDHAMQAGPVPAQTLREINQENDMKNALSSKLSEGNNFKIEAKNNMRQQGLSSKSSDNIFKFDEKNNTMLQGLSSKPSDNIFKFDEKNNTRLQGLNLKPSECDIFPFEEKSNKRLPGFISRSIKKSDVCKVEGITEEADEEKSDQMRLNLRERDWFKIKDPVSGIGTALNLGQFAIHNVQGIADHGGEHTTLGLSVYRPEKRV

SEQ ID NO: 1307 - protein, 340 aa, Pinus radiata
MSALDRIRSHLLSDFEPLFFGTGNWVSDSTRNCSPEEENFIQTALTADSVDDSRREIKTETLIAAVKSCRPSLSVSVTRHGSVECEQIPVDWELENSVIPSVSPCLSAAWTKLPLNENDSEDMVLYGILKEAANKGWVPRTPKEEPVTEIKKEAAFPVKLEADIRQETRVTPPPKNVKKNAGRHYRGVRQRPWGKFAAEIRDSARKGARVWLGTFSTAEEAALAYDRAAYKMRGSRALLNFPLQVGAEDVNTCNNTSSLEKEESSGENNLNRKRQPEEMMSGGEVQWDRQCRVRLEDRKKMGSGMVEEIVSGKMATPPLTPRAIEMSFTGFHCTGQLMVN

SEQ ID NO: 1308 - protein, 354 aa, Pinus radiata
MPSRSVKQEVEYAEMSVLDRIRNHLLGDFEPLFFSTANWVSDSPRNCSPEKENFIQTALTADSVDDNRLEIKTETLIATVKSCHPSLSVSVTRHGSFECDQIPVDCGLESSVIPSVSPCLTAAWTTLPLDENDSEDMVLYGILKEAANKGWVPRTPKEESVTEIRKEADFPVKLEAEIRQETRATPQPKNVKKNAARHYRGVRQRPWGKFAAEIRDSARKGARVWLGTFSTAEEAALAYDRAAYKMRGSRALLNFPLQVGAEESNTCNNTSSLENEEINGENNMNRKRQHEEMMSGSEVRCDRQCLMRLEDRKKMGSGMVEEMLSGKMATPPLTPRAIEMSFTGFLCTGQLMVN

SEQ ID NO: 1309 - protein, 418 aa, Pinus radiata
MVSLEAWGKMEGGQVAGMGVADEVKEQQLKEGNESDLLKGMKKARRERGSTAKERISKMPPCAAGKRSSIYRGVTRHRWTGRYEAHLWDKSTWNQNQNKKGKQVYLGAYDEEEAAARAYDLAALKYWGPGTLINFPVSDYARDIEEMQSISREDFLASLRRKSSGFSRGMSKYRGLAKQSQTGKWEASFGRVLGNRYFSMGSCSTSEEAAAAYEMSQGEYRGFGVVRNIDLSSYIRWWQPNKSLEVEPSAPRHMDESHSISEERHTQGEEPETPQWPGQACEPYQLPSLGVPNNGKHNPSPVTALSVLHQSSSFKQMLEKASAKKGKSDQDINANDNPENIQLEKGKGKIFLAEDTTGSKEFAYQPSGQTSTIFPFAQVQPVPPIQDCNTTVPASDSLWTNFVPATGGVALANAVSIC

SEQ ID NO: 1310 - protein, 419 aa, Pinus radiata
MDRQRSDFSKQGQRFDLCTNMVGKMDLITDPQKSEGPDRQGFRFPSLVSNQNLGIFNASVQDVFEDSASSSSSPSNGDARLEGLDACQNLRMPEASLVSGNSEVLCSSSSFFPNLPSNGFGHSDGLVWRPSFQGQNQYSGESIESAMVLYELLHVQQIQQIQQQQFQLQQQQIAAAASIHHMGRNPLGPRAQPMKLHGSSLSKPAKLYRGVRQRHWGKWVAEIRLPRNRTRLWLGTFDTAEEAAMAYDKAAYRLRGDYARLNFPHLKHHLEANSFAPWTGNSVLPSSVDAKLQAICQSLKQPLESMSKTEESEEISCAYENSGSLGSVRDEDAKKNDVVSVKSETCDSDSSDDSTITALNSAGESESRSASKSETQAETETDTLCSMPSFSASSIWAELDDYLLSIPPLDMDINWDVLS

SEQ ID NO: 1311 - protein, 448 aa, Pinus radiata
MCGGAIISDFIIPPASRGRRVTARDIWPDFDKFSEFINGGAAVESFDVSVDVDDDEEDSDDDEFLDFEESYQNKKKKQQQPISPTKGFELPLARGLDGPAAKSAVRKRKNLYRGIRQRPWGKWAAEIRDPRKGARVWLGTFNTAEEAARAYDAAARKIRGKKAKVNFVDEPPPSVKKESNNAKGSKKGSSKKIKSYTTPKADFFEGFKTANPSIAQYNFHQKFPNPSCDDLGYQNPLSPLHAICNRNFAAKQSSSALPAYSTEFSDFDDSEVDNLVPQPASFEPMKNINKRKGYNSFESDTSSVSADRSHISWVTEVKTPEISSVPKAEADSDHYDFADMSTPVATSVSAGSPEVQLPPFNNGLNKSPSVEDGVAAEKSPKLEESSQLEISEDLPSLESYPWLFQMPYFEGLDQSLQGVGIGDASFPDGENDLQLWSFDAVPISDSAY

SEQ ID NO: 1312 - protein, 457 aa, Pinus radiata
MCGGAIIKEFIPANRSRRVTARELWPDFDTFAEFINGGATQETFNKPGKLDEGCKQKSKPSKGSVKTQQEFCSGFEGGRSEVIPPLEDVEGSTPTIGGRKRKNVYRGIRQRPWGKWAAEIRDPSKGVRVWLGTFNTAEEAAKAYDAAAKRIRGKKAKLNFADNSCSVKNDTSKKVSGKKGKLCSKHPALLLEGFNASCKVKPSYSANPDLLGGYNINRKVKASLSGVGKSDLTICGYDDMEYGDSGFSKPSAPFQNNSNACTVQFSEHSNLTQTSKKSCSCEICSHSYSEMSNVMPPAYGNAVNFEPVQTSNPGGYFDSDHSSMSFEGAHFPWAQEIKTPEVSSICDDANESAFVDIKPVDNVVKAKPVDTPIEVDGGTDDCYKTQDGDGQFDKQLSALESYLGLSENSIAKANLCIEDAGRSAGSFPDEQCFLEQWFLDDLPNSGLRYPSSLGSRI

SEQ ID NO: 1313 - protein, 464 aa, Pinus radiata
MCGGAIISDFIPAKRSRRVTPRDLWPDFDIFADLFINGVALSESFNKSGSFDEAYKQKNTPSKNFFKSKHEFSSDDVSEAISAFKDFENPPFKDSKKCSAKSNKRKRRNLYRGIRQRPWGKWAAEIRDPRKGVKVWLGTFKTAEEAAKAYDAEAKKIRGKKAKLNFADHSCSVKMDSRKKMSGKKVKPCTKDNNLLFGLNMNSEVKSSYSPKPDLLEDCSLQMDVRRSDLPIYGYDDMEYGDSEFINLPAPFQSNSNASAVQSSEHSHASQTSQKSCSCELCILNYLEVKSPYAVGYFDSDHCSDSSYGAHFPWSHEAKTAEISCVYDDGHESVFIDIKPPVHGVVEDRPAETSIEVNGGTGSFAVETFMEINNGTECLAVDIPVEVNGGTECYKTKDSIAQLEFCKGLSALESYLGLSESPNLNAPMDESIEAANKTPSSFPYDDCFLNPWIYDDLLISGSVY

SEQ ID NO: 1314 - protein, 493 aa, Pinus radiata
MCGGAIISDFVAASRSRRLSTRDLLPDFDKVAELFINGGAVSKSSGKSGSLGEGYVVFDEGYKQKNKPSNNIFNSKKEFSSGGESKAILPVKDFEKPAAKNAGRKRMNLYRGIRQRPWGKWAAEIRDPRKGVRVWLGTFNTAEEAARAYDAEAKKIRGKKAKLNFTDDSCSVEMDSSKKMSRKEVKYCTKTPDLLQGFNMISNFKPSYSPKRDLLEGYCINGQMEPSLKDVCRSALQNYGYDDMEYGDSLFLKPRAPFQSNSNVSTVQSSEQSNLSQTLQKSYSCELCSHNYSEVSNFMSTACNDVANFEPVKSCHPGGHFHSDQSSISLDGAHFPWAHETKTPEITSEYDDTYESPFVAIKPPVNGVVKDRSVHTMDVSGGTQTFCVNSSMEVNDGTQRSAVNIPIQVNSGTECYKTEDNIMQLQFSKQISALESYFGLPDSPNNKATMDGSTEVAGHAPGSFPHEECSLKPWFFEDFPNSSSDYQSNLSDM

SEQ ID NO: 1315 - protein, 624 aa, Pinus radiata
MTTRTGSLMDLDGCCKGQGKRSAALRESEIDSPNVALSLACSPSQKIVSSAATAIHVLGSQDQFARDESVELRTNEEMKNGCYTEDNQEDEMSSAMTEEFNCSVMGVSENGTQPKQETVAFKDLCSARSVEKNLHGLERMGSGISVLSVSGGESEGFEDPRRYSMSTEQAGKLLSSQYKGVVPQPNGRWGAQIYEKHQRVWLGTFNREEDAARAYDRAALKFRGRDAMTNFSPVGDGDPEVRFMSGHTKREIVDMLRKHTYDEELDHHGKRIKILAAQSAAVNNAEASGGVAAHVCQENQGQLEGNGNVASSSSADAGRAGLPHEHLFDKAVTPSDVGKLNRLVIPKQYAEKYFPLDVNSSEKGLLLNFEDNTGKVWRFRYSYWNSSQSYVLTKGWSRFVKDKKLEAGDIVSFHRGSVQSDHLYISWRRRPPGQPRLGVGSQSLQSKGPGVVYPLKEPPSMNPFNTVPHAAVVYDAQWMPIFWPSSSHPDAFAQFNSHFVSPVVNKVDSLWSQSAATPLNSTLPFYFSASPTNQTIQSKFYDINSASCQPTELYLNYRNSLNRGDEISTNLKPLHPFLNPARASEESETPEHKPSSTLDPATKKGVRLFGVTLPEAQRLSSQHH

SEQ ID NO: 1316 - protein, 678 aa, Pinus radiata
MKSPSTSCLSHPVEGEQKSINSELWHACAGPLVSLPSVGSVVYYFPQGHSEQVAASTQKVADTHIPNYPNLPYQLMCQLHNVTLHADAETDEVYAQMTLQPVNSCNKEEILSSDLGLKQSKQPTEFFCKTLTASDTSTHGGFSVPRRAAEKVFPPLDFSMQPPAQELMARDLHDNVWTFRHIYRGQPKRHLLTTGWSVFVSAKRLVAGDSVVFIRDEKSQLLLGIRRANRQQTSMPLSVLSTDSMHIGVLAAAAHAAANQSPFTVFYNPRTSPSEFVVPLAKYNKAVYGTQVSVGMHFRMMFETEESSVRRYMGTIAGISPLDPVRWPKSQWRNLQVRWEESGAGERPNRVSIWEIESVATPFFICPPFFRLKRPVQPGMFGEESDIESTTKRSSPWHREEHDILDFQHPLSIFGLEPWVGMQQRHDVINPTVPLDYHRPMTGSTSEVFRSNDACKELCAPQQTSQPREMQHSILQQQEYQSQSQVSWQQLQQQIQQQQQQLTSQQMVLQQLQQNIPLQQLQKQVQQNPMLQQLQQQNPVLQQLQQQHVLMQKSQQQHTSLQQLKQLQQSIPELKQFENQPLQQLQPLQQQQPSLLSQQQLQQPMPLPSQQKILSVQPEQLHNQHQPRQSPMMGQSSENHLHNQQLQLEKSILHQQPAQQSLPPAQQFSCRIRHEILL

SEQ ID NO: 1317 - protein, 789 aa, Pinus radiata
MPVPCTMNGPRITSMDSAHGYGLVMQRGADDGNPGLDSQLWHACAGGMVQMPSVNARIYYFPQGQAEHSATNVEFSANLRVKPAILCRVLNVKFMADTETDEVYSRIRLVPIKPNEAAMEDCSEDNDNAAANEKPVSFAKTLTQSDANNGGGFSVPRYCAETIFPRLDYTSDPPVQTVLAKDVHGEVWKFRHIYRGTPRRHLLTTGWSTFVNQKKLVAGDSIVFLRSLNGELCVGIRRSTRSTGGGDSSAWHLAGQQQQHGSCMSPYRSSSRWEVKGGDNFSAAFFGGGDKSSANGNSNGFARNKGKVSAKSVIESATLAANGQPFEVVYYPRASTPEFCVKANAVDAALRMKWTAGMRFKMAFETEDSSRISWFMGTISLVQCADPIHWPTSPWRLLQVTWDEPDLLQNVKRVSPWLVEVVSNVPPIQLSPFTLPKKKLRVSQHPEFQFEGHGIMGGLQMATLTNNVLGQINPWHGLSENVPAGMQGARHGHIYGVPLSDFHSNKLQSGLSLDSFHQLEQGALSSTPVSTDLNIGCFSQLERSSVQDNLSCVLTMGNSSQSEQKATKGRSTSSTTKSAPFLLFGKPIHTEQSPKSEQQQQSGVSSSDGPGFHVVNDSGSPGLTSNSSTDGNPEVVDRLQRAMAGRSDTSKLSENYGLRLYCGETLESTVNNGGGNLSWFKDRQVSLQTLENGSGGKTSEDGVVHCKAFLESEDVGRTLDLSLFSSYEELHNKLAKMFGIEDSDLSNRVLYKDAAGVGRHTGEQPYGDFMKTVRRLTILSDSSSDNMGR

SEQ ID NO: 1318 - protein, 883 aa, Pinus radiata
MAYAENLRNFGFGANNGGSNQSNSSNGGVDGYSSMSNEGGLVMGQIGGPHGYPNSSPSAQDALYEELWHACAGPLVTLPRIGERVFYFPQGHMEQVEASTNQGADQHMPLFNLPYKILCRVINVQLKAEPDTDEVFSQITLLPEAEQDESSVEKEPLTPLPPKPLVYSFCKTLTASDTSTHGGFSVLRRHADECLPPLDMSQQPPSQDLVAKDLHGVEWRFRHIFRGQPRRHLLTTGWSVFVSSKRLVAGDAFIFLRGENGELRVGVRRAMRQQNNVPSSVISSHSMHLGVIATASHAVTTKTMFSVYYKPRTSPSEFIIPYDQYMESMKINFSVGMRFKMKFEGEEVPEQRFTGTIVGISDADPVNWPNSKWRCLKVQWDEISAIARPERVSPWKLEPSLTPVAVNPLPVARGKRPRPNILPSSSDLSVHDKAPVDSTQVHRFPRVLQGQEVMTLGGSLGDGELESGQKMVAWGGSKLDDVKAEGMGCQRRLVSENWMPPLRHDSLYSDTFSSFQPVGEVQEFRGSLTNSILEDGQQPKLSRKQFQDQEGKIVDGSGLWSMSFPNSLQLCESNRKMSATSAAQSHKQSGNVRWTGGLNGHPQFSNIGMEASVGNWPMHMISPCQSEVSGAHGGVDRNAARTMQVNNMGATEQQPSFDLWEMSKGAEVVSRQIDSNCKLFGFHLIDNSTGGGDPNPSKIRASVNEEELHVAAHASTETHLLSVEPDQQSEQTKTAKSDAPAGSCEQEKTSPRSSQETQCRASAQSNSTRSCTKVHKQGSALGRAVDLTKFEGYTELIRELDLMFNFEGQLQDANKGWQVVYTDDEGDMMLVGDDPWQEFCSIVRKIFIYTREEVEKMTPRTPPNMKLPGHAEEEKVARETPTR

SEQ ID NO: 1319 - protein, 252 aa, Pinus radiata
MSCSVGNMAMVLEKSGGNAQHEKRDSLDFAETELKLGLPGVAAGARQRICGKRSFSEAMESRNYTIPDEDITNTSTHEDLDKFKGPIVKEKQMALSANDPPRMGPPPPSKAQVVGWPPVRDFRKVRTVAASNSLYVKVSMDGAPYLRKVDLKLYSTYHELTSALEKMFSCLIIMGKCGSLALNESNLMDLPNGSEYVPTYEDKDGDWMLIGDVPWQMFVDSCQRMRIMTASEAIGLAPRAMENCKNRNRVHP

SEQ ID NO: 1320 - protein, 252 aa, Pinus radiata
MSCSVVGSMGMALEKSGGNAQHEKRDSLDFAETELKLGLPGVAADESRAHQKSCGKRSFSEAMESRSYTITDDDITRTGTPEDADKFHGPIVKEKQMALPANDPATTGSRPPPKAQIVGWPPVKDFRKVRTISTCDSLYVKVSMDGAPYLRKVNLKIYSTYHDLSSALENMFSCLLTMGKSRSHGLNESSLMDMPNGSGYVPTYEDKDGDWMLVGDVPWQMFVDSCQRMRIMKASEAIGLAPRTMEKCKKRN

SEQ ID NO: 1321 - protein, 302 aa, Pinus radiata
MERFANDGDEHSLKETELRLGLPGVCESDTGLGQTRNGKRAFSEVMDSTKASSFNDNKWIFPSVKCQPPTSAITETAEACKGSQPGLFSATPGQKIMMQGGCGAPQSWAGDNGLSRSTAPKDELHPKTPRDGPTEKTNATSQSQAATDPAKAPAPKAQVVGWPPIRSFRKNTLAANSKPNDEGSSSNALYVKVSMDGAPYLRKVDLKMYSTYHELSSALEKMFSCFTMGQCGSPGLSESKLIDLLNGSEYVPTYEDKDGDWMLVGDVPWEMFVDSCKRLRITKASEAIGLAPRAMEKSRSKN

SEQ ID NO: 1322 - protein, 321 aa, Pinus radiata
MPATNAKSEVDSKVSSQQPQHQNQHHHQHQPPLPLMYPWANAVQVPNTWQVSLEQQQQQHRGSYGAFPTQAAARVMVGNVMAAAAGSITLNEAPHGIPSESRAKSSQESVSASAMRPPMPPPAPSERQQKNPTGNEALTPPSNGNGNSAASRVSPVVGWPPIRSFRKNLAPQPKPDIEDPTDASGNSYASTDPGQSFGDSMFVKVNMDGVPIGRKIDLKAYDSYDKLSQALEEMFKRFINVQDSGQRQPTNPSSKNDQPTLLSGTDYVLTYEDNEGDRMLVGDVPWDMFVSTVKRLRIMKSSEARGLAPRHPLKPQGQVTQ

SEQ ID NO: 1323 - protein, 326 aa, Pinus radiata
MGCLREDDDEHSFKETELKLGLPGVTEGSDEHRTGKRTFSKAFMESRNDEKWMSSSSVKSTATAFEMSKSNEQGMLAATPPLSQLQRSFPPLSWKTGIQTDPSRVAVPAKEKQSGNSANGSEMPPPKAQVIGWPPVRSFMKNSLTFNSKTTEEGSSSSSGLYAKPTQTQTTPDTTMAPAPKAQVVGWPPVRSFRKNTLAVNSKPTENGPSGSALYVKVSMDGAPYLRKVDLKMYSTYHHLSFALDNMFGCFSMGKCGSQGLNEKKVMDLLNGSEYVPTYEDKDGDWMLLGDVPWEMFVDSCKRMRIMKVSEAIGLARSMEKCKNKI

SEQ ID NO: 1324 - skipped

SEQ ID NO: 1325 - protein, 376 aa, Pinus radiata
MKSGVGSSRSNASSVTASTLTEHDYIGLSEVSSSSHTSEYTNTNNNGSNEKQTQESDGSLGDAELNLGLSLSYKKEPLNAAAGFNGSEKAFQKWVSHEEYQRPRSTSVSQQGVWAKAGFEHRISQEKGASSSSMFAGVQVLRSWEGARILTAEDLQAPPAPHTAVVHDVGERVRPGYGFSNSGRVIMPPPTAAPAAISGTKRIHNESDGSDGIQDSSEVSKGQAVVGWPPIGTYRSKTRATTQPRSPLYVKVNMDGVPIGRKVDLNAHDSYETLALALEDMFQRPNNGNGQSGSHIPMERGHVGANDPKHPRLLDSSSDFVLTYEDKERDWMLVGDVPWRMFVNTVKRLRIMKTSDANGLAPSCPEKIDGQKSKAV

SEQ ID NO: 1326 - protein, 439 aa, Pinus radiata
MSSSAGVGSSLKVVDSSSSSSTERKYQSKFGSEGTGIYKEVSHSVSCSTESQVRMEIEQNLKETELRLGLPGVLSPVREHTKCPASNEESSSSSELGALPAESSAPGDGKEAVSRGKVGEHGSGEIPLLALAAPAAEWISVRRDVKSSGGAKRGFAEAMEGRKVFSGGKWVFPVVTPGSSEVEASKAKFLQQQGQLASPKASVVQGAGSMWQQQQGDQYLTNSTGVSNLNGNCKSIVMNDGGCSSSIGKEAAGQSKVAVQERSSQHGSSKNQGSAAAEVPPASKAQVVGWPPIRSFRKNTLAANSKSSDESEGKPGSNALYVKVSMDGAPYLRKVDLKLYNRYQELSSALEKMFSGFTIGQYGSHGLPGRDGLSESKLMDLLHGSEYVLTYEDKDGDWMLVGDVPWEMFVDSCKRLRIMKGSDAIGLAPRAMEKCKSRS

SEQ ID NO: 1327 - protein, 459 aa, Pinus radiata
MSSNINVYIEEGLSKAPTPASSTIADGSSQNNPGGLKEHDYIGLSEVSSSIESSVVSCDGEENNMNLKETELRLGLPGSLSPARDSSELNLLSPLNIRTEVEEKNLFPVEKQQHSTKDGVAEEKNGQDKYIIQPSGMGRNMMTVSPKNIVTGSKRGFSEAMESRNCFPDSRNNGFSAEGKWVFPAQVGGVIVAGSEVELPKTTTQGKFLPQGLASAPGASTMMQGPTSWHTGGLDHSGSSFMCSRSSNGTNLNGKSIKDGVASTGVKDIAQSKMPQERSRTESQHGTNQKQVPSANNPGMAPAAKAQVVGWPPIRSFRKNSLAAPKSNDEDDVKSGSSALYVKVSMDGAPYLRKIDLKLYNCYLELSSALEKMFSCFTIGQCGSHGVPGRDGLSESKLMDLLHGSEYVLTYEDRDGDWMLVGDVPWEMFTDSCKRLRIMKGSEAIGLAPRAMEKCKNRN

SEQ ID NO: 1328 - protein, 211 aa, Pinus radiata
MMGSLQCNKWMSFLEDNLLEDVGQPANSFVWPGQAINVHPDCRPREESCDKHGLKACREKMRRDRLNDRFMELSILLEPGRPPKMDKSAILSDALSLVNQLREKAGELKDSNERLRQSNKELKTEKNELRDEKTRLKAEKERLDQQMKVMMTSSPGFMPHLAVAHAFSAQSQAANNKTLPIPGFPGMAMWQWMPPAAVDTSQDHALRPPVA

SEQ ID NO: 1329 - protein, 228 aa, Pinus radiata
MMGSLQCNKWMSFLEDNLLEDVGQPANSFVWPGQAINVHPDCSDSKNDKEDREKMCPRKRPREESCDKHGLKACREKMRRDRLNDRFMELSILLEPGRPPKMDKSAILSDALSLVNQLREKAGELKDSNERLRQSNKELKTEKNELRDEKTRLKAEKERLDQQMKVMMTSSPGFMPHLAVAHAFSAQSQAANNKTLPIPGFPGMAMWQWMPPAAVDTSQDHALRPPVA

SEQ ID NO: 1330 - protein, 236 aa, Pinus radiata
MSSPQSNKWLSYFDEPLLDDVGVGQPANPFFWCGQGINDQPDVSVEIDGPNKDMDEQDKLCPRKRSREESSGGPGSKACREKMRRDRLNDRFMELSSVLEPGRPPKTADKATILSDAARVMTQLRTEAQNLKAENERLQEAIKDLKAEKNELRDEKLRMKAEKEKLEQQVKAMALPTGFVPHPAAFHAAAAFAAQSQAAANKTMPVPGYPGMAMWQWMPPAVVDTSQDHVLRPPVA

SEQ ID NO: 1331 - protein, 248 aa, Pinus radiata
MMPSSTAPSSQLSTRMEVRDRRKRKRSKACKNSEEVESQRMTHIAVERNRRKQMNEHLSVLRSLMPGSYIQRGDQASIIGGAIDFVKELEQLLQSLQAQKRKRECEEFGCSPNSPTPFNGFFLSPQYTSYSAQWNARYGMENTSFNDTGNELIAENKSAVADIEVTMIETHASIKILSQKRTGQLMKTIEALQSLHMTILHLNITTIDQTVLYSFNVKIEDECQLTSADEIATAVHDIFNIIHSNAIN

SEQ ID NO: 1332 - protein, 254 aa, Pinus radiata
MDTRLQYAGEIFKSDYYEDQNNKQWLDNIDEIAGQLDWDDSDPEMMGGSKPAGKINYLQAASKNLYTERKRRKKLNDTLYTLRSVVPKISKMDKQSIIGDAISYVLDLQKTIREIESEIEGLRSSSKGDHTQTIPQTVNHLANAELVKRSVESSDTKKSMDKLKHAKVLQVEICNGGEGGIYHVRIEGKKETGGLVKLTRALESLPLQIMNSNICCFDEAIHYSLTVNVKSLGNVNTAKLEDMIRKTTTSDCFE

SEQ ID NO: 1333 - protein, 333 aa, Pinus radiata
MLARENRSGDTEHDDLQGTLLTSYTGPQGGQTVLPRTPGAQSHQQNLSTQTIQSGEGTSLQQYGNHSAVSQLQSGAGGGNAANGAARPRVRARRGQATDPHSIAERLRRERIAERMKSLQELVPNSNKTDKASMLDEIIEYVKFLQLQVKVLSMSRLGGAGAVAPLIADVPSQGSGGVMSTALGQASGPLTLSQDGLAFEQEVARLMESNMTSAMQYLQNKGLCLMPIALATAISSSSGKPVLATVPGTGVDSSEKQNSDMQSIVLPFSSSSTTMGLRATASGSDAPINENSMNKASIEKVVAEKSNGISPGLSSDVPKVGSQSREELLKRAQ

SEQ ID NO: 1334 - protein, 338 aa, Pinus radiata
MEIMEEMIEIPRLNDNIGLNIPWLHGGLFRKRLTSSPLHNEPAGKQANMMPNMENYFTRLVQGFEPGESCVTALSDLKPGGNNIDTFNAVQSHSETAEDGISDTTQEDQQNAISMAVPAADAGKGRKRKRQKVSKNSEEVLSQRITHIEVERNRRKQMNAHLDVLRSLIPQSYIQRGDQASIIGGAIDLVKELEQVLQSLQFQKIKRENVDRTDPTNCLSILPPHQSSARCNSKCVVDTSSSQVRALEDKSSIADIEVTLIETHGSLKILSKKKHGQLLKIITALESFHMTILHLNITSMDETVVFSFNVKVEDECQLTSADEIASSLHRILRIVHAC

SEQ ID NO: 1335 - protein, 373 aa, Pinus radiata
MPANSNETHLSFCQPLSENFLADFNGIPEFCPCESTDQILDFDAEFCNANGANRVFSRKSHKADREKLRREKINEQFAELASALDPDRPKNDKASILIESVQVVKELRVELKQLQDEHALLMDESRELTEEKNELKEEKAALKSEVDQLQDQFQQHLRIISPWMMMDPTVIMSTASFPYSMAVPQAAPLPSSNFQQSFASNQAQRPIVAPSPYIPLATIGAFPLHPGLHTYATFGNSHADGSGPYLQFPNYGPPLNGHCHVERPYIQHSSQLHPMPPYLAQMQLHQGCQAPVSSSGPGVEICKPCASVASCAAVKAQDKSSPASSQNLDDERGGKYAISPSPVDNAFVEHIESCRSAVACGSDTLPNDMNKEL

SEQ ID NO: 1336 - protein, 463 aa, Pinus radiata
MSLLPPGIGGQGLNSQENDPYPYDDSQFLANRLRQHQLSGNSSMNQTPNQASQGINETNTSPGRSMVLQLSTGSASASQLLASMGNSPRGTAVMTQSPSTGGSCNGSDGGMLPLPLSLGQAGKSGDINESRSRDEIEASFKSANHARDSNLGGLFPPFAASPRGVRPTGQNFHTQSGQVPMQVYGGMPQPQHQNPSPTGVGAAPPVRPRVRARRGQATDPHSIAERLRRERIAERMKALQELVPNSNKTDKASMLDEIIDYVKFLQLQVKVLSMSRLGGAGAVAPLVADIPAEGANAPQGTRTNSSQNSSPDGLALTERQVAKLMEEDMGSAMQYLQGKGLCLMPISLASAINNSGARPQAPSTPSLQGLLPPNANDRQILEPSNSALSALTSTSMTIQSSISSPGSGITEQGDNAHKAVNGTRNPKDSREANSVTKSNGIGGPALSKNAVKGEDEPQRRTGQ

SEQ ID NO: 1337 - protein, 465 aa, Pinus radiata
MGTGEMGTPAKTTKASTPQEQPPTSTAMLYPDWAAAFQAYYNSGTTPPPPPAYFHSSVASSPQPHPYMWGGQPLMPPYGTLPPPYAAMYHHGSMYAHPSMPPGAHPFAPYVMTSSLSTTEGAPVGTTSGADAEGKPSEPKDQTLLKRSKGSLGSLNMLTGKINEADKGTGGGGNGALSISGESGSEGSSERSDETSQNGSEATQKKGFELNSTKAAEAQNTTTTSYNAHGGSAFGASGVQTVNATVNLAIAAVPISVAGKSATVAGSKTNLNMGMDYWSGSTTATSTMRGKRPAVPRTTAMVPAPQSISLMVPCDGVPTELWDERELKRQRRKQSNRESARRSRLRKQAECEDLAKRVDILKAENASLRKELNRLGEECKKLSTENAFLHKKLCKAPEEETRDTRSEKDGEAGTGEQHEQQNEDTDSGAVESMQRDGRREETSFNLDGKNQPLDNRNQAVSVSAG

SEQ ID NO: 1338 - protein, 466 aa, Pinus radiata
MDSDFGVERQTFEAVPDSKSLASLHSSLSCSLNTMDTIFCDESRYSQKYAGEFGEIATQNAFGGATDSIISNVDGAFYADPSFAAKYLRKSSFSPVMAKESSNADGSGGIGVHNVPILANSVQFHTAGVKNGVNATGWRNLDASHLGSEVSKFSIGSVPVPSALVQFPSDPGFVEQAPKFSSFNNMDRNSSENVGCGASNLRPVVGAVQQGGETMSVFSEPNKRVDDGIGKKRRAKSLTSVDNGKEQEEAKAKRCRLGENSEIDDDDNNEETSDSNSKKGKEKNPKVAQKDDNYIHVRARRGQATDSHSLAERVRREKINQRMKFLQDLVPTCNKVTGKAVMLDEIINYVQSLQHQVEFLSMKLATVNPKLDFNIDNFFAKEMSGSFSSKGMSPTYFHLDQLKQASLQTVPSPGSDIPSTMSSVDSAEMFDGANFQRQEGWDSELQNMYNMGLLQSRLQQHHQRPL

SEQ ID NO: 1339 - protein, 586 aa, Pinus radiata
MGSDAVSASRFWNEEDKATVNSLLGPNAFEHLMVSYVSSEGLVSGINDCALQQKLQNLVESSSFNWTYAIFWQLSRSKTGEVVLGWGDGSFKGPREGQEADQARGFDHRFAETDQQLKKKVLQKLQSFFGGGGEEENNFVSGLDNVSDTEMFYLASMYYSFPRGIGVPGQALASGKCIWLNEPSKLPSNLCSRAYLAKTGGIQTLVCLPMEHGVVEVGSVEMIRESKHAIDKVRSSFNENACDGNRGQQAVKGSLVVPFPPNPMRVNAVNAKAAPPLKPSHDWKIFGQELSKSTEAVVTKVEDRDRHYQPVFRPPYAHAASYVTNEQRIPYSTVNQNGLQPPNWSHISNGEAGEIYNTRDLIKPSTILPLGVAGPSLNAVTARPSIMESEEHSDVEASERRPVVVEERRPRKRGRKPANGREEPLNHVEAERQRREKLNQRFYALRAVVPNISKMDKASLLGDAISYIQELQSKVKDMETEREKQQQPQPQQAKSNIQDGRIVDPISDIDVQMTTGEATVRVSCAKESHPVGRVMLALQRLQLDVHHANISAANENILHTFVIKLGGTQTLTKDQLLEAISGWSPR

SEQ ID NO: 1340 - protein, 605 aa, Pinus radiata
MGSDGKEEFGFSMNYKTSGSPPSSNWQSAVANAAMNNVQESSLRVPTSSESLSSSFFSLNWEPLIEQSIPFQSSLSPMVSPSPPATSLPSDSIAIRELIGRLGGNLCGVSGPLGSTMDTVLNMGTAWNPLNSSPNLNLAVDPSKGGLSIQGAKHTPPNSLAQFSSDPGFAERAARFSCFGNRNYPELATPFNFPEGEPSYRSAAADNSKIPRVQSNQSLKSGLPINLPNLAETKESNASETPNEGSEADPRFTDRKISRLSRSSTPVSTDDMKQRLATSGNESDEAELSTGREESSCSDQIAGREPGSKTSNEINGRKRRVLSKAKAKDTPSVVACSGARETKSLEADESPTKRYKVAEAGSNEKDDAKSKAEQSTIVSTGESSPKQTKDIVKTPEPPKDYIHVRARRGQATDSHSLAERVRREKISERMKFLQDLVPGCSKVTGKAVMLDEIINYVQSLQRQVEFLSMKLATVNPRLDFNMDGIIAKDMLQSHSSSPRMLFATDPTAAFPQLLPPQQGPVQVGVTCGTEGHRMGHPVEGALRRTMNPQPPCIDGYGDSIPQVANVWDEDLQSVVQMGFGQNRQSPFTSQGFHGSVPTNHMKIEL

SEQ ID NO: 1341 - protein, 701 aa, Pinus radiata
MGNEGAASMRLWGDDNNSMIEAFMGNLDYSYSTFWNGIDANPSSLPSPAHFPSSAASVAIATPFNQDTLQQRLLAFVEGAAECWTYAIFWQLSSDASGGSELVWGDGYYKGPREMTEEERETKKAASVAATAADQELRKKVLRDLHALINPNATGEADPAEFPGDDATVDGEVTDAEWFYLVSMMKSFGNGLGVPGQAFCGGMPIWIIGSEKLQSYNCERARQAQQFGIQTMVCIPTPNGVVELGSTDLNPQNWDLIQKARNSFTFTFPDNLWEENHTQNDPDPALWLTEPPADPKTEPEKKQQQIPNVETEALHSFFPHELGFSDLGFLNGEGENTAQKVGIEEFGQKEDKSSSQGFTGSQVLYQQDWQAQTTCKTEVVEIPAFQPGKRGNTNGITLSFENPYGTQGLVSWGDEKMKRPVRNGNEDGSAVLCFSSEVAAASASASGTAVAASLPVNGAAGVRSSVDSEHSDIEASFKEAECSQAIVERRPRKRGRKPANGREEPLNHVEAERQRREKLNQRFYALRAVVPNVSKMDKASLLGDAISYINELRSKVQDSESHKKDMQAQLEALKKELVARESAASGFSGSNFGLLKNPAADPSNLDVKGFGSKNQCPNIELEVRILGREAMVRVQCPKQNHPVARMMVAFKELELEVHHASVSTVKELMIQTVILNMTGIVYAQEQLHAALLRKVADPGLR

SEQ ID NO: 1342 - protein, 757 aa, Pinus radiata
MAVMASANNSVIRKQLESVVQSIQWTYAIFWQLSNQQGVLEWSEGYYNGDIKTRKTVQPMELSNEELCLQRTLQLRELYESLSAGESNQPARRPCAALSPEDLTDTEWYYLVCMSYTFAPGVGLPGRTLANGRLIWLCQANEADSKVFPRALLAKSASIQTVVCIPLADGVLEFGTTEVEREDPGLVQRTISFFLEYPKPICSEQSTSSPQCSDRDEKDQVGMVTIMSSDSIACLARNQIGASTITDCGQYLPTSHEDLDIPIQTFELKDKISVTEDPQQHGLNESMQVDICEDYKASGSPEDQCCNGDPGSHEFPLLSAENDCLPNGHVNINSAGFEGWPYMEDNTSHGLQASGECVTQSIVDPSPQLCTYSERDMNMNMNMNMNMSVLLGLEQGSNALETILESAPQTLDEDGHYSRTLSTILERQQASNLTESTGFISTKLGKDWRSRHSKQGSGFIHWKNNGNCVVGIKAVASPQRILKKVLFNLARLHNKYKEDPGYSPKLGEEEIGSKLVGRKIGQEDLSVSHVLAERKRREKLNEKFIVLRSLVPFVTKMDKASILGDAIEYLKQLQRRVEELEASSKLMEAEIKKTQNRNLPKRSGSTENMRMTRHGVNHVDSCLQSSCLDGELGWTLTDTKQPPSKMPRLESKRKLNDFHKKGSCTLAAAAADLDVSVSVIEDDAVLVEIQCPCKHGVLLDIMQRLSSLHLDTYSVQSSTADKIFAAVLKAKVQEKFRGKRPSIAEVKEAVELVASKC

SEQ ID NO: 1343 - protein, 163 aa, Pinus radiata
MQGTAPDLSGSATGDKFFTSSSGDLHEEARNECVNESDDDIRRVPEMGVQTGVVVNSDLVVKTDSERGLSGSGSQRRRGRTPADKEHKRLKRLLRNRVSAQQARERKKAYLNELETKAKELQQRNSELEERVSTLQNENYMLRQVLKNMTAKNKGGGVGEVEG

SEQ ID NO: 1344 - protein, 173 aa, Pinus radiata
MSPPPSYSMFPNSGMGLNPSVTSSEPSSQVSGSIPHQYSGSEEDPKLTIDERKQKRMLSNRESARRSRMRKQQHLDELRAEAAHLRAENSHMLTKFNIASQKYMQLEEENSLLRSYAMDLSLKLQSLTMAMQWAGVLNDVDLGSSTGFIDTTDIKSCYLPSISHPLASTEIYH

SEQ ID NO: 1345 - protein, 236 aa, Pinus radiata
MQSEQVLLPSGPMVSNGSFHMGTVDTRGGQDFLSRECYESLLNFNNFMLYPPPTLNTNSSPEVCKPSPKGRYIRQDSIASTSQSAQTACNSASDEAEEQQTGMIDERKKRRMLSNRESARRSRMRKQKHLDELRAQVAHMRSENRQILSSFDILTQRYSQALEDNRLLKVQAMELSQQLHQFQQAIAASQSSAAPNFALNALQASHRHNNNNNIISIDDAVDNNTNSLTQCPDILL

SEQ ID NO: 1346 - protein, 334 aa, Pinus radiata
MADTSPRTDDTSTDVDTDEKMNQQMDLVRHGGDSSDRTKDKNGDQKTLRRLAQNREAARKSRLRKKAYVQQLESSRLKLTQLEQELQRARQQGIFIGGSCVGGDQSHSMSGNGALAFDMEYARWLDEHHRQINELRSAVNSHVGDNELRVLVEGVMGHYDEIFRLKTVASKADVFHLVSGMWKTPAERCFMWMGGFRPSELLKILVTHLEPLTEHQFMGINNLQHSSQQAEDALSQGMDALQQSLAETLASGSLGPPGTSGNVANYMGQMAMAMGKLGTLEGFVHQADNLRQQTLQQMHRILTTRQAARALLAISDYFSRLRALSSLWLARPRD

SEQ ID NO: 1347 - protein, 362 aa, Pinus radiata
MNSTTTQFVSSRRMGMYDPIHQIGMWDENFKQNGNPNAPPALIIPMHANLDNQSEDTSHGSQDTAGKYEQETSKPYDKVQRRLAQNREAARKSRLRKKAYVQQLEASRLKLMQLEQEVDRARQQGVYMASGVDSAYPGYGGCLNSGIVAFEMEYGHWIDEQNRQICELRAALNDHRTDVELRILVESGMNHYLELFRMKAVASKADVFYVMSGMWRTSSERFFLWIGGFRPSELLKVLMPQLDPLSDQQWAFVSNLRQACQQAEDALKQGLDKLQLNLAEAVASGHLGEGNYIPQVATALEKLEALVSFVNQADHLRQETLLQMSNHLTTRQAARGLLALGEYFQRLRALSTLWATRPREPA

SEQ ID NO: 1348 - protein, 364 aa, Pinus radiata
MGSRTMLSSNGGRTPQFQPLVRQNSLYNLTLEEVQNQLGDASKPLSSMNMDELLKNIWTQEESQAISMAIGNGPMNGVPPNSAPASGGLQRQGSLTIPRTLSRKTVDEVWRDIQQSQGKSNEEKKPQQRQSTFGEMTLEDFLVKAGVVREDNNGNSNNNNGSAVTVGIAESPQPVSVCGVPTAGIGMDAMAAAQNLQQQAEWYQYQLNTAQQQQQQQQQQQQQQQNMMVAYGNKRPVPPNGPLGIPGNPLLEGGYGDNQLALSSPLMGCTSSDSQTPGRKRGAPESIIEKTVERRQKRMIKNRESAARSRARKQAYTNELENEVMQLKEENERLKKQQFLEKLLPSVPPPQPKHTLRRTGSAPF

SEQ ID NO: 1349 - protein, 405 aa, Pinus radiata
MDTPTKTTKTPTSQEQTSTSTPVAYPEWAAPIQALYNSGKTPLPPGYFHSAVASSPQAHPYMWGLQHMMPPYGTPPPPYVAMYSHGAMYTHPSMPAGAHLYGSYGMSSSGVSNEVTAGAVTASVEGETKSSQAKDRSPLKSTKGSLGSLSMLTGKTNETGKETTANGVFSQSGESGSEGSSEGSDGNSPNGSQSGQKTRFEQGSTEADESQNGNATSRNGQIANTDRASGGQVTTINSSPAMGAVPMSLPGTSGTATAPMTNLNIGMDYWCVTAPTPLSNMRGQLPLSPTTSTIIPAQNMPAMGTELSLQDERELKRQRRKQSNRESARRSRMRKQAECEELARRVEELKSENLALRTELTRLQEECEKLTAKNNSLTEKLKNVHDNESRETRVKDELENADTEQ

SEQ ID NO: 1350 - protein, 410 aa, Pinus radiata
MDTEEMDTPTKTTKTPTSQEQTSTSTPVAYPEWAAPIQALYNSGKTPLPPGYFHSAVASSPQAHPYMWGLQHMMPPYGTPPPPYVAMYSHGAMYTHPSMPAGAHLYGSYGMSSSGVSNEVTAGAVTASVEGETKSSQAKDRSPLKSTKGSLGSLSMLTGKTNETGKETTANGVFSQSGESGSEGSSEGSDGNSPNGSQSGQKTRFEQGSTEADESQNGNATSRNGQIANTDRASGGQVTTINSSPAMGAVPMSLPGTSGTATAPMTNLNIGMDYWCVTAPTPLSNMRGQLPLSPTTSTIIPAQNMPAMGTELSLQDERELKRQRRKQSNRESARRSRMRKQAECEELARRVEELKSENLALRTELTRLQEECEKLTAKNNSLTEKLKNVHDNESRETRVKDELENADTEQ

SEQ ID NO: 1351 - protein, 438 aa, Pinus radiata
MDHQFSFSPADDVEGNSMAVITEEEEEESPVVSGRMSRSASEWAFQKFLSFDGSKIPSEDGEGEQKPLGVKDPLLHGHMDNVPAALSPLFAEVKDEVLLPTDPRDYEAFLKRRLNLACAAVAFTRVTGISSPGPGPSTVDANQSQNTLGSERAASLVSQSSATDARALYVGAASSTASGPIGIPALPPQPKSGNIQVRTTSGSSREQSDDDDQEVGPSEQSMDPSHVKRERRMLSNRESARRSRRRKQAHLTDLEIQVAQLRVENSSLFNRFTEINQKYNEASVDNRVLKSDVEALRAKVKMAESMVPKAVAAATAGFPPQNSSQVQSAVGLRYRTGIFDSPATNVLQGEDGLYMNIAQSTGTGGSSLTCAISDMNQQTKELQIQPPGSKMGRTPSMQRVASLEHLQKRIRGGMTCGSIPWGGAWDVDGSQVIEPSEH

SEQ ID NO: 1352 - protein, 466 aa, Pinus radiata
MGTGEEATPTKPAAKPSSSSQETPTTPVYPDWAAAFQAYYGPGATPPPPAFFASTVGSAPTPHPYMWGGQPLMPPYGTPLPYPAMYPHGGIYAHPSMPPGALPYGHYGMPSPGNAEVTTTLALPNAEAEAKSSEGKERNTMKRSKGSLGSLGMITGKGGEGGKATSGSANEAMSQSGDSGSDGSSEGSEEDNTQTESQVARKRSFDQMIVDGANAQSTNIQSYNSQAGEPYVTSGGHAMGNPISQAVAAVPLGSVTGKPATSGPITNLNIGMDYWNATPPGAITTVKGRGSTAGISTAIVPATAQLMPSGRDGVPPELWIQDERELKRQRRKQSNRESARRSRLRKQAECEELATKVETLTVENMALRNELNRMAEECKKLTAENASIMEQLKLNGQDMTTITEENGSTKISLQSVKPEGNGHFHDISRGINSNSTERNEQRQSETCDSNGKVHTLLDANARSDTG

SEQ ID NO: 1353 - skipped

SEQ ID NO: 1354 - protein, 517 aa, Pinus radiata
MERVFSVDDILGTFWKLDTQGEGVGETAPSGDMATNRTTTRTSMNRSASEWAFQRFITGSAPIPPTSPSGSSSPHIPNHQDLDHKMKKNSSSSSAPTPTPPALVNVEEEEEEEEMREDVKVEKEGKDEKQGSKDKKEEVAAKGVVGNEPSPSSSSSVAVNVNPLSPLLKGTGSVIEKGVVTHTNPQEYESFLKQRLDLACAAVALTRASGIDFHGAPPLTFGAQHSQNLGMESQAGSTISVAQSSGSRPIHNGALGHNVSQPIGIPALPPQPQSGTAQIKTTTSGSSREQTDDDDLEAEIEANQSSMDPSDLKRMRRMLSNRESARRSRRRKQAHLSDLEMQVAQLRVENASLFKRLTEMSQKYSEAAVDNRVLRADVEALRAKVKMAEDMVARATGVNHSIQNPTQISQASGMRYMGGPVESPVTSGPQDSSRYSHPGQPVSTQGMTCDASNINDRSKEVLPHNVGTKMGRTPSMQRVASLEHLQKRIRGGVACGSTPWSGGWDIEGSPRIENGGQ

SEQ ID NO: 1355 - protein, 643 aa, Pinus radiata
MEEMDSSYGDLMQRLQSSIGTSSSFIPKQQLNKSEPSSPAVSQTRPPFTSNIQNFNPGSKRQGIPPSHPHFPPTSPHSQAFYSQMPVLQSSVQQNSQNQQHSNASPNSLHTRSMSQPHIFNLDNLPPLNPCSYRDPSSPSLSDPVSGDVSMEDQEGSSAVPSISPHNPPSLFSGSRRSQNHMSDGLPPRKGHRRARSDNPFTFMSGSQSLSGDIQQGFGSSLETASVKGTAQMDHLNQYVSSLEREKPKAQAVKTELNQERNSIQNVEGTGEGETGKGGGEDMVSACIDVEKINNLNKSRPASGELPDNLNGAQEDSGGSSVKQKNLKDGDQFTSSDEADSEVNEFNIMKRSNSGVGYEDNKRSGGQGDGNQYRSRHSRSISMDSIMSKMHNFSEDLEQEPSQGRNVRHSHSNSMDGSTNFNVEFGNGEFSASEMKKIMASEKLAELATVDPKRVKRILANRQSAARSKERKMRYISELERKVQTLQTEATTLSAQLTLLQRDSAGLGSQNHELKLRLQAMEQQAQLRDALNEALGEEVQRLKLATGQLGAGQSGSLAQQMSMNSSLFQLQQQGPHHPLYQMQQQQQQQQQHQVQYSQQPPGKQTNRNEILQTSYTSLPGPVGSSSKPDNSNMSASQGSDCSF

SEQ ID NO: 1356 - protein, 272 aa, Pinus radiata
MRIQCDACEQATASVICCADEAALCRECDIKVHKANKLASKHKRLSLLETSRKLSRCDICQDRAAIVFCLEDRAMLCQDCDESVHSRDTLAAKHQRFLATGIRVGLNALSSESPGSSEFDKQPSSISNPTAPTHATPRMGSTHSSSAKSIPLGEPCWSMDELLPISDFESKGDPEGLGEFDWEVDGLDHLGLFEQQQEQEEALACRVPELCPTGPAGGRPNFTVKGKSKAEIPTVPDFDEACIVPDIGSLDTHEFYPTPQLKRARRSSFEAW

SEQ ID NO: 1357 - protein, 358 aa, Pinus radiata
MPKPCNVCRIASASLYCRADAAYLCSGCDVKVHGANKLASRHERVWLCEVCEQAPAAVTCKADAASLCVSCDADIHSANPLARRHERVPIVPFYECVSVAKAFLPPLPQTSSLQDSDAPGTLDYDDDEEDDEIYAAEAASWLLPNPKASAEGTKNCDDGVSCFGVDAGPNKAAGGYFSVVDLFSDVDPYLDLDYASSFEATGGTDSVVPVQSNGSSHDGAVSTPSDCFETDKAVYSYTTTTSFSHSVSSSSLDVGVVPDAMLSDISRPLNGGAALELANPGAVHVGVQYVQADREARVLRYKEKRKNRRFEKTIRYASRKAYAETRPRIKGRFAKRTNADVVQMYTSAEFGYGLVPSF

SEQ ID NO: 1358 - protein, 175 aa, Pinus radiata
MRTLCDSCEAAAAQFFCAADEAALCAKCDEKVHGCNKLASRHVRLQLRESWSIPRCDICETAAAFLHCSIDGSSLCLQCDMDVHVGGKRTHVRYLLLGQRVELPNGNNMQLTNGSHIRDEHGNPKTMETARAWQKKYCQEHYRNGDPSHNNISNGNIHNVASCNKENVQSNGQKD

SEQ ID NO: 1359 - protein, 248 aa, Pinus radiata
MAKTMKECELCELSARLYCESDEASLCWDCDAKVHSANFLVARHCRSLLCQICQSVTAWRASGAKPGPTVSVCERCAGGGRSKSDGDDDEENNDENQVVPLASGYSGPPLSCSSTDEEEESSGDDRHSAESPLSNAPLNAAPHKRLHESLALNTSEGDCGCSSSSGVNNSNNNMSGGEDEATSSAIRGLKKRKVNQGFKDDLVKTLEVIRREDHDDSAILAICKLCRDSHPRELVSVDCPSYNSPYAG

SEQ ID NO: 1360 - protein, 272 aa, Pinus radiata
MRIQCDACEQAAASVICCADEAALCRECDIKVHKANKLASKHKRLPLVGTSPKLSRCDICQDRAAIVFCLEDRAMLCQDCDESVHSRDTLAAKHQRFLATGIRVGLNALSSESPGSSEFDKQPSSISNPTAPTHATPRMGSTHSSSAKSIPLGEPCWSMDELLPISDFESKGDPEGLGEFDWEVDGLDHLGLFEQQQEQEEALACRVPELVPPDLQEGGPTFTVKGKSKAEIPTVPDFDEACIVPDIGSLDTHEFYPTPQLKRARRSSFEAW

SEQ ID NO: 1361 - protein, 293 aa, Pinus radiata
MKMKVQCDVCEKAEATFLCCADEAALCSACDNNVHAANKLASKHQRVSLINPSSQSPKCDICQEKTGIFFCLEDRALLCRQCDVSIHSLNNLVAAHQRFLVTGVKVGLEPSNTISPSTKTSTQSSDITNKKSQTLRNGPTEVSASLHQGVQKGIGGGGISRRGTVSEYFSDLLPLWRMDEFLNLPELDNGYGFGEAGSSRADNANFVEEWPANSFSTEEDNSENCLAQVPEMASPPTASGLYWPRKIICQPKEGKRREDLTIFGFDDASLVPDIGCRSSPPDSPLSKRRRLHA

SEQ ID NO: 1362 - protein, 296 aa, Pinus radiata
MKVQCDACQSAEASVFCCADEAALCMKCDSKVHDANKLASKHRRLSLLEPSSSSSSDSLICDICQERRAFFFCQADRAVLCRDCDLSIHSANELTAKHNRFLVPGTRVSLKPIETLAAPEKAVATATVTKALIPPVQKMPDHAQPSMDLPVETVTASTSNSEFSQYLSEVEQFLTSASPERLDWGGSAEAHAIGKYMESAWAPNLGLLPEGFYGDSLAEVPHLPSPTTDSGFCMYGQFGITMKPKAKQQVQNVPYFLAGFETGDDNFTVPDIVLPPSAKRMRMSNTTLHDQQFFIL

SEQ ID NO: 1363 - protein, 309 aa, Pinus radiata
MGKGKGPKCELCCNDAALHCEADSASLCYKCDANVHGVNFLVARHVRVVLCSGCYHHTERNVSGATPNADQSLCCACCKSQDIEQTALCNSTAESAFAGPLSAVSSEQSKGLDVGIDCSLFHGSRFGEGNLKACSREGDNQRTGAPERSEVSINAWSYNDGVSTTSSLGNSQTVDNKPQVESHNKETGLLHRRSGPRVLNAEMKVEIVFRKWFRHLNLRNPSTVPLAMDLMEKGLQKLGALSRQKIKICLAASFWLAATLCEKQNHLPPVKRLEECSGIPSKLILLAESRLGRILRLKMQEEGSAECSS

SEQ ID NO: 1364 - protein, 443 aa, Pinus radiata
MVKEEDKDWHNVEGWDRGSHVDHKEFLRGIGGWRMSMPKLCDVCQVSSSVIYCRAHTAQLCLVCDAKIHGGSKASLCHERVWVCEVCEQAPAVVTCKADAAALCVACDTDIHSANPLASRHERAPVIPFYECPNMPTNNTVTHANNDNLDCNVLLNEDGGGDDPLKHDYVDDDYDDYDDDENDQNNLLNNQEDNNDAEICCAEEAATASWLIPEANRNNLTIINGGNSEGEDKMVKDKLKFKAYMQSMDFLQDVDNYADLEYLGTTTITTPINPTANMGADSMVPVHTPEVIEHSSTKVSIDTAGSMDVDAASKCNHVYRTTSLNHCVSSSPIDVGIVPDSNITSDISTPYHDPRGVFEIPPRVVHPGGQGEVMGREARVLRYREKRKNRRFEKTIRYASRKAYAETRPRIKGRFAKRTEVEVEQIYSSSLLPDQGYGVVPSY

SEQ ID NO: 1365 - protein, 536 aa, Pinus radiata
MDEAAPAKAPLPCDYCGEANAVLYCRADSAKLCLPCDHHVHSANALSKKHVRSQLCDSCKDEPVIVYCAADDAVLCQECDWDTHGGASTGHHQRHSIEGFTGCPSAEILATKWGFDLSDKSLNNSASPLGLTDPQCGNSLVWGTLDDSLDCIVSGRMKADPVDSWLCTPSSALQDVLVPNPNLGSVVFPTPGKQQNHPLCGKQKQLIFEQLLELMKREGSTENPEDDEEEGKPISRPGTPNQHQPIHPALEVNDAGNQNPSQGEQRSVEAIRPIPSSSLLILQQNGSDRATEQDIIWNRSSGNQASQGWDLNAHNATNCEGHNVDRYNVADIDFSNFKSYSDLLENACNDSVISLENISTMKCSPKHATGPSLQYFASHDACAIQPTGKWLSNLPGSVGQVPGSPRVPIETACLGRSAGELNGNDAKPPTKVDDSGLASTTAKLGKDTISPDCDHNVSSLFKGDPGRNTTKLDSEALAQARGNAMLRYKEKKKTRRYEKHIRYESRKARADVRKRVKGRFVKADKECDQDALGSSN

SEQ ID NO: 1366 - protein, 554 aa, Pinus radiata
MGTMCDFCGEIRSTVYCKADAASLCLPCDGQIHGANALSKRHLRTLLCDGCSVEPAAFSCNNHKLSFCHNCDRQSHSNAPQHKRKSISYYTGCPSPAELAELWNCELDRQGGDDKQGSSVPGTRWGNSGKEDVSLETLLASGIDVGFTQKFGPWMEPSVSSKVGLPPSSQRNSNVNTRIFDSEGSEGTMKTCEEQQQQSKQKHAVVQQLLDLQKSQHLALTEVQNHQEVQAYVPPQVQGEVQSMESSLSRSLEDDFQIQSQHLQRQQKDQQQMKQNFQEQKMQGVSLVIPESEPLKSDTNMEMAIQGDSFWRCSAASQTNQLWDQNMQDLGICADDDCCDALNMSDVNLIFENYEDIFGGPQVESSSMFEDLEAACSSMDKVVSVADPSECNNHNLKASSAPAGCYAVLSSQGAGKEGETSRPITGRTVQGAPGPNVPSNIRHYVQPAPACLPHSLSSYSGDGDVADYHDCGVSTMFLKGEPPWGSTNTDSAFLNARGNAMIRYKEKKKARMYDKKIRYASRKARADVRKRVKGRFVKAGEAYDYDPLATTGFY

SEQ ID NO: 1367 - protein, 559 aa, Pinus radiata
MENQDALECAECESERAKVVCCTESLAYCNPCSLKIHSKRARSHHTVLPIPPCSQCLLRPAKLQCFQCSKSNHNLSSKANPIVLCTHCSTSIHHSPSTPVHKVTVLAILSSIIKIENQFPSHVKQEKLDSEDECLIKKGKKRKSTASYDSNPDNKCSSSNKLRRSIKDETQIKEEPVSPREGQKGPRRNTPRAATKRVFGPTETDSSSSESESDGGWSDFEEETGVRRMHRGSVSVEAFVVNAEDDDDDGGGDGGGSNARNGEQHSTVVGIKERIRKMLELGLHPDTPDIEAQQALKNAQRLLTKHNLQQVEVMEGALKDSSALAGGMRVVELRYKGRIGRLGRIEEWVIDLVHVIADNFDTQYFTRKYDRQDRPLQVVFYGIKQNADCSGYAFAATFNRITIMSANYYPSKSLVDKDNKERALQRTYTRIARNNYKLGIVAGLKKIVSGREDAADSEEYQDKNGIKGETRGKGRSQRMQDEDKERERKAIQALVLHSKEVGQAYIKAKGIKIKTSKARMRETAWNIEAFTQGEIDSKQIDINQKALPTSQKGKSSKRQ

SEQ ID NO: 1368 - protein, 298 aa, Pinus radiata
MMKDQEEMGGMEGTADMMDSYPPRQLLDRRLKPQADQEILKCPRCESTNTKFCYYNNYSLTQPRHFCKTCRRYWTKGGSLRSVPVGGGCRKNSKRNNSNNNNGKRSSGEACSSATGSDQLSPSLAGVSNDCKYYNGDGEELIGINYVNSLRQVDHEAAFAGCSINSGVYGIQANDHQSSQSFQPYHLPTALQSLQGSLILGSDQAPNGFNQAANRGDLGLVQQQAAGAVPYDREAYHPYINMSLDQSDGHSRAPQQHKGNNIIEHPPQGIVYEGGYWNSGVWPDLSAYGLSNINPNSM

SEQ ID NO: 1369 - protein, 301 aa, Pinus radiata
MMLSPVQVCMDSTDWSQGMMQERGFRPSGEDLLSCSRPLLERRLKPQPEQALKCPRCESTNTKFCYYNNYSLSQPRHFCKTCRRYWTKGGTLRTVPVGGGCRKNKRAKRSVAADQPVFSTQSEPSTSGAPSASALPIGLDHQADLNPATNSSSYFNLAANNTPASTEANLAFARMQQAARQGGRSVLPNCSNSDFLGLSCGSSTQSSFGPQNSLNNLNPISSLTNLSALSALNSLKFSFAGLEDFHGNSNRSDQGSLAVPSEWQLPSETTLFEQAGDSTNYWSGGAWGDLTSYGSSVSPQI

SEQ ID NO: 1370 - protein, 355 aa, Pinus radiata
MNLALAPEMQVSSSSFEGIPDMAVAVQNLGGRRSKPHPTQVQKCPRCDSLNTKFCYYNNYNLSQPRYFCKNCRRYWTKGGALRNVPVGGGCRKNKRSNKRNSDKRPAASSAPPASAADNQAAGGASAASSSSSLVNGSDRSSIGFESDCNNTTTSTTTTNTGGATGTPAGVSSGQLFDGMNPINPPPPSLDPQARGALLNSGNNLSSILDPSAYENAQFSCMDPVISSTPDWSRGLSMPWKQQQTLTSLLTDGIRTSLDGFLSQPPPLLEDINSLAEAATRSVFGVKTSAATVPWPSLQDDDNIKAQSLQGLEWQTANGNSTSDAGLLEIQSDLGPWGAGSWPDLGNYGPGSSLP

SEQ ID NO: 1371 - protein, 357 aa, Pinus radiata
MVLSSVEVCMDSADWTQSFLQNSALKLPEDLMPCPRAPPMMERRIKPQTEQALKCPRCDSTNTKFCYYNNYNLSQPRHFCKTCRRYWTKGGALRNVPVGGGCRKNKRAKRAVDHPVSAQNEASTSAAPGNEVPDRSPFEPPSSKSIYYGGENMNLTGLPFSRIQQDRAALAHCNSSSFLGMSCGTQSASLEPHLSALNTFNSFKSNNPGLDFPSLSTDQNSLFETSQPQLSRAMASALFSMPMAPGLEDPADFHWKLQQQQQKLSFPFGDGQIENGPGSEGHDFLTYEDSSKDDQKPEVVTKLPSSSVKVEEDQNALATDWQVPASEPLFAGDSNSYWNGGSWPDIASYGLSVCPLI

SEQ ID NO: 1372 - protein, 467 aa, Pinus radiata
MSKDCVVVCLSGNDRIHGHADEKGFDPGFKLFGKTIPVRAAEEIKQEEPVSGQQPGSHKEQSLEGEEEVQQETGSSSEDGKDESMNEGKSEGQKTVLKKPDKLLPCPRCQSMDTKFCYYNNYNVNQPRHFCKNCQRYWTAGGTLRNVPVGAGRRKNKHSVAASTVSSHYRQVISAASECGLGVRTDDQDSGVDQVMIPCAALPASCVRPLKVAGSRIQVVPVDVLESGASTGTVLNFGSEARNKTQRGGDNDPSIEKSTMESSSGFGKEATAHINQAAPRPQMDPSPNWANGAAGAAFFGGAWSYGWNFPNPAWNAAAAALTPGWPGLSWPMVPGSYFPPPPPPPAGWGPAPWVSGPWAAAAATTASNSPAVADSGSPTLGKRPQSEDGCLWVPKTLRIDDPGEAAKSSIWTTLGLGDKPESAITSGGIFKAFQPKTQGAKDSRKASQALQANPAAFSRSLSFHESS

SEQ ID NO: 1373 - protein, 497 aa, Pinus radiata
MVAVNAEIMPKFEGKSAKSLDSTFKLFGRTIAVKNPCDSSSNGIHVDGIPAEAVNSAVPKASETHHHDEKQKQNEDSEKVGKKPTKLVPCPRCESMDTKFCYFNNYNVNQPRHYCRRCQRYWTAGGSLRNVPVGAGRRKNKPCFGINHRQIMDDTETGWNDVQGQASRGNSDKLVKVEPFYPEFEKFREGLNEAATPKEGNSKPQSIIQSQFDDYSHPSTVNLAREKVGKEVLFGSGNQVGAMGWPGNSTHLAKEPENSTHVANEPGNFTHMAKELESVQKPSCSSEKTQTSATKADSAEPVDDLTSDSNLKSEPKNMSPDGSSSSSSSMNYTGSPWPVYYNGCWGSFPPGVEGSEKNRVPWYTPSTGFLPTGLNWPVPSGVMWGLPWMAGNDNSESKTLGKHQREETPQAVPENKNRSLWAPKTLRMDDPEEAARSSFLTNLGLENKKEGSIKSGEILKGFQLKMDNKDDKRTTSVQVLCANPAALSISSSFLESS

SEQ ID NO: 1374 - protein, 330 aa, Pinus radiata
MLSDMGMDIARNNSSFVGFPGLECPIEWGEAAKSFDFSSIGDVFRIEDLSEFSNEDIAGPIPSGSLSSLSSPGSSQNMAKHTVCASFLNEGDFICPPYEDGIGLEWLSDFVEDSFAATGSSNSGSLADLSKDKIDDNREKKKQNPTDEAIIPEIPPIKETPRSQRAVPGRARSKRRRSSGAPIRGWSTSEDYALQNEGGMKTVTGADAINHYQSSAPQQQPRRCTHCLSQRTPQWRLGPLGPKTLCNACGVRFKSGRLFPEYRPAKSPTFIRYIHSNSHKKVLEMRNEETNDLEGLVFDPHLSDSKHQDQGLLKVKIKLAGLDNLSSQSN

SEQ ID NO: 1375 - protein, 331 aa, Pinus radiata
MDFQTAPLYCPDTSEAWGAVGEAFHIDDRLDFSNDDIGAPIQNDEENSSESTEVSAGSAEANYSSVTQVTEELPAAELCVPMDTLADLEWLSTFVEDSFMPELPSACGPTSEQVPLTDGNKTASDDNDEPKPRSCQASFLAACNKWIPVKARSKRSRTGGRVWSFNGPPVRRVSSFNGPLLPPNPSVESDGVVFTQSSDSSCSESSQPRPAKKYKKTHSKKAQDGSQPRRCSHCLVQKTPQWRAGPLGPKTLCNACGVRFKSGRLVPEYRPAISPTFLSEVHSNSHRKILEMRRQKEEEQQRPELTSQTCSSGANESFSDNSLPSEESLLV

SEQ ID NO: 1376 - protein, 350 aa, Pinus radiata
MSDTDNLDPESRVIHNNHQHHSFYPDRQAPIHAVNAHAHVAAHHAPMHGILMQGQNEGDPHRHQGAQFQGVDSGHMHIHYMHSDEHGHPLHHSNDNGAGEEQDEGDGDNNCMEEADIQSDGDNLAEPQSVVPVRSQGTNQLTLSYQGEVYVFDMVAPEKVQQVLLLLGGREIPNSMAGMPIATLHHQKGLSDVSHRLNQPQRLASLTRFREKRKERCFDKKIRYTVRKEVAQRMQRNKGQFTSYKSDSKDLVSAGHKWDSAEGWAPNTNGTQQEAVCLHCGTGERSTPMMRRGPVGPRTLCNACGLVWANKGVLRDLSKSSTSLGSQEQSQSSHEQNDGGPGSQETELGE

SEQ ID NO: 1377 - protein, 396 aa, Pinus radiata
MEAADYLYGTNYGTPFLDGKKSSGKFTELKNGVQLQDFFHIDDLLDFSNEEIAGPIGDDDNNWASCTTTTAAAAVATDSSTITLAETVSCNSSLDGKSFRAYNVLETDANNNGHLCVPCDDLAELEWLSNFVEDSFSTEQAPKPIFPPNFGDVRTDKEEEKPHIANPIRSTSPLSGLDTSSSSWKTPSFSPETPVPGRARSKRSRAPACNWSSRIVSPASSASALENGPTSSVLSSDSEFFAESYFPAKKPAKMSQGNKKREQDQQTQIRKCMHCDTTKTPQWRTGPMGPKTLCNACGVRYKSGRLVPEYRPAASPTFVVSKHSNSHRKVIEMRRQKEMQDALQQASKLYPNDKEGNEDGDEYEEDEDGSDGQYPHFGSDDDTYLVHTNQDYRHFI

SEQ ID NO: 1378 - protein, 618 aa, Pinus radiata
MGKQGPCCHCGISTTPLWRNGPPEKPVLCNACGSRWRTKGTLANYMPMHSGGCGANGSLDYKWPRGKKVSQKFKEQRSHKRKEPCDIHQDMEFTVANSNQHHGIFLDEDASTRSSSVSGLSYSEGCMQHPGAFEKYSTVAWDSPVPSKKRTSMFRQRPSSLENLTKSVQVSHGQDLSYLSSSSEHDLLYECKDQIITPEIGLGGVFIRQPHSATREEESEASSLLIDNKGYSKFDVSNQAYSGVGDTRVQIWGDDITRSERWMEMKELKKLLQSCHSPLISIELEDVVNFDTFMELLKEDEQRHLVKYLSSVDHSGLPESLKCMFNSGQFKGALSNFQHLLSEGMFGTYGSRLSPQVERLFQQLLIVTDLTNSQWIERYSKLHKDVDSKCVNFSEIPEYKESTKTKDFGLPAYSVSKPWKHATHKAFMSSPGQLSSQVITGSEKSTRNTDNMQIGGPNTVNPVTPAWASCNMEGICHESIDTGSTSKDAAGFEIKPKGSPSLGASSLFSSPSKRCSSFVFDSLGDFADEDSDSVLLFDVPSNLSFPQAELLHTPVLKCKAPKDIVSDASNLENSNSGGPVVNSEESPDWGSLLWNSSFIGSGQTLSGGTVLNPDKTHL

SEQ ID NO: 1379 - protein, 181 aa, Pinus radiata
MSTSGFEVGSDHLCYVHCDYCNTILAVNVPCNSLYRTVTVRCGHCNNLLSVNMAPLLQSLAQDPQQQGQNTGTYDYNRDPASSSTVIRDASYLENEEARMSSYRQPEKKQRVPSAYNRFIRDEIQRIKAHNPKITHKEAFSAAAKNWAHYPHIHFGMMMDSRRQANSEDGGDVLNAEVCNN

SEQ ID NO: 1380 - protein, 190 aa, Pinus radiata
MSGCIDSASATEQLCYVHCNFCSTILAVSVPSSSLFKIVTVRCGHCNHLLSVNMMGASPPLEAGQIQNDYSRDSASSSASSTVSERTANSYAGNEAAKMFSSMPTEKRQRVPSVYNRFIKEEIQRIKAKNPDIRHKEAFSAAAKNWAHFPHIHFGLMLENNKQATMEKGNLREGTQIGTVKDGRMTTNLC

SEQ ID NO: 1381 - protein, 209 aa, Pinus radiata
MKGSETQELAMTFRLLAASTPGSGVTSDFLSIPWQELTMSQIEKMLEETKKMLFLNEKVHDCSECGKRFATPSSLKDHLNEHSGDKPYNCKFEDCAMRFKSKQLLCRHLKKHECAHKCMFEGCGKRFAFRERLIVHQKIHSNERPLVCPWEGCGKRFKWTNSLQGHKRTHTGEKPFQCTYQGCGRHFGYKVDLTRHLRTHNGQPARGSH

SEQ ID NO: 1382 - protein, 359 aa, Pinus radiata
MMNIMKNCSIDLEGSESYFSEESVISQQLSASNVSAGLESSLFSQQQHQPHYMFQVQENVPKSGEKSSTEDFKLEETSEVSLNLTIGYDDEGGGTVREGKDLQTSNFIDYFGQSNHTEEAENEHDASVDTKGPLESSNEVGHPTTYPESSSLSAQGSEPRVFSCNYCQRKFYSSQALGGHQNAHKRERTLAKRGQRIGAFQHRYISMASLPLHGSTESATGQMNRSLGIKAHSLIHKPPYAEPSLPLSHHGWSRPPIEQHPAVGKYVMEDMGSSRMIVGNRGGVARFENNNFGAGRILGANPFLHEEPASFCWPGSFRRMQQQSQEGGSYHTQNHETSSNAFYLKPQDDISKLDLSLRL

SEQ ID NO: 1383 - protein, 374 aa, Pinus radiata
MVNANRYLAARGFKSANKMNTKSDNLHQYTSLGTVAAAAGAANSVSFTESNKPLEAPINSISSPSCVPLAIPCTDSFVGHQVPRSHAANDVNINDQNRVFFQQLQQPPKEYGGSPPLREELPLLLSLSPPREKRSGEERFRSDPEETAMVSLHIGPPNSLCEKSEPSLKSTDSSDADKESVIVQGRSEGRTRFSESQYWIPTPSQILIGATQFSCPVCAKTFNRYNNMQMHMWGHGSQYRKGPESLRGTQPTAILLRLPCYCCTQGCRNNIDHPRAKPLKDFRTLQTHYKRKHGIKPFMCCKCNKSFAVRGDWRTHEKNCGKLWYCSCGSDFKHKRSLKDHIRAFGQGHAPIAPDSFEDEEDLGSEDEVSVLSH

SEQ ID NO: 1384 - protein, 390 aa, Pinus radiata
MAATTYLAEEEEGEDYFFQFRSPDMDREPPHFVSSISSAIKGKRSKRSRHGLPPLPKSEFTAQQEQEQEQEPDQDQDQDQYQDQEEEDEQEMAARCLMMLLADGSDRHSHSLTTTSSSESPAPSTLHPIRRRIKKPKRYDAGNADFPYSQEWDDGFKPEMMIRSYACKSCNKKFPSFQALGGHRASCQLKDSKSSFPKLLVHNQSDEGFKEAASASASLPRPPVETYKQSLSNEIKKVRVHECPVCHRNFPSGQALGGHKRTHSSPPATSTNNSSSLSITEQQHLSAMRSTPELDLNRPAEDENDCTQVQPSSAVSVSLGGDFLNSTDWPPYGYKFMSYKSPQPWWMESHQPGVVKEDEADSQFMSNTGFARGRDLGCKQTGLPLITTVN

SEQ ID NO: 1385 - protein, 395 aa, Pinus radiata
MQKPEEYGLAVLSQREFSYLETMNMRRYHADIGGSPAPMTAHPSISFTEWLKPKPSSGMLAASDLPMAIPCMETFDPRSNLTTYIPPSALYSAHSYTPQTLDQCPPQLPERCDSPPLREALPLLTLSPSRNPTDHNLERHDRKDEEDHHDHDEELNDNVTVALHIGPPSTNSYNYDNNSGAAVSFKADHQSGSNYSYDHAADKEKLRAGRVPEGQYWIPTSAQILIGPTQFSCPVCGKTFNRYNNMQMHMWGHGSQYRKGPESLRGTQPTAMLRLPCYCCAQGCKNNIDHPRAKPLKDFRTLQTHYKRKHGMKPFMCRKCSKSFAVRGDWRTHEKNCGKLWFCTCGSDFKHKRSLKDHIRAFGHGHAPQGEADNYSFEDEEDQGSEDDELSGGSQ

SEQ ID NO: 1386 - protein, 420 aa, Pinus radiata
MPGLTCNACNAEFNEEAAQKFHYKSEWHRYNLRRKVAGVPGVTEALFQARQQALAEEQKRLESNRMLYSCSLCGKEYRSVEAHAQHLKSKAHIQRASETPASRSAGITVIKPLPERAANRSSFVSKPSSSLNEDKSEESEGSEEWEEVETYDMVSVASESMKSLDVNESSLGNAGGSFQSIAEKLEWDASCCFICDFRPDGTIESCVEHMHKMHGFFVPDAEYLKDLRGLLSYLGLKVTNDFMCLYCNEKRKPFPSLEAVRKHMISKNHCKLHYGDGDEEEDSDLDDFYDYSSSYADESGMQIVPTEENLNVNIELGFGGAELVIQRKSENGTTCKMLGSREFLRYYRQRPRPTVERDVALSRALVSRYRSMGLATVQSKEKILRRNALKKIQRSGVEAMRTKVGLKNNVIRNLPNNVPY

SEQ ID NO: 1387 - protein, 483 aa, Pinus radiata
MPSKRQRPEGEALIHCNKAASASASASPLYTDACQDRDAGTSTRACILKEGEKKENIGAALFLNSGYPNENLASLQYPTETSMGEEVAQEECSNHLGSTSMEIKNKKETVTVTNPKPLQRSFSTTQRDYHQQKDQCSEEVTDEAAEGRCKREKSMKLFGFELRQKKVEAENRSSGSAHHDDDNKVNEEDVEGEDRSSAAQAAESGSNSASDSRKYECQYCCREFANSQALGGHQNAHKKERQQAKRAQIQASRSAAVAAAHAASANRAGNAGAAAVAVPGFYGMHRLAGSALLTPHSGRMTVLGGEIPPPSPAPRFPAPVIASTVPHYLDYQNHQQPAGMGFGSALRPASVRPSWFYVPQTGQYGFSSMSYGDFGCSNMYSVNPQFPTATAMPSIQSRHCSTDNRYLMLQPQPQPQPQPQPQPQPQPAISEFEAPGRSVSRPLSQIGVSRIEAGNSSSVHHESSTGVEDSSLDLKLGLGPTRS

SEQ ID NO: 1388 - protein, 661 aa, Pinus radiata
MSSLASPSVDASASSSNRGDGNSVQQQLASNADPNSGVQAVPVKRKRNLPGNPDPDAEVIALSPKTLMATNRFVCEICNKGFQRDQNLQLHRRGHNLPWKLRQRTSKEIRKRVYICPENTCVHHDPTRALGDLTGIKKHFCRKHGEKKWKCEKCSKKYAVQSDWKAHSKTCGTREYRCDCGTLFSRRDSFITHRAFCDALAEESARVSGGITLGGHGQLLGVHSSDSLGQRGAPLPVMGTSNSSHHLVKELPQSLHSTISSRLAFSESSEPASSNAAGALKPRLPLWLAPGRGPPGGHSQVNTMEAAASEFLDAQSPKSMLQVMPPPPKYDYSQGQKPLSGLLPLTSSNTGSGNLYSMLFATGSGQDQAMSSSGNIERSSVTGATDFGPRGTDWTDRGSAGLTSNSSGNTNGNKVDSLPSLPYLYGQHSNSGTGTAQMSATALLQKAAQMGATVSSSSLLRGCGSDSTPFGLGLCWQGSSQEKQREDQMSGMASSFVNSHALLKGHPDVTAQSNSFAAGNTRFSENAALQQVISSLSEGFMGSLYERDFNTIHHSTFGENIGTIRRSPQQSVMQGTHPLISATMRNLNARTEDGSDGLTRDFLGVGGVNPMITAATEGSCMGRSSLLNICSGMDSYSNHGENLTSIRTDVSQSPAKSWDAS

SEQ ID NO: 1389 - protein, 689 aa, Pinus radiata
MGTENSQKKKDSIFDLPAHYFDSASLLRLPHDTANSATASHKVSLDLDLGVSSLDTPIPNETEYGENEEEKQSMGTGMGVSMNRWSCKTCTAEFSSLEEQRSHFKSDFHRFNVKRRIIGRGPLNEDEFEEVAQGTFLKDDDISSISGSDEELDDPITCGWQPRTESVNRSMSMKNQILISLQSGEIVSIWKSLLLGDREDLLPEHNNSMVKENDAKSLALADKEVIGRLQSLVKESRDQKNLRVVLLASGGHFAGCVFDGNNILSHKTYHRYVVRAKAGGRQSSKDSTGRMPKSGGASLRRYNEMALKKEILELLAAWKCHLDSALCIYIYSPSINGQVFFGGENPPLVYHDNRVRRMSFTVRRPTLKEAKRIYHQLTSVYTAVRPEIHFPNELGEPPLNSKKGKEDATEVNKTKIKSKNKTEKASVPETCSDLDHQESSVTETSDIGNKATVNQSSPLHEAARSGNAARILELLEQESNPCVKDDKGRTPYVLAADRETRNVFRRFMAANPNKWDWHAANVPSPLTEEMEASQAAKQAEKDAKRKAKAKEMKKIRKSKQKAQAQSTSLEVASVAVCYGQNAVSELLEKGKALPNMQSHAFQEDLKKVQAMEREKRAAAAEKRMLALSKNFGNVFSAVSSNVGFRDMNFDTHCSCCAAFLAGKVPFPRYNYKYCSTSCMHPHREMLEDE

SEQ ID NO: 1390 - protein, 772 aa, Pinus radiata
MAEVLDIPPETLDRRRDRPSDRKEKEKPSEERSKRDRDSRERRDERDDRPPRRGGDYHERTRSPAIGSGGGGPSRDYKRRHSPSPPPYIPRDRRHSPPSRRSPPYKRSRRDDVYDSRRGSPRAGFNPDDRRFGYDNMGGYDRSGMGGRSGYVDERPHSRHLGRASGGFQGGSPDWPGSGRAGFGEMGTPQREGLMTYKQFIAELEDDISPAEAERRYQEYRTEYISTQKRAFFEAHKDEDWLKDKYDPSHLEAVIQRRNENAKATAKEFLLDLQNGTLDIGPSSTGSTPLTAKGGQGSDHNSDDDAEVSGKRRRHGRGPAKENDPVSSAPKAPPVSSEPRRVKKDIELGQALIRKLDSEKGIEENILGSSEQDKFEGDKSISGSIGVVIVRGTNTVKGLEGLELLDVVATYLWRVHGLDYYGMIELKEPPKGLRHVRAESKNNHDEQSTAAAEWEKKLDSTWQARLQGQDPLEIMAAKDKLEAATTEALDPFVRKIRDDKYGWKYGCGAKGCAKMFHATEFVHKHLRLKHPDLIGELTSKVCEEVYFQNYMNDPDAPGVTLTTQQAGQRDKARRRKAGHNLSGDGGQIGGTSRARDVDHPDRASRRENERTDRSHEDDRYDRNDDSSPRDYQSIPGGQDVGHHDPSMFDPFAGPGMRGPPPFGSDMPPHLPVFMPLPGAGPLGPFVPAPPEVAMRMLREQGGPAPFHPNDSNGGLRGRKGRSGGGPSMGGITDPPMMLPISPGFRQDPRRIRSYHDLDAPEDEVTVIDYRTL

SEQ ID NO: 1391 - protein, 424 aa, Pinus radiata
MQVGSLNGTKLGMEFLNFGTGKRPTQMADVKPCLYFARGFCKHGSNCRFSHAENYLSVPVSASSSPSGSVSDEPISSGSLERLELELQELLRAKRTPISIASLPQLYYERYGRTLQAEGYLTESQRHGKAGYSLTKLLARLKNTVRLIDRPHGQHAVVLAEDAPRFTEYRSERSDITAGLIAGSRQIYLTFPAESTFTEEDVSNYFRTYGPVQDVRIPYQQKRMFGFVTFVYSETVKIILAKGNPHYVCGARVLVKPYREKGKHGDRKSTEKLDHSKYMAAAYNLDLDYDLQLGPRIDTSEVMRRQLLAEEQEQAIEMERTRLAELHLFNQVSKITTVNNAIVTHEQHNDFDDAKATDQDLNDFSLTDHFSYLLEVLNSDSMSGEKPKNNNTSDQDSSHGHNLPDSPFTTPRASYTANNISAAT

SEQ ID NO: 1392 - protein, 326 aa, Pinus radiata
MAEPNETGPSQQQTCNFFKKPTRNKNIRKREAEEVTEEENKDGSAVVHKPKAAKKPDNKLHFSSGPSKKSNIEDNDSETAGLPASTFFYESSKEIQVQNDSRATATLETETEFTKDARAIRERVLKQGEESLKGNNPGDEKLYKGIHGYTDHKAGFRREHTVSGEKAGGAHGPLRASAHIRSSIRFDYQPDICKDYKETGYCGYGDACKFMHDRGDYKSGWQMEREWQEAEKKRKNNLALGLLEEEEEEPDSDEDALPFACYICRQPFEDPVVTRCKHYFCEHCALKHHARNKNCYVCNKPTNGVFNTAHEIRRKMGKDNVGAKNK

SEQ ID NO: 1393 - protein, 329 aa, Pinus radiata
MDPFGHARKKARSETILNENGGLFNPHESNIFGDGNRFKAGGMKFALQPEKESLPTGLGSKSKACTKFFSLSGCPYGEGCHFQHYVPGGVNPVTQIGTLGTALGAASKKPTGLLPAEPTLNASNYKTRLCSNFGTDIGCRFGDKCHFAHGEKELGKVNAVAHNLKDDLATGPFGSRFPVGGLDGKPGGRPGYHEATPPGMAAAATFGASATAKISVDAALAGAIIGKGGVNSKQICRSTGAKLAIRDHESDTNLKNIELEGSFDQIKEASALVRQLIMHTSATLPAKQPSFTTNNFKTKLCENYAQGTCTFGDRCHFAHGASELRDNSK

SEQ ID NO: 1394 - protein, 330 aa, Pinus radiata
MDPFGPPRKKLRPEVEFVNGNGGIHTHTHALTDVGTRRFNPSDIVYGDPTRFKQPTFVSPEMESLPTGLGSKSKACTKFFSTSGCPFGENCHFMHYSPGGVNLISQVSNLGSGLRTASRNSTGPPTSILPPDQAAAVQPYKTRMCNRHGTAEGCRFGDKCHFAHSENELKKGNTLAPVEREWTSSYGRPVPGGGRLVQHEATTPGMAAAASFGSSATAKISVDASLSGAIIGKGGVNSKQICRVTGVKLAIKDHESDSNLKNIELEGSFDQIKQASTMVHELIMQTRAVAAKPSGFVSNNFKTKLCENFSKGTCTFGDRCHFAHGASELR

SEQ ID NO: 1395 - protein, 408 aa, Pinus radiata
MESFEPTLKKSRGYDTDGANGMPWTSSSSAGNMNMNPGMNLSSGVNYHSGPNPNQGHGFNPNAAGANPNPNPTLNPNSGVNEVMQGPPQGGYPPAMGGGQYAGGSGASYGGGSYGGGSYENGNHSTHFEVLGFQQQHQQGSNVNVGDLECRRYKLDEGCPYGLTCRYKHGPTDERDFNIHVPSSGGKSKPCMKFFSTSGCPYGEGCHFSHYVVGGIAALGLAPVQTMPAATMAPPRKQPGPIGDPSATVSGYKTRLCNRFNTDPGCRFGDKCHFAHGESDLRSSNNISASNRNGVPMQSAPAIYDNGPLATVSNPAGFVDTTAYGNSASTATYGNSASTAAYGNSVVYSANTFPSSQSYAEPTPPGVAANTPFVPNYNMPVENSSQLPGVEGTMQGGPVTGTNNVQVY

SEQ ID NO: 1396 - protein, 468 aa, Pinus radiata
MDYNAAMQGGFARQRGLVIDPDGWQQHGRPRAEITGVEEAMWQMNLQPQHESLEPEIGSYPERPGEPDCTYYMRTGLCGFGMSCRFNHPPNRKQAAAAARNKGEYPERLGQPECQYYLKTGTCKFGATCKFHHPRDKAGSTGRAAINVLGYPLRPNEKECAYYLRTGQCKYGATCKFHHPPPVGPLVPVRGSSLFTPVQSPTTPGPQAYPGSLQTWPMQRASFIQSPRWQGPSSYAPLILPQGIVPVPSWSTYPQGQVGSISSSDGQQQAIGAGLVYGPTSQTDPMASGIQGTFSSFPPGSPGMGPPTLQLPSSSAQRESMFPERPGQQECQFYMKTGDCKFGMTCRYHHPKERIIPIPNCVLNSVGLPLRPGAPACTFFSRYGICKFGPTCKFDHPMVHSSYSQSISSPIDIPVGRHQIGSASATLASVPLSSDLVVDSGGGKSIEHTSTAEARQQSSGVENLGPDA

SEQ ID NO: 1397 - protein, 471 aa, Pinus radiata
MEYYRQEENWAMHSNKNNVLTFTSSTDMKSIEKSMGKMTLKSPVDPVESGSYPERVDEPDCAYYMRTGLCGYGPNCRFNHPPNLKQAIASKGEFPERVGQPDCQYYLKTGTCKFGATCKYHHPRDRNGLGGQVQMNFLGLPMRQGEKECAYYMRTGSCKYGVHCKFHHPQPTTIMPVSGYASSGSPTTPASSYPPGILSWPLPRSPYVPGHRLQGSPTYVPMPIIFSPTQGVMPMPWNNYQGPLSPLLSPERHQQPLGTGVAYKSFQQSDSSASGVQSAVTPLIQAGSAAMVLPTVQAQTSVGQKESFPERYGQPDCQYYMKTGDCKFGTTCKYHHPKERVAQSPTCVLSPIGLPLRPDQPACTFYSRYGICKFGPACKFDHPLGGVSYSPSASSLSEQPVAPYPRGSSPPRMLVRSSSSENSQAALAVKGQSSRLEESASFKHHSPTDGPVGEKEADTSNSVAAVLSESA

SEQ ID NO: 1398 - protein, 502 aa, Pinus radiata
MIDGIYRASVPQQRLASGTRSRRVTDVRADNWLPSLAGLNSGKSAAESMKESLWRMTLQPQDLRSRMNGYSESYPQRPGQADCSHYMRTGFCGYGMNCRFNHPTNVKQQAAGNRGELPERVGHNACQFYMKTGTCKFGATCKYHHPRDRLRAGQIQLNMLGLPMRMGEKECTYYIRTGFCKYGATCKYDHPQPPALGALVPVSGSSMYATVRPPISPASATQYSPALPTWPSPRTPYRQSLHMPGALPYMPVMYSPHQGMLTASGWGTYQSTASPLTSPEIQQQLRRMNIIYNSTQPNGLSVGGVQGSITPFTQGSSPTVGHQPGIFQPNRTQTETYPERPGQPECQYYIKTGDCKFGFACRYHHPRERVSQSSSCVLSPIGLPLRPMQPTCTYYSHYGICKFGPTCKFNHPLTGLSYSPSASSLSEIPVAPYPRGSSPTTTHVQSPSEPTQEIAKSRDQPSREPTSSKQDSEAVVSGNTKENASTYSDAAISSRSAQIALC

SEQ ID NO: 1399 - protein, 506 aa, Pinus radiata
MEYYGNSSAMPRYLGSAVDPPPTDWNSQHVAADLGMEEAMRQMNLQSHDVAERGLFGPFPERPGEIDCAHYMRTGICGFGMTCRFNHPPRRNIAAAVARNRGEYPERPGDPECQHFVKTGTCKFGATCKYHHPKYKAGTSDWQQLNALGYPLRLNEKECSHYVKTGQCKFGVTCKYHHPQPVGPSVAIAGPSYYPTGPSLSIPSPQQYAGGLTTWPISRTPLMANPYLQAPSTYVPFVIPHGMMPVPGWNSFHGQVGSITSRDVGQQAPGTGLFYGPRYQTDGMNPSIQGALASYSSRSGSMGIPSTNTQMEHMFPERHGQPECQFYMRTGYCKYGSTCKYHHPRDRTVPLTSCTLSPLGLPLRSGAQTCSFYVRQGFCKYGPTCKYDHPMGTLSYSPSASSLADMPVAPYPVGSAPATLAPSFSSTELRTETTAGPFKESILTPETPLSSSAGESLDLGAQGPLLSTSTGLTSSESEENPLVKKSNQVSVLANGIAKEGDIPISN

SEQ ID NO: 1400 - protein, 519 aa, Pinus radiata
MLFVQGQREGESPFSFTTTTHGGLQGSYTDGERTMHDNCPLSSSSSPRVPGDALEETVLQISIQTLDTLEEIGFYSGPYPERPGEQDCAYYRTGLCGYGRHCHFNHPPNVKLDTQYMSELPERFGQPECKYFMKTGACKYGATCKYHHPHDRDGPRVQLNYLGLPMRQGEKECPYYTRTGSCKFGATCKFHHSEPTALLSDSGSPVYAAAELPLSPASGSSYPAGLTSWFLQGAPYVSDPHLQGSPTYMPVILSSQQSTPSVQPGWNTCHGPTSPLSSPEGKQQLGAGTVYSSSYLTDSSSSPEGKQQLGAGTVYSSSYMTDSSSSSHMHGALSSPVQGSSTAMEHPGVQCQVAAPKREAFPKRLDQPQCQHYMKTGCCKYGTTCRYHNPQERVALSPCCMLSSQGLPLRPGQPTCPFYSRYGICKFGPICKFDHPLTGPNCNPAAFSSSEQQTTSYPKGGSSGAHCQSTSEEFSKQDLKATDQYSKAEEASSLKQKSTEEGAGDRLAAKSPSTSGAAI

SEQ ID NO: 1401 - protein, 534 aa, Pinus radiata
MPGVSAEQHLFSGSGSPVVFGNRCCPVSRAFESQDLPKSFYAEPPELSPYALTNMEYLQSLNLFSETSPNSEKSRYSKDSASVQKLFNKSLSFGSNGLGVDFGGMESENFLVSPRTVIESPDGISSLHKFLPSNNEEEASWPAVDAYSCDEFRMYEFKVRRCMRGRSHDWTECPFAHPGEKARRRDPRRFHYSGTGCPDFRKGSCRRGDACEYAHGVFECWLHPARYRTQPCKDGRNCRRRVCFFAHTPEQLRLLPGASQAQSHASSNFGNRNSFQMRNTVSGSYDGSPLRYAVTAAASLDGAFGYDGFDGNASPRGPLNYLCKAKVKAKASQISSPTSTLVGHSYSSPPLSPPLSPSASPPISPGSCLDSPVNYANSAVKSFPKSETNTAPGSFTPRGHLERLISIPQPNLDPSPLSPAVHSPAPSSKLIMEGLINTLQRMEINGDTLPWRQQQQQFNLPGRSCLSFPGAPRLDDDAWEVEAAEDGSIQRVESGKHLRAKIYGRLTRESTLQDNNNTNTEYSPDLGWVNELVM

SEQ ID NO: 1402 - protein, 612 aa, Pinus radiata
MDLMFPGVEGKMDTYEATRIVFTRIQSIEPENVSKIIGYLLLQDLGDQEMIRLAFGPNTLLQSMISKAKTELGLSSPSPLQSPLRYTQFSNLLSRSFSSPAPNGFDDCQLQDHLFYPTENLDSYSLPNDSHVYTEMLSFLNGSKTGLNHRRSYSMTDVSVSCEPVSWKPCLYFARGYCKHGSSCRFTHSYSRSDNVSSSIPLDPRFEEAFSVESLERLELELQELLRGRRAPVSIASLPQLYYERFGKTLQAEGYLTESQRHGKAGYSLTNLLARLKNTVSLIDRPHGQHAIVLAEDANRFTTYRPSERDPYYLSGVSSGSRQIYMTFPAESTFTEEDVSNYFRIYGPVEDVRIPYQQKRMFGFVTYVFPETVKLILAKGNPHYVCGARVLVKPYKERNKHGDRKNGDRGEQYARYLLPSYNVDSKDYDLCPAPRMFQNSELIRRHIEEQEQAIELERLRLTELHLADRAQRTQNNAITLQQQNSHSNGLLNVEEEETQVSEELNSFDPPTDHFGYLLDVLDSEQNPEEEPKQQKADNDEECNGHNLPDSPFGFSHSIKTTLPHPEKTNNFSFFDTSPAQESSTSIMTKEGTCSMCLDSIVEQVRLECKHVR

SEQ ID NO: 1403 - protein, 621 aa, Pinus radiata
MDAYEATRIVFSRIQSLEPENVSKIIGYLLLQDHGEQEMIRLAFSPDSLIQSMIIKVKKDLGLMQQQGTPAPTVSSYLSRINRLPNLPLQSAQISQSRAFSSPTALSPHAAPWGSHISQQTRPLSNNFNSILNEIQTNTSTSSTINSTSNGYLNFSLPSMPDQANSLPYSEHPGLVDEFQLQDQLPFLNDSPESAQSHANYLNYPEMLQAYCNGNQPLTIDHVSPTAANNSYPGTTHIPKQPSSISDIYNLTSESAPGSALAWKPCMYFARGYCKNGSNCRFLHGNYGGHVRSESNNDHSEKFMGSSSGPLEKLELELKELLRGRGSPVSVASLPQFYSERLGKALQAERFTRYRSERDSSDHLASSASNSGSRQIYLTFPAESTFREEDVSNYFSIFGPVQDVRIPYQQKRMFGFVTFVYQETVKIILAKGNPHYVCDARVLVKPYKEKGSKPAERMKYTDCRGDYSGYVTTHNLDIKDSNLQLGPPRFVENSLDLVTRRQLEEEQDHVEQAVELQTKRLAELQLGDRKRPQLVPSDPQVSMASTNSGPAQHYQNQFSNGPNNHSEEDATTSEDFSSSTLAEHFGYVLQVLDSESVYEEHPKPVNHHHDRLPITNGAMRL

SEQ ID NO: 1404 - protein, 640 aa, Pinus radiata
MGHQIYSSSQSLGSASRGNPVLGYNGGRALEPPMFPARPYDLPAESRYFSGDQMSNSMQLDKPGGRYMFGERVPSERTPAETGSRPGSFSLERYMPSEATQRADSSRYYPGHNSSMFLNGSDTALYKGGDAVGFGSTSAYFPSRHSAGLVSPPLQQTQWPGAESRGSMPGGVTGVKRPNEEVSQTLLGTHNAFGQNEALSSVNALPKRPRLDGSSDLPIYPQRPGEKDCTHYMMTRTCKFGADCKFDHPSWVPAGGIPNWKEVPSVATSSESPPERPGEPECPYYMKTGICKFGAKCKFHHPKDRLATLNSDENFDGNEVKLATGSLPERPGEPECAFFVKTGICKYGAKCKFDHPKDKGGSLKISEHKGNGDAAVTVGTEEQGVSGDINGKTDVIPIKPATMHNSKGLPIRPGETDCPFYVKTGSCKFGPNCRFSHPDRILNMPPAVMPFSVHDQPLVGYSGMLPQHSLGAPIPPQRPGEPECTFYIKTGECKFGPSCKFHHPLNRPDPSVKLTLAGLPRREGETICPFYLKTGICKYGVNCKFDHPPPGELDTARAQQPVKLTLAGFPRREGEATCPFYMKTGTCKYGATCKYDHPPPGEAVAKAVAMAATTEDISADYDKIDSGNVGANATDENIKD

SEQ ID NO: 1405 - protein, 755 aa, Pinus radiata
MCGTPEHSKVSENNEDNGKVVLAEKQLSKMKETQKCFSILLELAANNDLIGFKQAVEEDGSAIDEISFWYGRQNGSKQMGLEQRTPLMIAALFGSMDVLSYILSAYATCGIDVNLKCGSDRSTALHCAAAGGSSFAVEAVRLLLQSDADVNCLDANGRRPVDVIVVSPKLSNAKVILNNMLKAEYHSRAGACLKVLSRVSEYDNTDLSGRGSNSLSSLPHLSLPFEPQSPKVLMSSPKISETSRNCADGIEKREYPVDPSLPDIKNGVYSTDEFRMYSFKVRPCSRAYSHDWTECPFVHPGENARRRDPRKYHYTSVPCPEFRKGTCRRGDLCEFAHGVFECWLHPAQYRTRLCKDETNCTRRVCFFAHKPEELRPLSGFTGSAVPSPRASSSLDMNSTMSPLTLGSPSPVFVMSSLSPSNPPQGGLSTPPRSPSSSSANSLSHSSFSGTWPQPSVPTLHLPGGSLQVGLQASRLRASLNARDVPLEELTLDSDCEGQLINDFASLSGSGNTLMRSGKYKSHGCSIAPVNLEDLFASEMSPRGPCLEPSVFSQISSQIQSHKAAQVQPQVQTSISNQISQIHQMQQGAIGSQGNSHLHSPVQQSHRLPSLGLDLERQTSNGSVLSPALMAGMKSRSASFAQRDLRSYSSRDLGAHASLPSLADWGSPTGKANWGVQKGELNKFRKSASFGFRTSNEPDLSWVQTTVTENPVDAVEGCTVGFSLEALRNRQTENINNAVLGAWAEQQMHLDQQMVA

SEQ ID NO: 1406 - protein, 151 aa, Pinus radiata
MEPMDIVGKSKDDVSLPKATMFKIIKEMLPPDVRVARDAQDLLVECCVEFINLISSESNEVCGREEKRTIAPEHVLRALEVLGFGDYIEEVYAAYEQHRLETLDSPKSGRWASGAEMTEEEALAEQQRMFAEARARMNNGNANPPRQSDSD

SEQ ID NO: 1407 - protein, 162 aa, Pinus radiata
MEIVGKAKEDVSLPKATMTKIIKEMLPAHVRVTRDAQDLLVECCVEFINLISSESNDICYKEEKRTIAPEHVLESLKILGFGSYIREVKAAYEQHRIENWDCPRAGTRWSKNRLEMTEEEALLEQQRMFAEARARMNSGSNTFPGQYQSQSQSQSQSQSQSE

SEQ ID NO: 1408 - protein, 190 aa, Pinus radiata
MAYNRKHAAAATSPDSSLGSDNESGGGGGGGGGEGQSTKNGNGNYIREQDRLLPIANVGRIMKRALPGNAKISKDAKETVQECVSEFISFITGEASDKCQREKRKTVNGDDLLWGMTTLGFEDYVEPLKIYLNKYRELEGEKSSMAAPPRQSDLQQHHHVNGSDPHPYGHSPHGPMAYHVPGGGAFGHGR

SEQ ID NO: 1409 - protein, 191 aa, Pinus radiata
MGDHSGGESSPHSDIESTGIHNNGSSSSSQSIIREQDRLLPIANVGRIMKKTLPTNAKISKEAKEIMQECVSEFISFVTGEASDKCHKEKRKTINGDDILWAMTTLGFEVYAEPLKVYLDKYRELEGEKLSMSKQLQVDQPQPDLQYQACNPSAHNRPLVMTYKMPLPMPMHGKGPSGADPAATGHGRRPF

SEQ ID NO: 1410 - protein, 220 aa, Pinus radiata
MATTRHQRSPDSSPRSEDESGAHTYSNQDGSVKEQDRFLPIANVSRIMKKALPANAKISKDAKETVQECVSEFISFITGEASDKCQREKRKTINGDDLLWAMGTLGFENYVEPLKVYLQKYRELEGEKTSMAKQSGDQSPSKDASSGSTVNGSTAGNPSISPGSTVKYSGGYYPQPYGSQAAQMYGQHQMVAPYQMHINTGKAGGAGAANSGDHHPRGQW

SEQ ID NO: 1411 - protein, 268 aa, Pinus radiata
MDEQSAMQHMPMHYRATPYPNAQLQPNIAHGAFQQPSIHGHPHALSSHHNQLPYQQQIHQHQRQLHHHQQQQIEVFWANQMQEIEQAVDFRNHSLPLARIKKIMKSDDENVRMISAEAPVVFAKACEMFINELTLRAWIHTEENKRRTLQKNDIAAAIARTDIFDFLIDIVPRDELKEDQVINLGNPRSVLSVGSSSTNAAAAAAAANSFPYYYLPNQHSVPHGVFVGKPMDPTIYMQQPQSPVAYMPNIWQWGHVQADQSRSPNPAS

SEQ ID NO: 1412 - protein, 268 aa, Pinus radiata; identical to SEQ ID NO: 1411

SEQ ID NO: 1413 - protein, 154 aa, Pinus radiata
MADLASSVTSQESPHSEDTNNNSQNQGSNAREQDRFLPIANISRIMKKAVPANAKIAKDAKDTVQECVSEFISFITSEASDKCQREKRKTINGDDLLWAMGTLGFEDYVEPLKIYLHKYREAEGDSKGAATSRSGVGDPTKKDSSNFGALPNIR

SEQ ID NO: 1414 - protein, 164 aa, Pinus radiata
MAEAGSPGSQESPRSGEQSPQSSVREQDRFLPIANISRIMKKALPANGKIAKDAKETVQECVSEFISFITSEASDKCQREKRKTINGDDLLWAMSTLGFEDYIEPLKVYLLMYREAEGDNKGSSKSGVDQYGKKESNVHQGIPNMQQSQMQHHHMVTMQGNDLS

SEQ ID NO: 1415 - protein, 164 aa, Pinus radiata; identical to SEQ ID NO: 1414

SEQ ID NO: 1416 - protein, 164 aa, Pinus radiata
MASTSEVEDLPRANVRRVVKGKLSQLMKDNPSSSAKDIAIHKEALLACSESARIFIHYLSATANDICCESKRQTINADDVLKAIEEMEFPELLDPLKTSLEVFRKQNASKKSESKTKSTDRKRKSEGDLEMENGNGSHTEDANEAQDDFGEENKEDENDDLEED

SEQ ID NO: 1417 - protein, 220 aa, Pinus radiata; identical to SEQ ID NO: 1410

SEQ ID NO: 1418 - protein, 202 aa, Pinus radiata
MDQQQPTIPALPQVGYGTNPYIAPPIGGPPHPQLASYHQQLQAFWGNQMREVEQAQDFKTHSLPLARIKKIMKADEDVKMISAEAPVVFAKACEMFILELTLRSWIHTEENKRRTLQKNDIAAAIGRTDIFDFLVDIVPRDEFKDEGLVIPRAAGAVPFMGPGDNVPSYYYVAQQAPNVAAYAPPTQQMRSKAPAPPPHGSS

SEQ ID NO: 1419 - protein, 236 aa, Pinus radiata
MEGNYPHLQSSATPPVSHGPSSLMHNSLFQQQQPQMPLQHHQQQLQGLMQPHLHYMQIQKQQLQMFWQQQMQEMEQVAEFKQHQLPLARIKKIMKSDEDVKMISAEAPVLFSKACELFILELTLRSWLHTEENKRRTLQRNDIAGAISRGDVLDFLLDIVPRDEVKDEEYGGHWTGIPQAESISYGGIHFPLMHAQPYHHNFNPDVMAAQQTMSQQLMSQQPLMPDQPLMYQPPQQ

SEQ ID NO: 1420 - protein, 314 aa, Pinus radiata
MDHHNHHQHHPSSSSGGAAPQGMSQGYPGGVAAQPSPVGMQGQAGQIVQTGLHQSGGQQAFHHHHMQQQQQQQQQLHMFWAFQMQEIEQVSDFKNHQLPLARIKKIMKADEDVRMISAEAPVLFAKACEMFILELTMRSWIHAEENKRRTLQKNDIAAAITRTDIFDFLVDIVPRDDLKEEGLGLGFARGGVTPEGSFYYPPPSMPQSPHQQGMMGSSSIMMGRPVPLQMDPSAMYMHQQQQPRPYGMPTHPHQPMWQHPHHPHQQQQQQQMPDGQSYGHPHQQQQQHMPDGQPYGQQQMTDEHSYGTSPRSAN

SEQ ID NO: 1421 - protein, 1167 aa, Pinus radiata
MDSPDKTKMEMDSPDRNVNTPSSTVQGSPFFNYLCNLSPIKPVKSVHVAQTFSELNFPPPPAVFTSPRVPSQKESNFLKRPYQKDTRDEENKSDNPPCETVKDFAVPMSDCDVPASLNPLARKNTNFDSLASDQTKCEDNTMSTFASCSPSKLLEEYLADPVEEENYTVDSSKIHLKSASSALVNTLVVDSDKPQETSDQCSKMKDTEMIEQSNFPEEFLGTGKIASEAETSQGDEEGTFSLNSEGSMKASVIRKMGHVGQNDTEGLSSVWSDVDSHHSNTLLFANNCETSETGVSHDENLVDQTTGSFAFILSKGSTCEIEEWQKASSSADCSGAFLQQGLKDIVNHSDRACRESDLDSTPQLMYDSFLDTNSAADPNVKLDSEQKCVVEQQTSFGCKPGNQSQRGIRRRCLDFEASEAQRKTMSNSSWKSTSLMPKTDPLLHSTHDSETNTSSSVACEKGVTSDCKQIVPLKRETGAGIGRISQSTSNVRFSSFSSKITELTSDKSDSNVRNNGNTPISVNIPSGIGLHLNSLATTMSHNSGVNTLTSAKVSVSTQGMSPSSGGKEVSSDVVGSSLPSASSGGNISVGSNSNIASGMVVSMVEKTRIDQQELQSSGMTQIGVTRSTTCFRSVTVGIKPLQSRLPFKSEERNLSPLGKKRPPLLDISQQSSFGMGEEFSQSSPRKKRKSTTTGDKEGCKRCNCKKSKCLKLYCECFAAGVYCVEPCTCQECFNKPEYEDMVLGTRQQIESRNPLAFAPKIVRGADSPPANGDECSETPSSARHKRGCNCKKSMCLKKYCECYQAGVGCSDGCRCEGCKNVYGKKEGGSDDIEENETPIEGWDKDSLEEKTEVHDVGNDILLSEQQHAKDLSPLTPSFQYSGQGKSSAKLNSCGKKHFTSEDLESPTVSQPSAKPPRSPGKILRPTKGLQGNISAIHNRQAGSRTSASPIFTSKMDKSGQFSPQWDCLGDICTLTPMLHPPMRPSATSASSVDGIDVSPFSGQQNETPSMSSRPLASRHSCHVGSSLGFRQPAARSPICTSDNIHWRTPVNAKVTPVTPALSSTACTAGNKLSDASDFDMQSHDVSCSLEDDTPDILKNNCSPTRGLKASSPNQKRVSPPHNYCPKEMMNRRPISSPGIRSGRKYILQSVPSFPPLTPLPGEGQANE

SEQ ID NO: 1422 - protein, 305 aa, Pinus radiata
MKKKLDTRFPASRIKKIMQADEDIGKIAQAVPLLVSKSLELFLQDLCDRTYEITLQRGAKTVSASHLKQCVHRYNVFDFLREIVNKVPDMGGSDAATGEERNGGRRRKAQEGDENESDEDEVKRARMGAHHGSGRGRGRRGRGRGSRGGSSGRNGITVEKFEDEDLDLSSEHSEKQEKVSEIFTDVNTETRETKVAVNLVSTPVVRDFDLNMELDESGVVASMPTQPVVKLEHHPSDAANVPVIVKEADEFPSDVPIVQHPIKQEEQYPNWSHSDVDNVAIDSMQFHVHSDRIVDQDEDDYDEDG

SEQ ID NO: 1423 - protein, 455 aa, Pinus radiata
MTQVQFDLQTILILSMLFVGASHSQSSAMFPAGSIQSMSNGVGLVSAPFLISNVPNNKNCLQRDLINELHEAGIYDYAQSLGIIQNGVIVVQNELWPGAGAYSLPISNGTPTTYPQFNPCPSVPLVSVDTGSNGSSSRGSDGAMARLASDNIMARLNHLDAEGDEFESPGTVGRKRRRIHRSSIGVTGGRGLRHFSMKVCKKVESKGWTTYNEVASELVAEFVNPNSTHLSQDQQQFDEKNIRRRVYDALNVLMAMDIISKEKKEIRWKGLPTTNLSDIERLKTERKRLTNRIDKKRAYLQELKEQITGLQNLVQRNERVYESGNSPSGGVTLPFILVKTRPHATVDIEISEDMQLVHFDFNSTPFELHDDAFVLKAMRFCKTPDSNGPVDEKPDNEFMKNYSILSTMHRGTSSPHSTRTSDTDSYSLSSIPGKICSSSPDPGIIKTRIKNENFI

SEQ ID NO: 1424 - protein, 141 aa, Pinus radiata
MAVSQMQQRYINFTNSLFQEGFVDEQFTQLQQLQDESNPDFVAEVVFLFFEDSDKLLADLSKTLNQEPVDFKRVDGCVHQFKGSSSSIGARRVMNTCVTFRAFCQDKNREGECYLVKNKLETLFQLEKQIVEAGGTVPMAE

SEQ ID NO: 1425 - protein, 151 aa, Pinus radiata
MAVSQMQQRYINFTNSLFQEGFVDEQFTQLQQLQDESNPDFVAEVVFLFFEDSDKLLADLSKTLNQEPVDFKRVDGCVHQFKGSSSSIGARRVMNTCVTFRAFCQDKNREGCLYCLQQMKQECYLVKNKLETLFQLEKQIVEAGGTVPMAE

SEQ ID NO: 1426 - protein, 151 aa, Pinus radiata
MDVIQLQRRFIDYTSSLYREGFLDEQFTQLQQLQDESNPEFVAEVVSLFFEDAEKLLADLSKTLAQQPIDFKKVDAHVHQFKGSSSSIGAHRVKNECISFRAFCEQRNREGCLQCLEQLKQEYYNVKNKLETLFQLEHQILEAGGTIPMSE

SEQ ID NO: 1427 - protein, 206 aa, Pinus radiata
MVTSRMSSAMRMKKEKNAACGEHGDELVRCDEMHVLAVDDCLIERKVIEKLLKTNFFKVTSVDSAERALEVLGFHEEQSTCATTNAFKVNMIITDYCMPGMTGYDLLKKVKETKCLKEIPVVIISSENVPQRITSCLAEGAKDFIIKPLKLADITKLKGHIKPPKDVASVSARASGPVSSKRKISSGRGRGKMSERRPRVDGLTSV

SEQ ID NO: 1428 - protein, 436 aa, Pinus radiata
MYNARKYPAVSLMPPRSQGPEQHMASPVPMVSNNTNNSPVASGMASKQRLRWTPDLHQRFVDAVTELGGPDRATPKGVLRVMGVTGLTIYHVKSHLQKYRLSKYLPDSMGDGLKSEKKESTDILSNLEAASGVQISEALQMQMEVQKRLHEQIEVQRQLQLRIEAQGKYLQKIIEEQQRLSGALKDGTASASFSLPASKGQPEQASDLKPDPSNLILMPVAAQDGGGTGGASSSVAKHSLNCLSHDESPSFSSQQGPPSPESLGDDESSSGANSPLESPQSRQPPQKKPRLDIMSASSDQQVCRQSKKERAGCDAESLSGSSFQQRDSLPLILNLHHQLPDSHTVLHPLRPSQTAVSGAALSTSPPSQPQNQQLSQKKHAVSSEMSASAHMLQESSRDACYPFNSSSSITGQGLTLTEILIKEETKDCRKLIPKKI

SEQ ID NO: 1429 - protein, 276 aa, Pinus radiata
MKEEDWLAKWEEELPSPEELMPLTQNLITPDLAAAFKIHTSSASASAPTESGSVFPGSGQQQQRPGGEPPKRIELEEEESSVGGVTENVGEEPARTLKRPRLVWTPQLHKRFVDAVAHLGIKNAVPKTIMQLMNVEGLTRENVASHLQKYRLYLKRMQGLSSEGPSACDQLFASTPVPPSHFLHRDDMVVPLVPMGIGVPGLSHGHMVAGPPHYGGFDPRFLTTLSRQQQQQQPPPPQRLAPSAATPRGEYVMVEDLSSTATPPRQVLTLFPTGDN

SEQ ID NO: 1430 - protein, 405 aa, Pinus radiata
MYQMEYPSNPGIVLNHGRAPSQPERQHQQPVLTGSSHYPCDPSVVVSADPKPRLRWTPELHERFVDAVSQLGGPDKATPKSVLREMGVKGLTLYHLKSHLQVCSVPTLPILREFCSLLQFFSGGSSDGGHCLSRMARDSSIAPNHEAMQIADALRAQIEVQRRLHEQLEVQRRLQLRIEAQGKYLQTILEKAQQTLASEASTSAGLEATRAKLADLASKLPTNSVKPNYSPVKVAPLMDIHRQDHGDLEAKPHLRDRCSQNQFAGHTMEQRLNESESLIEKKRCRKLFHERNGGNSPTKLRELGLNASACKTEKEQEEEEEFIKPTTVERPAATRALVDERMAMLVQSNGLSLIQADHEPGLYHPHSMLGNCRKVAEGLDLNRKGEGSVPQQGRELDLNAYGWGR

SEQ ID NO: 1431 - protein, 407 aa, Pinus radiata
MYHPKSISTSHSHDQDISSGAPVGANDALNSLSTSAMASKQRLRWTPDLHERFVNAVTQLGGADRATPKGVLRMMGIQWLTIYQVKSHLQKFRLARYIPGSMDDGQNMGRKEAPGILSNLDARSGLQITDALKMQMEVQTRLHEQLEVQRQLQQRIEAQGKYFQKILEEHQRIGGVLKDSANSVECLSVMSGEQSAQDSDVKLDLSAHPTQATSQDGSGPGRACNKLDIILHNNASDDESKSFSSQQNPSSNSLSSALSLPLESTKPAEPALKKLRLEKPSSSEIHICNQSDQKHINRFSSDQTAEVKCDPDIGGQTSVSTGHECQQGHSGSSVEQRQLHVPIQDSHLSLNVQRSDSVTNLSSLPESQPQLDAELPKFLHLHETPSDHTSYGVMKRSDIHRNLHQDS

SEQ ID NO: 1432 - protein, 432 aa, Pinus radiata
MRRQKLPGLSYCEGNTMVSLNSFPASMASGESWNPACSSHLLPQNLSPNCFMPSDYSVFPSSSSNKELSNSTFVQPNATSHMIMPGSTTLCTNLQSSKPITSQQQQPPFDSLPLIYPPSKSPVQSQQSGVCEAAFLRDSTKSTSQDVGMGDLFPDFLIFPPNALECSQPLENIDATRIAPQYDPNQSEWHTWADRLDSSDDALCPGFWKEPANVDNNPKTGLNTINQTSTVSTTNVGSHQTQLQPQLCQQIFAPTVGTHLAPSPTACATTTSSKTRLKWTPELHERFVEAVNQLGGAERATPKGVLKFMDSEGLTIYHVKSHLQKYRMAKYIPKHADGMEDKTRNSFDTSASFDLKTGMQITEALRLQMDVQKKLHEQLETQRTLQLQIEEYGKRLQKMLEEQQKTGRKIECDPKAADDQSKSDAVGGSTPE

SEQ ID NO: 1433 - protein, 433 aa, Pinus radiata
MFQNKKFSTAGLVPQRFHGSEQRGAGPLGVTSGSSGSPVTSGGSGSAKQRLRWTPDLHDRFVEAINQLGGADRATPKGVLKVMGVQGLTIYHVKSHLQKYRLAKYIPESLEGGKSDKKKGNEIISNLEATSGTQIAEALQMQMEVQKRLHEQLEVQRQLQLRIEAQGRYLQKIIEEQQKMGTAKHETLSSPETSPPRYGEPGDITDKAFPDSQSPGKSGRQRQDGNAAMPSVDIAQTDQSADVAYGRDGPQLQASSYAYRVGDGMTSSDSPKFGSPSKRSRLNNDTGQPKQENLSSHPRDQQQTLPMSYSSQASHLKVGEVPGSIYQNRVVGLVGKIETRPSQSTADLQAEQSPGKLSRNNLDCISHAQEFHRPLCAKTASDSIRFVSPGSQIQVPASSLPASSHDEFSSALDGHDGCHNVSSSQVSLFGPWA

SEQ ID NO: 1434 - protein, 445 aa, Pinus radiata
MNSFVPNFNSQPENRNPTSKLIPQTEKMYQVKKPTMECHSERPVMLQEINVPTETGLVLSTDPKPRLRWTAELHERFVDAVTKLGGPDKATPKAVRTRMGVEGLTLYHLKSHLQKYRLGKQPHKEVNVDTSRDGSSHGGPVAGYGSTACRVPEVQVACNSVSSIIPANMTETLQITEALRMQMEVQRRLHEQLEVQRHLQLRIEAQGKYLQSILEKARETLAGYNVGSIGLEATRAELSELASKVKSECFNSTFSALTFSTMPEIPGLFPESQIAHQQSQAADCSAYSCLTSNESSEKSPTENLQAGGRKRPRSAYDNKVQFWQDEIREDIRLQELTGEENLSSPSSRTKDSSIVFHERANSDIVQAEENGNRLSDKKGKEYEMNGVLVDPPITRTLAFSSALSLQENSQMYESSKVYTNQDKTRSKGYNKFSKMTQGFGLEFQR

SEQ ID NO: 1435 - protein, 456 aa, Pinus radiata
MEKMYQVKNTVSSNGSLPSHSERPLLLQGSNGPGEMGLVLSTDPKPRLKWTAELHERFVDAVSQLGGPDKATPKSVMRVMGVKGLTLYHLKSHLQKYRLGKHLHMVVNLDNNKHGCSAAASKTSEMQGASSAASSMIGTNKTDALQINEAVRMQFEVQRRLHEQIEVQQHLQLRIEAQGKYLQSVLEKARETLAGHNLGSVGLEAARAEISELASKVSSECLNNAFSSLPEMPSLYKQQQHMVQAMHSLNQQSQVPDYSMESCLTSNESSEKNLDRNMQNAAKKRLRTLQNRNVPFWQTETREDASLRELSATQLGWEENLKEDEKFLSSSGNPKDSDRNSIPTKGNLRERTTSFRVQTEENGYGMPDAREKQMEVNGSCVGQQAIKPDVPRSFSLQEVCRKSELAGLHRDEDESPSVSFNKLSKLTEELDLNANDDASIASNCREFDLNGFGWSI

SEQ ID NO: 1436 - protein, 541 aa, Pinus radiata
MTMGSPSELTLGCRLSATSYSSVLKAINLASDQFERTRRLDEYLKGLEDERRKIEAFKRELPYCMHLLNDAIAASKEQLADCQPSVQAPKPTQQTGLQFEEEQYNRPVLEEFIPIKKRCDESGDESQENNQNDSKRTKFANGEKPNWMVSAQLWSQNSESVECKKEKTSSPEEPLKQHDSQLRSDQEQLFPTNSNLFSDSKQRTGGAFLPFSRERQSNPSVSARSNTVKAPPDLALSSVEQEVGSTFRCSETAPMNNVTITALNRSKEPTETTVPTPQKEAAAKPNGAVSVVPTPAASNATQSGGQSQRKARRCWSPELHRRFVNALQQLGGSQATPKQIRELMKVDGLTNDEVKSHLQKYRLHTRRPSPSPPTPASQAPQLVVLGGIWVPPEYAVATHQGPGLYSTVSNTTSSHSQSHYCQSPMPQEHYSQMNMSSQLQLPQPGYCEQQQTPSQSLSSPQGPLQLTGQSSGARGTSVDGGREESVGEDGKSESSSWKGEENAKNVEARNMGRGLSLRKQPLQSVDGDEEDSRGSETTLKF

SEQ ID NO: 1437 - protein, 790 aa, Pinus radiata
MVMMAAHDSVTSTMGNSYGGGKTDHQFPAGLRVLVVDDDPTCLKILDKMLKRCLYQVTTCCRATAALSMLRENKGAFDLVISDVYMPDMDGFKLLEQVGLEMDLPVIMMSADGGTSTVMKGIKHGACDYLIKPIRLEELKNIWQHVIRKKRNEPKDFDLSGSFEDNDRHRKGSDDVDYASSVNEGTDGNWKLLKKRKEAKEEEDDGEEDNDDPSASKKPRVVWSVELHQQFVNAVNQLGIDKAVPKRILELMHVQGLTRENVASHLQKYRLYLKRLSGVAQQQSGMNSSFGGTTEAGVGPMGLLGRLDLQRLAASGQISPQALVTLPAELLGQVNPNNGLGLPNIDRTLLLQAAFHGVNSNPLNRGKFGQPLMNSQGNLLQGLPRSIELKQFSQPQQHIPSFGNLGLPTNDASAGFSMLQQQHNTGAEVGSVDCGINNNGASNPQNNAMVMQLIQQQQQHQINQQQQQLQRSAAQQQPGGQLQGSQLQSGQVLNLPSASIVGPQVLPNEIRGRATLSSLANGNSSLGNNIIGAPGSGQLNRMPMPAYGLGATESNVPEGIGRMSTVDYKSQNVHILQGNDYSLSSTVCLSSPLTTSDIEGGMNISGIKRLGGISDIVGSPTLSCSGISFGTSNGIGQNLSQSGRQGWQMQNVSMNQDLSQTATAILSPCHGQASHRTQGLNVPVVQDPGQVRSFGFVGKGPNLSSRLVQNAGYPGMLSNAQSQGELLGIDSGLRLKDKSASDFGLTPKIECGTLSDHFPSEDLMNLLFKQQQDGMGISENEFNLDGVSIG

SEQ ID NO: 1438 - protein, 701 aa, Pinus radiata
MSLASPCQESMRGDDNSYRTNSWYRGNLSGVPEISRNMGMQYMPGGIGLNLQRGWGNSFRSCSTDLSPKQNGNFAIDHTSTTGERSAGTLKMIDQRSPISPLSPKGIGSDGLPQTSQSQRLYSSERIQMHDDLIHSSSHNHGSFNDQVYIHESFPCNNELSRESSICIQSSDGSPLSSQHSQSYSSDSRYFHSAEDAADLVGNAYSGNGQPANLKILEEIETALLGPDGDDPLDMDYAYGDHTLNSNSEWSLEALSDFNDFLDQTSNPGYSQINNADSSRVPDNLQQLTNHGDRNVKEETVNEVNLKIEHFSPSSSDMEKLEIEELGSPQGDVKSLLIECAKAIADGRNADNLIAGLRQVVNIYGDPLHRLAAYMVEGLVARLHFSGGHIYKTLKCKEPTSSELLSYMHILYEVCPYFKFGYVAANGAIAEAFKDKDRVHIIDFQIAQGSQWVTLIQAFAARQGGSPHVRITGVDDPQSEYARGQGLNLVGERLSKLAESYQVPFEFHGLSVFGSDVHAEMLKIRPGEALAVNFPLQLHHMPDESVNTSNHRDRLLRMVKNFSPNVVTLVEQEANTNTAPFFPRFMETLSYYTAMFESLDVTLPRDSKERVSVEQHCLARDIVNVIACEGDERVERHELFGKWRSRLTMAGFKSYPLSAHVNSTIKVVLNSYNENYRLIEKDEALYLGWLDRDLIVASAWK

SEQ ID NO: 1439 - protein, 779 aa, Pinus radiata
MAYMCTENGNLMAIAQQLVQQQQQQQQHIYPNPGGYFNGGNMSMSMGGVNMNMNMSPWLSAPTAWQHDGLMSFPPGICTDVVGDLCSTTTNSYLSEPNSVLDLSRASMLFSPMEQFQDFTQHLHDGIGAKQMPLLGGVEPPAPAFKDNALYHHEALVKKERPPIKEPGVGDGSSAALRSSVFRSPELHTFGFESPVSNRNDFVSPDVCTEWMDCLMSDLQPEAIAGNGNAAIASCFDSSNPCESTESSELPNGGSGYRRHSSEDAAAWQSEFGILGEAFKRSSPTSWTPDTTTEQLLCSSPSADLLSAASSELLSTNSLKGKAALQEQYGGAAGGGHEFQTLHHRMPNVHQSVCPPKQQLIREPSTPPQKRQQGQQEQDPLKGKREEDPPKPEIDALDRHMQGQRSDLLHSLLDCAKIVDTEPERAGQSVAYLQRIASHHGDPTQRIASHFADALAKRLSKGIEQKPQFQSSDECSKSFEDLTLAYKALNDACPYSKFAQLTGNQAILEAMDKAEKIHIVDFGIVQGVQWAALLHAFATRPGGKPHKIKITGIPAPTLGQNPTSSLLATGKRLTEFAKLLDLEFEFCPVSKHMSEVELSTLKIEQDECIAVNFMLQLYNLLGDSPEPLVKILKLAHALSPKVVTLGEYEAHLNACQFQVRFRNALEYFSAFFESMEPNMARDSAERLNVEKHFFAEKIMGIVAFEGAERKIRLEGRDQWRIVMESAGFKFTNLSHYARSQARILLYNYCEAYSLDESSGFLSLAWQNRPLLTVSAWCCC

SEQ ID NO: 1440 - protein, 153 aa, Pinus radiata
MKDAKAKRTAAKETKNKNVEAKKKLLSVKEKPNKKQAKPKAVKDPNQPKRPPTAFFVYLEEFRKTFKQKHPDVKGVTAVGKACGDKWKELSEAEKAPYIAKAAQKRAEYDVTMKAYKKKQEGVQSATPEESEKSKSELNEDDEDDESGEDDDE

SEQ ID NO: 1441 - protein, 155 aa, Pinus radiata
MKGTKAKVDQKQVAEKKAAKRKPATEAQAKRQMKKDKKAKKDPNKPKRPPSAFFVFLDEFRKEYKKSNPNANSVSAVGKAGGEKWRAMSDGDKAPYVAKAEKKKAEYEKSMSSYNKQKDASPEEVAEESDKSKSEVNDEEEDESGEEDDEHDDDE

SEQ ID NO: 1442 - protein, 157 aa, Pinus radiata
MKGAKAKNEASSTLKKIEDKPIGKRKAATKEVKPTSKKEKKGGKAAKDPNKPKRPASAFFVFMEEFRKTYKEKNPNVKSVSVVGKAGGDKWKSMSEADKAPFVAKAAKRKTEYEKNMAAYNNKQTSTAGDSAEESDKSKSEVNDEDDDESGEDDDQE

SEQ ID NO: 1443 - protein, 219 aa, Pinus radiata
MATNSSSKTNPPRQRKRVDVDPANLKRARDGSGFIKCDVCNKSVPVALSDMHDCKLEDKIWSNFDASKEAKHADAQKAPEAKKTKKKSEEKPKKRTKAKKTKDPNQPKKPATAFFVFMDDFRKTYKEANPDAKGAAQVGKEGGVKWKSMSDEEKKPYLEKAAELKAEYDKAMSKYQQDLKDEAAKSSGECEDEGTKSDGDGGDDDEGAKSSGDGETEEE

SEQ ID NO: 1444 - protein, 242 aa, Pinus radiata
MKPKKRSAGAVKGSWKKDPKDLKPVQKERVLRVKKNEDKQTCKGKGKIKGKGKGNDKSKGKGRQKQQHKEREKKTKTEKDPNLPKKPATAFFYYMEEFRKTYQKENPGVTGMREIGIACGIKWKELTYEEKAPYYDIATQKRAEYEKILAAYRKKKEAGEEVEAHEAPGKTNSVINDGKEGGEEAGKEVEAHQGPDKTNSEINDDKEGGKEAGEEVEVHQEADETNLKINDDKEGGEQEDME

SEQ ID NO: 1445 - protein, 428 aa, Pinus radiata
MSEQHHQHQTGHAKPIHPPPPVQRPLSQQRSAESQSAPGEPLPLPLPAPQSAGGCRFYPSRLFKHEEVVANRDLFFDTLNKFHLALGTKFMVPTIGGKELDLHLLYIEVTARGGLDKVIKDRKWKEITCAFNFAPTTTSASFGLRKYYMTLLRYYEHVYFFQKKGQLPAAPLSTVSPVPQSSDNGSAHPGSDEKQPEVKKRKKRSLPSPIVGVDPTSSVDQPVTGVIDGKFEYGYLVTVKLGSDILRGVLYHKTSENLGAQFAGVSCLQDRNVFDTAASGNSTCQKKKKERIKKRDPNHPKPNRSGYNFFFAEQHARLKALHPDKDREISKMIGELWNKLSEEERGVYQDFGLKDKERYKKEMQEYKERLNVQSDTNEVFKQQFSRIPDSDVDMMRLSTQSGRRDINISAEQKISDQENNYKEPIVKQ

SEQ ID NO: 1446 - protein, 649 aa, Pinus radiata
MADGQLFNNILLGGRGGTNPGQLRIHSGGIVWRKQGGGKVVEMGKPEISSLSWTRIPKGYQLGVKLKAGLNVKFNGFREQDVNNLSNFMTNTLGVTPEEKQLSISGRNWGEVNLEGNMLTFLVGSKPAFEVSLADVSQTQLQGKNDVVLEFHVDDTTGANEKDSLMELSFHIPNSNTTFAGDEASPPAQIFREKIMSMADVGSSGGEAVALFEDIAILTPRGRYTIELHLSFMRLQGQASDFKIQYSSVLRLFVLPKSPHTLVVITLDPPIRKGQTFYPHIVLQFAMEELAECALSMNEELLNTKYKDKLEPSYKGLSHEVFTQILRGLSAAKVTRPGKFRSSQDGYAVRASLKAEDGILYPLEKSFFFLPKPPTLILHEEIEYLEFERHGTGGASSISSHYFDLIIRLKSEQEHQFRNIQRNEYHNLFNFISSKGLKIMNLGDAHGTSGVAAVLENSDDEAVDPHLERIKSAREGGAGEDSDEEDEDFVAEKDDAGSPTDDSEEEQSDASESEETKEKPAKKEVKKKEAPVAKATGTKRKKKDEEEDGGKKRKQKKKKKDPNAPKRAMSGFMFFSQIERENVKKSNPGIPFTEVAKALGERWKKMSAEEKEPYESRAKADQKRYKDAMAGYKSGPTNIIDSGNESDSE

SEQ ID NO: 1447 - protein, 650 aa, Pinus radiata
MADGHQFNNILLVGRGGTNPGQLRIHSGGIVWRRQGGGKVVDVAKNEVKSLSWTRVPRGYQLGVKLKAGLNIKLAGFREQDVGNLTNFMTNTIGLAPEDKQLSVSGRNWGEVDLDGNMLSFLVGSKQAFEVSLADVSQAQLQGRNDVLLEFHVDDTTGANEKDSLIELSFHIPNTNTTFTGDESRPPAQILRDKIMQMADVGVGPSGESVVVFEDVAVLTPRGRYTVELHLSFLRLQGQANDFKIQYSSVVRLFLLPRSNQPHTFVVISLDPPIRKGQTFYPHIVLQFATEELAERELSISEELLNSKFKDRLEPSYKGLSHEVFIQILRGLSGAKVTRPGKFRSCQDGYAVRASLKAEDGVLYPLEKSFFFLPKPPTLILHEEIEYLEFERHGAAGTSSMSSHYFDLIIKLKSEQEHQFRNIQRNEYHNLFSFINTKGLKIINLGATETIGGVAAALQNSDDEAVDPHLERIKNLRDGGAGAEDSDEEDEDFVAENDDAGSPTDESEEEGSDASESAEVKQPAKKEVKKKKAVAPKATETKKKKKDDEEEGGKKKQRRKKKDPNAPKKAMTGFMFFSQVERENLKKSDPGMAFTDVGRTLGERWKKMSAEEKAPYESKARADKERYKEAMADYKSGPTNVDSGNESDSE

SEQ ID NO: 1448 - protein, 169 aa, Pinus radiata
MSSIPGGRETRRWSPTREQLRILEAIYNGGNQTPKPEQIQVIAAELRRHGTVAGINVFYWFKNRKARERRKSRSIQEAHAAANSSGFSSFQPNDHFSSEMTVGETNYLLNSNSEEDESKFSNCVEVYDFLLNSDSAAAEVGVEVESSLQTLQLFPPSCTESMAYNNHQQ

SEQ ID NO: 1449 - protein, 253 aa, Pinus radiata
MELGGQEEEIGMPISVSYGPIHESSKLKILTPGGNGAAASDEQQQQVQQAAAKKSVRYRECMKNHAASIGGHAIDGCGEFMPSGEEGTLEALKCAACNCHRNFHRREVEGEPPCYYCYNPRKDGRKRPSGGSPLPLALPSTSPSGVITRPSPQMIMAFGSGPTHENDQQEHDLGSLHGLHGAQMAMPIMKKRFRTKFTQEQKDKMCSFAEKLGWRIQKHDEAAVQQFCMELGVKRHVLKVWMHNNKHTLGKKI

SEQ ID NO: 1450 - protein, 269 aa, Pinus radiata
MDIPGGEEEVISMPISTSLTAVSDSSRLRLLAAASTPDGKPPEKGSEGRKTVRYRECQKNHAANLGGHVMDGCGEFMPSGEEGTPESLRCAACECHRNFHRREVEGEEAQTACDVCYHKGLVSGSNLIPLSFPPPAIGVLGRALPQIIAAAPVNNNNMRSSPAFAPSPESEEQADGNLPSGKKRFRTKFTHEQKERMLAFAQRVGWRLQKHEEAAVQSFCQEVGVKRHVLKVWMHNNKHAMATKPHADNNNHNNDNTAAANSSSNNSTP

SEQ ID NO: 1451 - protein, 281 aa, Pinus radiata
MEMGAGGNEAEIGMPMSVSYGHMAAIHEANSKPNHSNMGADNCSTASDQEIRPLSHEAAAAAAGASLAKPRSVKYRECLKNHAASIGGHANDGCGEFMPSGDEGTLEALKCAACGCHRNFHRRDTSGNGGADPSAAASCYYCCYGSNGNGSSKRPGGALHLPLPGPHVPLALPSSPSGIPRTHPQMIMAIRDVGGDDHDHMMGGAGAHAMYMAGHAMKKRFRTKFTQEQKDKMCAFAEKLGWRIQKHDDLAVQQFCMDVGVKRHVLKVWMHNNKHTLAKKP

SEQ ID NO: 1452 - protein, 282 aa, Pinus radiata
MFCGGDGEGLMLEQRALGHMMDLGNTQHMPVSMSAPYGVYPSGNGNGNAAIIMVLPHDESSSNPLNPQNPINPRNPMEAASAPLATKVLRYRECQRNHAANIGGHALDGCGEFMPAEDDTLKCAACGCHRNFHRREVEGDEQPPSNCECCLRKKRGGGSSSGPGSPAAPYYPLPLPHGSSAPHMLMALSSGLTESDDPDGNTHNNSNNNLSHHHHRGMKKRFRTKFSQDQKEKMHLFAEKMGWRMQKQDEAIVQQFCNEIGVGKGVLKVWMHNNKHTLGKKS

SEQ ID NO: 1453 - protein, 288 aa, Pinus radiata
MMDHHHHHAHHQIPVSISPVSVHDISRLQQHQIFHNPANIVHEAGTGNNNIHSNSNNVHVTQNGNGDDGKPLVEKSKKGESGEKIVRYRECQKNHAANIGSHALDGCGEFMASGLDGTAEALKCQACGCHRNFHRQEVEGEGGLDGWYSGPAGRSRVDKKRLLPGVGNVGVPLFSSPSPPPSATAVNASGPQMLMALSSACTLGDQEFHEGLVGRGVGSSSSAMKKRFRTKFSQEQKEKMHAFADQLGWRIQKHDEAAVHQFCNEVGVRRHVLKVWMHNNKNTVGKKL

SEQ ID NO: 1454 - protein, 304 aa, Pinus radiata
MGMDMEDCNTGLGLGMSIGLGMNLMREDLQSHRHHVNGPPVQLDLLPLAPVLPSRDLPWGKTSPGTDGERSAGESKATVPRRIDVNKLPASCYYNEDTGTINVSSPNSALSSFHVDSGGAINAESSCYGMSVKREREATEELEAERACSRVSDEEADQEGGTRKKLRLSKEQSALLEESFKENSSLNPKQKQALAKRLNLRPRQVEVWFQNRRARTKLKQTEVDCEFLKRCCESLTDENRRLQKELQELRALKLASPLYMQMPAATLTMCPSCERVVPAENSRPPPFTLAKPQFYSYTHSSAAC

SEQ ID NO: 1455 - protein, 305 aa, Pinus radiata
MNLNDHTYNLSPMANSGNPEEQIDEDAVDDFMNYQPESKKRRLTVEQVRSLERSFEIETKLEPEKKIQLAQELGLQPRQVAIWFQNRRARWKTKQLERDYSVLKASYDALKSDFERLQQENKNIRAELESLKEKLEEADCCKEDNHSDMATSTKVTSTIENSKKLAADVAGEENDIDIKPFSDITLLFKEKDMGLEKMDIKPFRVMLLNEKEGSFSPGSDCSANTRNEDKNPPHQILSHLAQASSSMKYPSGTNNIAGMDNINDQGLMHLAEALCGMGLPPKAYQQLFRVDEGYLHEDAYNPLFQ

SEQ ID NO: 1456 - protein, 307 aa, Pinus radiata
MACDRSALYPSNVIMNTEDNSSANAIAAMIANSCTPPATFQGNRSMSVFETGNERKRPAGNSYSALELSDDIGDEDGSDDCIHLGEKKRRLTLEQVRALEKNFEMANKLEPEKKMQLAKALGLQPRQIAVWFQNRRARWKTKQLEKDFNILKHDYDSLKQNYDNLMEENNNLQAMIERLRNKSQSCHDQKFQANSSKLQKDDQDLPILMMSATKVCANKENNNEGRSSIGSEGSSVLDMDSPSTIESQQNIDSIGFSNVKARDPRLECNFRPKVEESVIEADEPCNYLFYNNMESGPLLWEYNWSCL

SEQ ID NO: 1457 - protein, 307 aa, Pinus radiata; identical to SEQ ID NO: 1456

SEQ ID NO: 1458 - protein, 312 aa, Pinus radiata
METTGTFKFSIPSPLVGCPGNIHDDDEEEDEEECSGTGQQTRKKRRLSLQQVRSLEKTFEVENKLEPERKLQLAQELGLQPRQVAVWFQNRRARWKTKQLERDYGQLKLNYECLKSNFDAIKQENQKLTSELNYLKEKWEETQNLERDNTDLNKANEEKKVFGTGEDKAISDTKSLDKTMVCKQDHDGAEIKVTGVAMIFNEKLEGSESESSAIVNEQADNNNNNNSPHSIDSHISTLSLNCCYVPGPPVASSAIDEGLMEALCPKGLIRPKEEHHHQQNFRADANFVQEDPACNFFNVDDTTVTLPWWEWA

SEQ ID NO: 1459 - protein, 315 aa, Pinus radiata
MEETKQRGLERLKSLANDDTTGLALGVGLSMAMPATITQEDDQKSAPLQLELLPFRPIASRVGTSPAPSPPFRWFMPNNCREEVTVAETNLSGVARGGGGGIDMNRVPSTNEYEESAVFQADALRVVDNGPMAVKRERERAFDLEAERDRTCDVSSRTSDEEEIGSTRKKLRLSKEQSALLEESFREHSTLNPKQKNALAKQLNLRPRQVEVWFQNRRARTKLKQTEVDCEVLKRCCENLTEENRRLQKELQELRALKAAPQPCVIGQDNYYMPLPATTLTMCPSCERVATMENSRSLQFSKSQISQFTQQSAAC

SEQ ID NO: 1460 - protein, 327 aa, Pinus radiata
MMMSGGRMYGGPNVLVTANENISRSADALEALLSSPVFNGSRSVANLEEVIGNVSKRSFYNSFDQEETGDEDLDDCIHPPEKKRRLTADQVQFLERSFEIENKLEPERKIQLAKELGLQPRQVAVWFQNRRARWKTKQLERDYDILKSRYENLRVDYDSLLKEKDKLRAEVTFLTDKLHDSDHEALTKDSESADKKVYPQPASHSDCVGEPERSTAAKDTPPGCKHEDLLSSGTDSSGVLDEDSPHHVDCGHSSLDHVNSHLFEADQSDLSHAEEEEEEEGMSEKLLPQTYTYHHLLKVEDGAYPDASIAYNDMFVLEDQVQLPWWD

SEQ ID NO: 1461 - protein, 353 aa, Pinus radiata
MASNGIMFNASNRNLIVMVNEAPSFEANSSLDGVMKNVSKRPFYNTLDADEAGDEDLLDECVHQPGKKRRLSVEQVRFLEKSFELDNKLEPERKTQLARDLGLQPRQVAVWFQNRRARWKTKQLEREYDILKSSYDTLRVDYDNLLKEKDKLRSEVICLTDKLHAKEKGFEIQTNDLETTCKKAFIQSDSQFESLEKSGIVSEGMTVSFDQQLVSYSIEDHHSSGTDGSAVVDEESPHHIDSGHSSVVLLGYSVEDPLSSGTDGSDVLDEESPHHIDSGHSSVVGYITSTRLSHIETDQSDFSQVDEEGSMREKLQFPQDCHNLKMECGLFPEAPTTSCNYVFSMDDSWWDWS

SEQ ID NO: 1462 - protein, 366 aa, Pinus radiata
MPSVTQGSAMANPNFVALHNNQVMTEEQMETLRRQICVYSTICSQLVEMHRAMSQQQPSSVPTLLMGQHMLYDLAQGNPGFRTSARQRWTPSQTQLQILESLFDQGHATPSKQKIKEITMELSQHGQISETNVYNWFQNRKARAKRKQLPSQRGGESENETDDEYPGEKRFKPQHDSNAQNPKSGHSEADPQVHKSDDVVQNKPCTTDQKQFGIQENDTQSLLQREDEMRPHASLGSTMLGVSGSAEHESVECLPEVKPIYSSVEVGNRDHDATQAYIHGSGTTTGQVDGKSWQVPSVVVDVRRMFGENAVLVDSRGHMVPTNDMGVSFHPLQASEGYTVLSQYQCASGVPVHALRANTGDPYRGT

SEQ ID NO: 1463 - protein, 452 aa, Pinus radiata
MVEYGGDVGVGSMMALMTEHHPESESIMTSIPIPSSYSSYSHGHGHGHGHGHGHGQSECLLSAAAMFQTSRPCQGSNKFEPANAQHIGGGGGGRGAGHFVMEQFIPEQAVISDSSISSVKTEVCSGSGGQFELIRRKEEGRCGRAYAEPSFVVTPLVTSLPPQQQEGRMVTSLAVDMDSSCSCKPNEADAMRAKIIAHVHYPRLVAAYIDCQKVGAPPEVVSELDDLSHKCQTQHCVPTISVGADPELDQFMEAYCEMFIKYQEELTKPFKEAMAFLKKIENQLGTLTKGTIRTSSLDQGDERGDGAASSEEEDGSGGEVEFHEVDPHAEDRELKDQLLRKYSGYLSSLKQEFLKKKKKGKLPKEARQKLLDWWTRNYKWPYPSESQKIALAESTGLDQKQINNWFINQRKRHWKPSEEMQFVVMDSPNPHNAAFFLEGHLRTDGTAFSMDC

SEQ ID NO: 1464 - protein, 473 aa, Pinus radiata
MQGMEHMNTTAQSSSSLYGVHMVEYGGDVGVGSMMALMTEHHPESESIMTSIPIPSSYSSYSHGHGHGHGHGHGHGQSECLLSAAAMFQTSRPCQGSNKFEPANAQHIGGGGGGRGAGHFVMEQFIPEQAVISDSSISSVKTEVCSGSGGQFELIRRKEEGRCGRAYAEPSFVVTPLVTSLPPQQQEGRMVTSLAVDMDSSCSCKPNEADAMRAKIIAHVHYPRLVAAYIDCQKVGAPPEVVSELDDLSHKCQTQHCVPTISVGADPELDQFMEAYCEMFIKYQEELTKPFKEAMAFLKKIENQLGTLTKGTIRTSSLDQGDERGDGAASSEEEDGSGGEVEFHEVDPHAEDRELKDQLLRKYSGYLSSLKQEFLKKKKKGKLPKEARQKLLDWWTRNYKWPYPSESQKIALAESTGLDQKQINNWFINQRKRHWKPSEEMQFVVMDSPNPHNAAFFLEGHLRTDGTAFSMDC

SEQ ID NO: 1465 - protein, 479 aa, Pinus radiata
MEAKMANLNSVTNMPFACENGGCNKRFRPLVPKLTLSPNSAAPMANAVWSTQQSHDQYSQLQQAFSSATSGNSVSVSAAACLLEPKISRLDGKVDDNSNQRNQIDRLIKGDQQNMKEEQAESCAVQSQPAASGTRWNPTPDQIRILEMFYKGGMRTPNAEQIEHITAQLRQYGKIEGKNVFYWFQNHKARERQKQKRNSSMHQVAATAAKKTPTTIMADNPNELHKPNSNGTYSLYNLPFTAMSEDSRLMFTSTSLLTMPCSKGLAASLAQVGVDVLTPATKRDGLDVLKKSSHGPPQVQMNEEGSPSKNSMIWDSINSSGEGIITNLALSQAAADMPVNAVNSCKRKNRLWQVMSPNEELGLHTESSSESICLQTSNSDPINPSDYTNEEDHRQLQTLQLFPLRPEGSLKSKGETNMDNSVLSLHVNPSSTYPFREFNKSAESSTQMGAAIFEEHKYSKAAEFFPNLSADYSFLNSMT

SEQ ID NO: 1466 - protein, 534 aa, Pinus radiata
MAFHSLSHDMPLQRFSEQRLDGGGTRYSERRAPAGQLGIAEEGKEEIPIPRQRYGSLGYTEAQSSSSSAKAALAGAGECGGGDKVPMLVLPLMSESGSASENNVKLGTTNTWLSRAVSGQHRAQQQQQQHYAERSVEEGRKWCGCAAGSRDCIHSNFLKLQNPASAGSSSAAANALSGRWLMPGPLLNDKIEGREGVELLGGEIPGESIMALSAQFKTAGSAAPERGLLNLHSADAVNSNGEPVDSGGAGGDRDGGEEAEDHAALWQSARIKADIVSHPLYDQLLSAHLECLRIATPKDQHSMIDAQLEQSQHVVTKYSVLGNDNFLVGDKKELDQFMTQYVLLLCSFKEQLQYHVHVHVMEAVRACIDLQHSLLTLTGVSPGEGTGATMSDDEDDNADSDTDLYDGGLDGGQDIVGLGPLIPTESERSLMERVRQELKVDLKQGYRAKIADVREEILRKRRAGKLPGDTTSRLKAWWQSHSKWPYPTEDEKARLVQETGLQLKQINNWFINQRKRNWQSNPSSSTTLKSKRKR

SEQ ID NO: 1467 - protein, 555 aa, Pinus radiata
MESEEDKISPENKKRRLKTPQQVEGLESFYAEHKYPSEAMKSQLSEELGLTEKQVQGWFCHRRLKDKRLMKEEASNNGKQDPHNGIMQDSVNGVKQDSSGSGKKSDHQRHSRCKEVESQRFANAMDYPAAVLASELRDHDLFKVNHDNEDTFAGSSSASQDRSSLQSGNPYEAEARRRPFQNGKHYEFEGKRKNRSSYMDPYSEEDGEHEAITAVREQLGDEYREDGPPLGVEFHPLPPGAFDDSTEPPYQGNIVVQDIQRMPKKMMEPDTRKMFRPEGFHTPCSTGVGLGYMSVPMGLKFERASPKFERASPKCEWASYSKHESLNIKSAWRPANNHLQIGDNYHVPDLNSSMQLDEDSPDDSPSSEFVTKSYPAWHKQEPAGRLSSDAHLPLPYGSKNGMIPGKVLNAGKEFSIPRPYNGGDIYHDTSGVNPNVKAAMPPVQSRDLLSSQGEDKFQPKKMTKRERLREERKIKREQDSALRLKQKLIPKEEKMNTQIERKKQMEEIRKPREVAKCLAANEKVALSKNLMKGHTGEIPNNFSGGGLVAACSSME

SEQ ID NO: 1468 - protein, 739 aa, Pinus radiata
MPFAPTMAHARVTAPAVKSRNPSNFFSSTGLSLMLPGGGGGEGQNRSGHDEDQDYESSENMEGGSGDDIADLDHPRKKRYHRHTPQQIQEMEALFKEFPHPDEKQRQQLSKKLGLAPRQVKFWFQNRRTQLKATQERHENSLLRQEIDQLRSENVSLRESLRNPICSICGGRGLNGDLMSFDEQQLRHENARLKDELDRVCALVEKLSGRPNSSRAPASNSSLDLTVGLSGLHSPAMNSVNQRAMVLMGIERSKVTEVALAAMDELMKMSQTEEPLWVKNPEAGMETLDHEEYSREFPRLIGPKPIGHKTEATRHTDIVVMKSSTIVDTLINANRWMETFPCIISRATTVDVISNGVGGTRNGALQLMYAELQVLSPLLPTREIYFVRFSKQHADGLWGVVDVSVDSLLDNPDPSLTKCRKRPSGCLLRDMPNNRSKVTWVEHLEYDNVGVHRIFRSIISSGMAFGAQRWVATLQRQCQRIAFLMSTNGPTGDLAAVPTPSGRRSLMKLAERMTNKFCSGVSASSRHTWTKLSQGTGDDDVRVMSRKNVDDPGEPPGVVLSAATSLWLPVSPNRLFDFLRDQSFRNEWDILSNGSPIEEVTHISNGKDRGNRVSVLSAKNSSQSNTLILQESCADTYGSMVVYAPVEISAIHQVMNGNDSINVALLPSGFVILPEGPPESRSVIDNRQVEGSILTIAFQILVNDLPSAKLTLESVETVNNLISCTAQRIKAALHKVEDV

SEQ ID NO: 1469 - protein, 765 aa, Pinus radiata
MPEGLMVHARHLPSLIAKPSFTSSGLSLAPPRLVEERQNSQTAETDLEKMREEEFESKSGSENIEGASGEEQDVDPRSRKKRYHRHTQHQIQELEMFFRECPHPDDKQRQELSRRLCLEPRQIKFWFQNKRTQMKAHHERQDNIMLKSENEKLRLDNMRYRDALSSITCPNCGGPATLGEISFDEQQLRIENAKLREEVDRISGIAAKYVGKPLPSPVTRLNTLSSSTLDLGSGGGSSCLGDFHGTAGGDIVSRHVVLADSEKPMVVEVAVAAMEELVQMAQVCDPLWTTRFEDGCEILCQEEYTRMFPRGNLGSTSRSPYGVKTQEASRDTALVIMSSINLVETMMDVNQWSSMFSCIVSRASTLEIFSTGVAGNFNGALQVMYAEFQVPSPLVPTRENYFVRYCKQHSDGIWAVVDVSLDTLRGNPQPHPNCPPSTLRCRRRPSGCLIQEMPNGYSKVTWVEHVEVDERAVHRIYDKLVSSGMAFGAKRWLSTLERQCERLASMLACNIPARDLGVISNPEGRRSMLKLAERMTNSFCAGVSASNAHTWTTLSGSGAEDVRVMTRKSVDDPGRPPGIVLSAATSFWLPAPPMRVFQFLRDENLRNEWDILSNGGLVQEMAHIANGQDPGNCVSLLRVNNLNSNQGNMLILQESCTDVCGSYVIYAPVDIVAMNVVLNGGDPNYVALLPSGFAILPDGTQSSLSLGSNVINDKISSGSLLTVAFQILVDSVPTAKLSLGSVATVNSLISCTVDRIKTALNCENA

SEQ ID NO: 1470 - protein, 832 aa, Pinus radiata
MATYFPGSNIQADNMQTLYLMNPGYAGYTDATTSGNMVLLNHSVGNTLPANNMAGGQPSQHFIGIPLPTASLSQQRSSLGVMGNSPTAQQDINTNLLASRIGGHPYNVWRNGGNELTFMQTTDAAGSSQTLSGHLNNSGSMGHQPVAEISQLGLRRAPMSSIQEQQSGMLPSGLSLQLEHSHGSTGHGQGLSLSLSPQQPSTVQLPSFQNQPTDSDINCPGISATSEENISRTDRSTSKWAGSLSAFRASSRDGMLGSGFSNTGFSGNLLAPGANKQMHLDSSSTGAPGLSNVLIGSKYLKAAQQLLDEVVNVGKGIKPDSAKHQKSQSWIGTTANKENSGAEGGGKDGAAAAPTWRSTSAQETNDRPSELSPAERQELQMKKAKLVAMLDEVDQRYRQYYHQMQIVVSSFEAAAGYGAAKTYTSLALQTISRHFRCLRDAISGQIRLTSKSLGEEDSTVSGKGETSRLRFVDQQLRQQRALQQLGMIQQHAWRPQRGLPERSVSVLRAWLFEHFLHPYPKDADKHMLARQTGLTRNQVSNWFINARVRLWKPMVEEMYVEETKEAEVDHGSNDKTGKESGEKKEDALSKEGAAGNNGNIHEQQSGKISKLDNIAQDGGADEKPAGVPKSENASNLINVRNQSFGMGGTSDSQIFNETENEGIRQGQLKKARNGTQECTSLLSPNMSIEVDLKSDETNSGEFGDHKFSDERQNTEDYSFVHNAMVHPDNSGSFGSYQIGDLSRYGHESFTPRFSGSGGVSLTLGLQRTDGLSLQGAQQNYMSTQSLALGRRHDLGGNSSDYCNIETSAPHPANLYENINIQPRKCFATQLMH

SEQ ID NO: 1471 - protein, 840 aa, Pinus radiata
MTVTVVTAQSFGMEAGKYVRYTAEQVEALERLYNDCPKPSSLRRQQLIRECPILSHIEPKQIKVWFQNRRCREKQRKEASRLQTVNRKLTAMNKLLMEENDRLQKQVSQLVYENGYFRQQIQTVSITTTDTSCESVVTSGPHPHHLTPQHPPRDASPAGFLSIAEETLTQFLSKATETAVDWIQMPGMKPGPDSIGIVTISNSCTGVAARACGFAGLEPSKVADILKDRPAWLHDCRRLDVLTAFPTGKGGAVELLYTQMYAPTTLAPARDLLTLRYTSLLEDGSLVVCERSLTGTQSGPNMPPVQHFVRAQMLPSGYLIRPCEGGGCIIHIVDHMDLEPWSVPEVIRPLYESSAVLAQKMTITALRHLRQVAQEVSGEVVLGWGRQPAALRAFSQRLCRGFNDAVNGFADDGWSLLGSDGVEDVIIAINSSPSKFLSSQIASSDGLSALNGGIMCAKASMLLQNVPPALLVRFLREHRSEWADCNIDAYSSATMKANAYNVPGSLGGITGSQVILPLAHTVEHEEFLEVIKLEGHGLTHEEALLSKDIFLLQLCSGIDEHAAGFCSQLVFAPIDASFADDAPLLPSGFRVIPLESGSDVSPPNRTLDLASALEIGSAGTRASGDCGDSPCNLRSVLTIAFQFTYQNNVRDSVAAMTRQYVRNVIASVQRVAIALAPSQQSPHIGPRLPPGTPEALTLTRWIFQSYRMHLGLELIGDNSEPNESVLKLLWHHSDGIMCCSWKPLPVFTFANQAGLDMLETTLVALQDISLEKILDENGRKRLCSDFTQIMQQGYAYLPSGICISSMGRPVSYDRAIAWKVLNDEDVIHCIAFMFLNWSFV

SEQ ID NO: 1472 - protein, 842 aa, Pinus radiata
MAVMANNKDAKNSMDTSKYVRYTSEQVEALERVYSECPKPSSLRRQQLIRECPILSNIEPKQIKVWFQNRRCREKQRKEASRLQTVNRKLTAMNKLLMEENDRLQKQVSQLVYENGYMRQQLQNASVAATDTSCESVVTSGQHQHNPTPQHPPRDASPAGLLSIAEETLTEFLSKAKGAAVDWVQMPGMKPGPDSIGIVAISNTCNGVAARACGLVGLDPTKVAEILKDRPSWLRDCRCLDVLTAFPTGNGGTIELLYMQTYAATTLASARDFWTLRYTTVLEDGSLVVCERSLSGTQGGPSIPPVQHFVRAEMLPSGYLIQPCEGGGSIIRIVDHMDLEPWSVPEVLRPLYESSTVLAQKMTIAALRRLRQIAQEATGEVVFGWGRQPAVLRTFSQRLSRGFNEAVNGFTDDGWSLMGSDGVEDVTIAINSSPNKHFASQVNASNGLTTLGGGILCAKASMLLQNVPPALLVRFLREHRSEWADSNIDAYSAAALKSSPYSVPGSRAGGFSGSQVILPLAHTVEHEEFLEVIKLEGHGLTQEEAVLSRDMFLLQLCSGIDENAAGACAELVFAPIDESFADDAPLLPSGFRVIPLESRTDGSGGPNRTLDLASALEVGSTGTRTSGDSGTNSNLRSVLTIAFQFTYESHLRENVAAMARQYVRSVVASVQRVAMAIAPSRLNSHVGPRPPPGTPEALTLARWICQSYRLHIGVDLFRADCEASESVLKLLWHHSDAIMCCSVKSLPVFTFANQAGLDMLETTLVALQDISLDKILDENGRKSFFTDYGQIIQQGYAYLPAGICLSSMGRPASYDRAIAWKVLNDEDSTHCIVFMFMNWSFM

SEQ ID NO: 1473 - protein, 842 aa, Pinus radiata; identical to SEQ ID NO: 1472

SEQ ID NO: 1474 - protein, 844 aa, Pinus radiata
MAVTSGKEGKSSSMDQGKYVRYTAEQVEALERLYHDCPKPSSIRRQQLIRECPILSNIEPKQIKVWFQNRRCREKQRKEASRLQAVNRKLSAMNKLLMEENDRLQKQVSQLVYENGYFRQQLQNASIATTDTSCESVVTSVKHQQQNHLTPRDPPRDASPAGLLSIAEETLTEFLSKAKGNAVEWIQMPGMKPGPDAIGIVTISHGCTGVAARACSLVGIDPTKVAEILKDRTSWLRDCRSVDVLTAFSTGNGGTIELLYMQMYAPTTLASARDFWTLRYTSVLEDGSLVVCERSLSGTQGGPSMPAVQQFVRAEMQPSGYLIRPCEGGGSLIHIVDHMDLEPWSVPEVLRPLYESSTVLAQKVTMSALRHLRQIAQEVSSDVVLGWGRQPAALRTFSQRLCKGFNEAVNGFTDDGWSLMGNDGMEDVTILVNSSPSKLFGQQFASSDGLPALGGGILCAKASMLLQNVPPALLVRFLREHRSEWADSNIDAYSAASWKANPCTVPSSRIGGFGGGQVILPLAHTVEHEEFLEVIKLENHGLTQEEALLSRDMFLLQLCSGLDENAVGACAELVFAPIDASLADSSPLLPSGFRVIPLDSGMDGSSPNRTLDLASSLEIGSAGARTSVDYGGNSGNLRSVLTIAFQFTFENHLRENVASMARQYVRGVVASVQRVAMALAPSRLGSHLGPRLPPGTPEALTLARWVCQSYRFHLGVELLRPNSEVNESLLKTLWHHSDAIMCCSLKSLPVFTFANQAGLDMLETTLVALQDISLEKILDDNGRKSFCSDIAQIMQQGYAYLPAGVCVFSMGRPASYDRAIAWKVLNDEENPHCIAFMFMNWSFV

SEQ ID NO: 1475 - protein, 336 aa, Pinus radiata
MAHSAKQNNDGTPVTVESHRSVPAPFLIKTYQLVDDSNTDDIISWNEAGTTFIVWRPAEFARDLLPNYFKHNNFSSFVRQLNTYGFRKIVPDRWEFSNEFFRKGEKQLLSEIHRRKGLIQPPPPPENRSISPSNSGDEQTWSSTSSPNSSTGVDALSHKNAIEENEKLRKENLLLVSELTQMKKLHSQLLLFLSRHVNITSADHVANFLSQNVGPSEGLSMLARLKDYLEQYGGEEISRDFPGSSLSSGISVANDDPFVSSSAKESMASKRPPFVDGACREVGRKSYISVKIEDDDEKGNPKLFGVPLLPSKRPLPGSNDNGQPEPVIRKIGRCAN

SEQ ID NO: 1476 - protein, 354 aa, Pinus radiata
MYEDKMAQSGEQPNEATVPRPADSHRSIPTPFLMKTYRLVDDPSLNDIISWNEDGTTFIVWRPAEFARDLLPNYFKHNNFSSFVRQLNTYGFRKIVPDRWEFANEFFRRGEKKLLCEIHRRKNSQANGATANRPASPSITGEDQQGCSSTLLPLSSQAEAGVLLDENERLKQQNLFLMSEVAQIKGLCSDILAFMSKHANISAESLRKSFDLHNVPDRFQQGEPMDGSPAQSKDSCQRTQLCSSVHHSENETANGCGNSREMDDSKCVDSVKAEDKDNSGNPKLFGVPLLSKKRSRPCSPDNDEKPEGNGNPFCVGNDAALKCVKAEPGLEMDLRQKQAPWLKFLSVRNEKVCN

SEQ ID NO: 1477 - protein, 423 aa, Pinus radiata
MTLLLDSCEGMLLSVESHKSVPAPFLTKTYQLVDDPATDHIVSWGEDDTTFVVWRPPEFARDLLPNYFKHNNFSSFVRQLNTYGFRKIVPDRWEFANEFFRKGEKHLLCEIHRRKTSSQAVPNSAHGMPMSSSISPTTSDDQDWSPLSTPLSSPRGVAAAAAVAAASVGGGGMGGSLMVGCSGGGAGGGATAAMHASAAAAAAAVSALSDDNDRLRRNNSMLLSELTHMRKLYNDIIFFVQHHVRIPPPPPHQSGSSSSSSAMNMNRLKYHHQPTANPNAVPLLLEAPTVPSTPRIADARDHRIMNPATREVVEISSSSPRSQQLFGLATARASSISFVDTKLKEMAAAATSSPSTSSVTVADQEGIKSPPKLFGVPLHGKKRLHPQWDVVDQADTPNSRNIIVTPPKVLKTDLALNLAPSSA

SEQ ID NO: 1478 - protein, 476 aa, Pinus radiata
MDGSQNSGGNAVPPFLTKTYDMVDDSSTDSIVSWSPGNNSFIVWNPPEFARDLLPKYFKHNNFSSFVRQLNTYGFRKVDPDQWEFANEDFLRGQRNLLKNIHRRKPMHSHSQNPQQGVCNDAIKYELEEEIQRLKRDKGLLMMELVRIRQQHQGTEMHMQTLEERLQAMEHRQQQMMAFLAKAVQKPGFVAQLVQQSENNKLLEAANKKRRLPKQENCSEAGETELTDSQIVKYQPASGDECSAVPLKVLNTDPFNRMESSLNTLETFFQDVGQACGEVMDSGNSSQAGLTEMHGTCFSSICISPAISDIQGSCSLSEMHSSSHPSPQLAESITSEIPCQMSLGLSLSQCETSKGGETPNQSGKDEREAYMGSKTSGIDVNSEPVAMEMGDNERAAGKVTASGKVTSGVNDLFWEQFLTETPGSATDTQEAESKIQETRTKDQDERLPENGKCWSNKQTLDQLTEQMGQLASGTQT

SEQ ID NO: 1479 - protein, 482 aa, Pinus radiata
MATSAEGSSSSPLGFVEESSQQLPSVAPQPMEGLQSSAIPPFLTKTYDMVEDPSTDPVVSWSSAGNSFIVWDPPEFSQNLLPRCFKHNNFSSFVRQLNTYGFRKVDPDRWEFANEGFLRGQKHLLKNIHRRKPVQIQQLSPPLGSCVEVGKFGLEGEVERLKRDKNVLMLELVRLRQQQHNTECEMQTMNQRLQATEQRHQQMMSFLAKAMQNPSFLAQLVQQKEKRQLAAARKRKRLPKQQQDPQGDMGPSNEGQIIKYRPNPNDDTQPSLIETFELGSGAKLEPPSSPFRAFFSGNPGENLQESNTLAGELMAVKGVEQMIQEGVPNPVALEIPNMSHLQPPSVVALAKGKHVESSQPEDDLQGEEYLVSFGQTACSEEESTDLMGLELDLPGDVDFCINKEEPKSVLGCEMSNDPFWDQLFGDNPQSIQSGPEGAGEFPGTGIQGPEEKPGAGEWWDSQSNMSEIAIQMGQLAKDPPNA

SEQ ID NO: 1480 - protein, 506 aa, Pinus radiata
MEGSQNGSSNAPPPFLTKTYDMVDDPATNAMVSWSPGSNSFIVWNPTEFSRVLLPTYFKHSNFSSFVRQLNTYGFHKIDPERWEFANEGFLRGHRHLLKNIHRRKPVHSHSQQKGESLSGGSCVEIKQLEDETEKLRQEKQGLVLELVRLKQHQQGTEFDLQSLEERLQLMEQRQQRMMAFLAKAVQNPNFVAQLVQHHDKIAHIATTNKKRRLPKHDEVLEISENGCTSSQIVRYDPGKSDAFSRDSPDKLETSADAFKNFFDAVPVDAHEKAKDCGSPQSHSSGPTITEMHGKPCFPDMPVSLGVSDIYTSSALSDLNSSSGLPEMSVSLRSQDIQASAGLVGSLRSDILCNLSLSPHSSSLELSKIDDATKAIQSGSPENRSLIGSKTGSNDGNSEAIDMEVRLRYGAAKTTVQEGSVNGKARGTGKSMGAETTRKRINDVFWEQFLTESPQPIDTEGTDSESQESSKDQDDVVPEYSNFCNRKENLDQLTLQMGQLASSVNL

SEQ ID NO: 1481 - protein, 404 aa, Pinus radiata
MDAEHFPVGFFRWDQRPAPVVAAAAAPTTTVFNKDHGRPLEVILPMNGRKDLKSLEDLFKEYGVRYVTLAKMTEMGFTVNTLVNMTEEEIEDLMKTLVELYHMDLLIGERYGIKSAIRAEKKRLQDSLEMQRLEILSEAERKRILHDDQNTFAAAMASEGTSKELRANDPLIFPESTSADHAPMNIASCKDSTLILQNSNQAQFCGSGLIGVPEHSSESDERKADTNKQKRRRSKEPGEDGEDRPREHPFIVTEPGELARGKKNGLDYLFDLYEQCGKFLLEVQRIAKEKGEKCPTKVTNQVFRHAKHNGAVYINKPKMRHYVHCYALHCLDSEQSNHLRRLYKERGENVGAWRQACYYPLVAIARENNWDIEGIFNRNEKLKIWYVPTKLRQLCHMERSKECQ

SEQ ID NO: 1482 - protein, 411 aa, Pinus radiata
MDPESFSAAFFKWDQRPPALAPPQMQRSAGLEAQRIFHDFGVPNAAAMAASNNSSSCRKELNCLEELFRNYGVRYITLTKMVDMGFTVNTLVNMTEQELDDLVRTLVEIYRVELLVGEKYGIKSAIRAEKRRLEEAERKRMEQLFVDVDGKRKIDENALDTLSQEGLSVEEPQGDNAIILSQNNTSANFPLNLNAGMDPVLILQNSGHLGTTVSGLIGMPDTNYGSEQTKACKKQKRRRSKDSGEDGEERQREHPFIVTEPGELARGKKNGLDYLFDLYEQCGKFLLDVQHIAKERGEKCPTKVTNQVFRHAKHSGAGYINKPKMRHYVHCYALHCLDIEQSNRLRRAYKERGENVGAWRQACYYPLVAMAKDNGWDIEGVFNKHEKLRIWYVPTKLRQLCHLEKSKQSHL

SEQ ID NO: 1483 - protein, 193 aa, Pinus radiata
MAFAGTTQKCKACEKTVYLVDQLTADNSVFHKSCFRCHHCNGTLKLSNYSSFEGVLYCKPHFDQLFKRTGSLDKSFEAIPRASRNDKMHENENRTPSRVSALFSGTQDKCVACGKTVYPIEKVAVDGTSYHRPCFKCCHGGCVISPSNYVAHEGRLYCRHHSSQLFREKGNFSQLSKATPTKGVTENSDTDDK

SEQ ID NO: 1484 - protein, 193 aa, Pinus radiata; identical to SEQ ID NO: 1483

SEQ ID NO: 1485 - skipped

SEQ ID NO: 1486 - protein, 197 aa, Pinus radiata
MAFTGTQQKCKACDKTVYFVDQLSADGVSYHKACFRCNHCKGTLKLSNYSSMEGVLYCKPHFDQLFRESGNFNKNFQSQRSSKAIDGLSPEMTRSPSKVSMMFSGTQDKCATCGKTAYPLEKVTVENLSYHKSCFRCSHGGCSISPSNYAALEGILYCKHHFSQLFKEKGSYNHLIKTASMKRAAAVPEVASAVPEI

SEQ ID NO: 1487 - protein, 167 aa, Pinus radiata
MGKTKMEIKRIQNPSRRQVTFSKRKNGLLKKAFELSVLCDAEVALIIFSETGKICEFASHDERTLLARSRLAGDQIRGLELPSSRSWKTSEGCSFHQIGESQLKALREKMNKLKKKERNMVGEDLDSLTIKELQRLENQLQIGIKRISDKKMKILVQSSKLLLQKVI

SEQ ID NO: 1488 - protein, 168 aa, Pinus radiata
MVRGKIQMKRIENTASRQVTFSKRRNGLLKKAYELSVLCDAEVGLMIFSPGGKLYEFANTSMEKILEKYRKYSQHTSRNGLTTEQDNECVKQELANTKAQMRVLDSAQKKMLGEDMETCSMQELDELEIQFEQGLNCIRARKTELLMAEVEELERKVTLSAQRYASTA

SEQ ID NO: 1489 - protein, 183 aa, Pinus radiata
MVRGKIQMKRIENTASRQVTFSKRRNGLLKKAYELSVLCDAEVGLMIFSPGGKLHEFANTSMEKILEKYRKYSQHTSRNGLTTEQDNECVKQGLANTKAQMRVLDSAQRKMLGEDMETCSMQALDELEVQFEQGLNCIRARKTELLMAEVEELERKVTLSAQRYASTAYKVLCIVTLTHGLHC

SEQ ID NO: 1490 - protein, 192 aa, Pinus radiata
MARGKTQMKKIENVTSRQVTFSKRRNGLLKKAFELSVLCDAEVGLIVFSPSGKLYEFSRPCMGKLLEKYEKNSRESGINNAAKEKDTQHSKREIANMEEKIRILESTERKMLGQNLASCSDEELSQLQSQVERGLNRIRRRKNELLMDRIEQLKRKCADLEGGSVLTSSVLQPGSTQCIDFETQLVMGPPNV

SEQ ID NO: 1491 - protein, 193 aa, Pinus radiata
MAGEKRKINRIANASARQVTFAKRRRGLFKKAQELSILCEADVALLVFSSTGKLYQYSSSSMKMILDQYILYSRSIQKDGKPNLEESHDIQKIKQQIKDISQNLRKLRGKELEGSSVKDLEELEEQLEMGLSSVRSRKDEYLIMEINELQQKGTRILKENTDLRRQLKERYGLHMENNETSGNKDPQSSESKI

SEQ ID NO: 1492 - protein, 208 aa, Pinus radiata
MGRGKIEIKKIDDVTSRQVTFSKRKMGIFKKAHELSVLCDAEVAVLIFSNTGRLYDYASSRCMERTIERYEKCTKAINCPTSDPIVENKSPIQEGIEILRQKLRALQRLQRNMMGEELALLKVGELHDLEHNIECAILKVRARQNQIQLEKIANLRFKEQLLMGENEQLQKMLLEEAQRSLGLRPTSLIQTDIITSPTTIMNPYEGFF

SEQ ID NO: 1493 - protein, 209 aa, Pinus radiata
MARGKTQMRKIESATSRQVTFSKRRNGLLKKAYEMSVLCDAQLGLIVFSPRGKVYEFSSTCMQKMLARYENFSEGSKATSTAKEQDVQGLKRQIANMEERIEILESMHRKMLGDELASCALKDLNELESQVERGLRNTEILVTEIEQLQRKEWILSEENAFLGKKFVHPHSVSKTPGSESGSIQNSEVETQLVMRPPCTNAHFLINSSH

SEQ ID NO: 1494 - protein, 213 aa, Pinus radiata
MGKTKMEIKRIQNPSRRQVTFSKRKNGLLKKAFELSVLCDAEVALIIFSETGKICEFASHDDMATILEKYRIYTETDGNMESSSVQSVKIGESQLKALREKMNKLKKKERNMVGEDLDSLTIKELQRLENQLQIGIKRISDKKMKILVQSSKLLLQKVRALEEEKIELETKLRIKGYSFSSATNLNLGLSYSTMPSGLCDMNSNGNSFSVEIP

SEQ ID NO: 1495 - protein, 214 aa, Pinus radiata
MGKTKMEMKHIQNPSRRQVTFSKRKNGLLKKAFELSVLCDAEVALIIFSETGKISEFASHNDMATILEKYRIYTQTETDGNMGASSVQSVKGWFPNFLEIAGITIESVAREDGQFEKQERNMVGEDLQSLSVKELNRLENQLRIAIKKISDRKTKIFAQNAKSLAQKVRAMEEEKIELQSKLRTRDDSFSSTNLNLGGLCDGNINGDCFSSEIH

SEQ ID NO: 1496 - protein, 215 aa, Pinus radiata
MGRGKIEIKMIENTANRQVTFSKRKGGLLKKAHELSVLCNAEIALIVFSNTGKLHDWSSSSMKKVMEKYQKSDQGLGLMDYQQQQLLCEMKRITKENESLRARLRHMNGDDINSLKLPELFHLEQQLETAATQVRRRKDQVLDNEKIKRRNKMRRKEEENIILHEMLDQHHGQMEEDNAQINFLFCQPLNRSDTTFPASLLRLQPNQPNLQDIGY

SEQ ID NO: 1497 - protein, 219 aa, Pinus radiata
MGRGKIEIKKIENSVHRQVTFCKRRGGLMKKAYELSVLCDADVALIVFSSRGKLYELGTSNNNNNSMRSILERYQKCSQTAKHMNFSNNTSDEKMKQEINLLKQQIDQLKLTNRYLMGEGLGSVSFEELTQLESRLQRGINQVRAKKHELMLDEIRALQSKEHTLRINNMMLQERLEECTNGKRLSSLLTHGFTTLLPNQHVPSGYDLSNQSLSSNVEM

SEQ ID NO: 1498 - protein, 219 aa, Pinus radiata
MGRGKIQIKKIENSVHRQVTFCKRRGGLMKKAYELSVLCDAEVALIVFSGGGKLYELGTSNSNRNSMRSILERYQKCSQTAKHMNFSNNTSDEKMKQEINLLKQQIDQLKLTNRYLMGEGLGSVSFEELTQLESRLQRGINQVRAKKHELMLDEIRALQSKEHTLRINNMMLQERLEECTNGKRLSSLLTHGFTTLLPNQHVPSGYDLSNQSLSSNVEM

SEQ ID NO: 1499 - protein, 219 aa, Pinus radiata
MGRGKIQIKKIENTTSRQVTFCKRKNGLLKKAYELSLLCDAEVALLIFSTSGRLYEFANKSVSATTERYMRTYAENMPQSRALYPDCHHWQEEVRKLTQQRDSLTNSIRQIMGEGLESLSMKELKHIQVQLEKSISCVRSKKNEMLLSEMENLQRRDCLLSAENQFLRSKIKELEDCSGKPDQLEATFAQNFIQQNTATETQQHSQTAPVVIQTALQLG

SEQ ID NO: 1500 - protein, 219 aa, Pinus radiata
MVRGKTQMRRIENATSRQVTFSKRRNGLLKKAYELSVLCDAEVALIVFSPRGKVHEFASPSMQMVLDKYQKYSQESGISNRTKEKNTRHLKGEIAQMEERVNILESAQRKMLGEDLASCSMKELNQLESQAERGLNRIRARKTEILMDHREQLKSKERMLTEQNVFLRKMCAGSQDDSDLTTPAIHLERIRMEHSEVETQLVMRPPHVQKNHLSTYSVH

SEQ ID NO: 1501 - protein, 220 aa, Pinus radiata
MGRGKIEIKKIENSVHRQVTFCKRRGGLMKKAHELSVLCDAEVALIVFSSRGKLYELGISNRNRNRSMRSILERYQKCSQTAKHMNFSNNTSDEKMKQEINLLKQQIDQLKLTNRYLMGEGLGSVSFEELTQLESRLQRGINQVRAKKHELMLDEIRALQSKEHTLRINNMMLQERLEECTNGKRLSSLLTHGFTTLLPNQHVPSGYDLSNQSLSSNVEM

SEQ ID NO: 1502 - protein, 220 aa, Pinus radiata
MGRGKIETKKIENSVRRQVTFWKRRGGLMKKAFELSVLCDAEVALIVFSGRGKLYELETSHSNRNKSMRSILERYQKCSQTAKHMNFSNNTSDEKMKQEINLLKQQIDQLKLTNRYLMGEGLGSVSFEELTQLESRLQRGINQVRAKKHELMLDEIRALQSKEHTLRINNMMLQERLEECTNGKRLSSLLTHGFTTLLPNQHVPSGYDLSNQSLSSNVEM

SEQ ID NO: 1503 - protein, 221 aa, Pinus radiata
MVRGKTQMKRIENDTSRQVTFSKRRNGLLKKAYELSVLCDAEVGLIIFSPRGKLYEFASPSMEEILEKYKKRSKENGMAQTTKEQDTQYSKHSKQKLANMEEQIRILESTQRKMLGEGLESCSMAELNKLESQAERGLSHIRARKTEILVDQIECLKRKERLLSEENALLSRKWVDRQSVDGSGSTSSSIGLGSIEQIEVETQLVIRPPNAQDHCSVNSGH

SEQ ID NO: 1504 - protein, 223 aa, Pinus radiata
MGRGKIEIKMIENATNRQVTFSKRRGGLKKKAQELSVLCNAEVALIIFSSTGKLHEWSSSSSFFMLQKSMKKILERYQKSEQGLGLMDYQHQQLLCEMRRITKENESLQERLRHMNGEEVNSLKLPELFKLEEQLDKAATQVRRRKDHVLENERIKQRNKMRRMEEENIILHGMLEQNQGHMEEDNGQFNFVLYQPVKKMRTAFPAPLLRLQPNQPNLQDIGY

SEQ ID NO: 1505 - protein, 222 aa, Pinus radiata; identical to SEQ ID NO: 1106

SEQ ID NO: 1506 - protein, 223 aa, Pinus radiata
MVRGKTQMKRIENATSRQVTLSKRRNGLLKKAYELSVLCDAEVGLIVFSPSGKLYEFASTSMQKLLEKYEICSQECGTSESNKKQDPQCLKQEIENMEKRVRILQSTQRKMLGEGLALCSIKELNQLEGQVERGLNHVRATKTKVLLDEIEKLKQKEHVFREEKALLHKKSVNLRGANGCTIPSIGLTSIERVEVQTQLVMRPPHATEMDDNFMDVDNVPLSG

SEQ ID NO: 1507 - protein, 224 aa, Pinus radiata
MGKKRVELKRIQNPSSRHATFSKRKNGLLKKAFELSVLCDAEVALIIFSETGKIYEFASNNDMAAILGKYRVHEEGTETSSPTSLQNVKYHESGLEKLQEKLTALQKKEKNLIGEDLEVLTMKELQRLEKQLQIGIKRISDRKMRIFSQSSKLLTHKVRALEDENKKLQTKICTRGESSTSVQETVVVQQTNLHLGLNTLPSRPSEMTGDGDNSQIGETEISNA

SEQ ID NO: 1508 - protein, 224 aa, Pinus radiata
MGRVKREIKKIVNATRRQATFSKRRNGLFKKANELAVLCDADVGLIVYNTAGKLFEFSNSSMKMLINKYLKDRGGGESDFFCEMHGCDDEIEVERLKEDIKNLSRFCRGDELEGISLKMFEDLEESLEMAVKCVQSRQREIFTRQINILRNQENNALNERGELRNRMEEIHTRTGSTRYCELVDVERESAENINSESTNGTKNRQSNYANKELDDFETFLTLRL

SEQ ID NO: 1509 - protein, 226 aa, Pinus radiata
MAREKIEIKRIANAPARQVTFSKRRRGLFKKAQELSILCEADVALVVFSSTGKLYDYSSSSMKMILDKYSLYPTTNQKDGQPNLEPETQDIRRIKQQIEEITQTLRIISNELQQLEEQLEIGLTHVRSKKGENIVKEINALQQKGIRIIEENTKLRRELKEGYLRHVENNDAEESVLIEPLENQDPQSSESITTYAFNFKLHKSAMKDYEDSDTSLQLGLSSQSKF

SEQ ID NO: 1510 - protein, 231 aa, Pinus radiata
MDLMESFEAKGKGEKRRTVRGKTQLKRIENGTSRQVTFCKRRNGLLKKAYELSVLCDAEVALIVFSPRGKRYEFANPSMQKMLARYENFSEGSKATSTAKEQDVQGLKRQIANMEERIEILESMHRKMLGDELASCALKDLNELESQVERGLRNVRARKTEILVTEIEQLQRKEWILSEENAFLGKKFVDPHSVSKTPGSESGSIQNSEVETQLVMRPPCTNAHFLINSSH

SEQ ID NO: 1511 - protein, 231 aa, Pinus radiata
MGRGPVQLRRIENKINRQVTFSKRRNGLIKKASELSILCDAEVALIVFSNKGKLYEFSSSSMTKILERYRKRSNLIQDIGKDPQNSDIELTHLKEEVDRLQRSRRHLLGEDLHQLGATDLQHLEQQLEEALQKVTLTKTQFMLHLIEELRRKEQLLEGINKSLLRNFSELEGQYPRDHYSLPISSRSLHSTTENYPQGEPTLQIGCPSTLTGITTTAQRQSRNYDAEGWMV

SEQ ID NO: 1512 - protein, 235 aa, Pinus radiata
MAREKIEIKRIANAPARQVTFSKRRRGLFKKAQELSILCEADVALVVFSSTGKLYDYSSSSMKMILDKYSLYPTTNQKDGQPNLEPETQDIRRIKQQIEEITQTLRNMHGEELEELSLNELQQLEEQLEIGLTHVRSKKGENIVKEINALQQKGIRIIEENTKLRRELKEGYLRHVENNDAEESLLIEPLENQDPQSSESITTYAFNFKLHKSAMKDYEDSDTSLQLGLSSQSKF

SEQ ID NO: 1513 - protein, 242 aa, Pinus radiata; identical to SEQ ID NO: 1119

SEQ ID NO: 1514 - protein, 246 aa, Pinus radiata
MGRGKIEIKAIENPTNRQVTFSKRKAGLKKKAHELSVLCNAQVALIIFSATGKIFKYSSSSMREIIDRYQRTEKTKLWDSEDQHMFSMIERTKSENETLRSTLRYMRGEDLDLLNDTNKMANLEKILETATARVRRRKNELMAKQSDDLERTVDFLQHQNEQLLKVLECHSRMGNPVHGYSASPPLCYQVEQQQPQHQHQQHIPLHILMPDVPVKPSQPNLQDSGYPQPDLQLGYDQLIPLLSIFS

SEQ ID NO: 1515 - protein, 262 aa, Pinus radiata
MGRGRVQLRRIENKINRQVTFSKRRNGLLKKAYELSVLCDAEVALIIFSTRGKLYEFASSSMNKTLERYEKCSYAMQDTTGVSDREAQQNWHQEVTKLKGKVELLQRSQRHLLGEDLGPLNVKELQQLERQLEVALTHLRSRKTQVMLDQIEELRQRERLLHEVNKSLQKKLSETEGRDVITGIEQTSNTNTGTNGPWDSSITNTAYALSHPQQDSNSSLHHVDCEPTLQIGYQPVAPESIVPPHQPPHNQTPNQYMQGWWV

SEQ ID NO: 1516 - protein, 270 aa, Pinus radiata
MGRGKIELKKIESTSNRQVTFSKRRMGLLKKAQELSVLCDAEVGVIIFSNTGRLYDFSSSSMEKMIETYYRFIEKNGHSQQPHLPIHPNQDLGRLMQELQAIESTYKKSIGEELSSLSITDLKRLEHQLELGISRIRGRKNLLVEEQIANLQSRERELLEENNVLHRLVSEARSSTEMAASRFVNDNLAVNISSAPVTSTNPFQQRFGQTSQVCIGNSSSSRNIEQSSSGPHSIAQQCPLPDQHGYHTQSAGLILDEWDLMEEYGSVIIK

SEQ ID NO: 1517 - protein, 379 aa, Pinus radiata
MGRAKIPIKWIPRHTSRNMTFMKRKKGLEKKVKELSILCGVEACMVCFGPQMDQQTTSDYPDVWPGKSKALEIVERYRNLSKEEQAKKKLDNSSFLEQRIKKLKVELSAKRKENRELEMEAVYSWDACLNYFTIDQLKDLVDYIDIRLETANERMNFLSRDEREISNGARQQMEDGGSYNSMMPYQSGHDSSGSTLDHLKPYLSLEGHYKEHMSSCETVAMDYSKANPPFIRAFNDYHAPNYKEAMDNGEDDRMAVCNSHLMVNESFPLLGIDGVNPIQSSTGSCSQWCRTITPCSLHNPLYSTCPQHDGMNPTIQQVQFSCEPHYQQWLDEMMESQTIQRVLGDEGINFQNDSGVRSTPLLLNRSSGSNDHCYIKNIF

SEQ ID NO: 1518 - protein, 74 aa, Pinus radiata
MTDMDRSSSDDNTSVDSQDDVNESYKVDFSEDEADLISRLYNLLGQRWALIAGRIPGRTADEIEKYCSKRYASD

SEQ ID NO: 1519 - protein, 225 aa, Pinus radiata
MGRSPCCEKAHTNKGAWTKQEDDRLIAHIRAHGEGGWRSLPKAAGLLRCGKSCRLRWINYLRPDLKRGSFTEEEDELIIKLHSFVGNKWSLIAGRLPGRTDNEIKNYWNTHIKRKLLSKGLDPQTHRPLGQPNNTPVTRPVPEHEIPAFQNPATPEIADLLQHHRLESSPIKPAASDAEEHPDLNLNLCISLPSNSAPAVNRVSSVDTIVDSNSNSGDGLCWQFL

SEQ ID NO: 1520 - protein, 244 aa, Pinus radiata
MGRAPCCANGDRSKGAWTKEEDDRLTQYIQAHGEGCWRSLPKAAGLLRCGKSCRLRWINYLRPDLKRGGFSEDEDDLILKLHALLGNKWSLIAGRLPGRTDNEIKNYWNSHLKRKLISMGVDPLTHRPFQRNSRHDLSLPGKVEVPEIARPRELVENFFHSPSELCGDSEQVSDAASESLARDEPSTLNLNLELSINWASMHVAVKEEPILKSKPGEEEGAGGRFDEKGYLFRYEECPVGKSLL

SEQ ID NO: 1521 - protein, 221 aa, Pinus radiata
MGRSPCCEKAHTNKGAWTKEEDHRLIAYIRANGEGSWRSLPKAAGLPRCGKSCRLRWINYLRPDLKRGSFTEEEDELIIKLHSVVGNKWSLIAGRLPGRTDNEIKNYWNTHIKRKLLIKGIDPQSHRPLGQPYSSNNMPVSRPISDLEIPALQNPRTPEIADFFGHDRSERSRVEPAVLDAEENADLNLSLCISLPSTSSPAGNGPSSVDRTVVSTPTSGL

SEQ ID NO: 1522 - protein, 288 aa, Pinus radiata
MGRKPCYNAKDGVNKGSWTEDEDLRLIQSIEAHGEGRWSALAKNAGLKRCGKSCRLRWMNYLRPNLKRGNISSDEEDLIIRLHKLLGNRWSLIAGRIPGRTDNEIKNYWNTRLNKKVHGNGSIGRLKSVRRTEPNVKETAVNLKQTINTNQLGERDKVIAQELNKGSTSSNSIESENSMCPTKQNPSSYLHAGTVSAEMKLWNQLQLNLILPSSWTNSSFLHIDDSNVDTEENGHPYSCTFDTVNVCQDFIDQRMYAIPHSSLPSPEFVPTDTMGEFADFFNFIPYPY

SEQ ID NO: 1523 - protein, 311 aa, Pinus radiata
MGRSSCYSKQGHSRGIWTPMEDMILSEYIRIHGSDGWKNIAKRAGLKRRGKGCRLRWLNYLRPDIKRGNISPDEEDLIIRLHGLLGNRWSLIAGRLPGRTDNEIKNYWHTHMSKKLYPSMNDSQPKSSQKLRRRAKSPVPVPNPVFKATAVRIKPAMRLPGIVRENGYNDAGSSNLISYEAFRLCNVKEIRKSSWGDLLVNDSIGYEESDLIALGLADNPVETSATNPLSPMWSLADQQSPHYDHFEEDAATLAESSFYLNEKSSQDCNLLPSLSDCSTGFTSEGLYREMVELYDNAEHDDWIHEFGYLEK

SEQ ID NO: 1524 - protein, 304 aa, Pinus radiata
MGRSPCCAKEGLNRGAWTKTEDIILSEYIRIHGDGGWRSLPKKAGLKRCGKSCRLRWLNYLRPDIKRGDISPAEEELIIRLHRLLGNRWSLIAGRLPGRTDNEIKNYWNTRLSKKLLLSMNKSQCKSRKNLKSKAKPSPIQNRVFKTTPVKITTTVRLSGTATPNGSMNGYGRSNPSSDKASKLCNVKETTNSSKSWCEHLGIDTDATISTSSMSSLPLERSPHSYYFGADAAPLAESLLDLNELGLTVSDDQRIEEFYDHTQHLDWIHELDYAEGPSPQSLSLLLLESDDEREERLGDHGQIP

SEQ ID NO: 1525 - protein, 304 aa, Pinus radiata; identical to SEQ ID NO: 1524

SEQ ID NO: 1526 - protein, 312 aa, Pinus radiata
MRRTKGLSKPSDGVLHRGSWTPEEDRILKTYIEANGVGRWSTLPQNAGLMRRGKSCRLRWMNHLRPNVKRGHISADEEELIIRLHNLLGNRWSLIAGRVPGRTDNEVKNYWNTRLSKKLGSTGDNLARSLARRQIAKASPRIGVDNDAAVHLNSESSNFKFTPSLRSPTGSTIVPEETRSDIQLPSPESNNDGDRRTTVEKDDTPHLEPLDIAQTNPCGVPPPEEIGQCSAQESGFVEQNHDMNSLGKEQSPDFSSTPYNTCLDSLLWFNYSPEMDDLFHCDYDQETSFSVSFSDHLQYISFGSQFWGDMIS

SEQ ID NO: 1527 - protein, 485 aa, Pinus radiata
MGRAPCCEKVGLKKGPWTPEEDQKLVTYIQEHGHGSWRALPQKAGLLRCGKSCRLRWANYLRPDIKRGKFTVQEEQTIIQLHALLGNRWSAIATHLPKRTDNEIKNYWNTHLKKRLLQMGIDPVTHKPKSESIMVPGVQSSNGSSNLSHMAQWESARLEAESRLARESKLRARGLWSAQLRNVNASSDLFSRLRRASPGFESDREESKIPGLSSPLGFDCMKITQKWDKFQDLRSGTKLDQCNLSVLGGSLGSYTPLENEDRASKTSYLGLLQQAMCPSAQGSKILFNEAKKLVESQKNRQTNATATLHWSTYHIDQSENCDEKKPTIVSEKAHSDVQSCSHEENVEPADSHHELLLSSVMLNDGNCSSARSDVSELTKTEQGADASYDKVGNSDNILSEFQHIHYDEISSSGGLKSGSSYDGFNADMLLDLVVTPPNGYSTAGCGDNRSLSGLSVDDNKEYWSNMFSVCNSLPNGNHSGVQGIF

SEQ ID NO: 1528 - protein, 340 aa, Pinus radiata
MGRQPCCDKVGLKKGPWTAEEDRKLVNFITLHGHGCWREVPKLAGLLRCGKSCRLRWTNYLRPDLKRGLLSESEEKLIIDLHAAIGNRWSRIAAQLPGRTDNEIKNYWNTRIKKKLRQMGIDPVTHKPFTQMQMQSTPAQTLLLQENDTEQQQQEQHNEPDPDQNQSSNGTVETLVSRAREPHDDIEPLQNFNMEDSNFNMEDSMQLFNVCSPTSGVSLSGRTEEVDSDDSDQVSKSFGNGSSTHSQYIGRETSGVKAECGLSGWDQMAGVLGDPLSEWNVDLEAWAAGLDAPAASASAWIQQLPDCQWNDFQGDFEICSSKSCPETLQRLGPFLDDDEL

SEQ ID NO: 1529 - protein, 485 aa, Pinus radiata; identical to SEQ ID NO: 1527

SEQ ID NO: 1530 - protein, 381 aa, Pinus radiata
MAMSNGRLCEDLDRIKGPWSPEEDASLQRLVQKYGPRNWTLISKGIPGRSGKSCRLRWCNQLSPQVEHRPFTPSEDAAILQAHAQHGNKWATIARALPGRTDNAIKNHWNSTLRRRCRDPEKGIVVHLDDEISSLDAARKRSSDGFSHDGSSALEDNGCSSWEVDSKRLKRLGELGTEQGPEVEAEVEVSDRSDANPGRVLYRPVPVVSFFSSFGKTVANLQETAAGAVGVDPPTSLSLSLPGLDPAIPSPKLSTQKDSHNNSTVNNNIPIPPVVEYMRADEAVVERLSTAVKATVASMLTPVLNSSPRGYNPPAVSSDLLALMRDMVAKEVQKYMSSHHQPGMYTPLSPHPEFLGAANLVRNVVLGGALHLQQMTISSCR

SEQ ID NO: 1531 - protein, 374 aa, Pinus radiata; identical to SEQ ID NO: 1151

SEQ ID NO: 1532 - protein, 381 aa, Pinus radiata; identical to SEQ ID NO: 1530

SEQ ID NO: 1533 - protein, 429 aa, Eucalyptus sp.
MGRAPCCDKANVKKGPWSPEEDTKLKAFIEQHGTGGNWIALPQKAGLKRCGKSCRLRWLNYLRPDIRHGGFSEDEDNIICSLYASIGSRWSIIAAQLPGRTDNDIKNYWNTRLKKKLLGKRKDQQTRRFKEAKNMSNGTGPYVSEGMSTTSSTINAIRSLMSNTEALYLSDRMPHMDMDPSSLGLLNPQVLQHTVSNIANYCSSSEHISFGTGPPQRLDQELTFDNVSLRKLLFRTECGFTAENNNNSVSQASPPIISSQIYSPSTILDPGLVHDSFEKCCMNVNVKEEPVAGALDHHHIDYLASMTLRDSCSSTEGNYIQSPWLYQNGLQDHSCLTYEFPMEQLNEGLYWNSASSSLQGHHEKEDLCAYSSYKESAHAQETGATFWGGTQLPCNYSKPLSDCPNYLSGAPSDANQQGLSRSQEAGIIY

SEQ ID NO: 1534 - protein, 449 aa, Pinus radiata
MGRHLCCNQQKVKRGLWSPDEDEKLINYITKYGYGCWSEVPEKSGLQRCGKSCRLRWINYLRPDIRRGNFSPNEEKLIIHLHTMVGNRWAYIASHLPGRTDNEIKNYWNSWIKKKLAKAEIISKNIEASKVHNNLPQFLFEESATLGNENKLLKSEMNTDGHAAPQSHVLPSKETCETFPLWDYKMINHSTARNSQYEMEDSKTALTIDSLLIRTDSETGPIREFNTWDPSGILTNSSSKNCKNSDFQYILQRDNGQQVQGLPVSNTWHGYSSLNPIEGSFYYNPNSESSNAVHTTSSINESDFMRSLDMGPLIYSHHETLDPADHANVATMWESGSSPNGVDLGYSECLYSGEQYNHATENSCSYLPPLYDVSEESAAIDIKHSGNNSLRYLEQIQSNEINISQEMDAIQQIFEQNSSLVTTIQYCLGSHSPVSDSHHLHHRPQDAFD

SEQ ID NO: 1535 - skipped

SEQ ID NO: 1536 - protein, 221 aa, Pinus radiata; identical to SEQ ID NO: 1521

SEQ ID NO: 1537 - protein, 226 aa, Pinus radiata
MGRAPCCSNDDRNKGAWTKEEDDRLIQYIKVHGEGCWRSLPKAAGLLRCGKSCRLRWINYLRPDLKRGFFSEDEDDLILKLHALLGNNRWSLIAGRLPGRTDNEIKNYWNSHLKRKLISMGIDPLTHRPFQKTSHHHPSPPQNVREAETTPSIGIVQDFFRCPSELSTKSEQISDAASGLAQDEQPHPNLNLNLELSIARSSVHRVAEKEDVVNSQQGESNLSEGK

SEQ ID NO: 1538 - protein, 227 aa, Pinus radiata
MRRLRCEKGNTNKGAWTQQEDARLIAYIRAHGEGGWHSLPRAAGLLRCGKSCRLRWLNHLRPNLKRGNFSEEEDDLIIKLHNLLGDKWSLIAGRLPGRTENEIKNYWDTHIKKRKLSRELDPQSHRSLWLPDNGSTTLSSPFADDHEISALQSPRTAETTDFFQPDQSESSRIEPAASENEEHGDLNLDLSMSLPSKSPRTENRVLSVDGTADSNFNSGCGLFRVYI

SEQ ID NO: 1539 - protein, 255 aa, Pinus radiata
MGRTPCCEKGHTNKGAWTKEEDDRLIAHIRAHGEGRWRSLPKAAGLMRCGKSCRLRWINYLRPDLKRGNFSEEEDEFIIKLHSIIGNKWSVIAARLPGRTDNEIKNYWNSHIKRKLLSRGIDPRSHRPLCPPSNTTSLSWLAPDREFPAIQNLRTPEITDFFQHNRSESSPILPAAPDAEEDPHLNLNLCISLPSNSSPAANTAQSVRKTVDSNLNSGSDEVCYPVGLQINYGKYCDSGYCEQNASCFSQFRLVL

SEQ ID NO: 1540 - protein, 271 aa, Pinus radiata
MPANMSNGEWTREQDKAFEMALADHLEDTKDRWEKIALAVPGKSPAEVKRHYEILVEDIASIEAGRVPIPCYVDEVAEQAADNGSAKKGGTHSSVYANLASENNGTGKGSSKSDQERRKGIPWTEEEHKMFLLGLEKFGKGDWRSISRNFVISRTPTQVASHAQKYFIRLNSMNRDRRRSSIHDITSVNGSDVSSPQGPITGQGNQSSGSAGQSANHASQPGLPSVYGATVGQPIAGPMVSAVGTPVMLPPGHAPYVVPVAYPMPQPTMHR

SEQ ID NO: 1541 - protein, 286 aa, Pinus radiata
MGAPKQKWTSEEEGALKAGVEKYGTGKWRTIQKDPEFGHCLAARSNVDLKDKWRNMSVSASGQGSRDKVKTPRVKAIASLPYSSVTAESTSVFSIEATTSTTPDNLISPKSSSNGKIHSPRYDGMILEALTSMQDPNGIDIATIASFMEERHELPPNFKRALGTKLRRLVAQEKVIKIRNSYKLKDMTSTEVTSEVLGSAIPIDNSMQYSNAFTNTIDTFSVDRVNEASMAAAMKVADAEAVSAMADKAVEESELAAMLAEESDMIFEAASEVFEQLLQDGVLVLS

SEQ ID NO: 1542 - protein, 293 aa, Pinus radiata
MWDMDLPSQGSSLSSSGSVWTIQQNKIFENALADFDKDTPDKWEKVAARLPGKTATDVRKHYEDLVEDVTCIEAGRVALPTYSNSSCSHEWLEKSGAMHGLKQQFGSGGRGQSTKASEQERKKGVPWTEEEHRQFLMGLRKYGKGDWRSISRNFVVSRTPTQVASHAQKYYIRLGSDNKNKRRSSIHDITTVHGTDRMPSPLLHVSNRQTNSPSTQAEMNHSPCLTYPSQISRGPLINSLGPQIDGNLLFSPHYPLNLYTQRGFGGLSPRTIIPDSSIAMHHSGYPGQSAMQY

SEQ ID NO: 1543 - protein, 294 aa, Pinus radiata
MGRKPCCDKVGLKKGPWTAEEDKKLINFLATHGQCCWRTVPELAGLSRCGKSCRLRWTNYLRPDLKRGVFSESEEKLILDLHSRVGNRWSKIASFLPGRTDNEIKNYWNTHIKKKLKRMGLDPATHRPISETLPQPAPVAENNDVPKNNEAGGLVNPSEDEKPIQQELQASSVLMKHVKEEESEQSSFPFNAANTQTTCKMDEELQVPEMMNAQTPLLLHAEYWWDYSDIVAGFAESSQDNINSWVNPESIAGHLFETQRTVVPVPESSNSHLFLQSLDYFPQGTSSKIFPLDF

SEQ ID NO: 1544 - protein, 297 aa, Pinus radiata
MGAPKQKWTHEEEAALRTGVEKYGPGKWRAILRDPILSSCLSSRSNVDLKDKWRNMSVTANGWGSREKARLALKRSKYIAKQSGRQLALSALSNGNMDVVVTKPLSTVNPYFPSSNTKRSISRLDKLILDAVFTLKEPNGSNKSAIATYIEENQYPPPNFRRMLSSKLKSLVICGKLVKIRQNYMINGSFRPDDEKVPKNEKVEKHVTTLSKNSSKKVVGEVGIAVKSEVDAEVSKMRRMNAEEAAKAAAVAVAEAEAAIAAAEQAACEAAAAEAEAEAAEAFAEAAMMALVNSRSC

SEQ ID NO: 1545 - protein, 308 aa, Pinus radiata
MGRSPCPPKEALNRGAWTGMEDTILTEYIRVHGSGGWKDISKRAGLKRCAKSCRLRWLNYLRPDIKRGNISPEEEELIIRLHRLLGNRWSLIAGRLPGRTDNEIKNYWNTHMSKKPWLSMDESQSNTSQNLKTRSKSPVPVQNHVFKTTALKINPAARFSGTVSADGYSGDGCSNHISNEAFNFCNVKETRKFSWRELLMNDSIRDEESGNTAFATTNNPVEAEATNSLSFMSDLADQESPNRDHFQGDAITLSNSLLYLNEKSFPNCNLLPSPSDCSTDFASEEFYRGMEEFYDNVQDEDWIREFDY

SEQ ID NO: 1546 - protein, 311 aa, Pinus radiata
MVRSSCYSKQGHRRGIWTPMEDMILSEYIRIHGSDGWKNIAKRAGLKRCGKSCRLRWLNYLRPDIKRGNISPDEEDLIIRLHGLLGNRWSLIAGRLPGRTDNEIKNYWHTHMSKKLYPSMNDSQPKSSQKLRRRAKSPVPVPNPVFKATSVRIKPAMRLPGIVRENGYNDAGSSNLISYEAFRLCNVKEIRKSSWGDLLVNHSIGDEESDLIALGLADNPVETSATNPLSPMWSLADQQSPHYDHFEEDAATLAESSFYLNEKSSQDCNLLPSLSDCSTGFTSEGLYREMVELYDNAEHDDWIHEFGYLEK

SEQ ID NO: 1547 - protein, 312 aa, Pinus radiata
MGRSFSCWSCSKDNGHERLNRRSWTVEEDTILSEHIKTHGVGRWTSLPKKAGLKRSGKSCRLRWFNYLRPEIKHGNISPEEEELPIRLHRLLGNRWSLIAGRLPRRTDNEIKNYWNSHLRKKIEMGELKPKIQKPLKRWGIPSYFDYKEEQAKAKDNCISHTTPVMKRAVGHCGTVTSDVENYNNDNYDLIHNNLEAINPEEEGMKAANDHVMEIDASKSRCQLLWENCIGNDKNDGFEVTDGLQPNSIVRTHNFGIEHHLHDQFCYYTNNYEIHSSYPSFFEDQEFPHSKHFHSTSFESLLDLSELPFFPQ

SEQ ID NO: 1548 - protein, 312 aa, Pinus radiata
MTRKCSHCGNNGHNSRTCPNRGGVKLFGVRLTDGPIRKSASMGNLMMMSNPSSPADPSEPASAAAAAAAAAASGYLSDGLVEASTSSNSRERKKGVPWTEEEHRMFLLGLQKLGKGDWRGIARNFVITRTPTQVASHAQKYFIRQSNMTRKKRRSSLFDMTPPNNGAPLSSQPASDQEFESNYSEKTAEAENSFSQCAAAMACGVPMTFPGFMAPLLPFPFPVWPGFRPATTELPPNSNIFKPRAEIPKAPVNIIDETGISKLSIGDPPGSIEPSGLSLKLLNKPSRQSAFHTNPALNDNGFSSSGNAIHVV

SEQ ID NO: 1549 - protein, 316 aa, Pinus radiata
MGRSPCCDKVGVKKGPWTPEEDIALVSYIQEHGPGNWRLIPVRTGLLRCSKSCRLRWTNYLRPGIRRGNFTPYEDNIIIHLQALLGNRWAAIASYLPQRTDNDIKNYWNTHLKKRLTKQQTMIAGNELNHDDSIRRSSFSSDDYRSSRGQWETKLQTDIHRAKKALFEALNMRDPSSSLQTSGTTLDSTFMERNSNSSYAVSMENLTKLLEGWKQSSPNEIKASSNTINPLEGNQSQSSQYSAEVPISCDSEIDCLHDVDNGSLAWVSPFNSSQDYGDDGGSLHDFDLYQSDSYQNTMDSNLPFSVLENWLMEETN

SEQ ID NO: 1550 - protein, 324 aa, Pinus radiata
MTRKCSHCGHNGHNSRTCPNRGVKLFGVRLTDGPIRKSVSMGNLLHYSNNASSSNNSPASASAMEPCESVANAAASADGYVSDGLVHNNSRGERKKGVPWTEEEHRMFLIGLQKLGKGDWRGISRNFVPTRTPTQVASHAQKYFIRQSNLTRRKRRSSLFDITAEPISCPLPSPALPVLSSQSASDQEEAESGDNSANSADVETLLPQVDETASADLTVFPGFVTPYVPYGFPIWHTFRPTITQTSNVYKPTAVMPTAPIKMDECTGLSQLSLGGVAAASAMKPSELSLKLHGRPPSRQSAFQAKPSLNESSSLSSSSNVISVV

SEQ ID NO: 1551 - protein, 325 aa, Pinus radiata
MANRSLWGGSDFDYENEADTRKGPWTVEEDMQLGIVNLHGEGRWNFLARASGLQRTGKSCRLRWVNYLRPDLKRSKITPEEERLIIELHRRWGNRWSRIAQSLPGRTDNEIKNFWRTRMKGKLNSETQKDIAGVDADDGVQFESELGSCRLPVISSHALPEVDVAEPSSTFPQQNAEEIMVQTNTTPSLQNDTPPQVIQSSEGNSENVLQGGEIDGHYQINDDGQPGESNPEHLEGPDSVFQKTRLPHTFSVGSLVTLLSSEFFADSAIQDCKISPLSSYVAASPEAVSDSEIYLSCYSDVLWNMDEEDNRCFRSWQSAEDTRLY

SEQ ID NO: 1552 - protein, 327 aa, Pinus radiata
MGRAPCCEKVGLKKGPWTPEEDQKLLAYIQEHGHGSWRALPQKAGLLRCGKSCRLRWTNYLRPDIKRGKFNPQEEQTIIQLHALLGNRWSTIATHLPKRTDNEIKNYWNTHLKKRLVQMGIDPMTHKPKSESTIAVGRQSCNGSSNLSHMAQWESARLEAESRLARESKFRAQGLWPPSMRNPNVNSDILTRLRLAGQGFDSDKEGSNILGLNPTGGFERMKIAGKWDKFQDLSLGIKSDQSNSSALGSSLRGYNPVENDQSADRASNTSYLSLLQQAMCPSAQGSKILYNEAKKLMENQKNRQANVTATLYNVHQPHGNCSESKHL

SEQ ID NO: 1553 - protein, 331 aa, Pinus radiata
MVKELLMMCSNCGHSGHSSRACPDRGSVKLFGVRLIATDDGMACMRKSLSMGNLGHYRSLYNVNHCSGTSECGSADQDGYLSDGFVHSSSNARERKKGVPWSEEEHRMFLYGLEKLGKGDWRGISRNFVTTRTPTQVASHAQKYFLRQSNLNKRKRRSSLFDMCPHDSHVTSSFRREDSLGNLYEFSPKHSALGVSPNFELYSFGVSPTLSLGRSLQPVEAVLEEKAAHYHPVNSEEDTSSMSSTTDAPAKEKNSWPSSAPQKFQLSLWPELELMTSSNASSGKENGMKPMVAGMPVHCGENTDLSLSIALPPRNTSLNSNGSLSNAIRVV

SEQ ID NO: 1554 - protein, 333 aa, Pinus radiata
MNRRCSHCGHNGHNSRTCPDRGVKLFGVRLTTDEPMRKSLSMGNLPLTPEQSESGAAEDGYVSDGLVQNSRERKKGVPWTEEEHKMFLLGLHKLGKGDWRGISRNFVTSRTPTQVASHAQKYFLRQSNLNKRKRRSSLFDISTDSMEDCYQGIPELSPVMHDLSLGQNSSLTSGNFFETGGAPPNLAASVGAFSVPPLAASRPVIPPCLSLGMYKSDDGEMARYEAKYSSLNEAERQESGGYSNPTSHYSFTLPFWPDLGTKASKIIKPSAPTSPSMEARESIENSGLSLSIAPPSVDPPAPHNTLNLDQSNSRRSAFRSSNLDSSSNAISVV

SEQ ID NO: 1555 - protein, 355 aa, Pinus radiata
MSSRSCSLCGLNGHNSRTCVGSGVMLFGVRLTDGPMRKSASMNNLSNLSQYEHSDPAEVAAEGFDGYVSDDLVHSSSNARERKRGVPWTEEEHRMFLVGLQRVGKGDWRGISRNFVKTRTPTQVASHAQKYFLRQSNMNRRRRRSSLFDITTDTFLSIPVESEDLVPGTGNTPSFTRQLSLGQNSSFPAPETGNFAIPVTSFPVPLSHAVLPGLPVGKSHELEKEESTPMECGDSPGSSSLAFSEDAVNASVSHPKIMDVGPLRYKMWKAATPLSSVEGSKVVRPIPIIPTPPLKTTESDVEKPMSSQNPVMEPSPLSLKLSEQPKRHSAFQSMTSHSSHELKSQGNLSNVISVA

SEQ ID NO: 1556 - protein, 355 aa, Pinus radiata
MSSRSCSLCGLNGHNSRTCVGSGVMLFGVRLTDGPMRKSASMNNLSNLSQYEHSDPAEVAAEGFDGYVSDDLVHSSSNARERKRGVPWTEEEHRMFLVGLQRVGKGDWRGISRNFVKTRTPTQVASHAQKYFLRQSNMNRRRRRSSLFDITTDTFWSIPVESEDLVPGTGNTLSFTRQLSLGQNSSFPAPETGNFAIPVTSFPVPLSHAVLPGLPVGKSHELEKEESTPMECGDSPGSSSLAFSEDAVNASVSHPKIMDVGPLRYKMWKAATPLSSVEGSKVVRPIPIIPTPPLKTTESDVEKPMSSQNPVMEPSPLSLKLSEQPKRHSAFQSMTSHSSHELKSQGNLSNVISVA

SEQ ID NO: 1557 - protein, 358 aa, Pinus radiata
MGRSPCCSKEGLNRGAWTKREDMILSEYIRIHGDGGWRNMPKRAGLKRCGKSCRLRWLNYLRPDIKRGNISPDEEELIIRLHRLLGNRWSLIAGRLPGRTDNEIKNYWNTHMSKKLLPLNESQPKTLPVPKRRSQSPSPLQNRVFKANPVKITTVVSPSDIGRPKGYSNRRSDETTNSSKSRYQLLVNDSDSITGSESKPIPSANADNHVATEAAMSSLADQQSLESNHFYAAAMADSLLYLNELSSPDSDLLSYPSNCSTDFGLEEFYSVPTTETNGFEDMCSDQRNMERVDNSTVAEKQVMEEIFHNTERLDWIHEIDYLQKSSSQQLSFLLLEAEDEWEERATGKAVPENTEQIP

SEQ ID NO: 1558 - protein, 358 aa, Pinus radiata
MTQATNYTAGTIRDDQEEQCVRRGPWTVDEDMSLIRCVTTRGEGRWNTVAKFAGLKRTGKSCRLRWLNYLRPDVKRGNITPEEQLLILELHRLWGNRWSKIARQLPGRTDNEIKNYWRTRIKKHIQKAHCDANPRQLEDSLRYSWLSALLQPKGIESSNQSAQAASSSEIIQPSELDYMLSQYKWMSGLETEIAGINEPGDSLNPASFRTSQGSIRSREYLNQNSRATFQDVHDMDQSTSEKQNCYYHQSLFGYSNSDSVHHEISQAISPSEVGIDKDMGTPCNGVALVQPIMISESEELKDIHESTAGFGIQYVNSEAQTSSCNNQISGIETNWPQESNNTSLWNEELWYIPSSAQL

SEQ ID NO: 1559 - protein, 381 aa, Pinus radiata; identical to SEQ ID NO: 1530

SEQ ID NO: 1560 - protein, 386 aa, Pinus radiata
MGRAPCCDKMGVKKGPWTLDEDKILVDYITKHGHGNWRALPKQAGLLRCGKSCRLRWTNYLKPDIKRGNFSPEEEDQIIKLHELIGNRWSTIASYLPGRTDNEIKNVWNTHLKKRLARMKADSVAVDAQPTPASSLASSTTEMTCHGSSPVRSQILCNSVPSAPSESQICDPVYVLPELSEDITSSSYNICTSTIDYQSTSTDSPLDVFQSDSIDSLEPEIDQNHISINTLDELECQQPLSKDPQIFIGNYQNNFEDSAGGSAISHDDKAEMGSSSSQGMSSDCDGEMIISDKSLNSPLNLRVDSPMQQFYAAEVDWFLDQSENMSAAMDSNHLPTNTNQLWGTDLHVNEGMDFWLNILRQVEPLPLFQFASPALVSSPINSSHHC

SEQ ID NO: 1561 - protein, 400 aa, Pinus radiata
MGRAPCCGDHEGLKRGPWTAEEDQKLIHYVQSHGLGNWRNLPKLAGLSRCGKSCRLRWANYLRPDIKRGAFSMPEELTIIRLHAVLGNKWSAIASHIPGRTDNEIKNHWNTKLKKRLLFMGIDPVTHMPLPTPDMLSPFMASSSTPIAARLNSALVEAQLGRLARDYVNTAHVSAGTADHQYSWQLSQILNLLGAHNNPVSAAPSGLLSSISRNEFLQPDALTWSHGSQKQINHEFISRQKDDSAKYNAFSQESLQFSDPQKKSKGKNLSINTDHSNEHRTPSSLIAERPSAFDTEISGWNPMPILMPSNNPHQNDHHYSYSDEKSSSTTCTNSCKGGSENTENTIQYQQDAPFGSAIRSSLSMSLPAASVDLHEDESNYWADLLNSIEDSNPAFPLPSP

SEQ ID NO: 1562 - protein, 404 aa, Pinus radiata
MPMLAETYRDSFETTSGGSSVDLVGMALPGLAPNLSSASVSASASEDSAKKIRKPYTITKSRESWSEQEHDKFLEALQLFDRDWKKIEAFVGSKTVIQIRSHAQKYFLKVQKNGTREHVPPPRPKRKASHPYPQKASKNVPVSQQVSTAFPTAATQLDSGYYPRAESSSILTKSGSSCPTVSSWVHHTIPSIDASFVEKDDGGPPGIATGNNCSSGSTESSPPTWPPCSEIPEKVKPDFSQVYKFIGSVFDPSTTDHLKKLKEMDPIDLETVLLLMRNLSINLSSPDFEEHKLFLSVYDMNPEDAEPAIENQTDECVAVPGTAAKQPSDLWNGPLGSVHLGSVKGHEKEEQNSQQKSHDLKGSSDSKHSDLDGSSVNGTAASFHGNLAKTCGMTRSCFSNEAPT

SEQ ID NO: 1563 - protein, 415 aa, Pinus radiata
MGRAPCCDKANVKRGPWSPEEDTILKNFVEKHGTGGNWIALPRKAGLKRCGKSCRLRWLNYLRPDIKHGDFSEEEDDIICTLYTSIGSRWSIIAAQLPGRTDNDIKNYWNTRLKKKLLGKCSKDNDNQQIRRLLAKEAAKGAGIRGLYNGDHNISSETAAISASNTQSSSESLTETATAANAMNSPYSALETGKVPGSNSSESKAAGFNATHSPNTHYYEQGFSQFMSQADQYSSLTHMLLRLENNESDCSTDNIQSLGIDTIPSEVPFYASTAMNVKAEAMERPSSDPQLNQARNSVPALWETCTSNSTSGGNNYQFSTLINDDTGNFSYGLSADMDEFIVYRNYGGNGSISQVKEEPDYSTAEAYWASQLAEPAKSSGLTTTCPNYSYILPSSEGGMGSGTTPQGLFQEGIIY

SEQ ID NO: 1564 - protein, 417 aa, Pinus radiata
MGRAPCCTKVGLNKGAWSAEEDSLLGRYIQTHGEGNWRSLPKKAGLRRCGKSCRLRWLNYLRPCIKRGNITTDEEELIIRMHALLGNRWSIIAGRVPGRTDNEIKNYWNTNLSKKLAVRGIDPKTHKKITTDGTNRVNGDRFSQRKGEKIYDSPQKPRQPERNVARAAQSTGLVIPNVHNLKADLKAQYIARIREFKSSNTISSSSRLNAQIEPKSRELSTEDPIFRCSSASEKTRETTHPDFMEPHPVASSDAGKQTNDSTVYCSSDSAASCSLIEHFSSEDDHHYLSMEGNSNECYSQTLAEDYGSLKPSTPHTESEPICDSRERDNDSHVQKHDQFPEYDVFSFFDVRNAENEICCSADQWVHEQEAEFMQQKDQEMPQLGSWEKQIDDQEKENFESHVNNDVTAMSWEASFWF

SEQ ID NO: 1565 - protein, 429 aa, Pinus radiata
MGVPKDEAAMAMAVAERIKGPWSPEEDASLHKLVEKYGPRNWSQISRGIPGRSGKSCRLRWCNQLSPQVEHRPFSPHEDATIIQAHARHGNKWATIARLLPGRTDNAIKNHWNSTLRRRYHGEKDQSNGLAVNLESAAEDKETMTPMTPVTATATATATATAMPVALVFPTAVDNVRKRSNSSCSANDNPGDAEVESCRLKRLNFSESPSSSENINNNNNNEEAVSGHCNSAAAPGSSPGQQLHRPVPRQSAFNCYEAVKVQEEASASVSASGSACAFDPPTSLSLSLPGSASSSENNSSGECSPTEQSSEMKYAKFQAYQQPTGYSFANPFPVGGYMKTEEAMAMMSTAVKIAIGQALPLIFQLPSGNSQEGCSGDSANYGGSLLSIMREMIAKEVQSYTNGSPCSNQGSGMNSVAPAFREVGLMLKK

SEQ ID NO: 1566 - protein, 442 aa, Pinus radiata
MKERQRWRSEEDSLLLSYVKRYGPREWNLISERMNRALDRDPKSCAERWKNYLKPGIKKGSLSEDEQRLVISLQAKYGNRWKKIAAQVPGTTAKRLSKWWEVYREKQDKIKDRNERTIADSATKIEEGKYDHILETFAEKYMQKQKQLATSSGCNLPTIAAMPSGLPPPISFSMPTSSTPDFIHFAIPSASTPTTCSFGAPTPCLPPWMSNRPNSAHGSGAEPFLHSSPLSKSSPSSSSSPSVTLSLSPSSSTPVMSANTASACSSWKQDTAKQSSENNVSGDSEAAKDKNRGISHVQMPSMDPSNSASSHQAAGGQGVIMQEISLFFQHCRELEERQQSWSVHKKETSWRLKRLEQQLEAEKARKRREKMEEIESKVRALREEENSYLDRLESDYREQLSRIHRDAEIKEARMMEMWTAKHVQITKFFEQMVHRHDPHKSI

SEQ ID NO: 1567 - protein, 444 aa, Pinus radiata
MGRTPCCEKNIGLKKGPWTPEEDQKLIDYIQSHGHGSWRALPKRAGLLRCGKSCRLRWTNYLRPDIKRGQFSFEEEQTIIELHAVLGNKWSTIAGHLPGRTDNEIKNYWNTHLKKRLLQMGIDPVTHRPRTDLLAFPNIQSSIFNTPGFGHMAQWESARLEAEARLTGEYLRQALFMAGNGSATADLFMRPCKSEFGNDQFNLTKNMGNPPWIQQPGMALDYKGAVPQSLEQFLQTNVCSASDINGGGCLSHEGGFSITRFASPCSTLDGIQIKTEPQSLCGPQVVKNDSQFLHSEGDLRKQAMLDMNVGSNVLSNMNAESKVSFGHNGIITDQEYNNLGQIDNNNHLSHAATTLWPVEGQLQAIASDSMPGLISSTSCTSNNIYSQPGLIPLLNSTTSSMGDTNSYREAQPEQNQDQASKQYWSTMLKAAGTIPASHIISARQ

SEQ ID NO: 1568 - protein, 485 aa, Pinus radiata; identical to SEQ ID NO: 1527

SEQ ID NO: 1569 - protein, 491 aa, Pinus radiata
MSCTTGGLSSPVSKPKLRKGLWSPEEDDKLINYMMKNGQGCWSDVAKQAGLQRCGKSCRLRWINYLRPDLKRGAFSPQEEQLIIHLHSILGNRWSQIAARLPGRTDNEIKNFWNSCIKKKLKHLSASTNNSKSISAPNRTSTMNSSITPFSESSAEPLEVMATRYQPSNAFNHEVPTAENQFCIPDVLALRHEQVQSQNQFSIDQDSATNNLISHLWNSNSTAVSSHESFSHAFMSPGLQTQGHVVKTPIKPCDQISWSTPLTREAAGSHACNYSLGCNIPALVESESLKEKFKNDAGDQINENEIMYSSTASSVITAWSTNSYSDAEYCTVDPHDQVGSILEDYVSHEKTTDHQPCPPLNSSLQFSAPEIRWTADQSNDHEEYDCKDRLNLRYDVNLGYPNNTNNKQNGYQLPQIGGGGVNGDHWDCTRIPNMEEANSTTPTSTILGGSGQFEFECDGDAGGQVTAWAHDALYNDIHTAASDLLGQIYFG

SEQ ID NO: 1570 - protein, 534 aa, Pinus radiata
MGRHSCCYKQKLRKGLWSPEEDEKLVRHITKYGHGCWSAVPKQAGLQRCGKSCRLRWINYLRPDLKRGTFSPQEENLIVELHSVLGNRWSQIATHLPGRTDNEIKNLWNSCIKKKLRQRGIDPNTHRPLSEVNAEAGDSKNDNSNKEVETQAAMDESHVSAGNEFKHLNAIPRADTANPKFFHVPVEDNTLIASDSQAMLQNGFINSNSTTTTTTATSTASAANFSLPKEFFLERFNSVNATPTSVEAGFNFINQTTSTQGFTGERDQKLIDNPVLWVLQAPNRSVGFPTENLMPWPGQGLAKAVSDAFSDFSSDVCDYNSIMANPSMYRPGPCLSSLLYSERSLDQDLLDNAGTNCMNGSGAAGSAQYWDNTDNNNNNNVRSSSRSSSCNSSTANLEVNNGAAFGHFWGFGERLDATDITSENERKAPLFLERADQSEYAVKWSEMLPPFSSHTQEETLPIYITTDSKSQDLVSSENINNPNHAALNSAIFPISWQQLQNTEYPVLGDRTATMLSTPLSDPDFHRIAAVLDQI

SEQ ID NO: 1571 - protein, 756 aa, Pinus radiata
MKMSLPSNVLTLSADSNSNSNSISSSGDELAAKVRKPYTITKQRERWSEDEHLKFLEALKMYGRAWRRIEEHIGTKTAVQIRSHAQKFFSKLVRGSSNKGVSSTERAEDIEIPPPRPKRKPRHPYPRKAAGTSHQSGSPASNEGDVFPPVVSSVPLLSLGDGPCKRARFDQHNANTRLSNSDNAQDIKMESPRLNSSPLSLKLFGQTMFVSNSEGSNTFSTEPAVSNNQGDFQEFVPVQQETSSLRTKAKNQILDDGTEILHGYGLNSHITAVANTILRSGSVSTADKDSREKTDSDEQLSSELDTNSSCLTRNQESPSIFSGYPRHVPVQRVVDGVVSENVNEVVNMTPLSESSLAMSMSNNTSSLSKSEIMSPCPSTFSPVFPWVQMQHGDTAVAEAVAVATVAAASAWWSLYGAVPSHLHERMFSGAATDAENMSSACKAEAVMGVREQSQSNTTEREGETLFQGSQSENRTSSFIQESNDARRHTEKQSCQTKEEDQIMKETELGKEGSGCASNTPSSTEPEIDPYSGTNSQGNTRNCVQSIQCNGGGYLPEAEEGSSTDEEETRYSDNLSTKQGGLKEAKICIQNSRNNSYSRVDGHVDDTWKDVLSEGQIAFRALFAQEVLPQSFSSGDGTFSKINGRDSFFEDSKKKSNRSVEGETCPHVKGSGTSVEQAYTGKVHTQSPKASFVSTSREEVLEDSEGAVSHGLLEVSAVNFCKANKFFSSSFSKSKSGVGFVPYERCSMQARNNELHL

SEQ ID NO: 1572 - protein, 285 aa, Pinus radiata
MAGKNRNSTGSSQLIDAKLEEYRIKQCPACGHQIERQEALQDWPGLPCGVKFDPTDQELIEHLQGKVGLDNSAPHPLIDEFIPTIGGEDGICYSHPEKLPGISRDGLIRHFFHRPSKAYTTGTRKRRKIQTACDESSEGETRWHKTGKTRPVLVNGKQKGCKKILVLYTNFGKHKKPEKTNWVMHQYHLGSQEEEKEGELVVSKIFYQTQPRQCNWEKVTDGGDTHRVSVTEATQVSERCTAGETVSSTARHIYNHLEQQTKITHRSYDLSVGRLENSDRVSISE

SEQ ID NO: 1573 - protein, 295 aa, Pinus radiata
MEGVAFQQQTVPELLVGFRFHPTDEELITHYLEKKVSSSPLPAPIIADIDPYQHDPWDLPAKAFFGENEWYFFSPRNREYLSGARPNRAAGSGYWKSTGSDIPIVNKSGSTSPRKVGAKKALVFYKGKAAEGVMTNWIMHEYCLAQTLPTKRKGSVPLDDWVLCRLFQRLNHSPGMLSCSQLEVPSPSATDVQRTGQKPAMPKFSSFSRVLLNEVPSMENLPSHATSDANNAAVSSAESTYSLQVVHHPLNSAESGSHSSMNWSAQRLQGMSRRRINIFDIFSDKNPSGKEGKQS

SEQ ID NO: 1574 - protein, 321 aa, Pinus radiata
MTQKGGTGGQIDLPPGFRFFPTDEELVVHYLCKKVVSHPLPAFIIGDVDLYKYDPWDLPEKALFGEKEWYFFTPRDRKYPNGSRPNRAAGSGYWKATGADKPITTCGGRKRVGVKKALVFYKGKAPKGSKTNWIMHEYRMAEINMAARKKNTLRLDDWVLCRIYNKKSSAERLEEKKLAEEMESRHDMQETVGLHDMQETVEQQKKTQSVPSEPSPTDASTVSAEAGLPSTNSSLFNPHLPAPPMNPFCQHQSTTTDEVQMNIKLANQLIQKQQQSGQCLNFNLGLDIVQSPFFQLDNSEPSSLFNPYQEFMDNYSIQRSY

SEQ ID NO: 1575 - protein, 324 aa, Pinus radiata
MREIGRMGCKSGPNSEQINLPPGFRFYPTDEELMVHYLCKRVASQPFPIPIIAEIDLYKFDPWQLPEKALFGEKEWYFFSPRDRKYPNGSRPNRAAGSGYWKATGTDKPVTAGANKIKVGVKKALVFYKGKAPRGVKTNWIMHEYRLADSASRAAKRKGSIRLDDWVLCRIYEKHYATQKNGPKESNELSSCVDQEEDQYMVAAASTSPADMDDSKLLINLPRINSLNRINSLLKFPTREVMKMPDPNYNQTEQQYSRAETVAGSNSGCQAIEYDQNSPYWRNQQFGYNYDQMVQNPFPHQLENVTSFGGNSSVYFANLAAELL

SEQ ID NO: 1576 - protein, 353 aa, Pinus radiata
MNTLSRVPPGFRFHPTDEELVDYYLRKKVASKRIDLDVIKDIDLYKIEPWDLQEKCKIGSEEQTEWYFFSHKDKKYPTGTRTNRATAAGFWKATGRDKAIYCKLNLIGMRKTLVFYKGRAPNGQKSDWIMHEYRLETNENATPQEEGWVVCRVFKKRITTQRKGNDDNVCWYEDQVGLMPELDSPKKLPQGGDMGYQLPFACKQELELHYHMSHDPFLQLPQLESPKVPCNASSSAPGKRAECSMPYNGFETGCNMEGHHGNANPQSAATQEDQQGVNTYNEEQVTDWRVLDKFVASQLSQEDVSKDARFSNETMYPIPDMTVLLRQSNKHEQQADYASNSNCDVDLWSFAGK

SEQ ID NO: 1577 - protein, 355 aa, Pinus radiata
MGTLALPPGFRFHPTDEELISCYLKGKLDHGLKEAEIEVISEVDLYRNEPWDLPEKSLLPSGDMEWYFFSPRDRKYPNGSRTNRATEAGYWKATGRDRKVYSRANTVGIKKTLVFYRGRAPQGERTDWIMHEYRLEENECEAGPCLQVDAMPDTPRIQCESACLPSVESELRYIPVNISFPQYGVPNGHLDAYFEEERMLEEMLCVASQDYTNSKAYHTSLGDTCADILNGGYIKVKNLIPSTGEVENHDSCLWEVPYPSFDHEETGIQLCSRSPVLQSHKQGFSFEGTAARGVCMQFHKMEDSSEINEKDVTVRHSQNMRNDWYVSGQEREQLHFDRFAGKKWDSEVRIKLNKL

SEQ ID NO: 1578 - protein, 360 aa, Pinus radiata
MGDLNCLPPGFRFHPTDEELVCYYLRKKLSNSKSELESDYLNPITDIDLYKYEPSDLAATACFQGRDQQWFFFTEGNRKKYPNGSRKNRATEGGYWKTTGKDRRVLSKGVTVGMKKTLVFHRGRSSRAERTSWVMHEYRLVHGEAGESSLLEKDHFVLCRVFLKSGSGAKTCEQHGVSLSREDSRSTDNQSALVTENKQYDDVILPSSGEGEVEETYSPLKPLTATSEENTIPWDGDHLSKFLLECLKEPDNDQAACDSLQIPVGADEWSGLINDPFAEVEGVNTLVDEVDILIRNDTHEQSSADQKLHTERNVHRVDYIDEANITEQSNFEELFSPAYLGGDFLELNDLISPLDSDFLL

SEQ ID NO: 1579 - protein, 360 aa, Pinus radiata
MGRRDAEADLQLPPGFRFFPTEEELIVHYLCRKAALLPLPVPIIADVDLYKYDPWRLPEKALFGEKEWYFFTPRDRKYPNGSRPNRAAGSGYWKATGADKPITSTASKGVKKRVGVKKALVFYVGKAPSGSKTNWLMHEYRLADINRPARKKDSLRLDDWVLCRIYNRKISAEKLALEQKESFNDVPMETIDEKEMKVEPTSTSFNHSTIEQSNPSFDHLSKFGSSPTCYNSVPPGASPMNSNSRFQNLDFLQNSTTPFSGSTLKAPVQNTAFNPISPSQTNYNSTELISGLHDDFSCSKASSFSEPIWEKEVESSFRLENFSQKQQQSLFNLDLEGLQSSFPHLDQISFSDAYQDWFLV

SEQ ID NO: 1580 - protein, 372 aa, Pinus radiata
MGSRSAEADLHLPPGFRFFPTEEELVVHYLCKKATSQSLPVQIIADVDLYKYDPWQLPEKALFGEKEWYFFTPRDRKYPNGSRPNRAAGSGYWKATGADKPITAKGGKKRVGVKKALVFYVGKAPKGSKTNWLMHEYRLADLNTPARKKGSLRLDDWVLCRIYSKKISAEKLQREQKESSNDVPMETIDEKEIENQPTSASIEHSGIEESKPFSDNLNELGPSTTSYNAVPMNSNIYFQNPGFFQNSTTPFIGNTLKAPVQNTAFNPISSSVNHHWTNCNSADLISRLHTDSSCSKPYSEPISEKEEIQSSFRMENISQEKQLPLFNSSLEDIQNTSSYLDQVTFPDTHQDYFTTLNCSDYLPRFYPNELFR

SEQ ID NO: 1581 - protein, 380 aa, Pinus radiata
MGRRNAEAELELPPGFRFCPTDEELLVHYLCKKGASQSLPVPIIADVDLYKYDPWQLPEKALFGEKEWYFFTPRDRKYPNGSRPNRAAGTGYWKATGADKPISAKGGKKRVGIKKALVFYAGKAPKGSKTNWIMHEYRLADVSRPARKKGSLRLDDWVLCRIYNKKTSAEKLALDQNESYMDVPMEAIDEIEMVNQPSSTSIEHSGIEQNGPSSDLLNKSGPSPTSHNGVPPRALPMNTNNISSPNLDFFQKIITPSSAGTPKAPVQNTEFNPISSSINQQWINYNSIDLLSGLHTDSNSSKPSSSSNPILEKEEVQSSLRLETSSPEEQKPFFNFSLEGLEYPFSHLDQITLPDPYQDYFTSWTGSDLPRFYANDMRFC

SEQ ID NO: 1582 - protein, 383 aa, Pinus radiata
MGMSRRNAEADLQLPPGFRFFPTDEELVVHYLCKKAASQMIPVPIIAEVDLYKYDPWQLPEKALFGEKEWYFFTPRDRKYPNGSRPNRAAGSGYWKATGADKPITAKGGKKRVGIKKALVFYAGKAPKGTKTNWIMHEYRLADVSRPARKKGSLRLDDWVLCRIYNKKISAEKLAQGQKEISHDIVPMEAIDEKDMDNQPSSTSIEHSGIEQNNPSSGRLMKLEPSPTSHNVVPPRSYPMNSNFNLQNPDFFQNTSNPFNASTPKAPVQNTAFNPISPSIDHQWANYNSADLVSGLHTDSSSSKPSSSSDPISEKEEVQSSFRLENFLQEQPQPTYNFSMEGLQNPFPQLDQITFLDFNQDYFTGLTTSDYLPRFNSNDIQFQ

SEQ ID NO: 1583 - protein, 389 aa, Pinus radiata
MGRQDAEAQLNLPPGFRFFPTDDELVVHYLCRKAASLPIAVPIIAEVDLYKFDPWQLPEKALFGEKEWYFFTPRDRKYPNGSRPNRAAGSGYWKATGADKPITAKGSNRRVGIKKALVFYVGKAPKGNKTNWIMHEYRLADVNRSAKKKGSLRLDDWVLCRIYNKKSSAEKLAKEQEWSSEEAMEQFHEEIDQKVPGILPTGDTTMNSNIEHSQRTSQDSTKSAPSPNCRTISKHDSRTSAITSMSYNSNSIFEQNLNISNASSAPMELPELVPFFNPMTNHRTNYDSADLIPPILLTDSSCSMQSSHDLKSDKEEVQSSCRLEELKQQQRQQQQENAGLNQSVFTFGFESLQNPFPQLDQIQPSSSNDPFQDYLASLTAPGYLPRSSF

SEQ ID NO: 1584 - protein, 392 aa, Pinus radiata
MTLSVNGQSRVPPGFRFHPTEEELLYYYLKKKVSFEKIDLDVIRDVDLNKLEPWDIQERCKIGSTPQHDWYFFSHKDKKYPTGTRTNRATAAGFWKATGRDKAIHTNLKKIGMRKTLVFYKGRAPHGQKTDWIMHEYRLDDAEYPQANTFNELQEDGWVVCRVFKKRNHHKSQESAELSPKYGSKQFSNNKILSDSDCPSDNLTDQLHYTHQLNMCKQELEMQQYAFPHDQFMQLPQLESPKIPTCNNPPSSGIKRFFPDSRSGFFQLENIPNSKRPCSYPMTLDMTELEGSTVTTHDHMTEFKPTEEVQNLQDWTVLDRLVASHLNGQEVETPKLEVRTYGAPNSSSDHQALVDAATASGDQLTLLPQLRINRLNPHDYSSCEIDLWNFVK

SEQ ID NO: 1585 - protein, 398 aa, Pinus radiata
MARPWITDGRRIAMKIRNPTQLLENENGRNDVRIACPNCDYEIDNSHVTQEWPGLPSGVKFEPSDEQLVGHLAAKVGIGNSRPHPLINEFILTLEERDGICYTHPENLPGVKQDGSSTHFFHRTSKAYTTGTRKRRKVDNFRWHKTGKTRKVCENGEQIGCKKIMVLYTTPSKGSKSVKTDWVMHQYHLGTEEDEKEDEFVLSKIQLKQCDKNDPGIPEEEDAGTSNSKGDPSTPTTSTPPQPCSKKQHSCLDRIEEEHMFRASSPQAADLDPKFHLPSEPIEAECDGQIFPDVTSWLAGESQCFEDSQEQMVGHFSCEEILGNGSCQENVEETNIPGLSDCGRIGGNGHEKEMQQTSYSDLANLDFDTPPDGPIPLDSQFSSQESLLGWLKNFGNSQ

SEQ ID NO: 1586 - protein, 436 aa, Pinus radiata
MARAPWLIDSRRFATKIKNPTFDPSKEDQNGGLVRKCPNCNYEFDNSDVAQQWPGLPAGVKFDPSDQELMGHLAAKVGVGNGKPHPLIDEFIPTLEEDDGICSARPENLPGVKQDGSVCHFFHTTAKAYHTGNRKRRKIQEDRWHKTGKTRPVIENGIHRGWKKILVLYVSTGKGKMFEKTNWVMHQYHLGSEEDENDGEFVASKIFYQQQHKQSDKNEVPQETEVTSLIPIPDPLTPVTSAPKLSSHAKSQADLDSVREEQLDCMDSPGQGVSHHTNENLDYSTWQGLNCQENISLDDSILLPKESQSRVDSQQLLDDFLFCAETVQCSSPQNLIPDAVEHGRIKAKELDKYGNVSDAIPCLDNTELDTHPQNAILDLGEHGRIKAKELDKTVNASDMIPCLDNIDLDTPPDIENIELNFNSQESLSAWTRGTTH

SEQ ID NO: 1587 - protein, 448 aa, Pinus radiata
MESATVNNKQQQQMNKIDDEHLPPGFRFHPMDEELVTYYLTQKVLDSSFSCRAIAEVDLNKCEPWDLPDKAKMGEKEWYFFSLRDRKYPTGTRTNRATEAGYWKATGKDREIYRGKTNTLVGMKKTLVFYKGRAPKGEKTNWVMHEYRLEGKFAYYDFPKTAKDEWVVTRIFQKSSGAKKGPLGLGRSSSYLDIDSPNLPPLLESPCIPTSVGGAISFESESAGSDQQHVTCFSTPGYTNNNQGFGLAPNQVQQTLGSISSDMPDFQFLQNMLMGMNSNSSPTQISPQMSNRASQLPSYPMGPNSNFPTFANLLYPGGMQQNSYNNIFKTHADIANDRFKQCKMEPPSPLFDASGTVKNSTVQQPGSSRWINPSSGYQHGNQDNLEQKYRVPQQQQQQMQNQNMVSLSQETGLSTEINTDMSSVVSSQLNQAYQEETPDMDSLWNSFS

SEQ ID NO: 1588 - protein, 499 aa, Pinus radiata
MGTLALPPGFRFHPTDEELISCYLEGKLNHGLKEAELEVITEVDLYRNEPWDLPEKSFLPSRDMEWYFYSPRDRKYPNGSRTNRATEAGYWKATGRDRKVYSRASTVGKKKTLVFYIGRAPQGERTDWIMHEYRLEENECEAGPCLQNAFVLCRVFKKSGLGTKSGEQYTAPLERGDLSPTEKNPSPGYSGDMEVQSEDLSKPVEGIDANLHLPSNISSKILHDTTGDNEPLNKWLDILLDDTIPNSSCVAADEDTIHTQVDAMPDTPRIQCESACLPSVESELRDIPVNISFPQYRVPNGRLDAYFEEERMLEEMLSVAPEDYTNFKAYHNSLGDTCADILNGGYIKVKNLIPSIGEPENHDSCLWEVPYPSFDCEGSGIQLCTGSPCLQSHKQGFSFEGTAARGVCMQLYKMEDSTERNEKDVTVRHSQNTQNDWYDSGPEMQQLHFDRFAGTKWDSENIKENEDSVAEALPTYMTGQIDGMCTLNIFLTLKKISLE

SEQ ID NO: 1589 - protein, 499 aa, Pinus radiata
MGTLALPPGFRFHPTDEELISCYLKGKLSHGLKEAEIEVISEVDLYRNEPWDLPEKSLLPSSDMEWYFFSPRDRKYPNGSRTNRATEAGYWKATGRDRKVYSRAKTVGIKKTLVFYRGRAPQGERTDWIMHEYRLEENECEAVPCLQNAFVLCRVFKKSGPGTKSGKQYTAPLGKGDLSPTMKIPSPGYTGDVEVQSEDPSKPVEGIDANLHLPSKISSKIPDDTTEDSAPLNKWLDILLDDSIPNPSCVAADEDTIHTQVDAMPNTPRIQCESACLPSVENELQDIPVNISFPQYGVPNGHLDAYFEEERMLEEMLSVASQDYTNSKAYHTSLGDTCDDIFILNGGYIKIKNLIPSIGELENHDSCLWEVPYSFFDREETGIQLRSCSPVLQSQKQGFSFEGTAARGVCMQLHKMEDSSEINEKDATVRDSQNMRNDWYGSGPEMEELHFDRFAGKKWDSENIRENEDSVPEALPTYMAGQIDGMYTLKIFLTLKKTD

SEQ ID NO: 1590 - protein, 508 aa, Pinus radiata
MGTLALPPGFRFHPTDEELISCYLKGKLSHGLKEAEIEVISEVDLYRNEPWDLPEKSLLPSSDMEWYFFSPRDRKYPNGSRTNRATEAGYWKATGRDRKVYSRAKTVGIKKTLVFYRGRAPQGERTDWIMHEYRLEENECEAVPCLQNAFVLCRVFKKSGPGTKSGKQYTAPLGKGDLSPTMKIPSPGYTGDVEVQSEDPSKPVEGIDANLHLPSKISSKIPDDTTEDSAPLNKWLDILLDDSIPNPSCVAADEDTIHTQVDAMPNTPRIQCESACLPSVENELQDIPVNISFPQYGVPNGHLDAYFEEERMLEEMLSVASQDYTNSKAYHTSLGDTCDDIFILNGGYIKIKNLIPSIGELENHDSCLWEVPYSFFDREETGIQLRSCSPVLQSQKQGFSFEGTAARGVCMQLHKMEDSSEINEKDATVRDSQNMRNDWYGSGPEMEELHFDRFAGKKWDSENIRENEDSVPEALPTYMAGQIDGNLVHGLTLTIGVGSTKDVHETLA

SEQ ID NO: 1591 - protein, 520 aa, Pinus radiata
MGTLALPPGFRFHPTDDELISHYLKGKLNNGLKEAELEVIPEVDLYKCEPWDLPEKSSLPNTDMEWYFFSPRDRKYPNGSRTNRATEAGYWKATGRDRKIYSRASAIGIKKTLVFYRGRAPQGERTDWVMHEYRLEENDCEAGPCLQNSFVLCHVFKKSELGAKNGDQYTAPVEKDDLSLTKNVRDPLPYHFGDIEVHSEDRSKPVESVDAISSLTPKFSLKILNDTTGDNATLNTWLDIFLDDSNSNSSCVAPNKDTINTQFDAVLDNPRMQCETACLDESEFPQIPVDLSFFRYEVQNGYLDTFFEEERMLEEMSFAASQVYNNSKAYHSSLGDVFADILNGGCIKLKSLMPSIEEMEHHDSGLWEVPNSSLDHVGTGIQISSHSSMLQGHQRGFLFDGTAARVCLQLHKMEDSEERYEKDLSVRKLQNTSNDMYDGNNCSTCGPETQQLHFDQSDGQKCDSHVRKINEKNNRENEDSAPEDLSTDMACEIDGTSSQFYCKFDSNQFYSKFDTSCDVI

SEQ ID NO: 1592 - protein, 695 aa, Pinus radiata
MDQVSLQPGFRFHPTDEELVSYYLKRKVRGQRFSFNAISEIDLYKFEPWDLPGKSCLKSRDLEWYFFNPKDRKYPNGSRTNRSTKDGYWKTTGKDRAISSASKTVGMKKTLVYHRGRAPRGERTNWVMHEFRLEGKDLKMPNIAQDSYVLCRVFQKSGPGPKNGEQYGAPFREEDWNADILGKAETKSSVEMDHISTNDSTLSKTMEEVISYHGENPPLDNEIVAQVDEPAPARSDYDINRILEENPPLDNEIVAQVDEPAPARSDYDIDRILEEWIGNPNDMEPNTDENELVQGNQDWDTLISKETLEHIIVQTEDVEVFNDLGDLFGNINNPVQRNMEDYAGVFHLQDGRGVEERVSTSIDPFISNPHESSPAFLDGSFLELKDLANPVELNSSDLETFDIKDTFFDVSESPDNFAASSIALYSKESQNQNTDLRFLRGKQKMSTEVSEQTHSPTYGYSVLQEAYNVERHPFSSPLGENLGSLSWMQEQWINNASDGFAFSEVDVARNLVPSADYEFMTKRQDASAGMQNLKNHEDSDIGSSSKFASMLASIPARPALAAEYPFKSKYLSLVPKVDSVTVETATNHVAAVSITCACSMVLEPKIKHSSGALLPTCSCGVGNGIVQGSFASSWPASSSIGFKSADLVTPRKTSGGLHAGLLFVFFLGAIAVFVWALLMGGTFILGKYMYKLVIS

SEQ ID NO: 1593 - protein, 717 aa, Pinus radiata
MASSVQAAAVNFPPGFRFRPSDEEIVGYYLKNKVHGNKFEFDVIREIDLYKCEPWDLPEKSILPSRDLEWYFFCPRDRKYPNGSRSNRATEAGYWKATGKDRKVSSRSNNFKIGTKKTLVFYKGRAPNGERTDWLMHEYRLEGTQCKGGTNLQDLYVLSRVFRKPRQGSNDQETFQEPFPIINKTSSPTDGSDGDIEGQSEDASPGKPEDDAPASSRSETSSEILDNKIEDNCIDGPMECPEDISNPNCNSVSHRDTSTKENDDSQRRNQQLQNDPFYSPYEYEFPLIFNNPYSDYSLGTQVNFSVMEPEAFERDFDFGSVSDQDNIDLASMLNSIECEDLYPLLPIIEEEKNDEPCVAGLLTSMPDNGVQIQFRSRSQLSHSNQQPLPSQGTAMRRLRLQIYKTEESANGRKENPLTVNGRSASSDCNSDDSDESEVITQSEDSPLASFPSQISCCSVEDDADSDTIHDSVESSEIVANGHDFNLEPTQFLPSSFFPVEAASEKSDMSVNSKESADKSVLIERTESVMSSACSQSSSTEIQIETTVSHTTSSQEIDSVSVKSSALGMESPTVLASKKALVSEGASSFGSRQLGAISSNHNGVAETQGLGKFTGFNVILTGLNLRGKFREKYVRSDHVEESRNVAQNVSDLCSKDSSKGFSSLRKALGIFIQPFQLQSKMSKGANCIPLICLLSTVFLVLCIWNTYLSARSSSPIIL

SEQ ID NO: 1594 - protein, 866 aa, Pinus radiata
MAPISLPPGFGFHPTDEELVAYYLKKKVHGHKIERDIIPEVDLYKCEPWDLPDKICLQSKNLQWHFFSPRDRKYPNGSRTNRATEAGYWKATGKDRKVTSQRSTIGTKKTLVFYMGRAPFGERTDWVMHEYHLDEKECQAAGLQDSFVLCRVVKKNGLGTKSDDQSVAPTEKNDSDGANNNTLPGILAETFCTGHQSPVLQEGENKSNLKLPSETSSENLNDMNEESVERWLDILLDDPDQNCSITSPAELTNNAKVDTAQEIQEVISSPLNWVQDFNWIPAGVDFNTPGDLEHLQFPNTLETFEEAEIIEEIFHTAQASQEDNIEANSLLLSDYLDEIWGGEEFRDEYHDTSMVQTGNHTNPEVTGIQLRQRSQICQQELPYQGTAMKRVRMQKYPVQHSAIEHQQDGCTAYSENDCIYDLQEQHILLDSFNRQNHNSKNMTPLQDPVPLASARQIDAIREGHSPYHLRGPLANESLGKNRQKAHSGRGVGSSFSRDNCQPGTSSMGFRQANEYKFNFPLHDSVMEGELSASDLADKVTVNHVISSMPPQSLIYGLFLNSQSSEIVDIPAESPNQTMKHEPGNSLEIWKSQQQVLTSLTEDKMPISKINHQTSLSEDGLLSTVAVIKEHEFVPSEDDSETPDQFGEPIKGSSSGEVPDSSGASSKVVHPEKILPAPSSSEPTSVRGWKISQRILKFCSSIPSYAAPVMEYLGRFNPKKAILPSEFACNFGPTDGVTDSAGNMGTCMCTEGNMEHARSNIFLSQLKQRVKPKVKSVMPDSGEESGDAMKMFCHRCADQSNSATLHGLEPPSGVLNGFSEFWNRCAPTSSTSVIVSVCLLGTTSLLFLFLLFRAIWRFSRSVSALIF

SEQ ID NO: 1595 - protein, 869 aa, Pinus radiata
MAPISLPPGFGFHPTDEELVAYYLKKKVHGHKIERDIIPEVDLYKCEPWDLPDKICLQSKNLQWHFFSPRDRKYPNGSRTNRATEAGYWKATGKDRKVTSQRSTIGTKKTLVFYMGRAPFGERTDWVMHEYHLDEKECQAAGLQDSFVLCRVVKKNGLGTKSDDQSVAPTEKNDSDGANNNTLPGILAETFCTGHQSPVLQEGENKSNLKLPSETSSENLNDMNEESVERWLDILLDDPDQNCSITSPAELTNNAKVDTAQEIQEVISSPLNWVQDFNWIPAGVDFNTPGDLEHLQFPNTLETFEEAEIIEEIFHTAQASQEDNIEANSLLLSDYLDEIWGGEEYRDEYHDTSMVQTGNHTNPEVTGIQLRQRSQICQQELPYQGTAMKRVRMQKYPVQHSAIEHQQDGCTAYSENDCIYDLQEQHILLDSFNRQNHNSKLWQNMTPLQDPVPLASARQIDAIREGHSPYHLRGPLANESLGKNRQKAHSGRGVGSSFSRDNCQPGTSSMGFRQANEYKFNFPLHDSVMEGELSASDLADKVTVNHVISSMPPQSLIYGLFLNSQSSEIVDIPAESPNQTMKHEPGNSLEIWKSQQQVLTSLTEDKMPISKINHQTSLSEDGLLSTVAVIKEHEFVPSEDDSETPDQFGEPIKGSSSGEVPDSSGASSKVVHPEKILPAPSSSEPTSVRGWKISQRILKFCSSIPSYAAPVTEYLGRFNPKKAILPSEFACNFGPTDGVTDSAGNMGTCMCTEGNMEHARSNIFLSQLKQRVKPKVKSVMPDSGEESGDAMKMFCHRCADQSNSATLHGLEPPSGVLNGFSEFWNRCAPTSSTSVIVSVCLLGTTSLLFLFLLFRAIWRFSRSVSALIF

SEQ ID NO: 1596 - protein, 347 aa, Pinus radiata
MPQESVTNRHMAKLGTDPQQISWDESLTFDEVAKFFSVPIAEAANILGVSSKVLKKISHDNGIPRWPYRKFLAGKTVEEIKREAVRDKEMNEELSKASNDNNKTVPSSGGPSVAISAQMPTPKPPNLAMQNQSKTGNTVNETGRWQPGVATSGNILQPSGSRIPQAARQPYHSGHRAFISTYLDDFKQGFPKNGLSSVSKKWWGSSGSISKEDAPEDSEISEAKLTSRKFNESSEGVELGTTNENGGRVTSEVDGFLKEGKSSDSESISKLFGHMGSQDEDLMHISILSRTRKRKAENGRKALKLAVTNGYGTYKIGNKDKILLERIFGSPLPRKWKTSLSFSDGTE

SEQ ID NO: 1597 - protein, 471 aa, Pinus radiata
MVGRGAWSSRRRSVDSGSGNSMKSSSKRRVRRGPREGTEEDEETKESEGEEQEHDEEQQQEEEDEEQGEEESENGQVLGEGFYEVEDIRKKRIRKGQVQYLVKWRGWPETANTWEPYDNVKSCADVVQAFEDSYGGRISKPGRKARRKSGFPFSHQKRKRVSLSSADEGAEAEAEVETEAKRAKTSYFGDSQISGKSEVEVEPQQLHGSGVGTVSEQCHPEKDDGAQSHIPEKEGKETEEQNGGKDVTNSVEEEAENKTEDQNPQQEEPTSEDHTKNGPPPSPEDARCAEEKEMAVDESKPDQGAAVNDSSRHIQTTQFTGAKKRKSGFVRRVKQALDSREHELKQGEENSNSQPAKEMFVENSKAQEANAVGNGEEIKSQKPSIAGLHSNANNKSSNSPDSALTLAITRILKAISYNNSTSNNKQDVSVLFKAQRADGQEVVVDNKFLRANYPLLLIDFYEQHLRYSTAQ

SEQ ID NO: 1598 - protein, 398 aa, Pinus radiata
MGADSTRTDYEDGKAVTEEDSSSSPAAASFLLPNWAGLEEMGNGINVVCSQNIRNPSAQRKLPSSQYKGVVAQPNGRWGVQIYEKHRRVWLGTFNSEEDAARAYDRAAIKLRGAEAITNFGTDRHPGAFFLRGHSNSEIVDTTYDEELGNDDTTSLSVYPDIAWSTTTEPREHLFDKAVTPSDVGKLNRLVIPKQYAEKYLPFDKASIHDKGKGVLLNFEDSSTEKIWRFRYSYWNSSQSYVLNKGWNRFVKEKRLQAGDIVTFDRTSRSRRLFITFRHRPHYLLPPAALPPPLARCQLAINPFAAKDYPHSEQLFYAPPTADVQNSAFHRLIPCVPSPNSVDLLLTPKSVSDDGKPSSLAFVDHQRSSPSTDGNCDSSSVWLFGVNLQPTPLTFARA

SEQ ID NO: 1599 - protein, 468 aa, Pinus radiata
MEKSPGGPKRTGSGLSVVTGSGGESDEREDSRRYLISTEQARRLPSSQYKGVVPQPNGRWGAQIYEKHQRVWLGTFNREEDAARAYDRAALKVRGRDATTNFSPVGEGHPEAQFMREHSKEEIVEMLRKHTYDEEMMMTVDRCATMDNSEASREVIGSGQGRSCEENKEHLFDKAVTLSDVGKLNRLVVPKQYAEKYLPLNVNSSERGMLLNFEDYTGKVWRFRYSYWNSSQSYVLTKGWNRFVKDKKLEVGDIVSFHRGSVQSDHLYISWRRRPSGRPRLAVNPQSHESNVRVVKGSCSLNPFNSGNQSAVVYNAQWMPVFWSSSRNPNALLQFNSKSIFPLINKFGHVDTLWSESHRVFPFYCSSPPTKDTDMNLKPLPSVDQNLNLQESVNSGDGSDIKPPNSLVSPPVLSVAQELDLDLDLDTPEQKPAPYLAPATTKGVRLFGVILTETQRLSTQRQGQLNLP

SEQ ID NO: 1600 - protein, 190 aa, Pinus radiata
MDEVQVKVDIQSTNVSADEPRPAKRQGFELAKSPENVASKSTALSSPKKPKAASSSSSSSPRAQPPACQVEKCAADLADAKEYYRRHRVCEQHSKARIVLVLGLQQRFCQQCSRFHVLEEFDEAKRSCRRRLAGHNERRRKTPSDSSVDRLDSNHHLNDNWLRHMKETDKMSIVLERNTTAKVCKEIKNH

SEQ ID NO: 1601 - protein, 323 aa, Pinus radiata
MQTSRGHNRPCMSSHNTDRPKPRNLRMTSELVEGSLESASSRNSSTLLDSPRLYWQDQFVDPCSMWTLGYSSDHTTLEQPSGVIEKRGKLVHGCYFMKEEKGLFPARMELNYSGPGSTAYSGGASEETCHGNTFCRTEISSFTGSQIPQCQSEGCKANLSSAKHYHRRHKVCEFHSKAPTVVVGGQIQRFCQQCSRFHQTSEFDGGKRSCRKRLADHNRRRRKPKPSQCTTSQCQAGTTNLQDDDKKTKGLSGHAAAGIQIIPNMISSTNTTLPLITSAPLLSSGTMMMFPNNYRGQIPVPQGTSNDKTSCVEFLHANIPQMV

SEQ ID NO: 1602 - skipped

SEQ ID NO: 1603 - protein, 550 aa, Pinus radiata
MKITSSPTPTWEWDNGENLMLFPGNGNGSRKATVNSKLKDEPKLHDAAAGFLRVQSVSEDGNSSPGEIRTSDASTPDDQQHHSGVVTVAVPAGSGDSGAIGLKLGKRTYFEAVKAIPGPAPSASSCGPAAKKQRSAMQGTHMVPRCQVEGCKTELTASKDYHRRHKVCELHSKSPKVIVNGIEQRFCQQCSRFHILSEFDEGKRSCRRRLAGHNERRRKPQPDSLAINPARFASAFYDDRGLNSILMDRSPFMHQRITSNSILEDSIDFKLGGYGKGAWPRVKAEDESSYDGQVSAGTVSHHNADRLLFFLQSSKTVPGGPISQDVHQYMQSSGAHAGQALTLSSSSGENLAGLDVVSATHGLSGVSDSGCALSLLSFQSGGSRASGSASFDMTTRSGLTMDQLIQGDQPLMAQPLMQGVQHNFGLFGADKLLTVCSQSSTNLATGGFPATVVNSMDKQHQGEPLVSNAGGIGNFGGHVFGLLQGSNFRASQAASSQDIQGTIDLMRRSSETQNDSHDQHGMVHQGRRQFTDAQLLRSFESSIYDTHQLL

SEQ ID NO: 1604 - protein, 630 aa, Pinus radiata
MNPPESTENEGDQISWVWDHSQHHHHHHQSHQSHNHNPGGGASGVVAAMSIGLETRQFQGGGGRVLEYDWGSSPVLLSGGQGIPAQDTEERKPQIISAAAAGSVMDTIQYSGNGNGNVNLAVNGMLSSGFGHNIISPNSMGNLLMSSSSAGTRNTYGGHNHHQQHHHHHNNHHVLDSIRSSAPSPLLYSGGNSALSGFGSGVYADSTRAALEEHRNHILGLMGMDQKNVFHNIVKREDLCGAGDFQTRIGLNLGLGGRTYFSSEDNIVNRLYKRPRAISPGSQVPRCQAEGCKADLSTAKHYHRRHKVCELHSKAATVVSGGLTQRFCQQCSRFHVLSEFDEGKRSCRKRLADHNRRRRKPQPNAVVTVSNTESSSALKTTDQDQDTNSGSNQSSLQQPEVQISRSEPPGLLTGISLSQSLPLVLQTSKGQEQYLQQTGPNLSLGGEIALDYPRHSSGGENYNGLEIPIPWLRPAGSGSEFGGSEKNSSNGQLSESGNGGGSSSTVQVFTSIQNLLPLQSSTELGTSEWMVNGNLSGSSSRGQHYGSADLNLQTSLEGQQMLSLLEKDVRSSNTDRHNTEDAVEYFSQQQGLNSKNSIDGHSEHRNQLSSSFPGIQSLRTLSQSLYQNIL

SEQ ID NO: 1605 - protein, 939 aa, Pinus radiata
MADLLDDPVALTLDAGDWEWDSVLDFSPGSFPGHILPWQSEELSDERLLTSQALEVQQVREVQNASPRNQSHDAEEDEKEAASGRIRKRDPRLTCSNFLAGRVPCACPEMDNMEEELSRKRAKVVVLRCQVPSCEADISHLKGYHRRHRVCLGCANAAIVVLDDVPQRYCQQCGKFHLLTDFDEGKRSCRRKLERHNNRRRRKPVNVVEGSVQQQTLRAESALQNADTEPHNDGKSGQASKSFSSLGCGEKQASSGSEEINISEVEQPYKGDLSLKNVGSKSADVSKVTSSMPVNVSTELEGKLLPERDMGNGEKFNDQDVRVVDNSQAILCVGPQNGDNGSTYAELNEQSYTGMPMEESSRKDRFPHNASGRSERDEGAGPLQSSLSSNRHDKHFSYASVCPTGRISFKLYDWNPAEFPRRLRQQILQWLADMPIELEGYIRPGCTILTAFISLPQFMWEKLSANSPGYIHSLLNGSQSILLDKGNMLVYLNDIVMQIKNGEACLVNTKMDMRIPKLHSVHPIFFEAGCPIEIVACGRNLFRSKYRFLISFHGNYIHYGTCEAIPLGNPSSCFRSKENIFHPSNHESFKIFIPSTDPRLFGPAFIEVENEYGISNFIPILIGDKQICSEFQMLEQELVKSGFCSRSNHGLAIGSSSSDICEQNLVKRQSILELLVDIGWVLKDPESDEDKVPVNFLHIQRLNCLFSYLINGHFLAITEKVLHSPKVVKMLRQVYGKSNEVNGADMKLLQNYVEHAWQSLRKQRDYKGTTDFQSFLDNVVLQGFPPPLTIATLSCNQQRCTVSHENQETERLLKIQPEIRPFSEIESSDTRVLSVEENNMLTPLLEKECSSNIAGDLKYNSTWRGPKIEVAEYTRKMKVCLKGDIRVDRRIFILAITVISVCAGICVVLQHPPQVMEISMSLRRCLFGLRKAREDISHP

SEQ ID NO: 1606 - protein, 1024 aa, Pinus radiata
MDGKAGPQVATPFFQHQLLSGPLYEPSLGAKRCVEPADSSWTRTNWQHQQQQKSPPVYEAPKPNWNVNVWDWDSVRFIAKPADLANHREPNPSNIKPQASPEILRLGSNDIGSNVVNGPSFPDQKRKLDEPPKPFLPGKDSSENDPGNLTLKLGGSSYSYADDTNPSRQNKRVRSGSPGSAYPMCQVDDCRTDLTSAKDYHRRHKVCETHSKASKALVGSLMQRFCQQCSRFHPLQEFDEGKRSCRRRLAGHNRRRRKTQPEDALPRGLLAASQENGGLGNLDIVSLVSILSRLQGNNSSMEKSNGQSSLDGDQVVQLLNRMNSSFPSSQKVAPPSEGFDLNIAQNLQSPRSEVPKANGSPSTGLTTELLAILSALTGPSHDALALLRNSLATNLKGNLKAHHQNVLPPSPTPVAQQKPQERDIQNQKTNLIVDSGANNRKINATYQDNSRTHLPLRLFNSLEEDNSPPNAFTRKYFSSDSSNPTERSPSSSPPVVQNLFPLHSGDESRENDCVSVCKEDNLTLETSPSNDRCSAYELSKLESRVHNQNFMSGFLHQSLESRTAVVQPSYTSSSGSDQSPASSNSDSQERTGRIIFKLFGQHPSNFPVALRAQILEWLSHSPSDMESYIRPGCVILSIFVSMPSANWERLREDLPQRLKLLVEDSRTDFWRCGRVLVQAEQRLASSNDGKVRFCSSWRSWDAPEIYFVQPVAVVAGQETTITLRGHNLATTGTKILCAYRGKYTSIDVLPEEEASECIPTDSRVQKFTFSGGPPNVLGRCFIEVEHGFKGNCFPVIVADPIICRELQSLESEIEIEFSSDKTSSIKVERSQEHFQGYSAATARDEVIRFLNELGWLFQKSSERQAELNVVKDASFLEFSSDRFKFLFIYAVERDMCALLKKLLDIFFEMNAGQEASAPESSKNLLESNLLHRAVKRNCKQMVDLLLNYAPSPNNMNLLQTKSFIFPPNLTGPGGLTPLHLAASIRNSEPLVDALTSDPQDVGLQSWSTALDSSGQTPHAYALLR

SEQ ID NO: 1607 - protein, 353 aa, Pinus radiata
MDAERIGLQGSSSIAEDLETISGAPISSSCTGNDLQGTNQQGIAKKKPSCKDRHTKVDGRGRRIRMPAACAARIFQLTKELGHKSDGGTIQWLLQQAEPSIIAATGTGTSPASAAAMAGSIGELGINVLTDSPHGSLGLTVRGCGHGDIIMERRSLLQGAGVHEAVGRYQNEGFVQKGIQLGHMQQDAELSERRALSVNLSVASRHFSMQQENPSEGLPHIWADSPMYRITPPPPASIQAGAGNLTCSNPMTPLTTYMLPSALNRMPGMNLSGLELQTGHMGHMPLSAMLQGSHHEQHLLGVQAAGEGQIGIIASNSAYNNSVRSITQDYQHHHHHHYPHAASGQDHSYDQNQ

SEQ ID NO: 1608 - protein, 448 aa, Pinus radiata
MVTMDGVSGIGPPANSPSSSSAQQTDENRSLTLITGVSQSVEVKQEVQREGDLKDQQQSIVKKTPPKRSSTKDRHTKVEGRGRRIRMPATCAARIFQLTRELGHKSDGETIRWLLEQAEPAIIEATGTGTVPALAMSMGNSVRSSAPSTMASSSTIRPLAMGLRAKTEWDESEDKKNVLDRTRKISAGPDASGGSRIVQEGQTMEGGSVKKRARGLVVKKEHDPLTASAPINAVPAKPAPTARQTPLQPPPQAQAAPLSQNTTLPQASGLMSMWAVAPDRAGSMPGAFWMLPVTASSASAPGIVGGGPSSQQIWTFPSGSVGPMYSMAAAAAGAAAPSGSNNPSSITNPGVMPLTSVLPSGMIMPRLNIPGGMGLEFPGGHLRHMPLTSMLLQDTSQAGTGLGIGAEGHLGMLAALSAYNKSTKSEHQFMGSSHQQQGESGDDPTNSQ

SEQ ID NO: 1609 - protein, 457 aa, Pinus radiata
MVGYNVQNTAANRQNQDDHGRSGLGSSGYLQAQAALVASSQVDSSLAMSAAKLYSNSESTAIIIPKSHEQQKTGGGGGGGVAVTEDAAKKPLAKRSSTKDRHTKVDGRGRRIRMPATCAARVFQLTRELGHKSDGETIEWLLQQAEPAVIAATGTGTIPANIASLNISTRSSSSSISAPLKPPYFHSGSLTLNANFAARLDQQIRSRNEWERVQEERSGMNTGLGIGHHHHTDSSGLTQALIHEQNLINDRAEINDLMNSDCGNSRKRLREEQQQQQFKNMQPMWAVTPATGLSSSGQNMPGTFWMLPPTPGVMGHAGPGSDPIWTFPASSGGAMYRTSMSSGLHFMPRPINLNSSSTSMGHVQFGSMLMQGPAGSGSGSGGAGGGAGSGSASQQLPQTGLGLGGGGGSNETHLGMLAALNAAYNNRSMNNNSEHQSMGSSGHNHADSGEDRRDNSQ

SEQ ID NO: 1610 - protein, 538 aa, Pinus radiata
MWCSLRMEITGGIFVELWEPDERSDRGKSEQRDSGGCEISELGGLQRSLVQGYHGSPASSRVMEAQHPGLQLGRGSLVQAMQAAMAGSNRIEGGSRALGAYRDYSGKERADQQMNAASVALVTVSRAVEETKAAVAPQVQNAVVAATSSGAASEQGGEIKKVPPKKPTKDRHTKVDGRGRRIRMPATCAARIFQLTRELGHKSDGETIQWLLQQAEQSIIAVTGTGTVPASAQNISGSMRSSGSMVASGRPSTSYGPMGLALRGAGSEPDMRDNSEMAERRFMEGLAGASLGFHHEGFVMGSVPPGKGEQQSVGHMHDESERGTGFLTSATAGSKYGPGSTSLSSQAAGLMPPPAAAAALWTVAPTSSRSPTIWMLPVTAGSSSTPPSSVALNQSQEQLWTSGYRLAAPASTSIHLGTGRGGDHNNLQSSSNPMMPLPTQMLPSGFTLMPRINLSGLELQTAHLGAHMPMSSMLLQQGSPQHPGIGLGLGGEGPYGIIAPLGAYNPAGRPMSSPDQYDHQRAQQQQDTSNDDQQPGQQ

SEQ ID NO: 1611 - skipped

SEQ ID NO: 1612 - protein, 429 aa, Pinus radiata
MYQVKKFSTSGMTPQRVQGHQQRGSGPSDVSSNSDGSPVTACGGGSAKQRLRWTTDLHDRFVEAVGQLGGADRATPKGVLRVMGVQGLTIYHVKSHLQKYRLAKYVPEFREGEKSDKRKAYEVIPKMDATSGVQITKALEMQMEVQKRLYEQLEVQRQLKLRIEAQGRYLEKIIEEHQTGATKCQAPSSPESSSHFSEELHGNTKGFLHDSEDRAQNDSQLPASRSSGAMTMTSSNISQKVEHPVISSAIMDKQQKIPSFTYSGYDHVSCLANPEFRSPSKRIRVNDSIGQVKQETFAGQSQDQQQLPTNEYQKHLSVHTTGELSNPNYQSRLACSTGHVESPGSVHLSSESQPQHSEGGRYSEEVYQKQSAAKASLGFSPTESQYRIPTYLQSMNSPFLSQSEFSSALDSMDSHQNMPLQARLFQSWM

SEQ ID NO: 1613 - protein, 242 aa, Pinus radiata
MEEPLQIINSSPIQQQHDHDDDDHGHGHEEEVIPHPLLPPPGDTCIVPYIMPVSTSTAEKHPPQPTNIAFNGPETEEDDKKRDREHKKRSKNWTRVETLKLIKLRTEFEPRFSRSGRKTELWDEIAESLRKEQFFRDAQQCRDKWEKLMAGFKDVREGLKDRNDNPYYEDLHPLLSGKCLRRENLKKEGDSTHNEKWDKLMAAYKDVIDGKREEGDLSYFVELRAIVGGRPDEGKVQIESMP

SEQ ID NO: 1614 - protein, 289 aa, Pinus radiata
MQGDNMTTVAALPLQSPSMEAEMNQAQLKRKDDRIPQWGHQETREFIAIRAELEKDFTQTKRNKTLWEIIAGKMKAKGYRRSAEQCKCKWKNLVNRYKGKETSEPDNGRQGPFFEELDAIFKERERNMDRLLLESKAGMKPKEKVKRFKRLLGEKSSDDYSEDEEEEEDESEDEKITKRKKSKADKERQRVTDRANSMQEVLEDFFQQQQRFEEQWREAVEGREEERRLREREWRIAMEKLEKERAMKEQAWREREDQRRAREEAWAERRDELFAALVNKLTQEERSHI

SEQ ID NO: 1615 - protein, 318 aa, Pinus radiata
MMMGGGGEVEGMGLGVMAALPLQLTPTVAISSGDHLGGPNSSNVVTNNGGGGLGSSLKKDDRIPQWGFTETKEFIAIRAELEKDFTQTKRNKTLWELISSRMKEKGFRRSSEQCKCKWKNLVNRYKGKETSDPENGRQCPFFDELHAIFTERANTMQRLMLESEGGNNQPKKKLKRLKGLQGEKSSDEYSDDEEDEEEDSEDERIVRNKKRKADRERQRVTAEKSRANSMQEVLQDFFQQQQRIEIQWREYIERREQERRLVEQDWRQAVDKLERERILMEQAWREREEQRRAREEGRAEKRDALLHTLLNRLIREDL

SEQ ID NO: 1616 - protein, 322 aa, Pinus radiata
MEGSHHYVSHFAKTQQEEGQPASSIEEMDPTLQEAVRLSSSHSTRLQVAPRWTLTEMLVLVREKWAVENELQLSPSKSQFSGVSDKWSIISNRCAASHVQRTAGQCRKKWELLISDYKKIKEWERQCGVESYWNLSHSAKREHKLPFYLERELFDVMDANLDKTPTACPDATFDSMDVAADSLFTSNDDSQDEMVKMQDPTASGSGNEPLDSTVRHKRRRCSIEDDREHDIISVLRENCQNIQAVIRETTQAQMCSSQLDRDMYWKGIEVNKQVQLQTSELDRELKRKQGQDLIDVLGGLVNAVNRLVDTIQNKSSQQLNGP

SEQ ID NO: 1617 - protein, 349 aa, Pinus radiata
MEVVTNGMQLQAQVQQHHHHHHMLLSSDINGEDHEIKTTPKKRAEVWGHDEIRALIALRREIDGLFNTSKSNKHLWDKISLRMRERGFDRSPTMCTDKWRNLLKEYKKAKHHHDSHDGSAKMSCYKDLEELLRERAKAAPYRSPNKVADLDSYPHFSPKGTGRSPFNMERRLDHDRLPLAMPLSDATAANGTPPWNWRDAAGNGGENHTPYNGKVILVKWGDITRRIGIDGTAEAISGAIRPAFGLRTKRAFWLQDEDGVVHSLDRNMPLGTYILCLDEGLTIKVCTYDESDSLTCTTEEKTFYTEEDFRYFLTQRGWSGLQEVGGFRTVDSLNELCPMCVYQRAGPLG

SEQ ID NO: 1618 - protein, 350 aa, Pinus radiata
MLAESFSEGLCIPPMGPDDPNGVIHKDEISEQQVNHSMATVADVICLPSNQEPRDLIPHEVRGKRKLSSEHKGRVRWTSSDTLVLVNAKLVEKNMHSAGGAIKRTKSAIEKWRTISAHCHDNGLDRNATQCRDRWKHILPDYKKIRHYERNIPPGHVSYWNMTPKERMDKRLPTNYTKELYDAMNKHFGQKGNDVGDMIIDTSASDHGTFEDCLTPAKNVIMHENTMPETPLQSPGDTSTDRDKQYPGKKRKSSSKTAGIKATLSENNKMIISNLKMAEEGRMKRHEKYCNLFERRMEMDEKYLNHHAMNVQRMINVEEQKVKAQRDLVSALNTIGQAMLKICESLDTKG

SEQ ID NO: 1619 - protein, 360 aa, Pinus radiata
MEAIPNGVPPLPLTMPFQQQQQQQQHHMVLTESSGDDHELRAPKKRAETWVQDEIQNMLAYRKELESLFNTSKSNKHLWEQISQRMRQRGYDRSPNMCKDKWRNLLKDYRKLRHQQKPDTPKVGYYKDIEDVMVERAKHTPHRSPVKYESTIQMVPKDFDRPALNIDQRLDNDSQTTSLLSHESPLANGMSPWSWRGDTSANGLPQWNTGMDRSIPAGRVIAVKWGDVTRRVGIDGSAEAIKDAIKSVFGLRSKRAFWLEDEDGVVRCFDRDMPLRTYNLHIDPGVTVKICYYDGSGRPTVTTEEKTLYCEDDLRELLARHGWQALREVGGYKDIDTIEELQPMCAYQQGGLGLYMPKVE

SEQ ID NO: 1620 - protein, 368 aa, Pinus radiata
MYLLDNHRQIEEDGEERDIIMEVVTNGLQPPSMHSAAQQQTQMILADSSGEDHEVKAPKKRAETWVQEEIKALIALRREMDSLFNTSKSNKHLWEQISLKMRERGFDRSPTMCTDKWRNLLKEYKKVKHQDRGGGSAKMSCYKDLEELLRERAKNAAYKTPPAAAAAKMDTYIHFSPKGSGKSSLNLERRLDHDGHPLAIASVDATAANGVPPWNWRDATANGDHQTSYGGKVIVVKCGEFTRRIGVDGTAEAIKEAVKCAFGLRTRRAFWLEDEDGVVRCLDRDMPLGTYILHLDDGLTIKICTYDESDRLTGATEEKTLYTEEDFRDFLTRRGWSGLQEVGGFRAIDSLDDLRPLCVYQRAGLLGE

SEQ ID NO: 1621 - protein, 374 aa, Pinus radiata
MTEFLPRPNYAAMAVESNGFAFKSPPDLLLSSPRNPNGKASANEAKIPAGIPKPHAISKEEATANGSSNPSIVDHAGGDGSDGQDKTPRLPRWTRQEILVLIEGKRVVESRGKKSRVTVDGQNGQVNTESKWSSISSYCKRHGVSREPVQCRKRWSNLSGDYKKIRDWENSHVELQSFWAMRNDIRRENKLPGFFDREVYSILDKFIGKQDGSKEAIRVMQEPIFDSGRPCGGGEDTLFSDFEHSAEEEVAGSPEKEAAVMLDSPTTTAATPPQPHRQGVRTEKVPTPVAEKGTTSCASGQKRKRTSSEGESDSDLKDQLIAVLERNSRVLSAHVDAQNLNCQLDRNQRRDHADSLVGVLGKLADALGRIADKL

SEQ ID NO: 1622 - protein, 423 aa, Pinus radiata
MSDGEEEKKKINSMALVACVPPSSSSTDAGDPSLLQNATFGRMSTGIFPETEDEKKQRQQQHKKRSKNWTRQETLRLIRLRSEFEPRFARSGRKSELWDEISMALQQESICRDSQQCRDKWEKLTAGYKEVRDGIKNRQDNPFFDELQPLLSARGAAAKVKDGAEPAAVGVTNGGDSKTDEEEGHGEGEGEGEEETEDGSPPGKRRCRYWTGTGTNNLDAVLENLFDRQQKFFRDLLDSMERREQMREQIRQEKEDRWRAEERAQRCSMSEAMIRLSRKLLQQQSQEFTAHNGVGVVSVTTTNNNSGGGNPKKRSKNWKRAEVLRLIKFRGEMETKFMKSSRRAALWDEVAGLLAREGIRRDGKQCREKWDKLVAEYKEVVDGKRDRGESPYFAELTPIVGRPPAEQQVLHQQQLQIETTATS

SEQ ID NO: 1623 - protein, 691 aa, Pinus radiata
MQIGEQYGLAELQQLMAGRGHMLTLAQEMPPEIQLQYHHHHQQQQAQQQQFQAAFHQRQQIEAHHQQQQQNHGNRVYQASSHPLQHEENRQNHHSYNHHVHQRPGNNGIAQQLSLSSDSPRPPSLSVSPPSKRTISPPGIISKQQQPPPVNVNVNGVPRDQQTFEDYDEGFDEGDRSGSGGNGRWPRQETLTLLKIRSEMDSKFREATHKGPLWDEVSRALAEHGYQRSSKKCREKFENLYKYYKKTKEGKAGRQDGKHYRFFSQLEALYGGTTIDAADSCFGVTTRTNLTESPGLDFNGDGASQKYADTHHNSEGFSLSSDSSSDDEYSHDIQENHIISRGKRKRKSWKSKMKMYFDAQMKKFMDRQEAWLEKVLDTLEQREQERVSREEAWRRQEAARLEREHQLWSNERARAATCDAAFISALQKITGQNLQLPEIFTLPPPQNSMNPEAQDQLDLVNREKETYDPNNKRWPKPEIMSLIRLRTNMERRFQEAGAKGPLWEEIASNMSRLGYDRSAKRCKEKWENINKYFRKAKDSNRKRPENSKTCPYFQQLDSLYRQGALGFSNGGSSTTATSTSTKLSNPPDGVHDQTTTDELVLQPCTSSHENDEHREAVEILGQLMPSSEGGCTHNNINNDNNNNGSNGHPTPGASSNNNNCVQFFSGAAENGCNWEGYPMKLKIKQQQQQQH

SEQ ID NO: 1624 - protein, 721 aa, Pinus radiata
MKEKGEGSEIIQAGRPQQFGLPQHQSDSMLPQFLASLTKESPHFQTSQTYENESQQSRDQTPLQPTTADTKPKDIGEFSSDLPHLVASPISSRPPAVTGTDVVFKQAIHGPDENNNNNNAADLGDDDAFGGSGGSRWPRQETLALLKIRSEMDAAFRDASLKAPLWDEVSRKLAELGFHRSAKKCKEKFENVNKYYKRTKAGRSGRQDGKTYKFFNQLEALYGNTDDTAIVDNNTSRINNIMAASVSSREFQATPSPPPPPAAVTTNRSEETQVPEEKKPPAPTDLSPMSFSTESSDETHDDNNISETRSSRKRKRITTKKMMRFVEKLMERVMEKQEMMQQRFLEMIDKREQDRMIREEAWRRQENVRLSRESELRSQERALTASRDRALIAFLQKVTGQTLHLPDQFPVNSQPLSPALPQQIHPRPEEINKDNNDTDSLDPNSKRWPKQEVHGLIKLRSALEPKFHDSGPKAQLWDQISAEMAAMGYHRSAKRCKEKWENINKYFRKAKESNRERPGNNNTCPYFHQLDALYTKGILRYSNSEKFNRTRDQDQQQEELLEQTTCGSSRDDQSPGHDGDNEILAIMPPPSITTAPPASNFFSTDQPDGHVNGSQAPAPMKVMFSSVSEGLLGNSPPKPDATTIMMFQNSSQSAPPLSTTITVEDDKNKHEKQADLDLPYGVFNDRTVNSASNVSRDSSSTFMAMVVDPPQFNIPGSSHAD

SEQ ID NO: 1625 - protein, 408 aa, Pinus radiata
MALKYIIQEMRDGMESISRRSFEIKLYRGRSQSSVRDEMVQREAETEKDEEQQHVNWSNMLPELLTEMIQRVEESEGAWPGRKNVVSCASVCKSWRDITKEIVKAPDLSGKLTFPSSLKQPGARDPPMQCFIKRRKETSTYYLYLGLTPTFMENGKFLLAARRFRHPTSTEYIISLDADDLSQGSNAYVGKLSSDFLGTKFTIYDSQPPHNGARLSSNRAGRRVASKQVSPRVPAGSYNVGQVAYKFNLLGSRGPRRMQCLLHSVQFSTMEHIGKVSTCKEVSDSTIDKSISTLNGEGSSKFSESSDIPVGKCAPIILKNKAPRWHEQLQCWCLNFHGRVTVASVKNFQLVAAIDPSRPGAQVDQDAVLLQFGKVGKDMFTMDYRYPLSAFQAFAICLTSFGTKLACE

SEQ ID NO: 1626 - protein, 412 aa, Pinus radiata
MSFKSIVRDMRNGIGSLSRRSFEVNLSHIHRTKSQSAVYEEQIHASPVQQSCWANLPPELLHDVIQRLEASEETWPARKHVVACAAVCRSWRDISKEIVQTPEKCGKLTFPISLKQPGPREVPIQCFIRRDRAKSTYHLYMGLTPAMPAENGKFLLAAKKIRRTTGTEYIISLDADEISRTSSTYVGKLRSNFLGTKFEIYDSQPPYSGATPTSGRTSRRFYSKKVSPRVPSGNYNIAHIAYELNVFGTRGPRRMRCTIHSIPASAIEDGGSAPTPSELTRSLERSFSSSFSNAMEKIVEFSSSSLTEVPVGSQSKGGPLILRNKSPRWHEQLQCWCLNFRGRVTVASVKNFQLVANKEPSPPVTQSDPDKVILQFGKIGKDIFTMDYCYPLSVFQAFAICLSSFDAKLACE

SEQ ID NO: 1627 - protein, 411 aa, Pinus radiata
MSFRSILQDVRDGIGSISRRSLDVKFSYSLRSRSHSAVHDSHYRSQVSLPQSCWANMPPELLRDVISRIEASEGAWPARKYVVACSGVCRSWRAITKEIVQTPQLSGKLTFPISLRQPGPRDFLIQCFIKRDRATSSYHLYLGLTATLSENGKFLLAARKSRRPTCTDYIVSLDAEDMSRGSNRYIGKLRSNFLGTKFTIYDSQPPCTGAIASTSRGSRRVGSKQVSPRVPAGSYVVAHIAYELNVLGTRGPRRMQCLMDAVPASAMEAGGSAPTPTECPLSSLDSLATLPHLGLKSEVIETSFFSGPIINSNWKEGPLLLKNKAPRWHEQLQCWCLNFKGRVTVPSVKNFQLVAATEPTQPAAQSDHDKVILQFGKVGKDTFTMDYRYPLSAFQAFAICLSSFDTKLACE

SEQ ID NO: 1628 - protein, 418 aa, Pinus radiata
MPPIKNIIQDMKGGIGSISKRSFDVKLSYNRRSRSHSHGVAVTSGDENHCKTAADVLHESCWANLPYELLRDIIERIESSEITWPARRNVVVCAGVCRTWREIIKEIVKPPLLSGVLTFPVSLKQPGPKDSAVQCFIKQDRTASAYYLYLGLASTICENGKFLLAARKFRKATSTDYIISFDGEDMSRGSNTYVGKLRSNFLGTKFTIYDSQPSHSGGVATSHAGRRVGSKQVSPRVPASSYNVAHIAYELNVLGTRGPRRMQCTMHSIPASVVEGGLNTSTFEIPSSTLVEPLASFRSSRSKSVISESNAFSGPLNSGNLKDDPLILKNKAPRWHEQLQCWCLNFQGRVTVASVKNFQLVAATEPAQSVSQSDQVKVILQFGKVGKDFFTMDYRYPLSAFQAFAICLSSFDTKLACE

SEQ ID NO: 1629 - protein, 418 aa, Pinus radiata
MTVKNIFQDMKGSIGSISRRSFEVKFLRSRSQSAVDDLHYRSNANNKNNSNNGGLQCSLWANMPPELIRDVIQRIEESESSWPFRKSVVACAGVCMTWRQITKELVPIPELSGKLTFPISLKQPGSREPSVQCFIKRDRATSTYQLFLCLNTTLSENGKFLLAARKFRRATSTEYIISLNADDMSRGSNTYVGKLRSNFLGTKFTIYDSQPPHSGAIASTSRAGRRVGAKQVSPRVPAGSYNIAHIGYELNVLGTRGPRRMQCIMHSIPASAVQPGGSAPTPVEPSVASLDQSLASCPTFGSKSCILESSSISEPLTGSNLKDEPLVLKNKAPRWHEQLQCWCLNFKGRVTVASVKNFQLVAAPEPNPSVSQNDCDKVILQFGKVGKDMFTMDYRYPLSAFQAFAICLSSFDTKLACE

SEQ ID NO: 1630 - protein, 250 aa, Pinus radiata
MDNWGSNGDNVENSQCGDKGLDSFNSLLWYNPLAANALSALNQQLNVPVEGQAQGQGQKEAWTQFVVEDKAEMKTEWIANSPVAQSIRSQEDQQSEICNVEEHVSEISDNKASVEGDIVDSKIIKKRKIKTEKGPRYAFKTRSETDVLEDGYKWRKYGRKIVKSSPHPRSYYRCSESNCSVKKRVERDPTDQGLLITTYEGTHNHESPSVIYYIGKPIILPQQGSKPAIVLVNASLCPEPVIKYASHQAL

SEQ ID NO: 1631 - protein, 280 aa, Pinus radiata
MPESYGQINPFVSAECMQGYFLTRPQHELVHSMNSFQETFHERNGVQEGGLQPSNFASQSDNSDYCFLRPGHLKLSGEYSAFSNRVSQDQALLINSTEFNDTQRGMISSPLGHAGDQVNFSCTDTISHMEYRNNLPEISLLRSTDDQSFESSVPDNAKRTEGLKNLSNLWWGSSSSCDVKMKKVKVRRKLREPRFCFQTMSDVDVLDDGYKWRKYGQKVVKNTHHPRSYYRCTQNNCRVKKRVERLADDPRMVITTYEGRHTHSPCSDTQSEQHDFLSSL

SEQ ID NO: 1632 - protein, 343 aa, Pinus radiata
MEGNMNKMAKLVADINHLKEKNQRLNSKLKRMISKYNDLRKHIGLLMQQRRGIDGSQVCNPDHRIKDQVCAKYFTGSDHCWEQGEEKEKKKAKFMEDQQLHSKKTKIDDNPCCDDKLTKNQNQVLSRSSGEEAVAAPKRIVSVQTTSVTSLVSDGCHWRKYGQKMTRNSTLPRSYYKCAMVPGCPVKKQVQRCAEDPTIVITTYKGEHTHSLSPLAIAVIHASTNQPTTCTSSPTITLDLADNQLNPAFYLHPAHLTAGSFQQLTPLSSDMGQILDNQSQVGQSAIMESVASMKADPNFTKALAVAIAGSILKLGSPIEGMPQHPPPTHYTNDSTTSVNTSVE

SEQ ID NO: 1633 - protein, 344 aa, Pinus radiata
MLMENSDKFLSSTLEVNLSIQEAVRSGLQSAYQVLNILAKQNQQCPFEKIQEDFSWAAEEALSKFRKAVSLLGRTDHIRIRKSPVLPVSGNGEPFIDAFNVIPPLNSNPVAHHVSSALLDVPSHAPSDLPILQKVRQLFFPTNGNNPQLAGHQAQNNFSEVDIMLKNNFRIFENSINCTGNLPQSCTKSFVSSVSIESSVGDDRHMTLQYPLAVSNEVTPSLYFKRKCSGKGDEPGGKCSSSGGCRCSKRRKLRIKRTIKVPAISSKLADIPPDDYSWRKYGQKPIKGSPHPRGYYKCSSMRGCPARKHVERCPDEPSMLIVTYEGEHNHSRILPGGPNLVLHT

SEQ ID NO: 1634 - protein, 347 aa, Pinus radiata
MAVEMLDSRNFMDRDVHQAASATLESVQNLIQLISRHREMQDERESQCGSAAEMAANRFKRVVSMLGTTTGHARFRKAPAGTSVPAPKISPSFEHGHANMSAAAAVASCSSQEPLKDSEGFISPAPLNNNTLFRPTPLHVQAPAQNPVMDSSPQQPKISLVPVNSDYSFMGSRSFKESVISSPPLSSTNSFISTLTASDPCDKTSILVRSLSPTAVGRPPLSSSKKACIHGKPDDLSGKCNTTGGRCHCSSKRKKSRVKRTIRVPAVSAKLADIPSDEFSWRKYGQKPIKGSPHPRGYYKCSTVRGCPARKHVERALDDPNVLIVTYEGEHSHSHSGSENTGLVLDS

SEQ ID NO: 1635 - protein, 347 aa, Pinus radiata; identical to SEQ ID NO: 1634

SEQ ID NO: 1636 - protein, 364 aa, Pinus radiata
MASKLYMKQRIMDPVNISLSLNIQRDCDVQIMSRAGLDSAQRMVSILSQKHQQNQQEQVQQEFVLAAEDALSKLNKVVSLLSRKGHARVRRGPLQTQSASGSGSEQLFMDGPNFLDLESPKTHASASIYSSSSSDFALSQCVKQFLPCQSSSSGVLSADTNRHQQLHPQMHYPPLQLQHLSPQAEVMFRNGYMQLDNSMSCTATISSTKSFMSSLSMDGSIANDKQLLQYQSISAAQERIPGASSKRKCSGKGDDSSKCGSTGRCHCSKRRKLRVKRTIRVPAISSKLADIPPDEFSWRKYGQKPIKGSPHPRGYYKCSSMRGCPARKHVERSLEDPSMLIVTYEGEHNHSRLLSSNSSLIVHP

SEQ ID NO: 1637 - protein, 367 aa, Pinus radiata
MGSRIGSGLMSTDVDDFAGFESPYMSFTQCLQAGLQMGEADYSALSKSLACGELGDHEQQQQQPEFPEYDQEIKVQANCKSQNPSAIQLGPSMAEAQVGSRSGDMSTVPGTPNSSISSSSSEGHELEQSSLVAPSSVTTNSTAAKGQGPADTESQPDLTAAEKPSMEPKKPPRKKGQKRNREPRFAFMTKSDVDHLEDGYRWRKYGQKAVKNSPFPRSYYRCTNGKCSVKKRVERSSEDPGIVITTYEGQHSHPSPAILRGSAESQSHFSDQRLNSPFTQTPLIRFPPHPMMMSSTNQVPAASPSSTNNFHHLGSIKSCMNPHLLPQSHHGNSQPHPTHLMPTNLSQQPLIDQGLLEDIVPPGMRKF

SEQ ID NO: 1638 - protein, 448 aa, Pinus radiata
MAVEMLDYRGSFRKEEDLKEAASAGLESMDRLIRLLAQQQQQKESYSSNPPDAMDVDCCAIADVAVNKLKKVVSLLSRTGHARFRRGAGVDSRRPSSVSLQNFSDPHERSFSNNNSPDNNAENANANGTNSAALLCPMAQQPLLPRPQAQSQSLSQSQTQTQSHSPHPFIKRSSSKPDAYFPMNSSKPIAADFSMNSFKPVASDFSLNSSKPVSSIKPAKDLTFEGLTGAGPTQLKPMQELTFKGFTSQGSKPITDFSMALTNHVATTDFYGHRKDSVCSSPPLSNTNSFLSSITGDGSVVSTDKRPSMLLASFPPSSGRPPLSSSKKKCHGKSNDTDGGKHCGPSGRCHCSKRRKSRVKRTIKVPAISAKMADIPADEYSWRKYGQKPIKGSPHPRGYYKCSSVRGCPARKHVERSLDDPSMLIVTYEGEHNHSQSMSESTGLVVDP

SEQ ID NO: 1639 - protein, 667 aa, Pinus radiata
MDYQQEQHPVTSSSHFYFPDQDLDMNSKSFSDLLADNNGDSLIWGANEQKLEFGAAGGVTRGGNSFAERFAARGGEPLKLSTAKFKTMSPSSLPIPRSPFLSIPPGLSPTTLLDSPVLLSTAQDMESPTTGTFPLQSFSFQSTAATASLDIVKNEDGSCSSFAFKPLAGSNPSSDMQPLGNLATFGYNHHQSLKGVQDDARMWTSPIFSQTNETNETGANSSSEPTTTGTTAMQAVPLQAVRSQAASFEEQQQRPLSDFNQTAIVPPTGIERPSDDGYNWRKYGQKHVKGSEFPRSYYKCTHPSCPTKKKIERSLDGHVTEIVYKGLHNHTKPQPSRRMGAAAAAAAAAARLEEGESTEGCGALVKVEDPSSTPPRRQNSNHLESLGTPEQSISASEEDDARTQVDKFSGDEDLDEEESDSKRRKKEVNTMDIIGATRTIREPRVVVQTTSDIDILDDGYRWRKYGQKVVKGNPNPRSYYKCTNAGCSVRKHVERASHDPKAVITTYEGKHNHDVPAPRNSSHTNAGLGSGQPPVPILQNSVAPSTNGMALTAPGTQETFSHFDRHPDLHNGYGNNNYMFGRIANESYNSQNGRGLGMSLGAFGLESKHSEIQQAEAPTSFPMQIKPASHEYSSIGSGNSGHIYYNQPNERDGLIRPKEEQKGQFLV

SEQ ID NO: 1640 - protein, 908 aa, Pinus radiata
MAGNEENNKMGFLDWGPLTSPTTLIASMMAEDFSSRSFSQLLAAPQIETPQSQEQNLKPLSPAGFNGSSSRSGKENDPFSISGGFAAGSVPTSGFGQVHKPPSRTGGGSFAERLAARGGFNAPRLNTARFKCLPSVSSPGGVRSPYLTIPPGLSPTTLLDSPVLLSNSQAAQSPTTGSFPLPPFLYESSLSPPVNSGSDGLKDKSYEDGTSSSFIFKPHVKSGPSSCLSPLGGLATFGSSQQQAVGGFQVQTESQTWPQFDSQMPSRSNSQGQAQTYTQIQTQAHAQSHTQAQNRTDAQVFMQAGNKARSHAAAQVKTQAQDQGQAHVPAQGQAQLWEQAVANSTGTKDLVAYSLPESPVPNNVIEEAKCVPPLQVAPPLHVDPQDFPSEESVPSEEQEQMHDSDAQLQLPEGDQKGLAPHTISGRPSEDGFNWRKYGQKQVKGSEYPRSYYKCTHPNCQVKKKVERSPHGQVTEIVYKGGHNHPKPQPSRRSAVGSAHMIQEGAESTEATTKVEGGNTWRNTELGLLKDKDAANCSKTWKNELLERSSSASVVTDLSDPSSTAQVQSSSRLDSLGTPEMSSTIASDDDMEDANDSKSVGDDGDENESDSKRRKKENNTVDIVAASRAIREPRVVVQTTSEIDILDDGYRWRKYGQKVVKGNPNPRSYYKCTNAGCPVRKHVERASHDPKAVITTYEGKHNHDVPAARNSSHDNAAKGNGAAPLAMQNNVPAPMNAIPRPVPQVQDIVSRPVPQVQGIVSRFDRHLDPRNEYVKRAYYEKVVDENLHLQDKNGGSLDLKMGAGMGFGMFGLANNHTDKRQIAEGHPPFPMQIHSTTSHGLPGIQFSGKPTVPVQSYFGQAKDNGMRFLRPKEEQNDDSGFGNTLTFNPTPNPSLYQQIMGKLSMGPSL

SEQ ID NO: 1641 - DNA, 1231 bp, Eucalyptus sp.
agcactgaaatgctcgtccctgctcctcttcaccctctcttctaatctccttgccggttcacgcgcctccgcctccgcctcggtccgccgcgcactccgtcgctccggcggcgctgagatttttccgggcctggaaatcggctgggggttttttttgtttcagttttttttttccttctccgccggagaggaggggggaagttttggtggtggaggtggtggtggtgggggttcgggagtttcgatttcggattcggagagacgggcgttcgagatggagggagggcagtacaaccctaggaccgtggaggaggtgttccgggacttcaagggccgccgggccggcatgatcaaggcattgaccactgatgtcgaagaattttatcagcagtgcgatcccgagaaggaaaacctttgtctgtatgggttccccaatgagctgtgggaagttaatttgccagcggaagaagtgccaccggagcttcctgaacctgctctgggtattaattttgcaagggatggcatgcaggaaaaggactggttatctttggttgctgtgcacagtgatgcttggttactttctgtggctttctattttggtgccagatttggctttgacaagactgacagaaaacgtctgtttagtatgattaatgaccttccaaccatatttgaagtcgtgactggaagtgcaaagaaacagtcgaaggagaagtcatctgtttcaaatagcagcaacaaatccaagtcaagctcaaaaggggggcagagagcgtcagaatctgtgaagtattcgaagccagtgcaggcaaaggatgaggaggaggttgtggatgaggaagatgaggaggagcatggggataccttgtgcggggcatgtggagagaactatgccgcggacgagttttggatatgttgcgacatgtgtgagaagtggttccatgggaagtgcgtgaaaattactcctgccagggctgagcacatcaagcaatacaagtgcccttcgtgcagcaacaagagagcacggccttgacacaagggacatcgtactctgaatctttcacaatgtcgtgtcaatttgggcaaggctatctgtttagggttcttatgtttgtgtcctgtacgcagattatttgcattggatacttcggcctcggatctcgtcatgttggatatgttcatatatggcaattcgtaggccttcacctgtttaaaaaaaaaaaaaaaaaaa

SEQ ID NO: 1642 - DNA, 1045 bp, Eucalyptus sp.
ggcgagagagagaggttgttgcgcgggcggacggagttggagagagatggatgggggagggcagtacaaccctcggactgtggaggaggtgtttagggatttcaagggccgtcgcgctggaatgatcaaggctctgaccactgatgttgaggaattctatcagcagtgcgatcctgagaaggagaatctgtgcctgtatggattccctaatgaaaaatgggaagttaatttgcctgctgaagaagtgccaccagagctacctgagcctgcacttggcattaactttgctagggatggaatgcaagaaaaggactggttatccctggttgctgtacacagtgatgcatggttactttctgtggccttttattttggtgctagatttggttttaacaaggctgacaggaagaacctgttcgccatgattaatgatctcccaacaatatttgaagtcgtaactggaactgtcaagaaacagacaaaggagaagatatcggtttcgaatcacagtagcagcaaatccaagtctggctcaaaagtgcgaggatcagattcaggcaaattcacaaggactatccaagcaaaggatgaagatgacgtggtggacggagaagatgaagaagagcacggggatactttgtgtggggcctgtggggagaactatgcttcagacgagttctggatctgttgtgacatgtgcgagaagtggttccatgggaaatgcgtgaaaattactcccgccagggctgagcacatcaagcagtacaagtgtccctcctgcagcaataagagagtgcgtacttgatatagctggtgccgtgcccataagctctctccccctcgtagtttcgttaggttggtatatgctaattgctgtcaggtcgtcaagttttcacatcgtaccaaacatttggtgttgggaaccttgtcatcgtggttcacatttgtaggtatcaggatttaagcatttacctaattctagattaggagttatttgtactttcagttcgaaaacagtttgtccttacattgcgtaaaaaaaaaa

SEQ ID NO: 1643 - DNA, 779 bp, Eucalyptus sp.
aaaggagaaggggaaggaagagaaaaagaaaaaggataagaaagaggaaaaaaagaagaagaaacctgaagctgatgaggaagatgaaggcgagaagaaaaagaaagacaagaaagagaagaagaaggacaagaagtgctctggctctggtgagggaacagaagctgaagatacggaaaatgaagagaaaaaggagaagaaaaaagataaaaaaaaaaaactcgagggtggcggagatccgcgagccgaacaagcggtcgcggatctggctcggctcctacaccaccccgatcgcagcggcccgcgcctacgacaccgcggtgttctacctccgcggcccctcggcccggctcaacttccccgagctcgtcttccaggaggacgacgagctccgggacctgtctgccgcctccatccgcaagaaggccaccgaggtcggggccagggtcgacgcccaggcctccgcggcccagccccccgccccggagccgaactcaagccgggtagccacggagaagccggacctgaacgagtacccaaaagcggagaactcggacggagactgaattaaagcgggggatcatccatataatcatttagcttcatctgaattttttcgttttttcttttcttttcccgttttgctgtagtccgtagtgggtagccgagttttgatcttctccttttcttggtttccacgcgccgattgatctactgaatatgaagggggaaaaagacatggccctgatgaagttttttcgtttctttcaaaaaaaaaa

SEQ ID NO: 1644 - DNA, 1208 bp, Eucalyptus sp.
gagccagcttctgtctcttataaacactagccccaccccattcattatccacttcactccaacccaacagctatcgcactatcccactgcagacgccctcccacgaaccctttctcttctgatccccatcccaactcctgccgcttcgacttccccaagccgtccttctcgtcgccgctgtccaacgggagtagcgccatggcagcccccgggaacttctccgacgaggaggcgcgcctcgcgtcccaccacccaaagaagcgcgccgggaggaagaagttccgggagacgcgccaccccgtgtaccggggagtgcggctgcgtgactcgggcaagtgggtctgcgaggtccgcgagcccagaaagaagtcgaggatctggctcggcaccttccctactgtggagatggcggcgagggcgcacgatgtggcagcgctcgcgctgaggggccggtctgcctgcctcaacttcgcagactccgcgtggcggctgcccgtgccagcgtcggcagacaccaaggacatacagaaggcggcggccaaggccgcggaggcattccagccagtggagtccgagtccgaggacgtgatgtcgggggacgagaagaagtcgccttcggaggagggaatgctgtacgacgacgaggacgtcttcgggatgccggggttgctcatgaatatggcggaggggatgctcttgcctccaccacgatgcggcggagatgggtacggcggagaggacgacgggaatctggatgcatacgtgtcgttatggagctattccatgtagtcatttctcaagttcagttatactttttgtggttagggacgactgggatgccgtactaaaatattttttgatggagtgcggatgaaaggcgaaggtgggtacgaaagcagaaggtattttcggaagccaatttttggggcatgccgttaggtagataatagagactgcacggctcttctgatgttgggcctctgatggaagaataaaagtaggccatgttcacggcagcatcgggcgttgcatatagttgataaagagactgcccgagtcatcatgatcttcgaatgtaaatcatgtaccatgtacaaggcaaagagtgtgctcttgtaattcttatggtttgtttgggttcaaatgctttttgctctggcccattaagacgataaattgaccatccctattttaaagcaaaaaaaaaa

SEQ ID NO: 1645 - DNA, 1840 bp, Eucalyptus sp.
gaaaaacagagagagagagagagagagagagagagagagcttcctctttctttgcagtcgctctgtgatcatttttcttcttgttcttcttctccagccccctctctgaacttcccccgcttctccgatccctttctgtcgtcgtctgtctcacggactctgctgtcctggttttgcgtttgctctttcttgctttgttttcgactgggagggtttatttttcttgtaccctcggcttgtgcgtgcgctctttctttttgcttgtgaagaaaacctcttccatcgaattggttttctcgttctgcgtttacaagttcgtgcctgttcctttggttttggtaagaaacaggtgatccttcttattagatctaacgagaactttcttgaattttggctgctcgtgtttttggttcagagagaaatggcagcagccgtcgaattctacaatagcaactcagatcccattagagaggaattcatgaaagcactagagccttttatgaaaagtgtttcccctgtttcttctccattatcatcattatcatcttgtgactcggtctttccacaacaacagcctaatttgaatcctgacctttgctcctcttggatactaaacccgatgggtctcgagcaatccggctcgattgggctcaaccgactctcccattctcaaatccaacatatccaggacgaaatgctactccgacgtcaaaatcaagaactttggttagcttccgctgtgaaatctcctctccagcacgaaaaattcgaccagtgtcggtaccaaaaccaccacggctctccccatctcctccggccgaaagccctctcaatgaagcgggtgggagtccctccgaaacccaacaagctttacaggggagtgaggcagaggcactgggggaaatgggtggctgagatcagacttcccaagaacaggacacgcctctggctcggcactttcgacaccgccgaggaggctgctctggcttatgatgaagccgcgtacaagctcagaggagactttgctcggctcaatttccctcgctcgagggacggtggttcatatctctgcgattataatcccctgcattcctctgtctgtgcaaagctccaggcgatttgtcagagcttggcagctaattcacagaagcaggggaaaacaggggagccctgttttttcccagacagggcgatggagactttcgatgcagccgccgaagccgacgaagcaatattcttcaaggttgcactgaagaacgaatacgacgccgatcttgcgtacccggagcaggattacaaggtggaaaattcggtgtcttcgccagccttttccgacgagtcctcggtggcggggtcttcttcaccggaatccaacctggcgttgctcggtttcccgccctcgcagtttgagatcgagaacttctacttggagaagtttccttcagccgagatcgattgggcagctatttgagcctgcacgcgttctaacgtttctgctatgctcttagttttcctttttgttcaggtccttccatgtccataagctggtctactagtagtcttgtctcagtttctaggtatggcgtctccagaggcatcaacgatggtattttttgacatctgttggagccctgttgagtgagccatttagtggtggggggttacattttacatcaggtagctttatgagaatttctccatctgttctgctggttaattttttcccctcaccggctagaactatggaggaatttcagcctgtcttagtaagttctctggtttattgtacttgaagctttgttcacttatatgtcaccgagcgtttagtcaaaaaaaaaaa

SEQ ID NO: 1646 - DNA, 1109 bp, Eucalyptus sp.
ttcagatagaaaggagattctcgttctctcagtctcaagaacaccagaagcatcagcaatcatcacacaccaacccagcgtctcgaccgattccgcaagaactcgccggaaccctatttccgtttatcttttccccatcaagaaacagaggaagaaggagagaggagccgctcgagtggaggcggaagttcgattccgaggaggaccgggagcggaaaaggcgaaggagggtttcgactcgggagggtttgcggtggcgcgcatgtcgccggagatcgtcgaaaggaagaggtcacggagtagaaaggaaggttctatgtccgtggcagagacattggcaaaatggaaacaatacaacgaccagctcgatccgcaggccaatggagacaagcctgcgcgtagggtgcccgccaagggttcgaaaaaggggtgtatgaaaggcaaaggtggtcccgagaatacgaccttcaattacagaggagtgaggcagaggacttggggcaaatgggttgctgaaatccgagagccgaaccgagggagtaggttgtggctgggcacgttcccgactgcaatcgaagctgctaaggcttatgatgaagctgcgaccgcaatgtacggtccatgtgcgaggttgaatttccccaccgcgtctcatcccatgtatttcggtgacttggatgccagagccacaacaccggtgggcactactgctaacacgactggtaccccaagcactggttattctgctggtaccccgagcactggttattcggcgggcaccccaagcgaggccacgacattgtccagtcagtcagaattgactggtggcccagaggttaaggacggggatcgcaagggtgagtcgaatgcagatggtggagagatggagccgaagagcgaatccattgttgacttcgactggctgagtgactatgccgtggatgacctgttcgatgtggacgaattgttaaggactttggagtctgatccgaagttctcctcagatgtcaagatggagcattagaacaatttagaacacaatagatagtttttgccggggggggagtgagttttcttatgaagaaagtattaaatttgttctttcactg

SEQ ID NO: 1647 - DNA, 1091 bp, Eucalyptus sp.
aaaaactccataggcgcgcagagatggagcgacccagaaactaaaccctccatcgaaggcggcggccgtcgagattttcgccggcgggaccttttccgggggcctcccacatccgttcgtcctccgccgtctgctccggaatccttccccgagggggggaaaaggggaggaaaggggggggaaaaggtcgcttcttggtccttcgccgcctgtctcatccatgcccgagaccggacccgccgcgacggccgcagatccgatcccgacgacccagaatttcccagactccgcccagcgggagcaccggttccgcggcgtccggaggcggccctggggcaggttcgccgccgagatccgggacccgtggaagaaggcccgaatctggctcggcaccttcgactccgccgaggacgccgcccgcgcctacgacgaggccgccctctccctccgcgggcccaaggccaagaccaacttccctctcgacccgctcaccggcttgccccaggccgcgccgtccccggcggcgctcctccctaggccccggccgcggccccggccccgcggccggcggcgccgcggcccgcccgcggaggatttccacgtcaaccggccgaccagcagcagcctgagcagcacggtggagtcgtacagcggtccccgggtctcgcatccggcaccggcggtccccagggtcgtggccgtccccagggccccgccggaggactgccggagcgactgcgactcgtcgtcgtcggtgattgatgacgtggacgactgctgcgtgctggcgccctcgtgcttccggagagcgttgcagttcgatctgaacctgcctccgccgctggaggacgcggatctcgacggtgaggagcttcgcgccactgccctgcgcctctgatccattgtacgaccaggatttgatatcaagttttctcttctttttttgggggtatttccatcactttacgacctctaatcttgtatcgcgttccgggaagaatgataaagagagagtggagagattcgggcaatcttgttttcttttttttttctccagagataatctacttatttttagatcaaaaaaaaaa

SEQ ID NO: 1648 - DNA, 1107 bp, Eucalyptus sp.
atagtccaagctctctgcctctctctctctctctcttctctatcttcatcttcgtcgtcttgatcgctctcatctcgctctcgcgaatgttgtctctcgtcttctcctctgtccgccattcaaagatcacctattctttccgtttggtttgcggtgactaagaactctttctctctctcgctctgtgtcactcttgctttctcccgacttttctgggattgatgaaaatggcggaaagatcgaactcgtcggacccggaaacaagcccctcgaactcaccctccacctcctcgtcttcttcctcgtactcgcccgacccgcgccgccgggccggctcgcccgccgcggcccgcgacccgtcgagatcctccaagcggagcaagcacccggtgtaccgcggggtccggatgaggaactggggcaagtgggtgtcggagatccgggagccccgcaagaagtcccgcatctggctcggcaccttccccaccccggagatggccgcccgcgcccacgacgtcgccgccctccacattaagggctcctccgccttcctcaacttcccccacctcgccgcctccctcccccgcccctcctccctctccccgcgcgacgtccaggccgcggcctccctcgccgcccacatgcccgaccaccaaggaacggtcgagaccttgcggccgacagcggagctcgactctcagcactcgtcattgccctcgaggtcgctgtcgtccatggtgtcggcaatggacatatcggcgacggtggagctgagcgagatcgtggagctgccgagcctcggggccagctgcgacgagctggggggcagcgagttcgccttcgtcgactccgtcggcgccgagtggggctactgctaccacgacgactaccagccgacgtggccggagcacctcgaggactgcgggccgtacgactgcggccatcagacggcggcgctgcccgagagcggtgggtcgctgttgtgggattatgactgagcgagtggatttactgttggtgagagagtttgtgaatttgtgtgaaaagaaaatgatttttttcccctttttttaatgaattatggtgcttttttttttaaaaaaaaaa

SEQ ID NO: 1649 - DNA, 993 bp, Eucalyptus sp.
cacaacacccccatatcagtaaacacttctcgctgctccagccagcttctgtctcatataaacactagccccacctcactcattatccgcttcgctcctactcaactgctatcgcgctatcccagcgcagacgtcctcccatgaacttctccgacaaggaagtgcagctcgcgtccgaccacccgaagaagcccgccgggagaaagaagttccgggagacccgccaccccgtgtaccgcggggtgcgtctgcgcgactcgggcaagtgggtctgcgaggttcgcgagcccaaaaagaagtcgaggatctggctcggcaccttccctactgtggagatggcagcgagggcgcatgacgtggcagcgctcgcgctgagaggccagtctgcctgcctcaacttcgcagactctgcgtggcggctgcccaagccggcatcgacggatgccaaggacatacagaaggcggcggccaaggctgcagaggcattccagccggtggaatccgaggacataatgtcaggggacgagaagaagctgcattcggaagagggagtgtcgtacgacgaggaggacatcttggggatgccagggttgatcgccgatatggcggaggggatgctcttgtctcccccacaatgcggcgaggatatatatggcggagaggacgacgggaacttggacgcatacgcgtcattatggagccattccatctgaccatttctcaatttcacttgtacatagaagctgtttaatagagtgcggaagccacttttgtgatgtgccattagataaagagcatatcgatgaagcacgggtcttccgatgttgggccgccgatagagcggatgggaaagtgaaacaaagcgcaaaagtaggctgcgttcacagcaacatcgggcgttgtttatagttaataaagaaaccgcccgagccatcatgaatttgagagaagtggttttcagacttacccaaaaaaaaaaaaaaaaaaaaaaaa

SEQ ID NO: 1650 - DNA, 1918 bp, Eucalyptus sp.
agcaactctttctctctctacaacttaatttgtttcaacatattgcacccatcttctcgttcagctttcctggagattgccctcccctcgccaggccttcttgcttcataaagattcgagattttctcagagacccacttcagtttttaaagattcactgacgagaaaggtccgtcgagaaaagataccatgttggatctcaatctcgagatgatctccagcgactcgtcctgcgacaacgacaagaaccagattgatgtgcaagagcgagaggaggaagcggcgaccaagcttcacgaggcctccggcaactacgatatggaggaagattccgggacctccaactccaccattgtcgccagcgccgaggaagcttctggcaacgccggtgaggagaactcctccaacaccacctcctcctcctccatattctatattatgaaggagaaggagaaagggagcaaaggcggtttcaaggccggagacccgccgccctcgccacaggggctgatcacacggcagctttttccggttgccggagccggagagcacggccaccaggcggcggaattagggttggggttgcctgcaaggcagcagtggctgaacttgtcctttggcgaacccactggagctcccacggagttcaggattctgcagccgaagcaacggaagagccgcaggggtccccggtcccggagctcccagtaccgcggtgtcacgttttaccggcgaactggaagatgggaatcgcatatatgggattgtgggaagcaagtgtatttaggtggatttgacactgcatatgctgctgctagagcttatgatcgggcggcaatcaagtttaggggagtcgatgcagacatcaatttcaatatcagtgactatgaggaagacatgaaacagttacagatggtgaatttatcgaaagaggaattcgtgcaaatacttcgccgccagagcactggaatctctagaggaagctcaaaacataggggcatgaccctgcaaaaatgtggtcgatgggatgccagagcggggccgctacttgggaacaaggcttctgacaatgcggcaaacaagtgtaatggaatggaagcagtaatgaacttccagccaggcagttacgaaggagacactaagccatatcccagagctggaggcggcggccacaatcttgatctgagcctcggaatgtctctgccatcaagtagttccatgggagctggaactcaaagggatatgctctttcattgtgccgaccacgagatgccaaatatcgtgatggttggttgctcttcatctgctcacaagggtggagaacttcccaatattggaatggcatcaaggagtcctcccatttggtcaaccttgtatcctgcactcgcaccaaattatgagggaaaggcaatggagaagagggccgaagcgattccggcattgaggttctcaagttacagattgccagtgcatggcaatgtcaacaatgccaacaatgggtctcaacaagcccagttgttcacctatgcagcatcatcaggattctcttcatccacagccactcctcaccctcctccacagctcccagtaagtctccagaaaaatggtgtccacaataatacagccagtcgtgcctacttcagttacagaagctaagcgaggcttctggttcatcttcctgaggtccacatgaccaatttgtcgccatgctctctcttgtgaaggttaggtaagaaacagcaagagaggacatagcaaccaacccaattgtttagagtgcattcttaatttatataggattcggtttgtttaattcctataaaccaagtgcacaaaaaaaacctatgacccatcatgtagtataaatgatatacgatttgcatatatatatatgtgtatgctcttgagaaaaaaaaaa

SEQ ID NO: 1651 - DNA, 1046 bp, Eucalyptus sp.
ccgaaatggccgaacttgatgaatcttccactttggaactcatcacgcagtatctcttagaagactctatcaacctcgctcaactccaaccggtgaaaacagagaacctgtttctcgatccaggaccagactcgccagattcagatcatcccacctggcaagacctggagacaccaaatcttgagattaaagccgagcccatcaccttggaatctccagagtcggagttggggtcgccggagaagaatcaggacgaggctggctccgcggccaaggcaagttacagaggggttcggcgaagaccatggggaaaatatgctgcggagatacgggacccgacacgtaaagggagccgggtctggttagggacctacgacacggacgtagatgctgccaaggcttacgattgcgccgctttcaagatgagaggccggaaagccatactgaatttccctctggaggcaggaaagtcggcaccgccgccgaatccggggcgcaagaggaggagggtggcggtgaagaaagaggagtcgaaagagaatctagaagattggccgattgagatgctggcgcaggcggagaggggtgaagatgagtggacacagtgttgactccgagcaactatcgttggtaactaggacaaagttatgtccacatactaaacagttgtcatgtgtccatcttagacagtagaacgtcaaaattagctcaatggctattatatgatatgatatgatgataccaaattctgtgtcaacacgtccccaaactcatcgtgacaccagcaagaggggaagagtgagggacataaggcgaccgagtcaaggaggcacaattgaaaagtgcgggtaatcgtgtaaaaatatcggtttgtagtgctttccatgaccagtgcaggacaagcgaccgagagaacggggcataatccaaatggaggaagtccgagggtcatgaaactttatctgttcaagggtgtattatctgtcctttttattctaaccatgctagctgttgcatatgaactgtaaatatatcagtatatatca

SEQ ID NO: 1652 - DNA, 2513 bp, Eucalyptus sp.
aagttgttgggttatattctcggaactagacaacaacaacagggaaaaaaaaaaaaaaaaacccaagtgtgtgtgggtgtgtgttttctctctcagatgcaagaagatttcgaaatgattacttcccttcttgccaatgattgaagcctcgagctcgtgcttgcctcgcaccacaatgagacatgcttaacgaagtaccgactttttaactgaacgaggaggaggagaagatggagatgaagtccgtgagcgagaacggcggtggcgcgagcgggggcaactggctggggttttctctctcgccccaccacctgaagatggaggtcgctccacaggcggagtatcaccagaaccaccaccaccaccaccaccagtatcaccaccagccgcagcaaggggaaccgggaagctactttctctcggctcctcctccgccaccacactatagcagctctggcctgtgttacggtggtggcgttggagacaacaacaatggtgggtaccttcactctcctctttctgtcatgccgctcaagtccgatgggtctctttgcatcatggaagcactcacaagatccagaccccaaggattaggtcaaggttcaacgccgaagctggaggactttttgggtggtgcaagtgcaacagtgacagcaacgacaatgcctctcagcttggacagcttgtatagctaccaacagagtgccgacccagagaaacagtcgctagatctccttcatgaaccgttcagacaccagcaacagcatcagatttattaccccaatgagctaacatgcccggctttgtaccattcaccactggctgaggaggaacagaaagagactcacattgcaagctgtgatgagaacggtgggttctcttgcctgaaaagttgggtcacaaggaatttctcatcttcctcttgtcatgtcgggttggaccagatgagcagtggcatggtatgtcataatgggggtaatagctccgaggctgtgggtccaatggagtgtggtgacttgcagaacctgagtttgtccatgagcccaagctctacttcgagctgtgtcacagtcccaacaaggcagatttcacctactgagaatgagtgtgtgggtatggagatgaccaagaagaggtcaagtaattgccataacaagcagcctgttcacaggaagtccatcgacactttcggacagaggacttctcagtatagaggggtcaccaggcatagatggactggtagatatgaagctcatctctgggataacagctgcaagaaggaggggcagaccaggaaaggaaggcaagtctacttggggggttatgataaggaagagaaagctgcaagggcatatgatcttgctgctcttaagtactggggaccttcgacgcatataaactttccgctagaaaattatcagaaagagttggaggaaatgaagaacatgagcaggcaggagtatgttgcacatttgagaaggaagagcagtggattttctagaggggcttcaatgtacagaggggttacaaggcaccaccagcatggaagatggcaagctcggatcggtcgggtagctggaaacaaggacctttatcttgggacatttagcactcaagaggaagcagccgaggcatatgacatagctgccataaagttccgcggtgtaaatgctgtgaccaacttcgacatcagtagatatgacgtggaacggatcatggcgagcagcacccttcttgcgggggagcttgcccgccgaactaaggagatcgcaccgaatgaggaagttgccgagtataatgcactgacccagcaaaaaattggcagcgatggaactcttcagcttgaaagcagtggcaacgtcacaaacggttcggattggaagatggttctttaccattcctctccgcagctccaagctagctgtatggagtcttcggttaactcaagccagccatcggttgatgatacggctaagctagggacacgtcacttgtcgaacccctcttccttggtgaccagcttgagcagctcaagggaggctagcccagaccgagccgggtcggctttcgctaataagcctccagttgtttcaaagctcgtgaacactagccctacttcagcttctgtgacttcttggcttccctcaccagcccacatgaggcctagtgcaattgccatgtctcatcttcccgtttttgctgcttggaatgacacctgaaaagaaagtttttgcatgaagaaagaggagggtgggaagaggggaggcactggcgttggtggtgggacaagttaggacgtgggaattatttctttttgttttttatcttcatgttgttattttagtactttattagggtttagtggatgaaattaggggagattgacttgggggacccggccatctctgtctgtatccatagtgtaggcaatgcaaagaaccctttttgaaactgaaaccacttttggttttggctcacatcggaatatatcaagaattttgcgaaaaaaaaaa

SEQ ID NO: 1653 - DNA, 1305 bp, Eucalyptus sp.
actctcatccggcatctaccatccctctcttctgtctctctctctctctctctctagcccactcactcaaaagctcaatctgccccgagctccttcagaaatggcgacgtcatcgatcaccgaagtgtcgacgaggcttcagctcatcgagcaacacctcctcggcgaattctccccgaccgacgccgccttcccggctcatctcgcccccgccccatcctcctactccatccctttcgaacccgcagtcgaacctactcgctctgaatctctctcctccgtctccttctccgacttcgattgcctcccaaatgaagatctcttcgagttcgatgtcagctcgtttgccttcgagcaaaaccagagcgagagcttcggtttcgaagcgaaacctcaaaagctcgaccttatcccttcggtggcgacgagttcgagctcatcgttgagctccgaaacggaatcgttcttggggtttgaagcgaagccggtaattatcggtgaaacggcctcgaaaacctcgcaatcaagcaagaagccatcgctgaagatcgcggtgccgagaaaagtcgagctgctgcaattctccaaggcgaatccgatggttcaaggaggttcgaatcaagcacgcgacgagcagaggcactatagaggagtccggcggaggccttgggggaagttcgcggcggaaatccgagaccccaaccggaagggctcgcgcgtctggctcggaacttttgacaccgcgatcgaagctgcgagggcctacgacgaagctgccttcaagctccgcgggtcaaaggcgatcctcaacttccctctcgaggccggcaagcccaggtcgctggtggccccagccgatggcaagaaacgaccccgcgaggagaaggaggaggagaacgaggtcatcgtgaagaaggagaaggaggcggagtctgacgtcagcatgtggagggacggtcccttgacgccgtcttgttggaaggggacctgggactctgatgacacgatggggatctttgacgttcctctgctgccgccgttatctccgattccgacgttagggtttccgcagctcatggtcaaatgagaggtgtcttctttgtttatggagcaacggtgtgcatagtttggtgatgttaggactaggtgctcagaagatggtttttgagatgaatgatcactttgaggtgcattgtatggcatggcgaatgacaatcttttggctaaaatgaaggatccatcgaaacactcgttaaaaatggaaaattgattatcgggattgaactaaatccacccaaaaaaaaa

SEQ ID NO: 1654 - DNA, 2303 bp, Eucalyptus sp.
agcttcggagccgttgactcggggcgtggggcggagatgatgatgaatcgagctgaaggtcgcggaggcggaggaggagatgacctctacacggagctgtggaaggcctgtgcgggaccgctggtcgacgttcctcgccatggggacagggtctactatttcccgcaagggcacatggaacagctggaggcatcgacaaatcaggaactgaatcagaggattccgctcttcaacctcactcccaaaattctttgccaggtcgtgaacgtccagctcctggcggagcaagaaacggatgaggtttatgcacagattactctaattccagcgggaaatctaatggagcctacaagtcccgatccagtctctgcggaaactccaagaacaagagttcatactttctgcaaggttctaactgcctctgataccagcacacacggtggcttttctgttctcaggaaacatgcgaccgaatgtcttccccccttggacatgaaacaggcaaccccgacccaggagttagttgccaaggatcttcatggatatgaatggaaatttaagcatatattcagaggtcaaccacgaaggcatttgcttacgacaggatggagtacgtttgtcacatcgaagagattggttgctggtgactcgttcgtgttcttaaggggggacaatggcgaattgcgtgttggagtgaaacgagttgctcgtcagcagagcagtatgccttcctcagtgatttcgagtcagagcatgcaccttggagttcttgcaactgcctcccatgctgtcacaactcaaactctgtttgtagtttattacaagccaaggactagtcaattcatcataagcttgaacaaatatttggaggctcttaacaataaattcacagttggaatgagattcaagatgagatttgagggtgaggattctccagagagaagattttctggtacaattgttggggtggaagatttctcacctcaatgggataattcaagttggcgatcattgaaggttcactgggacgaacatgcgtccatccctagacctgacagggtatcaccctgggaaattgaaccctttgtggcttctgtgcctgcaaacatccctcaatcaacaacgaagaacaagaggccccgtccatcctctgaagtccctgcagatgctactgctgcgcctgctatctggaattctggatatacacagacccatgatctgaaacaacggagaggtactgatgagggaaaaagtagtgatcattttatgtggaattacaagatggccgatgttaacagcagcagcagttctataacaagggtgcaaacagaaggggggtggctgccttctccatgcttaagtgtttctccgaatgttctacctgatgcagtggatgacagcaagagcgtctctgctttgcctgtgccctgcaggcacccaatagcgcatccatcaagcttgaataatgaactgatgcccaacccagctgaggacggtaaaaaagtcgagccaacttctagttgccgactgtttggtattgatctgattaaccacactttaagttcacctccttcggacaagggaccttttcaatctatgtgcgtatcaactgctacaactgaaggacatgttcaaatggccttgtcaacagctgattctgatcagaaatgtgatattcagaaggcttctgaggaagtaaaacaaagacagatgcagaatctagggaaagagggtcaaactaagcaaatttgctctactagaagtcgtacaaaggttcaaatgcaaggaatggctgtaggtcgtgctgtggacttgaccatgttggaagggtacggtcaattgatgaacgagctagaagagatgtttgacctcaaaggacagcttcagtctcgagataagtgggagattgtctttactgatgatgaaggcgatatgatgctcatgggcgacgatccctggccggagttttgtaatatggtgagaaggattttcatatgctcgagccaggatgtgaagaagatgagcgccaaaagcaagctccctgtatcctcagtacaagaggaaggcactgtaataagctcggaatcagcagacaactgaatcaacgaggggctttcccttgtcactttcttttctagttgtcattccgttttgttgttcgattcgttcatactaaagggagctggtttgacatttatttagagggatgttgttagtttggacagtaatgtaaccggacatccgtagctcgattttaggagctgctaacttcccaaatgaacctcattaagcgaaaaaaaaaa

SEQ ID NO: 1655 - DNA, 3304 bp, Eucalyptus sp.
gattttcagaggctgaggagagggggggaagaaagcttactgttttctgattccgttgggtgtagatcttgagttccctgaattcaacagttcattcttaagcttatttttagaaagaaaaatgaaagttgcgggtcttcttgtagctgtgaacaagttagcttcctgctgctaatggtatggcagtgtagattctggggaattgggagagtgaattttgtacaaagaaagatgaattggtggagcttttgagctgagaataaaaatggactggcttcgtttcaagggtctctctctcatcagcaaatttgatcttttgtggacttttcggggtgttactgtgcgattgtgattgtgtgttcttccaagtagaagtttgttaatcccctttcctccgggctcgaaacgtggggacgggatttttccgaattcaagcttcgaacaagatcgaaacgccagcgtttattgttaaaacaagcaccacaagcatctagtctagctgctgggagaagattcttatgctctgaaaaaaagaaaaaagaaaatctgttttcggtttggaaaaaccgccctttggccaagatgatcacttttattgattctaaggagaagctgaaagaggtggagaaaacattagattctcagctatggcatgcctgcgccggaggaatggtgcaaatgccgccagtgaactccaaggtcttctacttccctcaaggccacgccgagcattcatccggtcccgtggatttccggagctgccccaggataccggcatacataccttgccgggtttctgcaattaggttcatggctgatccagagaccgacgaggtcttcgccaagatgagattggttccgttgacaagtagtgagcctgattttggggatgatggaatcggagggcttcaaggatcagatggtcaagataaacccgcgtccttcgccaaaactttgacccagtctgatgccaataacggcggtggtttctctgtcccgaggtactgtgcagaaacgattttcccacggctggattattctgtagaccctcctgtccagaccatcctggccaaggacgttcatggagagacgtggaagttcaggcatatctaccgagggacgccacggcgccatctcttgaccactggttggagtacttttgtgaaccacaagaagcttgtggctggggactcgatagtgttcatgagggcagagaatggggatctctgcgtcgggattcgccgggctaaaagagggattggcagcggaccggagtcctcatctggttggaacccagtcggcgggaactgtgcggtgccttatggtgggttctctgcgttcttgacagaggacgagaacaaattgatcaccaacgggcatgggaactgcatgagcggaaatggaagtttgatgggcaagaaacgggtcacgccagaggcggttgttgaagcagcctcactggcggcaaatgggcatcctttcgaggtggtttactaccctcgagcaagtacccccgaattctgtgtgaagtcttccctggtaaaaacggcgatgcagatccggtggtgtcctggaatgcggttcaagatggcctttgaaacagaggattcttcacggattagttggttcatggggacaatatcttcggttcacgtggccgatccgacctgttggccggattcaccttggaggctactccaggtaacttgggacgagccggatttgctgcaaaatgtgaaacgtgtgagcccgtggctggttgaactcgtctccagcatgccggcaatccatctctcccctttctcgccaccgaggaagaagctaaggcttccacatcacccggatttccccctcgatgggcacttcccaatgccatcgttctccggcgacctccttgggcccagcagcccgtttggttgtcttcccaacagccattctgcagctggtatgcagggagccaggcacgcttactattctcagtccttaccggatctccacctcagcaaacagccatcgagtctgttccctgccggttttccgcttctcgaccactcaattagatccatgagaacctccaatggtccgagaatgcacaaatctagcagcgacgacgacatttctaccctcttgacaatgacaaattatgggaaagtctttaagaaactcgaggaagttaagaaacctccccagttggtgctctttggtaagccgatactgactgagcagcagatttctctaagcaactctgctactaccaccactactacagcttcgcctgttcgtacttcatcagaagagaagatagacaaaacaggtagtttccccgatggccctgattcggcacgtcaacagtcaggccaacgagagcagcagtcgtcatgtgagcagttgagagtacacgaggataagcaccaacaggagatggaagcctgctcagaaatcggccactgcaaagttttcatagcatcggaggacgtgggtcgtacgctcgatctctcgttgcttgcctcatatgacgagttgtgcaggaagctaacagatatgtttggcgtcgagaattctcaaagcttagcccgccacgttctgtatcgggatgacaaaggtgcagagaagcgcatcggcgatgagccatacagcgatttcatcagaacggccaggagattgacaattttgacgaactcgagcagcaacggcgtaggcagctagagagaaaccgaacaaatgatcttcacgtgtacagctaattgaccaaaccatctccattcacaggctgactttcgcttgcaattttgatggaccgaggcacccgccaattggaatagaacgcgcgacgatccgagccggattcacctcgagaccgttcttttttcagaggagcgactcgaagcacagtggatatcgtctcgttttgggtcttgttcattggtgtctagtcttctctttctacgtagtgtcctatcttccttctgtcttgttccagccgtcgatggtcggattcaaccacggtcagaggaactgtttcggcgggaacggcttccggcaaaagcgcttggaatccttccaggaaggcgaaattcttctggcatgatcaatgaaggaaggaaggaaggacttcatgtggactgtctcggacacaagtcaaaaggatttggtcctcctttgttgtggtcacaggtcaaaagcatcatcatcccttttcaggccatttggtctctttatgcaaattccattttaacgtttactatggttgatttgtagccaaactatgtgcgaaatgcaaatcgaattcttttcaaaaaaaaaa

SEQ ID NO: 1656 - DNA, 2599 bp, Eucalyptus sp.
ctgcgacaccctcccccgtccctcccctctccccctctccaggcgtacgagagctcacgagcaccaccaccaccaccaccaccaccaccacctcctcgcacgccgtacgacacgcctgcagccaggacgttacgccgagacgacgcgctcccgaggacgactcgctgaagaacttcaggggtgcggagggatcgggatagagaggatgagctcctgcgtcgagagccacgaccgctcgtcttcttcctgcggcaacattggaactgggagaggagataacttgcacgagcaactatggcacgcttgtgccggtcccctagcttatgttcctaaagccgaggaaacggtgttttacttcccccaagggcacattgagcagattgaggcttatacaaaccaggatggtgatatggaaatgcctatctacaaattgccttcaaaaatcctctgcaaggttgtttgtgttcagcttaaggctgagatccatacagatgaagtgtttgcacaagttacgttgatcccagaggcaaagaaagatgaggtcaatcctaactgcaaaacttcagcaacacctccgagggacaattcacgtttctttgtcaaaattctgactcaatctgatacaagcacgcatggtggatgctctcttcctaagcggccagcagatgaatgcctcccttccctggttgtagtcatgcaatgatgttttccttcagtacattagctgaatgcagtaggacctaggttgactgttttggctttttaggtacagaaaataacaacttgaagtgataatggtacaatcgtcccagtttacgggctaaaatgatacaaccgaaaattacaacatacaactaataaaacatgtagggttatgcatcaattacagatacattataatgtcccaactatggcttaagtgtgctcaagcttatgctgttgatgtcatatgaaggagggtttttcaggttatagtcatttctgggcaaatgttcatgttgtgattgctgttacaggacaagtcacagcaccatccagttcaagatctcgtgacaaaagacttgcaggggaacttatggtgtttccggcacatctaccgtggtaaaccagaaaggcatttgctcacaagaggctggagtgatttttcgacttcaaagaagctggtcactggggatgcatgcatattccttagtggaagggatggagatgtgcgcattggtgtacgccgtctgatgaaatctcaaacgaccacatcgtcatcaatcctgtcaggccacagcatgcgccatggcatactagccagcgcgttgcatgcagtttctactggaaccatgtttactgtgtactatcgtccttgggcatgtacttcaggttttatcatcggttatcaacagtacgtgaaagcaatggcaaatgactattccataggaaaaagatttaggatgcagtttgaagacgaattatgtggagaacagaggcttagaggcactgtagttggcatagaagatctcgaccagatgagatggcctggctctgactggaaatgtctcaaggtacaatgggattcctcacgtgtcaaatgtatatgcccagaaagagtttctccgtgggatattgagtccctagatccagacggaaagaagcaagctgttcttccaacctcactaaagaggactcgtccatgtagcttacagttggattggcctcctacatttgttatggatgaatcccagtggacttcagttgcaccaaagtctcaaagacaaccggtagtctttcaaggtgatggtggtaaaagagaaagtcggggtccaggtgatcactggcctccagcatccatcgctccaggatgtaatcctgttaaaagcttgccagcacaagacgtcatgcctgccaactccacctcctgggaggcacggacaacttttgaaacaaaggatgataatgaaaaaacccttgcccagactaatcgctttggcaaatgcaaggtttttggtgtcagtttagcagatgacacctcggagctcccttcactacaagtatccaactccagtgaactgtccagcccttcttcagttcctccattatcgaagtccagcgactttgtgcaggttatcataaatgaaactgctcgaggaaggccagccgacctcagcccattcaaaggctatgataaattcattcacgggcttgatcagttgttttattttggcggaaacttgatcggcagaagcagtgggtggcatgagaaatgcacggatgacaacggtgacagtgtgccaatacgggattataaccgggaatttgtctctatggtacatcaaggactcatttgcccaaaggaagaagaacaaggcaaacagggaccatgctcatctgatgtagtttcttcctaaagcttccgccggtcatgtctcttgtgtggttctttctcactttgtctactcaagtttatgatgattgggacttgttttagaccttgtgccgatgatatgcgagcgcattgacaatgtcgctgctgatttgtgattttgattgcttctggatcttctttaacttatatcaataacgcacactgtgctggaaatcaaaaaaaaaa

SEQ ID NO: 1657 - DNA, 1151 bp, Eucalyptus sp.
gatttctcagtttctggggttggagatgtaataaaagagtttgaggtaatagatctcgcatcttgatcaaaatttggtctctcaatcagcagctaagcatatagtaaaatttgaaaagcataaaatacagatgatttagtaattatttgttcctcttgttcaaatgattgaagcgctagactgctaaaatttgttgaaaaatctgtcttattacgtcaaaactgtagatgagtgaggccatgtctatcttcttgcacaatcatatacacatcctgattgacatcacacagtgctccagaaaaaaagagcaagcaagttatggatttcattttactgtttcttgtgatgaaaatccatttgtaacaataaaaccatgtgcacgcactcttttaagggcccaagtggtgggttggccaccagtgcgatctttccgcaagaacatggtggcagcgcagaagagcagcaccgaggacatgagcagcggtggcgccgcctccttcgtgaaggtgagcatggacggcgcaccgtacctgcgtaaggtggacctgaagatgtacaagagctaccaagagctgtctgaggccttgtgcaagatgctcagctccttcaccattggaagatgcgaatcccaaggagtgaaggattttatgagcgagagcaagctcagggatcttctgaatggctctgactacgttcccacctatgaggataaagatggtgactggatgctcgttggtgacgttccctgggagatgtttgttgaatcatgcaagcgccttcggataatgaaaggaaccgaggcagttgggctcgctccaagagccatggaaaaatgcaagagcagaagctaaaagaagtgtgtggatcacacgcagcctgcttctttgatctggtggttgaaagacagcacagatggattgagcaggtggtgatttcgatgtgttttattttttgtatcatgttgtcctgtgattacgttgaagtttgagatatatgtctatgaatttgagcaaatatgaaccccataaactttatgactctttcgtatgtccaaagactcggttttgtctttgctttgtcttagtgttaaccaatgttgtgtggctctagcctagcaataacatgtacggtgcttcgttgtaaaaaaaaaa

SEQ ID NO: 1658 - DNA, 859 bp, Eucalyptus sp.
atatggcagctcaaggagaggatctcaacctcgaagcgacggagctcagattagggctaccgggcacggtggagccggagaagcagcaagcgcctttgagtgggcggagcatgaagaggaatttaattgatgtgaacaatgagtacgggtccaatgaggaggagtccaatgggtcgagtgcccaaaaatgcgataagcaagatgtgcatcggccatctaaggcacaagtcgtggggtggccgccggtccgatcctaccgcaagaactgcttccaaaagaaggcggagggcgagtcgaccggggttttcatcaaagtgagcatggatggggctccatacctgaggaagattgatctgaagccctacaagggctattcagatctactcaaggatttgcaggacatgttcaagttcaaagttggtgagtactgtgagagagaagggtacaatggatcagagtttgtacccacctatgaagataaagatggtgattggatgctagttggagatgttccatggaacatgttcatcacttcttgcaagaggcttagaatcatgaaagggtcatcagaggtttaaaagggctcgaaaaatttgatgggcatggccttgctgctttaatcaagaagacagggctttccaaagcttgggctatcggagatttgaatctgggaacatgattttagttttatgcctctcccaaatgtaacatggaaaagaggaaaaaaaaggaaaatggtttttcctctttcttttctttactttatgggtagttgagcatacttcctgtgatcattgtacagagaaaaaaataaaataaaagactgcttcttttttttcaaaaaaaaaaaaaaaaaaaa

SEQ ID NO: 1659 - DNA, 1051 bp, Eucalyptus sp.
caagtttttctctcatcctagaaagagcacaaccacaataaaccaaagaggagaaggagaagcaagaaaaaaagttaggaattgggattgaattgttttgtgcatttagcaatagagatcttgcaagctctgagagtgaatcaagttgtatcaaacattgttgagaaattttgtctgagggaaaggagagagtataagatatggcagctcaaggagaggatctcaacctcgaagcgacggagctcagattagggctaccgggcacggtggagtcggagaagcagcaagcgcctttgagtgggcggagcatgaagaggaatttaattgatgtgaacaatgagtacgggtccaatgaggaggagtccaatgggtcgagtgcccaaaaatgcgataagcaagatgtgcatcggccatctaaggcacaagtcgtggggtggccgccggtccgatcctaccgaaagaactgcttccaaaagaaggcggagggcgagtcgaccggggttttcatcaaagtgagcatggatggggctccatacctgaggaagattgatctgaagccctacaagggctattcagatctactcaaggatttgcaggacatgttcaagttcaaagttggtgattactgtgagagagaagggtacaatggatcagagtttgtacccacctatgaagataaagatggtgattggatgctagttggagatgttccatggaacatgttcatcacttcttgcaagaggcttagaatcatgaaagggtcatcagaggtttaaaagggctcgaaaaatttgatgggcatggccttgctgctttaatcaagaagacagggctttccaaagcttgggctatcggagatttgaatctgggaacatgattttagttttatgcctctcccaaatgtaacatggaaaagaggaaaaaaaaaggaaaatggtttttcctctttcttttctttactttatgggtagttgagcatacttcctgtgatcattgtacagagaaaaaaataaaataaaagactgcttttttttcctttacaaaaaaaaaa

SEQ ID NO: 1660 - DNA, 1289 bp, Eucalyptus sp.
aaaaagttggcgcctttatgccctttttcccctcctctgtcatcgctataaagaacaggaacccaccgcccaagttcctcttctgctcgcatttctctctgggtcttgactttttggaggctgtggtgtgttctgggtcttgggtcggggactgtttcatcagggaaggaaagggtcttttctcttgaaaggtggggggaagtttaggtgctgaaagatttgagcttttttgatggagtttcgagaaatggagagaggggttggggatggagtgttcgggaaggatctcctcaacctggaggagacagagctcaggttggggttgccggggacggaggaatctggccagaagaaatcgaggaccggcaagaggctgttctctgagtcgagcgatgtgtctggatcttcaaagggtagctgtgttgctcctcaccatgatgaagaccatgaatctgctcccgcccctaaagcacagatcgtgggatggccgcctgtccgatcctaccgaaagagtgctcttcagccgaagaaggcggaagcagagggccctggtatttacgtgaaagtaagtgttgatggagccccttacctcagaaagatcgatctcaaggtttatggtggttatccagagctcctgaaggctttggagaacatgttcaaactcaccataggtgactattctgaaagagaaggctacaaaggatctgaatatgcacctacctatgaagacaaagatggtgactggatgttggttggagatgttccatgggaagccttcattttgtcctgcaagaagctgagaataatgaaagaatcagaagctaggggcttgggttatggtgtttgagaacatcccaaaggtaaagaagattgatttgcctcggaaaaaagagattctccagctcaggttcttggagaattttcaatcttgatgtaggtctccacggtggagacttgttgaagtttctgaaaggactctctagtcacgaaagggaagttatttacattttgcagtttgtctttgaaaatttggcagctgctcttttgttggtttgggcatctgcctgatgtcttctttacttagtgatctttctttctgaatgaaaggaggacggcgcacagatagatactgccttacatgtaaagtactgtaggagggaaatgggtgaaaatatattggcattttcatccaatgtttgctttctccatcggtttttgattgtcatcgagtcttatcaattcaactttctacttatcaaaaaattattcgacaaaaaaaaaaaaaaaaa

SEQ ID NO: 1661 - DNA, 862 bp, Eucalyptus sp.
aaaaaattatatcaccattttatacaagaatttatccaattttgaaaaaataaaacataagaattattatcatggaaatgaataaaaaagacgttaaacaccaagacaccgagttaagattaggtttaccaggcacagaaggattaaaatgcgctaataataataaaaggtcttttattgatactaaagaagtgtctacttctcctaaagaagattgtgttactaataatacccctcctccaaaggcacaagtggttggatggcctccggtgagatcgtaccgcaagaattgtctccaagcaattaaaaaagaagctgaaaatggaaatatgtacgtaaaagttagcatggatggtgcaccttatcttaggaaaattgatatgaaactatactcttgctatcaagagcttcttaagtccttggaagatatgttcaaagctcaagttggtgaatactcggaaagagaaggttataaaggaggtgaatatgtaccaacatatgaagataaagatggagattggatgttagtaggagatgtgccatgggaaatgttcattaattcttgtaaaaggcttagaattatgaaaggctcggatgctaaaggcttgggttgcatgcaataataaacgacttaactaatattgtttttttgttttttacctttttacttttttacccatgtatattttgagaattgatatgcattttaatgtaaattagtaaatgtaaactagttaatacgaggcttttttacaagctcaagaaagcctcgatttgtttttcctacttggcttttgtttgccatttttatttgtgggatataaattcatgtaaatatagtacgattaatagaaaaaaaaaa

SEQ ID NO: 1662 - DNA, 2796 bp, Eucalyptus sp.
accattttaaccgaaaactgttcgttttctgggaaaattccttctccctcttttgccgacctccccacaatttgtgcgttttcccttcctctccccccccccccatcccctgcttttaaccgggaaaggagcgactccaaattttcctctctctctccctctctctctctcactccgaccctcccccacactcgccgccgcccgattggtccccgcgtccttttctctctcaatctctccgaggcgattcgtctgatgatcccatttgactcccctgctccgccggtttgtatctcgtctgcttttgcttccgggttctttggttctttggtttttcttttttgtccatgctctcgctagttggtaatcgagatctgtgattgtatagcccatggcggagtgcgaggttgaaattcggggcggttgctttttagcggtcgaatgcgtgggaatttggagttctccttagaaagcaagggttttgtgttgctttgcgggtttcgcgagctgagattcgatctgggttttcgaggttggacagatttttagtagtgagcggcaagggctgtgggttgtggttcgtgggtcgtgggtgcttttttttttatttttttattttttatggttgggggtgggatagagatgaagatagagctaggtgctgggtatggcccgtggaatgatgaagagaaagccatggtggctgctgtcttgggaacccgggcattcgattatttagtgtcgagatcagtttccaatgaaaatctcttgatgtccattgggagcgacgagaatatgcaggacaagctctcgaatctcgtggaccaccccaactcttccaacttcagctggaactatgccatcttctggcagatttccaggtccaagtcgggggattggctattgggttggggggatgggtcctgtagggagccgaaagatggagaagaatccgaagcgactcgaatccttaatttgagactcgaggacgagggccagcagaggatgaggaaacgggtgctggacaagttgcacaccgtctttggtgggtcggatgaggacaattatgctctcggcttggaccgggtgacggacatggagatgttctttctggcgtccatgtacttcttgtttccctcgggagaagggggtccaggcaaatgttttgcctcggagaagcatgtatggctgacagatgcactcaagtcgtcttctgattattgcgttcggtcatttcttgcaaagtctgcagggattcggacaatagttttggttccgactgacgttggggttgtagagttgggttcggttagatctgtcccggaaagctcggagctggtgcagaccataagattgtctttctcgacgaattcatttatgtcggttaagccaatagctgccttacccatgacgaatgaaaagaaggacgaaaacgcacccttctctaatttggcgttggcaggtaagggtgaggcaatctccaagatatttggtaaggagttaaccgcagttaacagtcctggccattatagggagaaacttgccgttagaaagatggactccaggcaatcgtgggaacctcaccataacggaagtaaactcccattttcaactcctagaaatggcacccaagacacgagttgggctcatcatgctcatggcgtaaagcagttgagtcctgtggaattttatggctctcaaacctcagccagtaaattagaggagcggatgaacagcggtaggaatgattttggattgaaccgctacccaacaccaaagcaggtgcaaatgcaaatcgactttacaggtgccacttcaaggccttctgtgataacccgaccattcactgccgactctgagcattctgatgttgaagcttcatgcaaggaagagcagggtggtgcagcaaacgagaagagaccaagaaaaagaggcaggaagcctgcgaatggaagagaagaacctctcaatcatgtggaagcagaacggcagcgacgtgagaagctgaaccagaggttctatgcccttcgtgcagtggtgcctaatatatccaagatggataaagcttcattattaggagatgccattgcttatataaatgagcttcaagcgaagctcaaaatcatggaagcagatcgggagaggtttggaagcacttcaagagatgcatcagacgtcgaggttaatgccaccgcagagcaatcaaaccaatctccagatgttgatatccaagctactgctgctgatgaggtcgtcgtgagggtcagctgtcctttgaattctcaccctgcatcaagagttatccaggctttccaagaggcgcaggtcaccgttcttgactcgaagctttcgacagccaatgatactgtgttccatacattcctgataaagtcgcaagggtctgaacagatgacaaaggagaagttaactgcagcattttcccgtgaatccaactccttagagccattgtcgtctgttggctagtgggcgatgtgcacttatgctatagtggataggcgtaatgcatagggaaagcccctttggaagctcgatcagagttttggattgctgcagagtttcctcaaggagtggttgagccaaaaggagaaaaatgacttcctgttgaccaattaggacagcaaatttactttcattttttgttctttttcttttcatggtaaacaattctctgttaagcaaatattcttgaaagtttaattgagtctgtaagtttataccatttgtggctgttctgaacattaatatagtttctctttatatttttcaaaaaaaaaa

SEQ ID NO: 1663 - DNA, 1866 bp, Eucalyptus sp.
tcgtcgtgtaggtcgtgcatgatggagcttcctcaacctcgtccattcggaacggaagcgaggaaagcaacgcacgacttcctgtcgctgtgcagccattcgaccctccaccaccaagatccaagacagcctccttctcaagacagcttcctgaaaacccacgacttcctggggaagacgggcgccaaggaagaggccacgagcgagatatcgtcatccctcgagaggccgccgcctccggctcctccggggccgccgccctcggtcccaccgccgcagtcggtggaacacgtgcttcctggagggatcgggacgtacagcatcagccacatttcgtattttaataatcaaaacccgccaaaacctgaggcgaccatttatacggtggctcaggcaagtagcactgaccggacggatgagaactccaactgcagttcttatactaacagcgggttcacgctttgggaggaatctgcagcgaagaagggaaagacagggaaggagaacgtgccttctgcctctgtccgagaggcggaggtgaaattggggccgtggccggcatccgagcggccgtcacactcatcttccaataacaatcaccggaattcgttcagttcactctcttcctcgcagccatcaggggccaaaaataagagctttatggatatgataagatcagcaaagagtgggagcaatcaggaagatgaattggatgacgatgatggagagtttttgctcaagaaagagacttcccctattcctaaaggggagttgagggtgaaagttgacggaaagagtagtgatcagaaggccaacacacctcggtccaagcattctgcaactgagcaacggaggcggagcaaaataaatgacaggtttcagacgttgaggtctctaatcccgaacagcgaccaaaagagagataaggcatcatttttactggaggttatcgagtacatacagtatctacaggaaaaggttactaattatgaaggttcatttcaaggatggagccaagaaccagcaaatatgatgccactgagaaatggtcagaggccgacggataattatgttgatcaatctcaaaacatcactagtgggtccagtcctgctttggtatttgcggcaaaagttgatgagaacaatattgccatggccccagccgtattcaggaaagccaagaacccacttgaacctgagatgggatctgttaccgctttcaaatctgtagagcatcaccctggaatgacaaatagagcagttccatttccaatgtctctgcagcccaacatctcgaactgtgtcaggggtagtggtgcagtggcaagaggggatcctaatttggaaaacaacgcgtcccaaccactaacacagattagtagaatcaaatcattgactaacgagtgctctgcttcaaccgacaaactgaaagaagaggagctgaccattgaaggcggtacaataagtatctccaatgtttactctcaagggttgttgaatagattaactcaagcattgcaaagttctggggtagatttatcacaggccagtatctcggtacaaattgagctagggaagcaagccaatggtagaaatgccacctcttcatctcttcctaaggatactgaagctagaaatcaaggagtcacacggccacgagctgcgggtgagattgcagatccagccctgaagaagctaaagacggggaaaagctaggtagcataacaatcatcctgatattctttttgtaatacgatttattcaatttttttttgggttaaaccttcttacatatagggttcatccaatcttctcctggctaataaacttatccagtcgagaccattgtacattgtctttagtttg

SEQ ID NO: 1664 - DNA, 1139 bp, Eucalyptus sp.
gctttagatctcccccacattaaactaatctatcagctttttgacattgccttgatttggagagagagagagggagggaatggcacttgaagctgtggtctttccagatgacccctttaattattataattgcaaagaagtccaaagcttgttgggagagtgttggagctttgactttggtgatcaagagcagtgtgagaacagccatttccttagtactctggagatccaaacagaagaccacgaatgtagtgggtggaatgatcagtcaaatgtatcatcaaaggctttgatcgaccggccaaagcggtgtcggtacaagaggaggaagaacaaaaaagagatggagagtcagaggatggctcacattgccactgagaggaatagaagaaagcagatgaatgagcacctctctgttttgcgttctctcatgcctgactctcatgtccaaaaggttgatcaagcatcaattataggcggtgccatcaattacgttaaagagctagagcaacaattgcagcagcttggtgctcacaaagaaatggaaggacagagttcaaaatgtgaagatgacatctcctcccctcctttctctgaattcttcacctgtccacagtactcggcaagcccggatcaaggcaatgactcagtgcccatgaacgagtggacgagcctcactcagtctgcaatcgctgacattgaagtgaccatggtggagacccatgcaaatctcaaggtaaggtcaaagagaagacccaaacagctgttgaggttggtttctgggttgcagagtgtgggactcactgtgctacacctcaatgtcaccacagctgaacccttcgttctctattgtctcactctcaaggttgaagatggttgccagatgacttcaggggatgaaattgccgcagctgcgaatcagattctaagcagcattcaagagtgagggtctctctttgatcctcagaaccctgaagatgattcatgctttagtctctctctctctctctctctctcgctctctctcaattcaatatttagtgaatgatgagatgagatgccgatcttctagaatctcggtctgtaccaagttgcagcaactggcaactggcaactgatgtcaatttgcacacgatttt

SEQ ID NO: 1665 - DNA, 1771 bp, Eucalyptus sp.
cggcacaaggaaggcgagctggccatgggaggggcctcgctgcccaccttcaagtccatgctcgacgccgactggtcctacttcgccaccaacccgcctcaccattcccagcagcagcagcagctgcagcccgctccggaaatggccgacctttccttctcctccgccgccccgattcccgataacgccctcctcctccaccattcgcaccacccgcacccgctcgactcgtcctcctcgtgctcgccgtcgcaggccttcgtcctcgacccctcgcagacccaccagcccttcctgcagcccaagcactgcttctcctccctcctcaacgtcgcctggaacaattcctttgacaatggattcgatttgggctgcgacgccgccgggctttttggctcggtgcagggcaatcagacctcgagcgcgccgcttctcatgggcggttccgagctgggctccggttccgagctgctgcccgtgcccagtcggctcgtcccgctcggtgaaaactcaacccaattgccaggcggcgggttcgggctgactgggttcgaaggcttcgagagccccggcaacccactgttcacgaacaggtctaccaaggtcctaaggcctcttgaggttttcccccagacgggcgcccagccgactctgtttcagaagagagctgccctgagaaatgggtctggcagtaatggcggcggggctgagaaattggggaatttggagatctcggtgtcgaggttcggcgaattggacaagaagagaaagaagattgatgatggtattaatgacgaattgagctttgatgggtccggtttgaattatgataccgatgagggtaatgagagcgggaaggctatggaggactcgaagcacgaagggtgcaattcgaatgcaaacagcacggtcacagtcggcgatcagaaggggaagaagaaggggctgccggcgaagaatctgatggctgagcggcgccggaggaagaagctgaatgataggctgtacatgcttaggtcggtagtgcccaagatcagcaagatggatagagcttcaattcttggggatgctattgactacttgaaggagcttctgcaaaggatcaatgacctccataacgagctagaatcgaccccgcctggaaccatgttgcccccttcgactaattttcatccattgacaccaactccgcccacccttccttgccgtgtgaaggaagaactgtgcccgagctccttgccaagtcccaaaggccagcctgcaagagtggaggttagagtgagggaagggagagcagtgaacatccacatgttttgtgcacgcagaccggggctcttgctctccaccatgagggctctagacaaccttgggttggacattcaacaggctgtcatcagctgtttcaacgcattcgctatggacattttccgagctgagcaatgtagggaaggtcaagatgtcctcccagaacagatcaaggcacttctcttagagtcagctggcttccatgggatggtgtgactcagcgggagtagattaactggagcgaagccgatgctaaccctagtttccgttgagctgtttagtctttttaattgtaaatgctgcctcctctggtatgcttaagcagaaagtaggtttagctagtttaatgttgcaatttcgaggttgaattaccttactttacctaaatgggatgtacttccatgaacatgcttctagagagcaagacgatgttcctaagtttccagtttcatagataaaaaaaaaa

SEQ ID NO: 1666 - DNA, 3739 bp, Eucalyptus sp.
gtgttggcttagatagatcgtggatggaatggttttaggctcgtttgagaaaccctcatagactttgaaacgttgctcctttttttgttcttagccgaagtaggctctaggatgctttttgatgccatacgtgatttttcttcggcgagttttgtccggacccttgtttgttcgccattgatgtttgttgttttgtttcctgttcatcctcctatgtttgactatttcagttcatttccttttgtgccgcgcccaccaaattagtctccgccctctgcacggcaacgcaattcccatgctcccattcagttagagatgaatcaactcaaagaagcgagaacgaccttgaaaagcattagaaaaatggcagcttgtgatttttggcaagaactatatgtttcactggatgattcctgcactatcccttccctctgcacagatacatatcttgccaatccgacgttcaatgttagctcatacttaccctcttgagacctgctgcacctcaagagcaaccttaacacgatatttgatttcttctttcgtggctgctgctgccaagaaaaatgaagccaagttaaagtcaatcgtcctttcctttctcctttccttgttgacatataaacggtctataatcccttcagctgaaccttccacaagctgctctccactctgtttgcctcttttagcaaaaggctgttgatttgggaagagtgttactatgagcccatgacattttctcttcctccccaagtttctggctctggtccttctgaagcgccacctggtggttgggaagctaaagatagagttcaaatgcttatcgaaagaatgatgaccaaagctcaaattagtgtcgtcggtgaaggaataattggccgggctgcattcacaggagatcatgaatggattgcttcaacaagttacggtggacatgcccatccacctgaggttgtaaacgaggtccatcaccaattctctgctggcatacagacagttgcagttattcctgttccacttcatggtgttgtgcaacttggctcttccatagctatcatggagcacatggggtttgtaaatgatgtaaagagcttgatcctgcaagtggcctgcatccctggtgctctattttctagcagttctgctggaaaagctggaatgttaggctatcctggaagcctcactgctgctgctcctggcaattgtcaagtgattggctcggaatctttgatgacaaaaagctgcaaagatacgagcaactcttctcgcactgcagggtttgttagacaatcttctccactaattactaacacggtggataatctgcagcctgctgcatctacattacttacacttgaaaaggccacgtccctagctgaactctgtagtcacctctccaaatctagtcgtgcatcactcatgaagactagcctttctccgaggcatggagtagattcggggctagccagagctgaagttattcctgcaaatcttgatatgtggctgaaccagcatgccgttgcttgcaatttggggaatgacaatagaggtcaaactgctttgggtccaacagatggtacatggagcttcttcgagcctatcaagaagaaggtatcagcgggtgttgtgcttgagaaacctgagaataaatggaatagttttataaatagcactgtcacagctcaacctggaagaaatcaatgttcaatcatcaacccgtgcaaaacttctgatgccactcagtttcatcaaaacgctaagctgcttcatggagtaacttgtcctcctagatcaatttctgtttcgtgctctctttctgaatctgtctctaggaacttggttgcaaatgcatcatttcacgatgctgattctactaaattagagggcattccactgtttaatttgtcagaacaattgctttctggagcctctggtcagagaaatcatctaatgagcacaaagcgtggtcagactgaattgccttctaagaaacagagggtggtcgataatttttcccgacaagtcatgccaccagactattcagatatatctttgatcgagcagaagcctgagtgggctctttcttctgagaagcttgagggtggaagtcaaaaagtgatttcctcatgtgacacgtatgaaaatgcgtctgtccaacaattagtaaggaatgatctttttgatattttgggtacagacatgacggataatataattgatggtaacttagaaagtttgctgactgatgggccctattttgatgcacataagtcaggtgcagaagcttcgtctgttgtgaacttgcaggaaacacagacagatctaggttcacttagtgaaggtgtctcagaaagcggaatcttctccatgacagctgttgataatcttttagatgctgttgtttctgggactcgccctacttcaaagccaatctctgatgacaatatttcatgtaggacatcagtgacaagaatcagtagctcctctgttcccagtagctcttccttgaataaaaatttcaatatgctaaatcaagagcacaaggacttctgtggcattcagaagtctcttgtaaaggctggagtgtctgattctggttctttaaggtctggctgtagcaagaatggagtggagatgtgctctgtgagtaactccttttatggatcacatattagctcttgggttgaccaaggtcacggtataaaacaagatgataatgtttcgactgggtattccaaaaggcaggatgggatgatcaaatcaaatcggaagaggctaaaacctggtgaaaatccaagaccaaggccaaaagaccggcagatgatccaagatcgggtgaaagagctgcgtgaaattgtgccgaatggagcaaaatgtagcattgatgcgctgttagaacgtactatcaagcatatgttgttcttacaaagtgtttcaaagcatgcggacaagctaaaacaaattgggggatcgaaaatcatcaatgaggaaggtagaattctcttgaaagacaattttgagcgaggagcgacttgggcgtacgaaattggttcacagtcaatggtccaccccatcatagttgaggacctgaatccaccccgtcaaatgactgtggagatgctttgtgaggagcgaggtttctttttagaaatagctgacatgataagaggattaggattgaccatcttgaagggggtaatggaaactcgcagcgacaggatctgggctcgttttgctgtagaggctgacagggatgttacgagggtggagatatttatgtcactagtacgccttctcgaggaaaccatagagagcagtccattggtcgctaattccattgatggaaaaacaccgatggtgtgccagcccctcacacgagcaacctccatacctgcgacaggcggtcacaacgttttgcagtgaaagccttgccttgccctcgatttgcctcctcctggatatgttgagagcgagccttggtgtggcttgctatgactgacagactccagtctcaaatcgtcagttggttctgaccttgaggaggttgtcgcggcctctcgaatcacgtctccccatcagagaatcggttccgtgatgataggagctctatccagagcgatcaatcgatgttttgatgatgtgcaaatttagccaagataagcccgcgagctttttcctaaacctgtggatttgtgggaggtttgaggaatgaaagagtcgtgttccgagaaaaaaaaaa

SEQ ID NO: 1667 - DNA, 1939 bp, Eucalyptus sp.
gtacggaaaagagaaaccctccccctcagtctctctctatttctctctctctccgagccctcttccggtgcgcccctcgagacatcaaagtctctgctaaggagggagaggtggttgtgatggaagagctgataatctctccctcttcatctccttccctcgcatccaagtccatgtctcccacggccactccccctcccagcctcagcctcaccctccagcagaggctccagctgatggtgcagagccagccccagtggtgggcttacgccatcttctggcaactcctcaaccacgacgacggtcgcctcctcctcgcctggggcgacggccacttccaaggctccaccaagctcactctcgcctcccgttccgaccgcaggaggctcctccaagccctgcctcgcgatcccagcaacagccgcccagatgctgctgccgatgtccccctccccgcccccgccggagacgtgaccgatgccgagtggttctacgtcatgtccttgacccgctctttctcggcgggagacggtattcccgggaaggccctcagcacggggtccttggtctggctgaccggtgctcgcgagcttgagtcgtacaagtgcgaccgggccaaggaggccgagctccatggcatccgcaccatggtttgcatcccgactggtgatggagtccttgaattggggtcttgcgatgtgatccctgaaaactggggccttgttcaacgagccaagtctcttttcggctccgatctgctccttcccaagcacccgccaccgccaccacctccgttccagctccaccatgaccatagcgacatttctttcgctgacattggaataattgcgggcgttcaagagaatgatttcgctcctcacgctgaccacgagaagaaggtcaagaagaagcagccgctggtggaaggagctggcgggaggccggaggccccgttcggttgctccagctacctggtggagtcggagcactccgattctgatagtcctttcatggcggcggtgatgaccgagaagaggacccccaagaagagagggaggaagccaggcctcggccgcgacacgccgctgaaccacgtggaagccgaacggcagcgccgggagaagctgaaccaccgcttctatgcgctgcgagcggtggtcccgaacgtgtccaggatggacaaggcgtccctgctctccgacgcggtgtcctacatcaacgagctcaagtccaagatcggcgatctggagtcccagttgcagagagagtccaagagggtcaaacaggaggtcaccgacgcaaccgacaacctgagcaccaccacctccgtcgaccatagtagcccatccggatgcggcggttctttgctcgaggtggaggttaagatcgtggggtgcgacgccatgataagggtccagtcggagaatgcgaactacccatcggcgaggttgatggcagcgatgcgggacctggagctccacatacaccacgccagcctgtcgacggtgaacgacctcatgctccaagacgtggtggttagtgttccggaggggctcaaaggggaggaagatctcagagctgcgcttcttcgggcactggaacaatgacggtcggagaaattgccgggggagagagagagagagtacgtactgtttctcagcgtgtccgccccaagagaaccccgttcaattaatcgttgtgcctatatcccgtggtatttccaatatgctgggtaatgggtgtgtacttaatgtgatgtgcgtagctgtagttggataagaagggatgatcagcagctaggttttgtgcatttatatcttctttagtttcttctttcaatttttttttctttcccctcttttgttccccgtccttcttttcctgaggaggaaactctgttattaaaaataatatcagctctttgaccagaaaaaaaaaa

SEQ ID NO: 1668 - DNA, 1843 bp, Eucalyptus sp.
attgtgcctgagactgtgcgtcactctactccatagagtaaacccatttggatattttcccagaaaggactcgctgtacggttgatctcaaattagcctctggtattaagattggatttgatctgagactctttcggactcctcctgttttgaagccacttggatgaagcagaaccagaaggcaggaacccagaaagatactcgagttatttcattactggaaaaaagaacacgaagtttggtcttaagcaaacccggagttctccaatagatcgatcactactcgcagctaggcagagctgttaaggcatcttcataaatacgatgagtctcctgttcagtccaagagtggaatgtttagagggagagttgaaaaaggatccaggattcatggagtcggttatgcataacccaccgcatttgcagcagctgaactcctccttaatgcgatatcggtcttctccaagctctttcttcgactgtttggtcaatggcaacggttctgacatcggatgtgaggattacagctatccccattctttgagcccagaaatggatgctgccattgtcaaactcatgtcgattgatggttttgaatctaatgatatgcaagaggatggccggagatctgtaaagcaggagtcagaagttgtcttcaggactagtgtatctccggccatggatggtacttccccagtgcaccgccatctggatcatgaaattttagcaaattctattggatttgggagcttcttcgatgaagccaattccatggttttgcaaagtaatgcccctgcagaattgggtagcggaaaacgctccaatcttgtcaggcaaagtagctccccagctggtctcacttcaaacattgctgtcgaaattggctttgatgccaggagagatgctcagaatcttgaaatgcgtaaaggagatggttctttttgtagtaaatccaaatcagttggtcaaacagatttgaggtccacatcaatttcaacctcaaggcatatgcctcagattgccgaaatggagaatgagaacaaactagaccgtatgagaaaatcttggaaaaatacaacattcaatggcctaaagagggtgagagaggaagatgcaaacttgtcttccagcatacacactatggaaaatcaggataacgtgacccgaaacaggacgcatgggttgacacaccatttgagcttgcccaagacttccactgaaatggctgctgtgggaaatattttgcattttcaagattctgtttcttgtaaagctcgtgcgaaacgaggttgtgccacccacccaagaagcatagctgagagagttagaagagggcgcatcagtgaaaggatgagaaaattgcaagatcttttcccaaactttgacaagcaaacgagcacagcagatatgctggatatggcagttgtgtacattaaagaccttcaagagcaggttaagttgctcagtgaaagtaaggcaaagtgcatatgttcgagtaaataatgctaagaagggtcttctggtacttttctgcccgttctgcttctacaaattacaaaatgggaaacctcttactctcgactccacatgatagacggatagactccacatgatagacggatagaaagtaatcgctttcattgaaaaagttgtatggtgcattgaaatttaggagtcattccatttaaaccgtcagaaagaatgagtactagcagtctaccacttcaatttttaatttacagcaataggataacctcccacatatatcattcggcatcatataagccatgccaattggcttttgtatacaatgaagtactcaattttctattaaaaaaaaaaa

SEQ ID NO: 1669 - DNA, 1909 bp, Eucalyptus sp.
attgcttctttggcataagagtaggctcaatgagaagtttttgaaaaagagggaaaaatagctggtactctgtgtagattctattcctgattgataggatatgtcctttttttttttcactacgtgcttcgtgggatgctgcaaataagagacttcttttgctttaccaaactccggtactataaagctgacaaagtccattgtgttccttgttgagtcctgcaagatatcaacagctggttttggtcaaactaactttataccttttcactcttcttcaccttctctgggtcttatatatcctcgagtcctagtttatggtaacctttgctggtttattgaaattggttgaaaagacctgcttcagttcctgggttattgtgtctcaattctgaagatggaaggctgtgacggtggtgatgtcgggttcagacatgggggtgataatttcttgaattttccacactctggggtgactcccagttcagtccgggaggaattctcaggaatggcaatcaaccctttcgttagctctggttgggatccactcgtgtccctaactcagagttaccgttttgcaaatccttcaatggcctctggcttccccttttcttcacaccccggcatcatggaaaatcaaagaagtggtggcgactttcctcctccgctcggtcacaatctatcggcattgaccgagcaggtctcatttgaacggctcccctgctcagaaagccggagttacctggatgcggtcggctactttgggctgcctgacattgctaactctgggtgtcctcctaactacggctctcaaagggaggatgatcatgatggtagtgaaggggcctcggctaacaataaactgtcccaggactgccggatcgaagaggacggggagggatcatcaccgagcgtcaagagaagaaaaaatgcgccggctcacgataccatttatgatagtaaggaggtgaaaagggatccttctagggtgatctcagatgtcccgaaggaatgggacgagaagaaacagaagaatgagcagactttgcatcctaattctcagggcaaacaaactggtaaacaagtgagagacaatgttgaagctccgaaggagaactatattcatgtgcgagcgcgcagaggccaagctacaaacagtcacagccttgcggagagggtgagaagagagaaaattagtgagcggatgagaatgcttcaagaactcgtccccggatgcaacaagatcacaggaaaagcggtaatgcttgatgagattattaactatgtgcagtcgctgcaacagcaggttgagttcttgtccatgaaacttgctgctgtcagtccagagctgagcattaacttggagaggatactttccaaagatatattctgctcaccgggcagctctgcaactatcatggataccgagcgtggaattgcctgttcttctccttatacaaaaggatttttcccagaagcttttccaagcctcccgagctcgaatcatcattatcctccattaacacaggctttttgtgagagtgagctacaaacacagtgtcaatcgcacttcctttccagttcaggagtcgacagtttgggtctaaatgggcgcttaaagtcagagagatgaatttttcagagaagggtctttgttcaaccggctcaaaactggaaacctggagaattaggctaactgtatctgactgatttggaggagaaaatagagttggtttttcctaagtaaagagaaatgtagagttgtatagatggtgaaacaaactggtttactcttcggatttttaatcgaagaggatgctcggaagtgctaacatatttttgtatatttagacagcactgacgaattctctatccgcaatggctttttttcaaaaaaaaaaaaaaaaaa

SEQ ID NO: 1670 - DNA, 1917 bp, Eucalyptus sp.
ctcattcacattctttagaaacgccatcttagctctctcgcctctcttaagactctgatcccaccattctgatttcgattcccactttgcctccccctgcttcttcgctcctgaaacatggacaatgagttctttatgccatggcaaccgctctcctcaggaatggcaattcagcccaacgacctgaactgtgcttccaagcaatcccctgattgcttcttcaatcccaattgggacaactcttccgcagatcaaggtggtcacttcgagtctgcgctgagctccatggtgtcctccccagctgccgccggttcctacctttccaatgagagtgtcctgatcagggagctgattggaaaactcggcagcattgggaacccaggcgaggcgtcgccatcgccacattccctccccttgtccgggaatgccaccgccgcgatgccttacattggtggaagcaatagtactaacacgtcatgttataacacccctctgaattcgcccccagatcgcgcggtcaaggagagattctccagcgtggcggagttcactgctgatcctggatttgcagagagggccgcgaggttctcgtgctttgggagccggagcttcaatggcctgacgagccaattttccctgaacaatggtgagccgccttacaagtccaacccgctgatggagagcgggaaattccaacgggtcttgagtagcccatcactgaaggcgttgggatctcaggcagtggccaccgttcagcagaatgtgatttcgagactgtcagatcggattgaactgacgaattctaacgaggagtcctcagtgtccgagcaaatcccaggtggggaaaatggattgaaggcctcgaacgaggcaaattccaggaaaaggaaggcagctgctaagggaaaagcgaaggaatccgccccctccacatctgtcgccaatgctatgaaggtatccgagtctcatgacaattcgagtccaaagcgatgcaagccgaatgaagacgacggaaatggaaatgacactgccaaaggggaagatgatgccaaaggaaatagtaaaaagaatgatgcaaagccgcctgagcctccaaaggactacattcatgttagagcgagaaggggtcaggcaaccgatagtcatagtctagctgaaagagtgcgaagagagaagataagtgagcgaatgaagctcctccaggaccttgtgccgggttgcaataaggtcactggaaaggcactgatgctagatgaaatcatcaactacgttcagtcattgcagcgtcaagttgagttcctttccatgaagttggcctctgtcaataccactctcgattttaatgcagatgcactcatgtcaaaggatatgtttcagccaaacaactctgtaccgcgtcctatgtttccattagattcttcagcgactgcctttcatggccaccaccgacctcaaaatcagccattgccaccaccgctgcaaggacacgtctctagtggtacagcgacccaagtagagccattgaatctggggccatgtcacaccgttgagtcacattctccactgaatgatcttcagtatcagaatttctgtggagatgacctgcaaagcattgtccaaatgagttttggtcaaaattcaaatcaagaaacagcattccagcttcagactttccatggttaaagatagtattccaagattaggtctaatgaagaagacaattagttgtttttcttccttcaatttttgtctatgatctttcctttctttggggctaattcttgaggggttttttctcagaataccctctgtaaaatctttgtaacatttcttccggtgcagagtgtgatagccatacatgtatcataatatataaattctatgaagatgaagggatttatttttccaaaaaaaaaa

SEQ ID NO: 1671 - DNA, 1765 bp, Eucalyptus sp.
cctcctcgcgtccctctgcgttccgccagctaaccgaaattccggccacccccgccggagctccgccgtgaaaccctctctccgtctccgcctccgcctccgcctccgtctccgtcgcttccttccgccgtcgcgaccgtagatagatgcccttcccgcccgctcatggcgaacaacccgagtgacggcgccagcgacgagttcctggagcacctcctcggcctccccaacttcgctgccgcggcggaggccggcctcgccccgggcgacgggaccggcctgtccgtcaccgcggccaccccgatgatgctccagctcggctccggcgacggctccggcggccacggccacggccacggccacggccatggccaaggccacttgtcggccctcggcggcgggggagcgggggcggggggcggcggtggcggcggtggcggggggtaccatggggcggtgttcccgctggggctgagcttggagcaggggaagggagggttcctgaagcccgaggaggcgtccgggagcggcaagcggtaccccgaggaggtcgtcgacggcagagcttcgactgtgaaaaacctgcactccccgttgcccaacttcccagatgtttcgcaaatggcttcttttaggaaccgagatgtgtttcatggacaaccagtgcccaaccctgttcctgcagcaccacatccaccagcaatgcgcccgagagtaagggctagacgaggacaagctacagatccccacagcatcgctgaacgattgcggagagagagaatagcagaaaggattcgacaattgcaagatctggttccaagtgttaacaagacagatagagctgccatgcttgatgaaattgtggactatgtgaagttcctgaggctccaagttaaggttttaagcatgagcagattgggcgcagctggtgcagtggccccacttgtgaccgacatcccactatcatcagtcgaggaagaaggcggtgaaggtggaagaaaccagccagcgtgggaaaagtggtcgaatgacggcacggagcggcaagttgctaagctcatggaggagaatgttggcgccgcaatgcagttccttcaatccaaggctctctgcatcatgccaatctctctagccaccgcgatctaccaaactcaaccgcccgacacctcctcccttgtcaagtctgaaagcaatccaccatcctagaccagccacaacacaggcacctcccctttttccaggtcccaccaaaggctcaagacttaaatgctccttggtccccgctttagtttgtcccgtttctacaccttcaaaaaccagttgatggcccttcttccttcctcaaattgcaatcaaagtcagatgccatagcccttgcttttctgccctctctttaagcttttcgcccggacaggttcaatgtcaatgcctaataaaatactagcaggcccttcatgtcttgccaagttcaactaaaggagagatattcaaaccctcacttgatatgctctctctctctctctctctctctctctctctctctctctctctctctctctctctctctctctaccaatagaatatgcttagtggagaatgatgtgagcgactttatagtgggtgggggctcttgtttttcttggtagtgggtcgtgggaccttgtaaaagggattggttgtgtaaagtaccatttgtataatgtaatgcgtaatgtgttcgatgagggggaatggattgcttggtagaaaattgagaaaaaaaaaa

SEQ ID NO: 1672 - DNA, 2113 bp, Eucalyptus sp.
atctcgcttctgctttcccccccagctcaaaccctgctcgatcttgaattttctgcatttagattcttgaccctgaactgggtaatctttaaacagtacaaacaacgacgtaagctgagaaagttttcatttttctttctgggtttcttggaaacatggaaaatgacttcttcatgtgtggaggagcgctcgtcccaccacctccgccaccgttgcagtgcgcggagatgaattgcttctacaaccccagctgggaaaagtcaacagtagatcacggggtggccaagtttgactctgccctgagcgccattgggtcctcgcctgcagggtccacctctaactccaacttatccaatggcagtttcgtgatgagggacctggttggaaagctcgttggcgttggcaattccagcgagcttccgccgcattctcatcacctgttctctgcaatgccggcgaagacggattctcacgttggcggagataacagtaccgggaattcatgttacagcactcccgtgaactccccgcccatgacggatcgcttgtttcaggacaatcatcacttgcccaaattgggacatgccgtgatgcctatgaactctggcctagcagagttctcgcctgatcctgggttcgcggaccgagcggcgaggtactcttgctttggcagcaggagttttaatggccggtcaggccaattcagcaggaaatatggcgaaatcgtgaatagatcgatgccgccgatggcggacgagaaattgactcgggtttccagtggcccttctctcaaggcactcgagtctcaaatggctgctgagcagagcaagaattcgccgccgcaggacagaggcgaattgtcaaattcccaagagggatcctcattgtcagagcaaatcccaagcgtggaaataggtctgagggcttccaacgatgcgggcttgaggaaaagaaaggcagtccctaaagggaaggcaaagggatctgcaggaaccttgccatcttcaaatgatgcgaaggttgatgaggctaatgaaaattccgatgccaagagatgcaagccggatgaaagtgcaggaaatgagaactgctctggtaaggccgagcacgatccgaaagagagtactggaactgcatcagaagacaaacaaaccaagaccgaggagaaagactacattcatgtcagagcaaggaggggtcaggcaactgatagccatagccttgctgagagagtgcgtagagagaagatcagcgagcgcatgaagattctccaagacctcgtgccgggctgcaacaaggcaattggaaaggccgtcatgcttgatgaaatcatcaactatgttcagtcgttgcaacatcaagtcgagttcctttctatgaagttggcttctgtaaattctggtcctgattataaaatggatgctcttatgtcaaaggaaatgtttcgatcaaacgacccaattcaatatcctatccttccgccagattcctcggcggcatccgtcttatatggtcaccacaggcaccagaaaaactcagcagtacataaccacatcacggaggggacaaccgcccaattttcgatggacccactaaatgaaccgcattttcctccactggacggattaaatgatcacgttctcgcgtccttctgcggagatgacctgcagatgctggttcaaatgggttttggccaagacaagctgacagacgcgccattggatcatcaagattatcacggtcaaaacccggtctcccacatgaaaatcgagctctagcaaagctactaaagttttcctcactgactgcctggtgacggaggccctgtagatacaagcagtgttgttcggaaagtttgcaagattgccgagcaaatttgatcctaggtccgatgaagagaaattttttcgccctattattattctttccctgctagtatagtcgtccctgatcttgcccattagttcttcagaggtagtcttcttgccgtatagtgttggcacaatttggtcttggtcttacaatgctgtacagcttagagcaccgaatgtaaaataatatccccgagtagctttcgttttaaaaaaaaaaaaaaaaaaaaaaaaaaaaaaaa

SEQ ID NO: 1673 - DNA, 1548 bp, Eucalyptus sp.
aaacacccctttttccagtaaagcatcaaatccctcccttccaaaaacacagcacgatcacagcatggagtccatcgacgaggaattccgtaattactgggaaactctcatgttcttccaatctgaagagcttcttcacaacagctgcgtcagcgaggtgatttccagattcaatggtccgagttcgccggacgcggcggcgctgccggtagcatctaaaagcattgacctggaaagaaataggaggaagaagctcaatgaaaggctcttcgcactcagagcccttgtacccaagataagcaagatggataaggcttcgatagtgaaagatgctattgattacatccaagacttgcgtgaacaagaaggaaagatccgagccgagatcgcagagctcgaatctgtaattctgaagaaaaacccaggctttaaatttgagggagaacgatcaccaccggcccatccgaaatctaagagaaagagagcaaagctgcgccatgatatttccaagagtccagacatcactccaatcgaagttcttgagctaagagtgatggaagctggagagaagagtgtggtgattagcttgacctgtagcaacagaggagacgcgatggtcaggctctgtcaagcgttcgagtctctgaagctcaaaatagtcgccgctaacatcaccgccctcccggaggaacttttgaagatggtgttcatagagaaggaagagaagcagggtaaggaacacattcaatccaaaatacaagccgccatcgcagctctgaacagtcaccatgccgagcccactgatgcaagcatgaagcaacttatgagccgagacatatagaagggttcgattccattagtgctcatgggatgtcattctcggtggcagcgtattacaaaatttatcattgcttagtgttcaaaatgtgaatcttatctacttcaatagcacggcatgtcgaattctatgctttgtagacagtaagacgttttgcacatccaaatctaaagctgaaggggatgagatttgagtcctctttatgaccgaggtggcccttcaggtgaaatgattgtgctccttttttgtgttcgtgtgataataaaatatggtttcttttaaaaaaaaaaaaaaaaaaaaacgactattgatgaccgaaggcgccaaaacaaggaagttgggatgtaaagtaaccctcctgcacagaatagttgcctgagttatgaccttgcaagacaaacatttgaaggttgagggctttgaagtgtgtgaaactgcttgatacagttaaccatggatggttcgaacagtacttccaagccatactggtgtgtttgattagcacttaggaggtgaggcggtcatccaccctcttgtctagttggacttggggtaaaatgaattgtccatattaccgctagaaggaatcctcaaatatttttcttttgaacaaggaaaatttaattatcgtattatttagattttaatggtccaaccattggaaattacaattggttatgagtattatggtattataagtaaaaaaaaaa

SEQ ID NO: 1674 - DNA, 1270 bp, Eucalyptus sp.
actagtgattcgactggagcacgaggacactgacatggactgaaggagtagaaagaactgatacccatctctctggttttgatcccctgatccccgtcacgtctgtcaacctctctctttattaatacgacgttttcacgctcttcctgctctccagttcctctcctaatggcggccgcaaccacctcccccaaccccatccggaggaacggcagcttcgctcccgagcgcgagagcttccacaagttcttcgagtgctggctggtggagcagaaccagcacctccacgacctcatctccgcctcctcccctgcgcgggacggcgatgaccaagccctccgccccctcatcgaccgagtgatgctccactacgagcaatactacaaggccaaatcgcggtctgccaagcagaacgtgctcgccatgttctcgccgacgtggaggagctcgttcgaggatgccttcctctggatcgggggatggcgccccagcatggccttccacctcctctactcaaagtccggcctccagctcgaggcccagcttgccgagctcatccggggcctcgccaccagtgacctcgctgacctctccccgagccagctcgccctcatcgatgaccggcagaggaccacgatccatcaagagaaggctatcaccgagaagttcgccaagcaccaggagacagttgccgacgcgtccatggtggagctctcgcacaccatcacggagatgatgcacgctggcggcggggatgcagcagtggagaacgaagctgcgatggaggaggaggtggagagcgctctgacagcgaaggaagaggggctggaggagattctgcagatggcggacgatctcagactgagcacgctcaaggagattctcaacatcctgacctcgatgcaagcggtgcatttcctgatagcagctgcggagttgcacctgaggattcacgagtgggggaagaagaaagacgaagctcaagctcaaactcatcacgtagaagctcacgcgaccgcgcaataacactcgttctgcttcaggttcctcttgcacaacgagtagtagtcttagtcatattgggatttgctggttttctcttaaactaatcaagtgttactatggaattaggatgtgttaggttggattttacttggaagaagcggtgtcctataattaataccttctttttggggggcaaaagtcgtgtaatactccaaatacatgatgatcccttctaatgaaatcgaagcttcgtctaaaaaaaaaa

SEQ ID NO: 1675 - DNA, 1461 bp, Eucalyptus sp.
cttccttccgatcaatccaaattccgcctgaaaaaccctaaattccctcaattcagatgcttttgtagagatctcccatcgtctccttcatcttctttttccccttttatctttttttttggttttgttgtttttttgttgtttttttgtttttttcctagtgttctgatggaggatctggagttgcatatggatgaggacgtgatggctcacatcgacctcgacggcttcttcggcgacctcccggaggccggcgacgtcatcggcgcttgctcctcggcgaacgggtcgtcgtcgtctccggactcggggctctcgtggttcgacgagatcgagaacatcctgatgaaggacgacgaggacggcggagttgtcggtggcgggattagggctgattcgagccaggagttctgcgataggttcctcgccgacgtgctcgttgactcccccggagatgggtcggcggtgatagccgacgacgggtccggcgacaaggaggagcctggatcgtcggatgacggcggggtcgaggctgcgaaggttgatggggctgacggtggcggtgaagcctatgatcctgcttctaagaagatcaagaggcagctgaggaacagggatgctgctgttaggtcgagagagaggaagaaagcgtttgtcaaagatctggaggtgaagagcaaataccttgagggggaatgtaggagacttgggaggttacttcagtgcgttatggctgaaaaccaagctctgcgttttaatttgcagaatagtgcgtgtggtgctagtgtggccaagcaggagtctgccgtgctttcggaacccctgccgctgggttccctgttttggttcctatgcatcacatgcctatttaccctgcccccgccgctcctgttggcactggaagcagtgttgcgggaaaacgcaggaaggggaaatctgaaacctctggcagctccaagaggagcaagaagtgagatgtttggatcctgtggggtacaaacccttgacaagagcaggagatacaaagcattaaggacgaagatgaaggcgggatttttgctgccccgagttttggcataggccgattttcttctttgtgactctcggctgatttctcgcatcggggtttgcctttgtttctcgttccgtggtctaaaatggtgtaagctactggaataattagctaggagatgaggacttttcgagtagatccaagctttttatgtaaattccctcagaaccacacccgtgattagcccgtatgattatagcagttgctttgcctaagcgggttcgtgatttggttcagcgccttcttgtgtgtcctttaacatttgcttgtcatatggctgctcgaggacatccgaacttagatttgaggcttctgcaggtgggaaggatcatcatattttgttgctacaatgatatctaactatgacgttgttttagttaaaaaaaaaa

SEQ ID NO: 1676 - DNA, 1806 bp, Eucalyptus sp.
ctggtttgtaactctctttcttctcatccatctctctctgcctgttgggctgttcctccaaacgagtttcttttcgcgaaaaaagagttcattgttggtgttggagagatgaaatagcccggctctgagctcagaacaagtcttgcatggcgagccacagaattggagagattggtttatcagaaacaggaccatcaactcaccacgtcccttattcagtctatcatggaatcaacaatcccaccactttcattaatcaggaaggatctgcttttgattttggagagcttgaagaggcaattgtgctgcaaggagttaacatcagaaatgatgaagcaaaagcacctttatacgcaggcaggcctgcggccactctggacatgttcccttcatggccaataaaattccagcacaccccaagagggagttccaagtcacgaggagagagcacagactcagggtcaggagtgaacacgaacactctttcttcgagcatagctgaggctcggagagaagcagattctccggtcagtgtaaagggatcatcttctttggatcatcagaagctgcaaaagccaatggagatggcagcaagtgatacgtctcctctaccttctccaagtcaatcagcctcgaaagcgccccaagacaagacgttgagacgtttggcccaaaacagggaagctgcaagaaagagccgtctcaggaaaaaggcttacgttcagcaactagaatcaagcagaataaagctcactcagttagaacaagaccttcagcgggcacgctctcaggggtttctcttgggtgcatgcggtggtgctaatataagctctggagccacaatatttgatatggaatatgcgagatggttggaggacgaccaccggcatatgttggagctcagaaccggcctccaagctcatttgcccgacggcgatctcagagtgatagtagatggctacctttcacattacgacgagattttcaggctcaagggagtggctgctaaatccgacgtctttcaccttataacgggggtgtgggccaccccggccgagcgctgcttcctttggatgggcggtttccgaccctcagaactgatcaagatactaataacgcaattagatccgttgacggaacaacaattcatggggatatgcagcctccaacattcatctcagcaggcggaggaggcgctgtcccaggggctagaacagctccaacagtcactcgtcgacaccattgccggcgggcccagcatcgaaggaatgcaacagatggcaatcgccttgggcaaattaaccaatctcgaaggctttgttcgacaggctgataacttgaggcaacatacccttcatcacttgcgccggatactgacagttcgacaagccgcacgctgttttttggtgatcggagagtattatggtcgactacgagcattgagttctctatgggcgtctcgtcctcgagagagcatgatgaatgatgataactcacgccaaacaacaacggacctgcaaattgttcaggctacacaaaatcacttctccaacttttgattataccgcatcagaccaaggagctagagctgaacctgatcgatcggatcgagaacgacgacctcgttcacataaacaaattcagccagaatttcttggagcttctcttttaggaggatagcaaattttagtgtttatatatccactgtcttatctgttcttgtcgtgtaaatgaatgtaatcaattgtattgtgcattgggaagcttctagtggattgggttataaagaaagagaaaaaaaaacaa

SEQ ID NO: 1677 - DNA, 1291 bp, Eucalyptus sp.
agtaggaagtccaagggaattagaagaccatatggaggagggaaaagcaggaggaggagctgagaagatgaagaaaagcgcatcagagttggggctggaggagtcgatgcgaatcatgatgatcgccccttctcctgaacaccaccacctggaccatcatcctcctcataactattgttatgacagtcctcatactactagtatatcatgcatcacagacgctcctcctctctcttttcacgattgggacatcagtggtcctggtagcgatcatcaacatgatatggccaccgcaataaccgctttctgggatccccctcttcttaccgagcactcccctcctgattctaactcgtccattttcgttggtagcagtacatcattggctaataagcctaaatacagagatatccaagcaagagaagccacaagtggttcatcccgccaacactcagatgaagatgatgctgcgacagtggcagatccaagcgaacagagcagatatcctactgatcccaagcgaattagaaggatggtttccaatagggagtctgctagaaaatcacgtaaaaggaaacaagcacacttagccgaacttgaaatacaggctgaccgacttagaggagaaagttctactttgtttaagcaactattagatgctgcacagcactaccgccatgctgatacaaataatcgagtgctgaaatctgatgtggaagccttaagagctaaggtgaagctggctgaagatatggtggctcgaggcccttttccttgtagcttaaatcatgttttgcaaactttgaatcaccaacattctattggtactcgtggtcttagtgctgtggcaaatgtttctcctacaatcactgtccatggggataatgactcttcaactggcttgacggttccaatgccaaattcttgccttggagttgaaaacagcaatcctaataatagcaacttcacaaatggagtcatccatgatcctgtaagctttgtgtctgggatttggtcctaaaattcttatgttcctttctgtttcaattaggtaagtcttttgttctgccagtcctaatagtcctcttaaaagattagtcttgggtggtttcttcttgtactcaggctgtcccttacgtttaaaaaaatctccagggcagacttgagatgtcagaatactgaaggacaagttagcattttttatgtctgttgtatcaattaagcgatatgttgtgactatgtttttcaaaagctccaactcagatgctgaacagttgccttatttgaacat

SEQ ID NO: 1678 - DNA, 1805 bp, Eucalyptus sp.
gatcccgtccttccccgaattcgcccccttttcgcctcgaattatccgaacgcccccccaatttcccgtaccctccgccggaatcccgccgggctcgagctgattccgcggcctcggcggccgagctgctcccttgcgaatttcgcttgatcgattcgcgatcactcctccatcagtgaagcagaggggcatttcttggcgttctttcgatcgaacaggatgctttgaggaatttgtggagtgagcggggtagaaacatgggtagcagtgagactgaaaaatctgcaaaggagaaagagacgaaggggccacctcctactaccctggagcaatcgtcaaccgctagtgccaacccagttactccagattggtctggttttcaggcatattctcctattcctccgcatgggtttttggcatcaagtccccatgctcaaccatatatgtggggcgttcagcatattatgcctccttacggcacccctccgcatccctacgttgcaatgtatccccatggtggcatatatgcgcacccatctatgcccccgggatcttatccttttagtccctttgccatgccttctccaaatgggattgctgagggaagtacaactggggaagctgatggtaagccgactgaagtgaaagaaaaattgcctatcaaaagatcgaaaggaagcctggggagtctgagtatgattacaggaaaaaacaatgagcttgccaaaacatctggagcatctgctaatggtgcttattcaaaaagtgctgagagtggaagtgaaggttcaagtgaaggaagcgatgataattctcagaacgactcccaacagaaatcaggaggcagacaagactccttggaagatgtatctcaaaatggcaatgctgaacatggttctcaaaatggaggatcaaatactccacatggaacagtgaaccaatcagtggcattggtgccaatcgctgctgctgggccagcaggtgttcctggtcccactacaaatttgaatattggaatggattactggggtactcctgctatgcctgcaattcgtgggaaggttccttctaccccagttgcaggaggaatggtcactcctgggtcaagagaaagtgttcagtctcagatgtggctacaggatgaaagagaaattaaacggcagagaaggaagcagtcaaaccgagagtctgctcggcgatctcggcttcggaagcaggctgaatgtgacgagcttgcacaccgtgctgatgctttaaaagacgaaaatgcctctctaagagctgaagtgagccgcatcaggagtgagtacgagcagcttcttgcagagaatgcttctctgaaggaaaggctgggggaagttcccgcacatgaagattcaaggtctgaagaaagacatttgaacagtgaatctcagaagacagcaaagactgaacatggccagaatgctcgctagatttattggctaccctgtcatgctggtttctggagtgtaacctaaccaactagcaacaggaagttctcattttacgtagtatgtagttccaccgcttattgaagctgaccttgatagttttaggatgtgttaattgtcttgccttaatcatctgtcagcaagccttatagttgaggatgtaggattgggcttgagcactgtgaaagtttgccttccacccttatttttatctgttgagaagggtagcaatcacacttatgtgtaccaagtactgttgattgatgtgtaatttagagaatttaatgagcttgagcatgctgttaacgagcatagagttcatcaaaaaaaaaa

SEQ ID NO: 1679 - DNA, 60 bp, Eucalyptus sp.
tttccccggttttgtttcgtggagatacctgtgtccagattataagcactgggtagacat

SEQ ID NO: 1680 - DNA, 1352 bp, Eucalyptus sp.
ttgaatggggattcaaacaatggcttcacaaggcggcggcggcagcagcggtaatgccagaggtggcggtggcaataatggaaaatccactgaagttcagccattgactcggcagaattcaatatacagtctcactcttgatgaggttcaaaaccagttaggtgatttagggaagccattgagcagcatgaacctggacgagcttttgaagaatgtctggacagctgaggccggtcagtcaatgtttatggatgttgagggcacggctgtggctaatcaaaatgctctcccccgtcagggaagcgtttcattaactggtgcattgagcaagaagacagtcgatgaggtatggagagatatacagcaaaataagaacagggaagaaaataaatctaaggaacgacaacccactttaggagaaatgaccttggaggacttcttagtaaaagcaggtgttgtcgctgagtcatcttcggataaaaggagtacaggtaacattggcggggtcgaccccagcattacaccacaagttcctcctcaaggacagtggatgcagtacccacaacctcaatttgctcacccacaacaaaacataatgggtatttacatgccagctcagactatgccacagcctctgcaaatgggagctggttccatgatggaccttccatatcctgataaccagcttgctttaccttcaccattgatgggaacattgtcagattcacagacaagtggtaggaaaagaggcgttcatgaagaagtagtagataggagtgttgaaaggaggcaaaagcgcatgataaaaaatcgggaatctgcagctcgttcacgagcaaggaagcaggcttacacaagtgaactggagaacaaagtttcacggctagaagaggaaaatgaaaggctgaggaaacgaaaggagttggagatgttgttgccatgtgcaccccctcctgagccaaagtatcagctgcgaagaactacatcagccccattttgacatctgcttccgtatgctgtatctgaaggttctgtagatataacgatgccttcatggttggctgatttggtttacccgaggaagacagaaattaaaccgaagcccgtcgagtcgcgcatttcaggtgctttctaataacatagaaatgaaaccaaagcccgtcaagtcgcgtatttcaggtgctttctgatatttgtctgagccttaaaaaaattttgcttatatttaattcgcttccttagtgtgtcgatgggatcattgtactgtttgtgattttcttagttgtgtatcgctgtgagaattgtgattcttaagcagttttgtaagtatttgtatcctgtcaaaaaaaaaa

SEQ ID NO: 1681 - DNA, 2488 bp, Eucalyptus sp.
actctgatccgactttgcttgcctccctggttgattttgacttcgtgggctgctcgagtatcgaattctcgtaagaggtagaagaaggggataactccacggtgaaaggatctgctcatgatttttgaattcttgtgaggcaaatcttgggttttctccataataagaatcctgacatgacatagagctgatagattttacattcttccgagcaatgcgaaagtgacataattttgggggtttgaaacattggagcacggtgaagagaataaaaaggcctgcagtcagtgggatgctgactttgatccccaattagagatcttgaatctatctcagttctcgtattcctcttattgtaggacatcaattaataataggcgtgcgacaactctgtttacatctcggaggacactgccagaaaaggattggcccctaaatcttgcgttgagacctgcattaatatagagtattcagaagaatcatagaaatccaaatggccgatggtagtccaagaaccgacatctcaagtgatgacacagatgagaagaatcagaggttcgacaggggtaaatctacagctattgttgcctatgactccagtgacagatcaaaggacaagaccgatcaaaagactcttcgcaggcttgctcaaaaccgcgaggcggcaagaaaaagccgattaaggaaaaaagcatatgtccaacaactggagagtagccgcttgaagctaactcaactagagcaggaactccagcgagcaagacaacaggggatattcatatcaagctcaggagaccaagctcactcatctggtggaaatggggccatgacatttgatgtagaatatgcccggtggttggaagagcaaaaccggcaaatcaatgagctgaggtcagcggtgactgcccatgcaggtgatggggagctacgtatcattgttgatggcatcatggcacactatgatgaaatcttcaggctgaagagtaatgcagccaagaacgatgttttccatctcttgtcgggaatgtggaaaacaccagctgagagatgttttatgtggcttggcggatttcgtccatcagaactcctcaagcttctcgtgaatcagttggagccgctgacagagcagcagctgacgggtatcggaaacttgcagcaatcctcccagcaggcagaagacgcgttgtctcaggggatggaagcattgcagcaatctcttgccgagacattgtgcagcggatctctgggttctgcgggttcatctggcaatgtggcaaattacatgggtcaaatggccatggctatgggaaagctagggacacttgatgggtttatccgccaggtaatataacattgatcttctgaccaaaaaagaatataacatcaatcttctgatctctttggatgttcatattgaattcccacaaacttggattgggtcattcttttcgggtgctagagttgtgttatagactttccctttggtgtcacacttgagaagtttattcctggcctttcaaaatggattttccatcgattgaaggaaaagaacatatcatctttgaccgcatgtcagttttcaatgtctagcatttctacgtagcttgctgtcgaactgacatccaagattttggaatgttcacatagctcataatagaaagtcagaccgagttttctggatttttctctactattagtttgatttgataatggcagcatataatactagatcctgctgtagatatttagagggaatcaactcttaaccaaatctcatgtttcctgcatgcaaagcatgcaaaaattattgtaagggcaaatttcataaacttgtagcataacttcgcctttttattgatacatactattcaattcgattgcaagctattatgatccttacaatgaaccagtgagaaggtctaggtaaacatcctaagagcccctgagactgattctaggatcttgtgctgccaagtatttcctgcaacttttcattggggtattgttgttctgtgcctctggctttattctgaatctgattttaactatttttgattgccgccaccaggctgacaacctgcggcaacagactctacaacaaatgaatcgcttattaacgactcgtcagtcagctcgtgcactccttgcaattcatgattatttctcccgacttcgggcccttagttccctctggcttgcccgtccaagagaatgaaggggtcatggtctatgcaggctgacatgtacattggtgatctttaggaagctatcagttttgaagtagtttcggacctagaactggtttatttctagttttcttcattttttttttcttttggctataattattttttctttcttagacacgaagtcacagagaattgattgatggtatgctaagctatcataggttgggattgcattgttctcattgaagatactgctaattgtgtaggcactcctgttcattagtcatctaaaaaaaaaa

SEQ ID NO: 1682 - DNA, 1661 bp, Eucalyptus sp.
ccgcccgttggatccccccccccttttttttcaccgttgatatcccgagcacctgcgcgagcggcgccgctgttgattattgcatgagcccggccgtgatgatcccccacaagaacgcggcgaatgccttcagcggcaagaccgcgcgggcctgcgacaactgcatccagcggcgggctcgatggtactgcgccgccgacgacgccttcctctgccagtcctgcgaccgctccgtccactcggccaaccccctggcccgccgccacgagagggtccgcctgaagacggccgccaccccgcagaagcacctcggcgagttctcctcgcaccacaggaagaagccgtcgtcgtggcaccgcggcttcaccaagaagccgcggacgccccgcggcgcgaagtccgcgctccaccgggcgaccaagccggagaacgcggcccggaacccgttccccgtggttcccgaagtcggtggagacgagacgtcgaacgaggagagcgaggagcatcttctctatcgggttccggcttatgatcctttcgtcgcggaaatgtgcacgtcgaaaggagctgaggcgactgcgttttccgctgagccagaaactgtcgcggccttcgacggatcaggcgacggcgacaaccgaagcaaagggttggccgacgaagtggagaatttgcaggagtttctcccgtcggacgcggacctcgcggaattcgcggccgatgtcgagagccttctcggtcgagcgcttgatacggagtccttcgggatagaaggactaggttttgtagattgtaaggagcgagacgataactcgatggactgttccttaggtagcggcggagcgattaaagtcgaagagaaggagggtgtcgcggaggtcgtcgtggaattgggccacgacgacatggagatggatgtgagcaaggagacattcgagctgaatttcgactacgattctccgacaacgtgcggcgatgaagaagaagaagcgaaggtgatcgtcgaactggaaggggaaaagaatgtggagaattgcggcgcagatgaggggactaacattagtagcgaagagaggaagaagaagaagaagagggagattttcttgaggctcgattacgaggcagtgatatcggcatgggctggccagggttcgccgtggaccaccggagaacggccggacttcagccccgacaactgctggcccgacttcatgggcatgtccggcttggaatttcaaaacctctacggcgaagctggagtgcacgggggacacgtgggcatgggtgacgcggggcgggaggcgaaggtgtcgaggtacagggagaagcggaggacgaggctgttctccaagaagatccggtacgaggtccgcaagctgaacgccgagaagaggcctcgaatgaaagggaggttcgtcaagagggcttcgtctgcatcgtcatcagcgcctgcttttcctctgctcaataaatgaaactctctccgtcgatcatcagtgaagctacctggtcatggaatagccaatgacccgacagtaaagtgacgccctgttagaagctagcttctgggtccagccaagtttgcttatctaaatacacgtccacttcgtggagacctgggggtagctagagttctgtgttaatccaataaaaacccgaag

SEQ ID NO: 1683 - DNA, 1078 bp, Eucalyptus sp.
ggaggaggagctgcaagaaagacccctttcaaggcgtttcatatctttctgattcttgaaggatcgaggaggagagtgacttaaccctctctctcttcttcctttttattccatggatactgccgagtggcgacagggaattggggttattaaagccatggagggctcatcgaggcctgccctaaggtcgaggcctcaaaaggaccaagctttaaactgcccaaggtgcacttccacacacaccaaattttgttactacaacaattacagtctctctcagcccagatacttctgcaagacctgtaggaggtactggactgagggtggttccctcagaaatgtacctgtgggtggtgggtcaaggaagaacaagagaccctcatcatcttcgccttcaacttcatcgtcatcatcaaagaacaagattattcccaatctgactccacctcctccaaccatccttcactctgaccctcaaaaccctaataataagccccaggaaggccaaggttttggcctgcccagctacttgccggctcaggcatacgctgcccttagccaccaccttccaaaccctagctcttcttcttccccaatggagtttctaaagagcggtgggagttggcctagcggtttgagcctgagcagtttaatggcgattcccgggtctgattcaagcgcctgcatgtattcagcgtcagctgggtttcctctgcaagaactaaagccaaacctccaatatttctctcttgctggcctcgaagctggggagttcaaacaagtgccttcgaggactgctgaactcgagcaaatgaatagggggcaacatggagatccatcaactgggtattggagcaaattgatgggtggaggatcatggtgatgacattgtcatatgacagaaagatagcagctgtttttgcatgaaaagcatttgcaagaattcaggatgagtttgatttctttttgatttattttttcctttttaaatatgtccctctcagcgtgtggcctgtttttaggatgattgaaagctaagatatcgaataggggtcaaatggtttctttaaaaaaaaaa

SEQ ID NO: 1684 - DNA, 1107 bp, Eucalyptus sp.
ctccgtaagaaggacaaccatgccttcggacgcccggccgcaggcctccgccgctgcagccgccgggggagctggcctgcacccccacccgccgccgcagacggaggccctgccctgcccgcgctgcgactccaccaacaccaagttctgctacttcaacaactacaacctctcccagccccgccacttctgcaagtcctgccgccgctactggacccagggcggcaccctccgcaacgtccccgtcggcggcggctcccgcaaggcgtcctcctcctcctcctcgaagcggccccgctcgctggccccgcctacttcttcgtctccttgctcaaactccaattcctcctccgtgtcccaggagcccctgcacggggaccactcgggcctgctcctggcccaggtgaagtccgaggtgggctcgggcgatcaggtgaagaggaccgagaatgtggcgggacccggtgtcggctccggccaccagggtttcacttctctgctcggctcgccggggggccaggggtttctggctctgggcgggctggggctcgggacggggctggacggcctagggttcgggttcgggaggggggtctggccgttcaacgaggtcggcttcgtcgacggcggcggcgtgtatggtggcggcggcggcggggggcccgtggcggcggcgggaggcaacgcgtggcagatggggagcggggaaggcggagggctggtggacggcgacgggttcgcttggccggagctcgcgatatcgatgccgggtcagggcctgaagtgagtagcgtggctcgtcattttgctgtgcttttcccgtgtcgggtttgggagttggtgggcgagggtcaagagtcgagggtggcatcagggtttcctttttcttttctcttttccgggtgggggatttaggttggggatataagtattcactgaataggttttaaattacaggttacataggaagatatcgcgatgaccaccggaatgatatgatggtttagcgtaggtgaacgatgttcggtcggtcttttgttttccactctgcggtttggtccatgactgccctgtgtaaatctcgaatttggacatcgaaaaaaaaaa

SEQ ID NO: 1685 - DNA, 1125 bp, Eucalyptus sp.
acgcactgatcggtcaatcctatcaaccatcaaatcaaagcggaacaacatgtcctcctcatctgccttttcaccggaccccctctcccccaacgagcagctctgttatgtccattgcaacttttgcgacaccgtccttgcggtgagcgttccgtgtagcagcttgttcaagacggtcacagtccgatgtggtcactgcacaaatctcttgtcggtcaacatgcgaagcctccttcttcctccggctcctgcaaatcagcttcaccttggccattcttactttacccctcaaaaccttctggaggaaatccggaacgtaccatcgaacatgctgatgaatcagacgatccccaacgagccgatgatgcagctacgaggagggatagaagatatcccgaagcccccaccggttgtgaacagacctcctgagaagagacagagagtcccttctgcatacaaccgcttcatcaaggacgagatccaacgcatcaaagctgggaatcctgatatcagccacagagaggccttcagtgctgctgcaaaaaattgggcccatttcccgcacatccatttcggacttatgcctgatcatcagcccgtgaagaaagctaacttgcgccaacaggaaggagaggacgttctcatgaaagatgggttcttcacgcctacaaatgtgggtgtctccccctattgataattggctaagtactttgaaaagaaaaaacagcgcccttgtgtgtgtgtgtgtgtgtgtgtgtgtgtgtctttctctttctaagttcatccgttcacttattttcttccttctacttccctcgtatgaaagtgtcactactagttagtctcttattgttctaagcttcgtttctaagagagacttctctaagctctatggctcttgctcagtttccatgccccttgcggtgtgtttgaagcttttagttgattgattaagatgagagagagagagagagagagagagagagagagggggggggggggggcgggggaggtcttgaagcttgtacaacattgagcttcttgataccgaatcctagatgggtcaaggtttgttcatattcttaatatgttgtgaacctatcttaaccatgccgaaaaaaaaaa

SEQ ID NO: 1686 - DNA, 1639 bp, Eucalyptus sp.
ctgtggagaaaccagagaaagcagagagacgggcagtgggctaatcttttgctgagaccttttgaactgctccagagagagagagagagaaaacagagcagagctgtggcaacgaggagaatgttggagatgaaagatgccgcgataaagctgtttgggcagacgattggtctccgggagaagcgaggcgttcttgatgagccgtcctggggaggtgggaaagagtttgcttcggaagctggaggtccaggctcctgggatcgcggtggctctgtctctgctgatgctgcatggcaggaacacagaggtggaagagaagcaggggagactcgcggagacaaggcattatcagaaagagaaccgatgaatgacaaatatgaagaaggcatatcatgttgggcggtggacaacccaaaagactctgctgaatcaacgatcattaaccagaaagatgaaacgggcagagaaacttctcccccttctgcgcagaacaaagaagagagcgaaacgagtatctcacgagaaacgactttaaagaagcctgaaaagatactaccgtgcccgcgatgcaacagcatggataccaagttctgttactacaacaactacaacctgaatcagcccaggcacctctgcagaaagtgccaacggtactggactgccggaggaacgatgaggaacatccctgttggcgctggccgtcgtaagagcaagaattcgtatgcagccacggtggcactgtttcacaacacgggagtacctgaatctcttcgagctgattgtgctggtgatttgaaaaccgccggaaccaccatcctgaggttcggttcagattctcctaattggggtcaatctgcagctccagtgccaagtactataaacggatttcttgatcctggacgagcaattccatgttctggtagggggttagataacttcagcgacgaacgttcgtgtggatcttctttgacagcttcaaattcaacggagaaggcaagcaactgtagcgcaccagaaccggcagcccacaattaccgaggctttccattggattctgttcaatggaactccccaactgctgtatctactccaggcttccctgtttcattttaccaagcgccacaatgttattgggcttatgcactgcctggttccttgccctcctcacttagccacagcaacgcgagcactagtcctccaagtttgatgatactagggaagcattcgcgagatgggaatgtctatgattgcagagcaactaccaagcaatcgattatcggggcaagggaagcactggacggagtttctgattcaggggagtcggacggttttttctcccaggcttttcagtccattgcgaaaggcaagagcttcaatgacaggaggactctgttgctgcaagcgaatcccgcagcgctgtgccggtcaatgaacttccaggagagcacgtgagaggtagagacgaatccacccaaacttcgaatttgtatgataaaacaagtcgggagctatgccgatgcctctcttgtcagactgttttcctagatttttgctgctccgtcgcgtgaagacattcatcaatttgggcatttctctttgattccgggctattttcctgggcttgagccggaattttaga

SEQ ID NO: 1687 - DNA, 3975 bp, Eucalyptus sp.
acgcactccccagcccacaccatatctctctctctctctccctctccctctccctctctctctctatctctactttctctctctaggatttgttcttcgtgctgagcgagattctgcggagctccgctgcgcttccgctcgagggtttcccgatcgccgccgccgtcgccgccgtcgtccgcctgagaccggccgtccgccggagctggctgcggatctcgtctcctttcgacgaggaaggaaactgtgtgactgaggattaagaggggccgtgtggaatcttggagattgaagaagcctttctcgctgtttaatcttgagatcaagtatcgtggttttgagttgaagaagtattgcaattatcttaattgagttctggtctcaactcggaattactgtttgaaaatgggttatatatgtgagttctgtggagagcagaggtctatggtgtattgccgatctgatgctgcatgcttgtgcttatcatgtgatcggaatgttcattctgccaacgctctttcgaggcgccattcaagaacgctgttatgtgagaggtgtaattcacaacctgcttgtgttagatgtgcggaagagagggtctcgctatgtcaaaattgtgattggatcggtcatggggcctctacctcggcatcaacacacaagaggcaaacattaaactgttattctggttgtccctcggcagcagagctttcttcaatatggtcttttgtgctagacttccactctggaggtgaatccgcatgtgagaagggaatggggttgatgagcatagcagagggtaatgaaaacgcagcttgcattccaccaaaagacagcagtagccaagatgtatctgtttgtgctgatgatgaggctgggaatgcaaatgcatgggttgggtcatcttcattgccggaacttaaatcagcgtctctgaatatgggtcagctggctgcatctgcaagcacggcgactcctaaggcgtgccttcctattacaagaagtcctgggctttttgaagatgataggttctatgaggatttcaacatggatgaagtggatttggatcttgaaaattatgatgagctttttggtgttgccctaactaactcagaattgctgtttgagaatggtgggattgacagcttatttggagcaaaggaaatgtctgctgctgattccaactgtcagggtccagtagttgctgaggtatattgttattaaaggaagaatatttggtctttccgaatattttgctgcaaaatctgtcctatgatctatagaagagacacaatctctcttgccacataattgtgcatcatgtgtttttccctgtttgttcctcttttctttctgttgtctgtttggtggaagaagagtggagtgtggttatgttgctatttcagtaatcgaatcctatcgacacgtttccaaggtcattttgcagaaaggataactactaggtctatggtagtttgcacttcttgggatgaattgtatactcatcaggagaagtccttaggcattgtcacattgagatgaaatgatataaatattggttttctaggttgataatattggaggctgtgtatccccgtgaacatagttttgatttcttttacttgtttgtcgtatacagtaaacacttttgagcattaaaatataaccataaatacaagggtttcagcatctccagggttttggctatagattaaagcaggatgagattgttatcaaagtcaggctacttctggtatcgattgtcacttcacattgatttgagaagtagtggactatgtttgagaagatacatacaagaagggaagttagtgggatgttgaaaaaagttgttgtctcctgactagcagaaacatggagatgaagaatagcaccacataggcttattagacataagtgcatactttcaaagcaaaaatgaagaaaagaacatggggtgggacaatatggcaaacaccgtgtgattttattgcaatttaatggaaacttgatgtttgatgtccccttttgtttatcccggctctgggttgagtaccgattcaattatggtggactgttcttggcttgctctcttgatgagttgacgacctttgtctaacgaggaaataactaataattatgtgggacaaggcttgttggtggtagttgtttgtgtttccctttttgtgttgcagggaaagatttccctcccagtcaaatgtctaggaggatgaggttagttctttcccatattgaaagatgggtggcactgttggttggaggctgtatgtgcatctggaagttgttttaactctactatatgaatgctctcgggttgtgtctgctcatggatcaatgatcttgttctaattcatcttcaaatgttggctaccatcattatatggttgaggcatgctgaattttttgctggtattttctttttccaaactcaggagaggttaattcggtggtatttggaattcccttggagtctaatgaatttcatatgcaatgtggttgggttaatgttgtataacctgtttagttttgttcatagctggtgaaggtcatagtttgttgcagccgtggtatataggtgatgggttcactggacttctctgacaaatttcaatgcaatgctactgcctcttgtttttatatcttcctagctgtcaggtgttaatagcattgctatcaccgcagggcttgtagaacttctcttacattcttattctttcttagttttgagtattgctggcatggtaggtttttatgtagacatatgactgaacaatgttcatgaattttttcacagggatcatcttctggacatgcaatacagcctgcatgcagtgttgcctcggctgagtctatgatgagctctaaaaccgagcctattatttgtttttcaacaagacaaccccattccaatctctcattctccggtcatattggagagaataacactggtgattatcaagattgtggggcttcctcaatgattcttatgggagagcctccatggtgtacccctggccctgagaattcattcacatcagcaagcaggagcaatgctgtgatgcgttacaaggaaaagaagaagacacgcaagtttgacaagaaggtgagatatgcctctcgtaaagcaagagctgatgtgcgaaggcgagtgaagggccgctttgtcaaggctggtgatgcttatgactatgacccattgagccaaaccagaagctactgagttgacatatatatgcttagagggaaggaaccctcaccttctatttgcaaatagttggttcaatgggaagtggatggtgcaggtgcaatcttattgagtgcagatgcatgatggtgacactgaagccacagttatagccaagacagccgaagatgaaagggatggtgggatggcaatactgaaatgtgggatctgaccatagtcctcgtcgccataaagaattaactaatcgcgaaattcttcccaccaaattgtacgaatattagttgcttggcagtttctgttgctttgccatcctctgggcctcttcactgtggtatgagggggaaatcataattgatgccagctagacatagttaggcacgtcataaatgacaatatggggtaggctttcgtctacctctttttttgaagctcttcctgcatttggctgcacctctctgtgattagtcaaatttacagtttcaactgaagctcaggttagtgcttttattgcttctattgcaattcatgtataagatgaggtgggaaaagaaaatcacactttaatgtataggcagggtataaatatatgtagaatagagaaggacccagtctagctagtgaagttattgtagcattttcattcagtatacatttctgtatagcacagggatatcctgtacatcgttgcagagaataatctgtacttattttatgtgagattcatttttgtccgctgtgaagtaaaaaaaaaa

SEQ ID NO: 1688 - DNA, 60 bp, Eucalyptus sp.
aaggaggtgtacatacagcttcaaccgtgggtagttagctttgcttagttcgtttgaact

SEQ ID NO: 1689 - DNA, 1303 bp, Eucalyptus sp.
acctctctctctctctctctctctctctctctctctcaaaacctgtcttctacaacacccaactattcactttccatcatgacggacccctactcaagttacttgaatggatggatcaacttcaaccctcttcaccactgctctccttctcctcctcctcctccgtcctcttctttctcttccatagccacgaacaattactacaattcttctcactgcttctactctctctatgactacaatcacgtctacagcgccgcctctctacctcacgcctctcctcccccatctccgcccctgaaagaagcgctccctctcctcagctgcttaagccccgcgcggcatgaagaggaagagcaggcctcgctttctaccccgatggaggttgagaatcccagctgtcaaaaggacagcttttttccccataattcagcagatggtgccgatgaagatgatgatggtgatggtgaagctgtgacggtggctctccacttggggcttccaagccctagctctgctgatctgatctcgaggctctcctcaacagagatcagctcagacaaggaattggatcaagagaccactgtggcttcttctggttacttcacaagcaacaacaagctcaacaagggccagtattggatacccacccctgctcagattcttattggccctacacagttctcatgccctctttgcttcaagaccttcaacagatacaacaacatgcagatgcacatgtggggacacgggtcgcaatacaggagaggacccgagtcgctgagggggacgcagccgacggccatgctgaggctgccgtgctactgctgtgcgccgggctgcaagaacaacatcgaccacccaaggtcgaagccgctcaaggacttccgcaccctccagacccactacaagcgcaagcacgggatcaagcccttcatgtgccgaaagtgcggcaaggcgttcgctgtgcgtggcgactggaggacccacgagaagaactgtggcaagctctggtactgcagttgcgggtctgacttcaagcacaagcggtcgctcaaggatcacatccgggcattcgggagtggtcacacggcttatgggatcgaggatgattgcggcttcgaggaggaggaggcggctacttctgaaattgagcaggacaacaatttcgagtgctccaagtgattgaatgaagatggtgtgtcaaagtgaagttgtcgttgaacgatgatcagctgatccatagtttatgatactattgttttgacacggttcgtggtccaagagtcaaaaaaaaaaaaaa

SEQ ID NO: 1690 - DNA, 1862 bp, Eucalyptus sp.
gttattctccattttatctttttcctctctccatcacttttctgaggatcgctcttttgagagatgagaacaagatagaaccaaagtgaagcaaaagccaagaaaagaaaggcgagagaaagagaggaagaaagaaagaaaccaagagagtttggaaggtagagcgagagagcgagagagagagagagagagagagagagagagagagacaaaatcactgaaataagcaattttaatctttttcttggccacccttttatccctttctacctttgtcttcttcaagatgtcaaatatcacaggtgaaggtgggagcttctcttcaggcaatactggagaagccgaagttcaaccacaggagcttctgaatcacctctttggtgctaataattcattattatcatctgcttcagccaataacgatagtctctctgcgagtactcacgatgagaagccgcaacagcaagctccacaggctaagaagaaaagaagcctaccaggaaacccagacccgagcgcagaagtcattgctctatccccaaccacgctcgtggcgacgaaccgtttcgtgtgcgagatatgtaacaagggcttccagagggaccagaacctgcagctgcaccggcgaggccacaacctcccgtggaagctcaagcagagagggagcgccgagatccggaagcgggtctacgtgtgccctgagccgagctgcgtacaccacaacccggcccgagcactcggtgacctgactgggatcaagaagcacttctgcaggaagcatggcgagaagaagtggaagtgcgagaggtgctccaagaagtatgcagttcagtcggattggaaggctcattccaagacttgtgggactagagaatacaaatgtgactgcggcactatattctccaggagagatagcttcatcacccaccgagccttctgtgatgccctaaccgaagaaaacaccaagctaaaccaagccctagctccacacctaccttcctctgtgggccagcaacctaataatctctcttcttcttcagtccctctaagccaagctcaaagcaacaccattccctccactgaggcgcctgagttcgccaaccatgccgacacgaaacccccgttgttctctctcccgcaagggctcatccttcaccaatcaaagcccatgacgatgcctcaaaccttgttctccggcaacaacctcttcggcaccaccaacgcaagaactgtcgccccgccaccgatatctcccagcttgatccatgggatgaatagcccacaacgcggctcggcattcatgtcggcgacagcattattacaaaaggcagctcaaatgggcgcaaccgtgagtaacaacagcgcaacgagctttgtctctgcgccaatggcaccgtcgtcgttcgggggaatgttgccgaagcaagctcagcacaatggaggctttgtggaccggttcatggagaagggacaagaagagattagtgaacaattcatgaataatgtgaataatggtagtgatagagagggagtttttagtggattgttaggtcagaatagtcatgacttcttgaagagtttggaggttgaccatggtaagaccacgacggttgatttcctggggatcggagggacgagatcggcggggaacttacatgaaggtcagagggagatgcctctgaaagggtttatgagtcagtttcaaccacagagcacaatggagaaaccaatgtgggaggtttaaatagaacaattgtgtcaatgttcatgcaattaattagagatatttttgtcttccctatttccatccttgacccaattttatcctctccatcatataataatttatcctaaaaaaaaaa

SEQ ID NO: 1691 - DNA, 1331 bp, Eucalyptus sp.
atatttaccttctccacttctctcacaatccacctctctctctctctctctctctctctctctctctcaaaacctgtcttctacaacacccaactattcactttccatcatgacggacccctactcaagttacttgaatggatggatcaacttcaaccctcttcaccactgctctccttctcctcctcctcctccgtcctcttctttctcttccatagccacgaacaattactacaattcttctcactgcttctactctcgctatgactacaatcacgtctacagcgccgcctctctacctcacgcctctcctcccccatctccgcccctgaaagaagcgctccctctcctcagctgcttaagccccgcgcggcatgaagaggaagagcaggcctcgctttctaccccgatggaggttgagaatcccagctgtcaaaaggacagcttttttccccataattcagcagatggtgccgatgaagatgatgatggtgatggtgaagctgtgacggtggctctccacttggggcttccaagccctagctctgctgatctgatctcgaggctctcctcaacagagatcagctcagacaaggaattggatcaagagaccactgtggcttcttctggttacttcacaagcaacaacaagctcaacaagggccagtattggatacccacccctgctcagattcttattggccctacacagttctcatgccctctttgcttcaagaccttcaacagatacaacaacatgcagatgcacatgtggggacacgggtcgcaatacaggagaggacccgagtcgctgagggggacgcagccgacggccatgctgaggctgccgtgctactgctgtgcgccgggctgcaagaacaacatcgaccacccaaggtcgaagccgctcaaggacttccgcaccctccagacccactacaagcgcaagcacgggatcaagcccttcatgtgccgaaagtgcggcaaggcgttcgctgtgcgtggcgactggaggacccacgagaagaactgtggcaagctctggtactgcagttgcgggtctgacttcaagcacaagcggtcgctcaaggatcacatccgggcattcgggagtggtcacacggcttatgggatcgaggatgattgcggcttcgaggaggaggaggcggctacttctgaaattgagcaggacaacaatttcgagtgctccaagtgattgaatgaagatggtgtgtcaaagtgaagttgtcgttgaacgatgatcagctgatccatagtttatgatactattgttttgacacggttcgtggtccaggggtcaaaaaaaaaaa

SEQ ID NO: 1692 - DNA, 2380 bp, Eucalyptus sp.
aggaatgattctgaaagagaattgaagggaaaaaaagggttggtagtactaatggaagccatctgtgcattcaatgaagctcgtaagaagctcatagggaaactatcccctttcctttctcggttatctttcttttcaactttcttggcctttccaaattagggtttctgttgcggggctcagatgtctgcacacacacacccacacccacacccacgtgattccttgtgtgtagttcatcagtcatcttttgaagcagttctttgttgtgtaatgcgaaattagaagcggcaatggaaatgaaaggcctgttggcggtgaatgacaacagtatgtctaatttgacctccagtgcgtccggtgagatctgtgcttcttcaggttccggaagtgaaatttatggcaacaacaacaacttgtattctcatcactcctttgcttctgcaaatcatcaaccatctcctcctccaaagaagaagagaaacctcccaggcaatccagacccagatgcggaagtgatagccttgtcgccgaagacgctcatggcgaccaaccgattcatatgcgagatctgcaacaaagggtttcaaagggaccagaacctccagctccacaggagagggcacaacctgccttggaagctgaagcaaagaccaaaggatgaaccgataaggaagaaggtgtacgtttgccccgagccgacatgcgtgcaccatgacgcgttgagagcgctcggtgatctcaccggcatcaagaagcacttctcccgaaagcatggcgagaagaagtggaagtgcgagaagtgctcaaagcgctacgcggttcagtcagactggaaggctcactcaaaggtttgcggcacgagagagtacaaatgcgactgtggaaccctcttctccaggagggacagcttcatcacacatagggccttctgcgataccttagcagaagagtgcgcaaaaaccgctcctccgaaccagcccaacttcttgatcccctcctcttcccaacctcccaccacttccctcgtcacttcccgcatcaatctccaaaacatcagctccctctccatcaagagagagcaagaacagcagcaacatcagcagcaggttcacatcttcaaccccaggcaacagaccattggcccctcgtggacaccattgccttatatctcccgcggtaccttgtcgtccccatcgtcttttttagacccatcggcgcaggttctccaaaaccctagctccgataatccttccgctggcattagcattaatcttcctcacgcagagcacactgggactgggttttcttcgccgtcttcctcacctcacatgtcagcaactgcactgttgcaaaaagcagcacagatgggggtgaccatgaacaaccagcccagctcatcgcttggagtcaactgcagtgccccacaagcacaccacagtcgcatgcatgataataatctcgtgaacctggggtcacgtgaccgtcaccatcatcgtcctcaagatcatcagatgggaacaggtcggtttgctgatcagagcttgtcatctttcgggaataaagctgtcgcggctcctgcgggcgtcttaggaggagccggtgagccgggtcctcctctctctcttcttcaacaagacatgaatgtgatgatgatgatgaacccgctgtcgtctttggacggggctgatgacgatctgaacgagatgatcttgaacaacaattacggcgatgatatttcggagagaccttcatcgggacatgggggagatgattttaagggagcggcgaccttggaatcagcaaaaaggtatcgcctcgagggcgacaaagatagcatggcgaccagggatttcttgggtctcaaagcattctcgcccaaggattttctcaatcacaaagttgctgggtttgacccgatggtttagcgtggcaggacagagaatgatgggcttcctcagagtaaaagcaagaaacaaggcacattgacacccggcttaaagcttttcttttacaatgttcagtcaacttcaaccagcagctttcggcctgcttagagagagaaagtgagagggagagtgaggacatgttgatggcaactttacaaagatgtcaaggagatcatcctctccactgtccactcgtggagttcgttggcatgatttcgcagagggaatctagagaaagaagaacttcaagctgaggttttcgcttacattcttctcaatgaatatgtggatggagagaaaatcacagtaaggaatatacgcaagatcttggttttctcttccttcttgtttttgttatgggactcaacttaagttccctttgtttcgcaaaatttcaatttactgaatttttggaaataccaaaaaaaaaa

SEQ ID NO: 1693 - DNA, 1372 bp, Eucalyptus sp.
ttttctttttcttttttctaacacttggtatcttcccacacacccccacttaacctgaagattgctttaacctcacgtttttctgtctttctctgtcggtaccgaaccatgagagagctggaaaacaactccttagacctcaacaacttgcctgaggattacactagggatggtaataagcaagtgtttgagggtagcagctcctcatcagttccacttaatgggcgaagaaagagagacattgtaataacttgccaagctcgaagtgaaaaagcgagttttgagcttttacagtgtggaccaaaggttctcatctttctcaaaattagagaaagagtcgatccaaagtcgatctttcaaatagtatggaaaaagaagagcgacggaaaagaagaatgcggaaaggtctacgagtgtaggttctgctccctcaagttctgcaagtctcaagctcttggcgggcacatgaatcgccaccgtcaagagagagagactgagacactgaacaaggctcgtcagctggtcttcggtaacgataccctagccgctcatccagcccttcctcctcatcatcatctagccagctgccaatcgataccgggaggctatcacgcggcgaccaacgtggcagatccgccgcttccattcagatcatcgatgtacccaccgccgccgccaccacgattcttctcggcctcctcctcatcttccatcgtccaaccaccgccgccttacctatacccgtcgccgccccgcctcgtggcctacccttcgcattacaatggcaaccagcacccgcccgccggcgataactactcgatgggccatgtgttcggcaggagcccaagctcgcactttggcacgctggagtcgaactacacctgcatcggggcgccggtcggagaagggttcagtgcacccgggggaggtggcagggaaaggtcgccgcagggtcagaaggaaggatcgaattgggtgtcaagattggatcctccctcgatcaatcggtttcacgatgggttctaaaaatttgatcttgttggacgtatattggtgcgctgaaccgagttctcgaaaatccaccctcagggacagagagagacagggagaggacatgacaaacactgactagagagagggggttttcatttcatgcaatggaaggagagagaggagagaagttttggtttattttgggggacagagggagggggttgaatgttacagcttttggagtcaggtacactctctcctcagctagtttgtcctctgagagagagagagagagagagagagagagagagtgtcgtcgtgtatttggattaacgtattcgatctataaatcaattatgaatcgttgctaaaaaaaaaa

SEQ ID NO: 1694 - DNA, 1720 bp, Eucalyptus sp.
cccgagaggatctggggaaagatttcgatcccctcttttatttggcggtgatcttcgattcgtgatggactcaaagatggatctcgaagagaggttacgtgctgaaacctgggggaagccttcctctgtgaatgatttaccccaacgtgttccccctgaccggcagacaccattcccgaatttcgcctcacacaagaatctgcaaaagcgggaagatcaagatccttcaatctcaaattacggcatgaggatcgaaccttcattctctgaatttaatcgtccttctgaatgccagccacctcttcccagcaaccccattagtcaagatcgaggtgtccagatgaatgatatactccaactcggtaagacccaagagtgggacccaaaagcgatgctgaataatctctccttcctggaacagaagattcatcagcttcaggaattagtgcacgctattgttggaaggagagggccagttttgggacgaccggatgagctggtggcacagcaacagcaactcataactgccgatctcacttcaataatcatccagctgatctctactgctggtagtcttctaccatcagtgaagaactccctttcttcagcatccacgccacccatcaggcagctcggtcagcttggtgggattttaaataattctggatctggaattggtctcgacagcaatcttgtgctcccaagtcaaggcggaagcaaagtccctgatcagtctaaccaggttgatccaatggatcaatccgctatcgataatctggaggatcatgaatcaaaagatgatgaagatggggatgagggggaaaatcttcctccgggatcttttgagatcttacaactagagaaagaagagatcctcgcaccacatactcacttttgtaccatatgtgggaagggatttaagagggatgctaatttacgcatgcacatgagaggtcatggggatgaatacaaaacacctgcagcactagcgaaaccccacaaggaagctggttctgaaatgatgctcatcaagaggtattcctgtccatatgcgggttgtaagcggaacaaggatcataaaaagtttcaacctctgaagacgatattgtgtgtcaaaaatcattacaagagaactcactgtgacaagagctatacgtgcagtcgttgcaataccaagaagttttcggtcattgctgaccttaaaacgcacgagaagcactgtgggaaagataaatggctttgttcctgcggcactacattctccaggaaagacaaactttttggacacatcactctcttccaaggccacaccccagcgattccctttgacgagaacaagggcgggctatctttgcaaggagaacataatgaagacacaaacaaagttggtaatgtgagtttcagtttcggctccagcactcctagttcaggtggagttcagaacatcatggaagatgtcaaagggaatgttgatgatccatcgagtttcttttcccctttgagtttcgaggccagtaacttcggtgggtttaatgaattcacgcgatctgcttttgatgattcggaaggcgcgttctcatttctccttcaagcatcttgtaattaccctcagaaaaatggaggtcagtcgagttctaataatctagagtaacggtgtcgacagagcatgcgccagggtttgtgagtttcatctttctttcgcaattgtagaacgaggtgg

SEQ ID NO: 1695 - DNA, 1441 bp, Eucalyptus sp.
ctcttctttagggttggaaatctctggtttttggtttgatcgtgggagggaaaatgccggggctgacctgcaacgcctgcaacaaggaattcgaagacgatgccgagcagaagctccattacaagtccgagtggcatcgctacaacctcaaacgcaaggttgctggggttccaggagtgacagaggctttatttttggctaggcaagctgcactggcacaagaaaaaaaaaagtccagtcagactccaatgctctatagctgtggcatttgtggcaaaggatatagaagtgataaagcacatgctcaacatctccagtccagaagccatatcctgagggcttcgcaaggggtgaaccttgaagatggggagaagacaattattagaccgctagcaccacgtgttcagagcaggcctgctccacaaaaggagtcgggaatggcagaaagcgaagatagtgaagatgagtgggaagaagtggattcagaggatgacttggttggggaagctgcaaactctttgagtgaaatgaatgtagatgagccgtccaccgaccatcatatggaagatggttctgatgacgatgatttctgtgaagtggatccatcatgctgctttatctgcgatcgcgagcatgatagcatagaattgtgtatggttcacatgcacaagcaacacggtttcttcatccctgatgttgagtatttgaaggatccagaaggacttcttacataccttggccttaaggtgaaaagggatttaatgtgtttgtactgtaatgagaggtgtcatcccttcagcagcttagaggctgttaggaaacacatgacagcaaaaagtcattgcaaagttcactttggagatggcgatgatgatgaggaagcagagttagaagagttctacgattatagtagcagctatgtggatgaggatgggaaacaactggttgcctcaggtgatatgggaaattctgtagaacttggaagtggtggctctgagctcgtcattaccagaagatcggatggtggagtttcaatgaaaacacttggctcacgggaatatttgagatactaccgccagaaacctcgtccatcaactggaaataatgcggcaattactgctgcgctggcctcaaggtacaggagtatgggattaactaccactgtacggtcaagagaacaaatggtcaggctgaaggtgataagagagatgaatcgatcgggagtggaggcgatgcgcaccaaaattgggatgaagagtaatgtcattagaaatctgccaaaaaatgttacacattagaagaagggattttgtattttatctgtcatgtttttatggcctaatatacacgtgcatgtaagtttccgttagagattcaggctttctggctttcgttgctaaaggatgtttatttcttgatgactacattgagcagtatccaa

SEQ ID NO: 1696 - DNA, 2407 bp, Eucalyptus sp.
aaaaggaatgattctgaaagagaattgaagggaaaaaaagggttggtagtactaatggaagccatctgtgcattcaatgaagctcgtaagaagctcatagggaaactatcccctttcctttctcggttatctttcttttcaactttcttggcctttccaaattagggtttctgttgcggggctcagatgtctgcacacacacacccacacccacacccacgtgattccttgtgtgtagttcatcagtcatcttttgaagcagttctttgttgtgtaatgcgaaattagaagcggcaatggaaatgaaaggcctgttggcggtgaatgacaacagtatgtctaatttgacctccagtgcgtccggtgagatctgtgcttcttcaggttccggaagtgaaatttatggcaacaacaacaacttgtattctcatcactcctttgcttctgcaaatcatcaaccatctcctcccccaaagaagaagagaaacctcccaggcaatccagacccagatgcggaagtgatagccttgtcgccgaagacgctcatggcgaccaaccgattcatatgcgagatctgcaacaaagggtttcaaagggaccagaacctccagctccacaggagagggcacaacctgccttggaagctgaagcaaagaccaaaggatgaaccgataaggaagaaggtgtacgtttgccccgagccgacatgcgtgcaccatgacgcgttgagagcgctcggtgatctcaccggcatcaagaagcacttctcccgaaagcatggcgagaagaagtggaagtgcgagaagtgctcaaagcgctacgcggttcagtcagactggaaggctcactcaaaggtttgcggcacgagagagtacaaatgcgactgtggaaccctcttctccaggagggacagcttcatcacacatagggccttctgcgataccttagcagaagagtgcgcaaaaaccgctcctccgaaccagcccaacttcttgatcccctcctcttcccaacctcccaccacttccctcgtcacttcccgcatcaatctccaaaacatcagctccctctccatcaagagagagcaagaacagcagcaacatcagcagcaggttcacatcttcaaccccaggcaacagaccattggcccctcgtggacaccattgccttatatctcccgcggtaccttgtcgtccccatcgtcttttttagacccatcggcgcaggttctccaaaaccctagctccgataatccttccgctggcattagcattaatcttcctcacgcagagcacactgggactgggttttcttcgccgtcttcctcacctcacatgtcagcaactgcactgttgcaaaaagcagcacagatgggggtgaccatgaacaaccagcccagctcatcgcttggagtcaactgcagtgccccacaagcacaccacagtcgcatgcatgataataatctcgtgaacctggggtcacgtgaccgtcaccatcatcgtcctcaagatcatcagatgggaacaggtcggtttgctgatcagagcttgtcatctttcgggaataaagctgtcgcggctcctgcgggcgtcttaggaggagccggtgagccgggtcctcctctctctcttcttcaacaagacatgaatgtgatgatgatgatgaacccgctgtcgtctttggacggggctgatgacgatctgaacgagatgatcttgaacaacaattacggcgatgatatttcggagagaccttcatcgggacatgggggagatgattttaagggagcggcgaccttggaatcagcaaaaaggtatcgcctcgagggcgacaaagatagcatggcgaccagggatttcttgggtctcaaagcattctcgcccaaggattttctcaatcacaaagttgctgggtttgacccgatggtttagcgtggcaggacagagaatgatgggcttcctcagagtaaaagcaagaaacaaggcacattgacacccggcttaaagcttttcttttacaatgttcagtcaacttcaaccagcagctttcggcctgcttagagagagaaagtgagagggagaatgaggacatgttgatggcaactttacaaagatgtcaaggagagcatcctctccactgtccactcgtggagttcgttggcatgatttcgcagagggaatctagagaaagaagaacttcaagctgaggttttcgcttacattcttctcaatgaatatgtggatggagagaaaatcacagtaaggaatatacgcaagatcttggttttctcttccttcttgtttttgttatgggactcaacttaagttccctttgtttcgcaaaatttcaatttactgaatttttggaaataacatataaggtgtgaattttgtgtataaaaaaaaaa

SEQ ID NO: 1697 - DNA, 2305 bp, Eucalyptus sp.
gtctgggtctctgcgtctgagaaagcagtaattcttgggggggaagagagggtggaatttggagcctacccatttgatcggaacccattttcttgcgcccaccagctgaggagccgctcgtgcccattcagtgcgtattccatttctctctctccttccctctctctctctctctctctggctggtgggtctggtgggtcgtctcggttctcttcgaagaagatcgtcgtccgtccgtccgtgcgatggatgggtacgctgggggccacgagggctcgcggtcggatccttcgccggaatggcccaacgactccgaggccgacaccggcctcgaagagcccatgtggcagctgggattggggagtggcggcggcggcggcggcggcggcggcgaaggcgaaggcgaacctgacctggcttacccggagcggactgaggctgccgattgtatctactacctcaggacgggtaattgcgggtatggcgcggggtgtcgcttcaaccatccccgtgatcggagcacggtcatgggagcgacaagagctggtggagcagagtaccctgaacgagcaggccagccaaactgccagttctacatgaggacgggtacgtgcaagttcggtgcgtcctgtaagtaccaccatcctaggcatggcgctggttccagcagtcctgcgccactaaatttgtgtggttaccccttccgtcagggtgaaaaagagtgttccttctacgtgaaaaccggacgatgcaagtttggtgcaacgtgtaaatttcatcatccacaaccagcgggtgtacatgttcatgcgccatcaccaccactgcaagttgcaccaccccctatccctgtagctccgccttcatcctatccagcaatgcagtcaccatctgttccttcatcgcagcagtatggggtagtcatggccaggcctcctttggttccctcatatgtacaaggcccttatggtcctttgctggtttctccaagcatatttccaagctggaatccttatcaggcacctgtgagtccattggcctcttccagtcctcaagctggttcgggatcaagttctgtttatggggtaacgcaattgtctccctctgcaccggcttttccgtggccttatcaaccttcgccttcatctcttggcccttcagtcaatggccggagggagcaatcatttccagtaagacccgggcaacctgaatgccagcattacctgaaaacaggggactgtagatatggatcctcatgtaaataccatcatccgccagactggaatgcattgaatgtaaatattgttcttagccccactggtctgccaattcagccgggtgcacctccttgcatgcacttcgcacgtggagaatgcaaatttggtcctgcatgcaaatacgatcactcgtttgggcccccaagctacagtccatcggtgtcttctcttggagaccccttccctgctgggtttcccttcggaatgctctttccgtcatattcatctccagagttgagggccgaaatcatctctggacccactgaagattctctgccgacaagatcatcctcgacaacgagcatgtcagttacatcggtcgggtcagcacgtgcgagtagtgggcctatgccttcccaattgcctgatctgagttccacaaatctggctaactgcaacaccaaagagcgtcatagccctggctaaaagaatgtagctggacttccctggctcctctcttagatcaaccttccacgaagtgagaaccgtcacaattttcttatgatcaattcatcagataggtgacattatttctttgtagctcttaggtcatctctctgctctttaattatagggccataccgtagtctaggttttgaataagacatggccaatcttcaaagataaagcaaaacccatctagtcatccgccttccctcgcaaataactgcaaaaagtttctgcagtcaatagataccttccaagattctacatgagcttgttatttatatctgattctttccctgaaatgggaaattccggtccttaggcattcatcatgggaattgagtgtttgcctatgagcctttccacaaaggcaacaagcttcaaagcaaaacttgagatacgtttgatcattctggttttctctgttcatcccaggtccatatgttgctgcgatgcaaatttctgtagagaagatgtatctttttggttttgtgccgatgaaggatagacttgatcctttatatactatttacgatatacccatacaaggaatacaatcaagctttgtgacaaaaaaaaaa

SEQ ID NO: 1698 - DNA, 2622 bp, Eucalyptus sp.
gatactgcagcaccaccccgcccctgaccccgaccctctctcttccccttctctctctctccgagacccctcctagagagagaaacagaaggacccaagaggaagtaaggacaggaagtgagaagtgagtaggcaggagaagtgaggaagcaaagcgaagcccctgccaggcagccagagcgagagagagggagcgggtgggggggaggggggaatggacgcgaacgaggcgacctccatagtgctgtccaagatcaggggcatcgacccggagaacgcctccaagatcatgggctacctcctcatccaggacctcaccgagaaggacctgatacgcctcgccttcgggcccgagaccctcctccacagcctcattctcaaggccaagacccaaatgggtctctcctccaacgccttgcccgcgccctcccccggcccttcccaccccgccctcgccccctccgtctccatccccaccaaccccccgcccggcgccttgcctcctcagtcctcccccagaatcactccccgaggggccgactacgaggtcgggaagggccccttctccgccttcgccgccgccgccggcagcgtcgcccggcagaactccagcccttcgctccctttcgacggcgcgcgctatttcgctcccttgaacggtggcggcggcggcggcggcggcggcggcggcgtgagcgctggcggcgggagcgatttcatggaggataacaatcaactcggcgattacttcgctttcctcaacgattcgtccaagtcgggcgacgttttcgagatggggtacaatgcggacacgcatttgcaccgcaggagttactccgagagcgacgcgggtttcggctgcggcggcgaggacgcgtgcttcggcggcgggtataggccctgcctgtatttcgcgaggggcttctgcaagaacgggagcaactgcaagttcctccacggcgacgattttgaaggttccgtgaacttcgtcggttcgccgagtaatttcgacgccgaggacatgatgaggctcaaggtcgctcaccagcaaagattggccgcggcttcgcagtttttacctggaatttccccaacatcgcatggcaagtacatggctttgcttatgcagcagcacaatgagacccagaggatgggggtgccgggggtggcgatgggagatgacttttataagtatgggcgataccaagtggagaggaatgagtatttggctatggggttagcggagaaggcgaactcggcttcgagacaaatttatctaacattccctgcagacagcacttttaaggatgaagatgtttctgattattttagcaattatggaccagttcaagatgtcaggattccttatcagcagaagcgaatgtttggatttgttacatttgtctacccagagactgtaaagctcatactgacgaaaggcaaccctcatttcatatgcaattcacgtgtactggttaagccctacaaggagaagggaaaaattccggaaaagaggcaacaacatcaacagcagctattcgagagaggggagttctcaccttgctcgagtcattcgctgcttgacacaggagagccatatgaccatcttgcgaggtcaagagtattccataatccacaggagatggtgattaggcggaaactggaagagcaggctaatttgcagcaagcaattgaactacagagtagaaggttaatgaatctgcaactcccagacttgaaagatgatggaatataccatcacctacgtagcttttctgttggctctcctctttctccgcgtattcatcctcatactcagattaaccataaagttgttatgccacctgatgcccctaaccatgaaaatgctgaagactgtcggaacagcacagctgccaccatctctgtgattgctgcaactggtgagcagcagcttcatcatgacgtcaatgctgcgtgtggtcaggatgttgtcagtggcgaaggcaaaagtgagagctccaaactcacacgaggcgatagtcggggaagcttagagaacatacttcccgactcgccctttgcttcacctacaaaattttccagtgatcatctttcggacttctctaaattggccgatgcgactgattttacagcgagctctgggatccctgacaataatgtttcgctgaccgtgagttctggtgatgggccttctcactaaatgagtgtcctagctaaggtttttatttccctttccctaagcattcgatccattaacatgtaaataatggagatggccgtggtcggcaggattcgttgtctagagagtagaagcaaataggagggagacatatctgctagatgtatagcccaagcttacctgcaccttagattagatcccttagagatgattttggtgagagtcggcgccgtcatcatcgatacatactgctaacagcaaaatacatactactactacatctacgataccttaaggggacaggtgattcgatagtaatgtgtaggttctccctattttcttctatgtaacctctgtgcaggtgggtgcaggaccacacagaacagacaacttcatagaacaagcagacaattgtaactttggattacctttaatttata

SEQ ID NO: 1699 - DNA, 1468 bp, Eucalyptus sp.
attcaaaagaacacgaaaccctaatttttccaagctccgatttttatctcccttttcctgattatatatatactctctccctctctctccctctatctctctctctctctgtcttctttctctctcatctttctcttgcagcttgaggagtccgcacgagcagcgaaccccctcctggttcctctagggttagggttttccctggtccggctcgcgctcgctagctagggcggtttccgcggtgcggttcctcttcgtcgctgctggagtagctcccagctcgagcctctttagtgggtttcctcggaggcgttcttgcgggctgttgtgtcgacgctctgttcgcatctgtgtctccgtccatggacactcgcaagagaggaaggcccgaaggcggctcgtacgctaatggcgggctcaagaagcccaagcaagaattggagtccttatctggtgtaggaagcaaatcgaagccatgcacaaagtttttcagcatcgctggttgtccctttggtgagggctgtcacttcttgcactatgtgcctggtggctacaatgctgtggcccagatgatgaacctggcaccggctgtcccccaagcacctagaaatatggctgctccacccctgcaaaatggcacgggtgcgtctcagccagctgtcaaaactcgcatgtgcaacaagtataacactgcagaaggctgcaaatttggcaacaaatgccattttgctcacggtgagtgggagcttggcaagcccattgctccatctttcgatgatccgcgttcaatgggacccattacaggacccattacaagccaccgcttgggtgggcggatggagccgctgccaccaccacctggccctgtttctagctttggtgcgtctgccactgcaaaaattagcgttgatgcttctctggctggagccatcatcgggaagggtggtgtgaactcgaagcagatttgtcgccagacgggggccaagctttccatccgggaccatgagagcaacccagctctcaggaacatcgaattcgaaggaacatttgagcagattaagcaagcgagcaccatggtgagggagctgatcgacaacatcagtgcactaaccggccattcaaagggccacggagggcctgggggcccagcccctcctggcagcaactacaagacgaagctgtgtgataatttcgtcaaagggtcttgcacgtttggagagaggtgtcactttgcgcatggagctgccgagctacgcaagactgcactctgaagaattctgtggagttttgagggtgcaattgtaagagagaatctgttgtgcagccttgtattagggagagcttttaagtatctgagttagtagcattacgtatttcatgttctttaaattttggggctaccaaatcactttgataagatattgtctcagctttggtaatggtagagctttttgatgtaaaaaaaaaa

SEQ ID NO: 1700 - DNA, 1920 bp, Eucalyptus sp.
aggtttcctcctacgatccgaaatctttttgagcccctgaaaatatccaaaaaattagggtttctgatcgtttcctattctcgccttaattcctcgattctcctcccttttgcgacgtcttctgtttacgtaaattcagatttaagttagagcggggaagaaagtcgcggactttgccgaaatccccaaattttcacccggagcaagaacgatcgtcgtgcacatgttcttgttcccgatagcgtcgccgggtcggatcaagatttcccgcagccgtgcagcagctcgtttcttcgatcggattcgttcccgtctcctcctcgcctcgcggcaccgcttcgattgatcggcgcgatagggcggcggcggcggcggcggagaggctttcgttgctggggatattcgattcgtagctgaaggtcgttagctatggatatggaggggaataagcgcgtgttccagcggctcagcggcgggccgtcgacggcatcggactccaggcatcatccgcagcagcagcagcagcagaaggtgtgtttccattggagagcgggcaagtgcaccaggcatccgtgccccttcctacacagggagttacccgctccggcgcagccattgagcaacgggggtgcgccgaagcggttcgcggaggattcagggtctcagtttttgcggagagggcctaagttcacgggcgggtccaatacgtggggccgggttcacggcagcaatgccgtggcgaagaagacggagaaattgtgtaattattgggtgcaagggaattgcacttatggggataagtgtaggtacttgcattcttggagtttgggcgattgtttcgatatgttgacccaacttgaagggcaccagaaggttgtgactgggatagcttttccatccggctctggtaatctttacactgggagcaaggatgagacgctaagagtctgggattgtcagtctggccagtgtgcaggtgtgatcaatcttggtggtgaaattggttgtatgataagtgaaggtccatgggtgtttgttggtttaccaaatctcgtaaaggcatacaacacacaaagtaatgcagacctcagtctcaatggtcctgtcggacaagtttatgccatggttgtgggtaatggcctgctatttgctggtattcaggatggttccatacttgcatggaagttcaatgcagctaccaatggctttgaaccagctgcatcactttcaggccatacccttggagtggtttcattagtggttggagctaataggctttactctggttccatggacaattcaatcagggtctggaatctcgaaactctgcaatgcatgcagattttgacagatcatacctctgttgtgatgtctgttctttgctgggatcagtttcttttatcatgctcattggacaaaacaataaaggtctgggttgcctcagatagtgggaatttggaagtgacgtacacgcacaatgaggaacatggtgtgcttcatctatgtggaatgcatgattcagaagtcaagccagtcttgatgtgctcttgcaatgataattgtgtccgagcatatgatcttccatcatttgctgagaggggcaagatttttgctaaaaatgagatccgagcaattgaagtcggtcccggggggctgttcttcactggcgatggaactggtcaagtgagagtctggaaatggagggactcaccttgacagcattaatttgttctcatgacaatctgtaatattattatttttgctttgtcccggcctttggaataatgtgtatgcccgcaaaaggaattggaagatgagaatggtggttttctcttctgtgatagctacaatctcactactgtacttggccagatgtctatcagatttatcaggcttcgtttttcttttgatgaacctgag

SEQ ID NO: 1701 - DNA, 1261 bp, Eucalyptus sp.
cgcccgttctctctcctttcccctctgcgcgaaaccctagctctccctctcttcccccctctctctctctaaaccctatacgtcttcttctccttctccgagtcggggggccagtccgcggcggtgcgagcgagagccaatggacttcggcggcggccgcaagagggggaggctggacgcttcctccaacggcaatggcggtcccaagagatctagggaagaagcggagaccttttcaactggtataggaagcaaatcgaagccatgcacaaagtttttcagtacttccgggtgcccatttggtgagggatgccacttcttgcactatgtacctggaggctttaaggctgtgtctcagatgcttaatctcggtggcaaccctactcttccccatgcctcgaggaatgcggcaccatcttatccagaagccccatctcctacagctgtgaagactcggttgtgcaacaaattcaacactgctgaaggctgcaagtttggtgataaatgccattttgcccatggcgagtgggaacttggcaagccaactggtccctcctatgatgatcctcgtggcatggttccaccatctggtcggtatggcggccgcaatgaacctcctcctccaggtcttgcagcagcagcaagctttggggcttccgctacggctaagataagtattgatgcatcacttgctggaccaatcattgggagaaatggtgtgaactcaaagcaaatttgccgagtaacaggagcaaaactctcaataagagagcatgactcagatcctaatttgaggaacattgagcttgagggtacatttgatcagataaaacaagctagtgccatggttcatgagctcattgctaatgttgcctctgcctctagacctgccatgaaaaattcagctgcgcattctgctccccgaagcaacttcaagacgaagctctgtgagaactttgctaaaggctcttgtaacttcggagaaaggtgccactttgctcatggaactgaagagttgaacaagcccgggctttgaagatggttattgtttgttttgtctctactctttggaatttcaggtagtgtggcacaacgccaaatatttgagaattttgttgtgatgagaatgttagtttgttattagttagctcctttggattctgtagctatctttgtggatcttattagcaagcttttcccgtggtattggccctttatggaatttggaaacacaaggtggggcatttgtgtaaaaaaaaaa

SEQ ID NO: 1702 - DNA, 3372 bp, Eucalyptus sp.
ggaagacgaagagcaacaaaataggtctcactccctcctctctcctctctcctctctcttctttctctctcttctgcttctaacaaagtctcttccttgagagacagggctgcgtcgtcgtctttctctctcctcgctgcgagcttctgagaaagttcaattctttttctcttgttctctctctctacccttctgggtaccactgtgaagctccggtcttttctattttttttttttttgggctatctgggtctgggcaaatccatcgcgcgctctgctctggactgagaggccgtcagtggctttagatctgcgacgcctcttgcttgctcagtgagctgggctagttcaaatcgacgaagaaagcatgcgctagtgattggtgtgggtaatacactgcattcgatctctactaagtatccccaagtatactaagatcccgttctcagccatgagtcaactgaccattcagactgaggacacttttgccagcttgcttgagcttgctgctaacaacgacacagaatctttcggacggtgtgtggaacgtgatccttcgagcatagatgaaattggatattggtatggtcgccaaaagggttcgaagcaggtggtcaatatgcaaagaactcctcttatggtggctgctacatatggtagtgttgatgtaatgagactcattctttgcctatctgatgctgatgtgaatcgaacctgcagcacagacaagagcacagcccttcactgtgctgcctctggtggtgctgtgaatgctgtagatgctgtgaggctactcctgtcagctggtgctgacccaagtttagcagatgctaacggtcagcggcctgtggatgttattgttgttcctccaaagctcctttcaataaagtttgctcttgaagagctcttgtcgaccgaaggatctgtaaatgaacacaatctgagagtgtccgtagccacttccaattcaacctctcccccactttcatcttccccggataatggttccccagcatctgctaattgttcttcccccaagaactcaaagttaagtgatgcccctgttctttatgcatcagaaaagaaggaatacccggtggatccatctcttccagatatcaagaatagcatttactcaacagatgaattccgaatgtattcttttaaagtgcggccttgttcacgagcgtactcgcatgattggacggagtgcccttttgttcatccaggggagaatgcccgtagaagggatccaaggaagttccactacagctgtgtcccttgccctgatttccggaagggtgcttgtagacgtggagatatgtgtgaatatgctcatggtgtttttgagtgctggctccatcctgctcagtatcggactcgattatgcaaggatggtacaagttgtgctcggagagtgtgcttctttgcccacacggagcaagagctgcgtccattgtacgtctccactggttctgctgttccgtctcctcgctcgagtacctctggagctgctgccatggattttgctgcagccatgagcctcttacctggttccccatcatcagtatccatcatgtccccttcacccttcactcctcccatgtctccatctgctaatggtatttctcacccatctgttgcctggccccagcaaaatgtaccaactttgcatcttcccggaagcaatcttcagtccagccgcttgagatcttctcttaatgcaagagatattcctcaggaggattttgacttgctgtcagattatgatgtgcaacagcagcagctcctaaatgagttttccatcctttcacaacaatcgatgggtgctaattccttgaaccgttctggtcggctgaaaactttgaccccctcaaaccttgatgatctcttctctgctgagagctcatcccctcgctacgctgatcaagccctggcttctgctgttttttcaccaacgcacaaatctgcagtaatcaatcaatttcagcagcagcagcagagcatgttatcacccatcaacacaaccttctctcctaagagtgtcgaccaccctttgttgcaagcgtctttcggtgttcaatctgggcgaatgtcccctcgtaacatggatcccatctctcctataagttctcgtgtgtcgatgttggcccaacgagagaaacagcaacagcaattacgcagcctaagctctcgtgaactcggttccaattcagccgccattgtgggttcccccgtgggttcttggtcgaaatggggagctacaaatgggaaaccagactgggctgttagtgcagatgaactaggtaagcttcgcaggtctaattcatttgagcttgggaacaatggtgaggagccagatctttcatgggttcaatccctcgttaaagaatctcctaccgagatgaaagaaaagctttcgtcaactctctctggtgttccagcccccgctacatccagtgaggttccgagtatcagctcgcagatggaatcggttgatcacgaagtgctaggagcatggctccagcagatgcagctcgatccgctcgtggctcagcaaaactaggttgttttttttcctacatggccttgaggaagtagacagcggaaagttttttttggtaaatactatgttttttctggaaatttttgatgctgggggtggggtctggaagaagataacaaggcaggaaaggggtcagtgaagtcactggagaaaaggaattcatttttaaccattttatcattctattacaacagaaagtagggaaaaaaaaggaagaccctctgggttatgaagagaaattaaacccaggctaggcgttctcctttctaatatttccaattttaggtccatattactgtcatttcctttttgccgtcttatcatatttcatcaaaatggaactggggactaatgtttgttccattctttcgctcttctgatttatttgcacccttggggtaagatcaaaagagaaattatgatcattttcttttgaggatatttttttttcccaatatttgtgagaatgaaagttaagaggggatatgatgtgtctggtgttgtagtatgaaaaaccaataaccgagttcacctgttgctgctggtggtagaagaagtggagaagaagctatgatcctttgatgtaacagtcaatcaaacattttaatacctttattttttgtttcctcatgtaatccatcctttgtgattgtcctctctctctctctctctctctctctctccctccccgtgttctttcttcataagcgtcttgcttgtcgatctgtaaattattgaaaagggtcatggaaagccgtgccggtgtggattctcatttttgcaaaaaaaaaaaaaaaaaaaaaaaa

SEQ ID NO: 1703 - DNA, 1323 bp, Eucalyptus sp.
aaacaggagagagagagagaaggatgccgctggggaagtactactgcgactactgcgacaagcaattccaggacacccccggcgcccgcaagcgccatctccagggcctctcccacctccgcgccaaagctctctggttcgactccctccaccacgaacccaaccaggcctacgccgagggctacgtcaggggagtctgcaaccgcttcgtcaacacgggtttctgtcagtacggggattcgtgcaagtacttccaccccaagagcgtttcgtctccggctccgcggaccgccggcggtaatgctcagtcgacggtgatcccgggaagtcatctagtcgggggcacctctttgcaaggtaatgtggtggtggcagatggtacgggcacagccactgcctgggggaatctccctccttccctaaagcctccacctgagggtggatatccatctttgcctttcattgactggggataagcatgtcgtttcatctgaagtattggggatagatgtagcaagaaattgatgcatcatctttaaagtgagttaaaagcatgtcctttccagttcatttccaagaggatccgaggtcgtgcttcaataattctccgcaatggcactggcagtaaaatctgaattcgaaacgacaggggctttttgtgggtcaatcgagctgagttgagtcgagcaagttaatgctgaggtcgagtccaactcgaccccatgctcgatggtcgaaattcgatggggctatgatgaagtattaaatctcctactcgtgctctatccggatagaaaatggagacgctcgaaatcgtcctgacccggttgttaataattaggttgccattgagctcgatcatgagttttgcctaaacaaactcaaatgcttctcctagacataacttgattttttatgtttgaatttataattattaaattcattctaagatgtagctagaaggttgattaagctcacatgacaatcgagttgagcatcgatgagttcacacccgaacttgaccgaacaagatactcaaatagatcaagagctcctgcttgggctatagtggttgaagattaggtgattagttgggctttagtacttgattgaggagccgagcccgagctatactttttatgtcatgcaaaatctctcaccgtcatgtaatcctaatgtacattagcttttgcaagacccaaaggaaatgtacattagctttcacaagacccaaaggataaaaaaaggaagaagaagaagattgcctgtactcgtcccttgtcaaaatcaaaatccattcccccttgttcatcaaaaaaaaaa

SEQ ID NO: 1704 - skipped

SEQ ID NO: 1705 - DNA, 1984 bp, Eucalyptus sp.
aaaatggagatgatggtgtctacgtctgtcatcgtggtgaagaaatagaagaagaagaagaagaagaagaggatgatgatgacgattgatgaggtaagagacgtcactggtcaatggtcatgcgctgaagctttctacctttaatgcaagcatcgatcgtctcggcgacgtgctctgcttcctcttcactgctggtcagttcatatgcatccacgcgtagttgtcttcaagcgacgcatgcactgattgaagcgtcctcataggcttgtgagatgatccaagacctttcactgcttgtgatactctttataaaggacgagggatggtcttgatgaatcaggttcatgaagtttctatttggttttctgaagggctcatgcatgtagacaatcttctgtcatagttagtgtttaatagaatgtgccgtagaaaatcagtctctcatggatggaactgtgctggacttcatatttctggcattttcttaatcttagttccttgctgcaattttttgctgtttcaagagtgtctactcgacatattatgaccctttttggcagtcattcagtttgacagtgggattcagatgttgggttaacaatctatgtcttttcactttaccatttcaagaattggtggatatttcagcaactatactcgtttgcatgattaatacataagttctatcaattcaatgtcttggtatgtcggtagcagcccatctagagaggcttccaccatatcacagtttggacttgtgccaatgccaaaaggttcaagcataaagatgggagttccactgcaacattctagtggtatcaaacaattgaatgttcactttcaagagcgggacttgtgttctactcaatcaaccagtcaatcattcagtgaagtgcctaatataggaggaagtactgactgtagccaagccacagttttagaacagacagaacatggtgaaactgaagggcaatcagtgagaggacaagcaaaatcagccttgtcaatgggaactcaggatttagtcttccaacctttagaggtgtgcatcccactccactatgctgaaccatccttgggtggttttatgcccgctgcttatgggccacaggctatgatctcttaccctcaaatggcaggaatgataccttctcgactgcctctgccctttgatacgacacaagaagaaccggtctatgtaaatgcaaaacagtatcatggtattctccggagaagacagtaccgcgcaaagctcggggctgaaaacaagctcatcaaggatagaaagccttaccttcacgaatctcggcatcatcatgcagtaagaaggccaaggggatccggtgggcgttttctctcaaaggatcagaaagaatcaaaatttacctcccttaatgatgaatcaaacgtcaaaagcaccgcaagggtgtcttcagccatcgatttaccgaattcagaggtgtgtcagctgaaagatcacagagacaccggctccaccacctcttgctccaaaacgactcaaaccaccaccagcagtgacgccatcccggtgtcaaaattcaggttctttggtcaaccttggcatgtgatgaccacgtgtgatccttcttgtgacgttcgttatagtggggatattcgccatctttctctgccaggtgaaagatgagtcggaacaacaatcacagtcgtcagctctgtgaatctggcgcttgagtggagaaagtacagctgctggtttcaatgggaagtcatccttggctctgttaccgttgcttcttattaggtagcttttttaaaactattttaactgccaggctagtcaaaacatacaaagcctgcggattgtggtctctgttacgagactgtcgtccttaataagcttattaagcgcacgaagaacacacgccctgatggtgtaacttgaaagtgtcgagcagccgtcattatgctaagcacgtgagttgtttgcctgataaaaaaaaaa

SEQ ID NO: 1706 - DNA, 1214 bp, Eucalyptus sp.
ggtcacctcacctcacaccactttctagaaacctccctccgtctgtctctttatctctctctctctctctctctgaaacccatttttggagctactattctagctattcaaaaaccagattctgtgtctagggtttcatgcaacttaagagtacagaagctccagctctgctaagctgttgatgatagggcaccttggagtaacacattagagatataaactaatcttgtcatggatcagacggaacaaacacagcagcagcagcagcagcagcaagtagtcggggttgtggctggcactaaccaaatggcatacgcccctccatttccaactgctcctgtagttgctcctggcactcctgctgtacccataccttccccgactcaggcacccagtactttccctggctctcctcatcagcttgcataccaacaagcccaacacttccatcaccaacagcatcagcagcagcagcaacagcttcaaatgttctgggcaggtcagatgcaagaaattgagcaaactcaggacttcaagaatcacagccttccccttgcccgaatcaagaaaataatgaaagcggatgaagatgtacgaatgatctctgctgaggctccagtcgtatttgcaaaagcttgtgagatgtttatcttggagctgactttgcgttcttggattcacacagaagaaaacaaacggaggacactgcaaaagaatgatatagcagctgctatatccaggacagatgtgtttgatttcttggtcgacataattccaagagatgagttaaaggaggaagggctaggagttactaaggctaccattcctgtggttggctctccagctgatattccatattattatgtcccaccacaacaccccatgggacatccaagtacgatcatgggaaagcctgctgatcaagcagcactttatgctgcccagcagcctcaaccgccggtttctttcatgccctggccgcatgctcaatctcagcaaacccaagatgatcagcaaacgaattcttgatttggggtcatgcaaattctagtgcagcttcttagtattaatggagttcctttgcatgtaattgagaggtagcaattgtctcggattgtagagtattgaaatttgatgcgattgtaacttgtttgggctttgtaatggcatctacattaatatctgaagcattaggttgtttaagtgcacactag

SEQ ID NO: 1707 - DNA, 2023 bp, Eucalyptus sp.
tttgagagggtcctcaatttcctctctcaaatggtggacaagtcgggctcaaactcagatagagaaggcgacaacaagtacaacttctcaggaggagcagcaacaagtgcttcaaatgaagaagcaagctctttaagagagcaagatcgtctcctcccaattgccaatgtggggaggatcatgaagcagattctccccccgaacgccaagatctcgaaggaggcgaaggagacgatgcaggagtgcgtttctgagttcatcagcttcgtcaccggtgaggcctcggacaagtgccacaaggagaagcgcaagaccgtgaacggcgatgacatcgtctgggcacttgggtccctagggtttgatgactatgccgagccgctcaagcggtacttaaatcggtatcgggaggtcgaaggggagagggccagccaaaacaaggtcacaggcggcgaatcaagaaacgagaagaacttgtacggggatgagtcgccggagaagcagctgggcgctgcctcttcgtcgcctctgaagttctttgatgtggccgacaggagtaccaatggctctttctctaagaggtattgagaggtacacacatcttggaaatcaatctaactaaaactacagatttttagttttggtagtaaatagcatatatatatgtgaagcaatcaaaaatatatatgcttgtggtggtgtgtgttgctggcaactcatggtttgcatcttagaattagcatagatttcctttcactgactattggtagatgcagaataattatgtacaattgatgttggttgtttgttggaacatttggatgcttaatttgcagctacttttatgcgaatgacacaagttttgcaactttgggttttgtagtggaggtgctttgtgttgaattgatcaagagtgagggtttccgtctatactaaacatgctaataatttggacattttcttcatctcaatttgcctagcctttttaaagttcagtcttgataatcagaatctgcattactcatggcacttttccctattttgaaggattagtggaagcctaaaagcataggcaatcagtattttgaaacaagacctaactcgtgcttatgcttggtaacttggaatctgtaaaatttccagacatacgaaactagtttatgtcaatgtccaaggcttcgtgtgtacacggatcgaacatggtcacagaaaggtttatatttcgattgattcgctgagctttgagctgtatgacgataaacaggttttgacccatgaaattaccagtacacaagtcagactgatagggtatgcatagaacatgtagttacccgaagccaagcatctaatttcttttcttttcatttttggccgaagaaacaagcttctcgtaaggaataacctttgcggttttttactgctactatttgcttgaattgtaataaatttgcttcgctcaagaattggggttgattatctacaatttacatattggaaggagctataacttgctagattcagttacgagtcaaaaggaaatttagatatgccacaaaagactagtagatataacttgcttcttcttttttcattggacctaaaaaaagaaagatcaacttctttctttgattaatgggcggttgataggtgagaccattggacatctttaatatattcctcatttctcatattagtgaattccgtgtttatggaatttaaatttatataagaccgattacaagtattgagaatatgtaataataagtgagtatcaccgacagatgtatgatgaaaatattagattctgttataaagttaaaatgaaatttagatctaccacaaaagactagcagttaattgaatttctttctttaatcagttgccagttgatcgatgagatcatttgatattcttgatatattcctcatgtctcatattagcgaatatcgtgtgtacaacttcaaaatttatttgagaccaattacatatagttagagctggcaataattgagtatcaaaaaaaaaa

SEQ ID NO: 1708 - DNA, 1442 bp, Eucalyptus sp.
agagagggacaggagagactttgttgttgttgctgttgttgctgttgttgtggtggagtgtggaagaaggaggaaggaagggagggggaggtctcaagaggggagacatgttcagcttgatcccaacagttctattctttgcttcttccctcctgaccagatccttcaccagctgatatctgaatgagctgaggagagttcatttcttgttcactgtctacttgaatttggatcactttgtaaattgctggaattagatgcctataagaatccagaacttgccaaagaaaaatttcgatcaaggttcgagcctttcgatgcctcatgtcggggtgacttacccaccatggtggagcctgaatgaacagcaacttccgcaatctttacccaaaaatagtggcttgaaagcggaatctccacccatgctccatcatcaagcaaagcatttaggtcttcaactacaagaacaggaatcgtcttcaactcaatcggctggcaattcttgccatgaagtgagcgtcgtgggtggggccaactctcaagatcaaagcatttcatctgaatctggtcaagatgaaagttgtggcaggagctttgagggccagacaaagccaattttcatgttcaacaatccggagattgtcttcaattcttcactagctgatcaaaatcaacctctgattcgtgttccatatccaccagtcgatccttattacggtgggcttctgactgcatacagaccacaggctattattcaatcccaggtaggatctcaaatgttcgggatggcacctggacgtgttccattgccacttaaccttgcagacgatggaccaatctacgtcaatgcaaaacaatatcacggaattcttcggaggaggcagtcacgtgcgaagatggaggctcaaaacaaactagtcaaagctcgaaagccttatcttcatgagtcgagacatcttcatgccctaaatagggtcagaggatcaggcggccgcttcctcagcacgaaacagcgtcagcagctcgactctgcttcaagcagtcacagcccatttgcaactggacccagagatcgaaataaagatgcttatgaaccagaaactcaccaagtgggagccagtgagcggcagttcacttcaaccatggccggcgcggacttctatccggatagcaggttctccggaatctccacccacatgggaggagcgatgcagtgcaacaaggggctcatgcgcagcggtgcagcccagcactgctcttcatccgtccggtgagcaagtggtgcaaagttctaaaccaccacgtcacctggacggggcaaatcatccttggctttgttaggttcaactcccaactgtttcatactttggtcgcgatatgacaccatgttgtctgatactattttactgatgttgattgggaaattcaagttaaaaaaaaaa

SEQ ID NO: 1709 - DNA, 1620 bp, Eucalyptus sp.
cctctctctctccttccctctctctctctctctctccccctctccccctctccctctccctctccgaacaaggctttctctatcctgttttgcttcaaattgtacgacatggttcctaacaaatgggtgtctctttgcttgaagctgttcctgcttccttccacttgtgcctgagtcctgatttgcagtaaagtcaaagcaaaccctatttgaaaaaaaaaaaaccagaattatccttgtgatatttgcgaagatatactggctatcaagccatgactttcaaagagcatgaaatgattcacaataatccaaatacacagtcgtcatcgctgtcgtttgcgccttggttggtgctccatggctcacaaactcctcagagtgaatctgttggtcgattgaattcagtggaacaccatgcttctgaggagttccaccctttatccaaaaaggcgactcaagctgttgaaggaagtgctgacaggccagatatgactcaatttgccatcttttctgaagaaagtaaattctcaattgactggcggaagcctcagctaaccatgtcagctctaccggagtatggttctaatttccatagtgaatttggcccaccgatggtatcattctacaagtagccttaatattattcttaatttatagttttatattgctaatgctaaattttttttgtggatggatgatcatccaagatgtattccaaatattcaaatgtagatcagatttctgggctattccctctttatggagctcaatgccagggccgcatcatgcttcctctgaatttgacagcagaagacggaccaagatatgtaaatgccaagcagtatcaaaggatcctcacacgtctcaagtgccgtgcaaagaagaaattggagaactttggaagagcccgcaagccatacatgcacaagtcacgccatcttcatgctatgcgccgccccaggggatctggaggtcgcttcttaaatacaaaagccctgaaaaatgcaacagaagtaaacatgaagaaaactggcagtgatggaatgtcaccctgcccaaccagtcctcagagttcagaagtcttgcaacctgagagcagaggtttgaatgcatcaaaagtgggagataacaacaggaccaaccttactggttcggaggtggccagcctgtactccccgcatcggctgctgaacaatcatgtccgaccatgcgttcacccacatctacatgtggacaatggggggcatgacatggttatgcccggaaagtgggctccagcagctgatagctgccatgacctcaaagtcgtctgagggcaaaggaagtcgttccggtgctagtagcagaaccatggtcacatcctagcagcaattcgaagctcagttgcagttactgttcttgcactgagtttcttggtctggaggaggcaaatcatccttggctcgtgcatcaaggctgtcttgaccatgctacatggcatggctttaggctttgagaccttgatgcccaataaaagtataatatcaaaggtgacaattttaggtttcgttgctggatcttgatgtaataagggcatgtcaaatgtgtgtttgctgtaaaaaagacatcaaagctatgcat

SEQ ID NO: 1710 - DNA, 1607 bp, Eucalyptus sp.
gtggaggcacgtctcaggttcgatcttcgtttcgcgatttcggggaaatttttcgccttcttcttcttcttctcctcctcctccttcctgctggttgcggtcgttttcgcgtccggatctgggattcgcgcccgtcgattgtgcatggaaacgaggcggtctcgcgactgtcgtgacgcttcgcgttcgggagctcgatctgatttctctctctagatttggttggtggtggtgctgcctttccttttttttttttttttttaaccttttccccccttctgagaggggaaaaagagaaagggaggaagggaggaaagggggggggaggtttcgtttgatgctgctgcggtcctgacgccatgaggaagaagctcgacacgcgatttccggctgcaaggatcaagaagataatgcaagcagatgaagatgtagggaaaattgcattagcagttcctgttctagtctctaaagcattagaattatttttgcaagacctttgtgaccgtacatacgagataacacttcaaaggggagcaaagactatgaattcgctgcatttaaagcattgtgtgcaaagctataatgtgtttgatttcctgagggagattgtcagcagggttcctgactatggtcatggtcatggtcattcagatgctgtctctgaggatagaacagtgtccaggagaaggaaggccaccatcgatgatggtaatgacactgatgaggaatccaagaagagcaggatgcttgagatggcccatactggcagcagtggcagaggaagaggccgtggccgaggaagaggccgcgggcgtggtggccgagccactgagagggagactgcgcaccatgaaactgaatcatctgagccgaccacatctctgcaacctgtcaacaagaacattgtcaatcaaggaacagtttcagatcacagctctgagccaaagaaaactgctgaggaaactatcacagccactgatggttccaagcttggagcgcatggttttgatctgaacactcaagttactgagaatgagggcaccccagcgaaagttccagtagctggtgtttcatctgaggaacctaatgttgatgaggccaaacacgaagaatatccaggatggtcactgtccgaggttgacaagatgtccattgaccctcttcaattagcaaatctgggtacccgcattgatgaggatgatgaagactacgatgaggagggctgaaaccaggagcctcatgtaggaactctagatgggtcggataactgggagatcatggggagagtacatgaggagcagaagaggtccaaatcgtcaccagacaagcggtatatgcatgtggaagattgtaccctgtttggtgctccttggcaagagtttagttcctctctgcatttggtttgatattgcatctgaattttaccatattgtaagctaacatcatcattctccaagaatgtagtccttcgctgttagattttctcaggcaatgtagtcttaagagaatgttagaagaaccaggttctgctcttttagtcatccattattgtagtaaaaatttggttatctaaatgaagcaagggttaggaaggcttaaaaaaaaaa

SEQ ID NO: 1711 - DNA, 2620 bp, Eucalyptus sp.
ccgtctcaccatcattgactcgttcccttccttctctctctctctctctctctctctctctagcgcatcactttctctctcgcagcaaattcggcttctgggttttgtgaaggaaccttcagaaaggttcttgtgcggtcaaagttcgagtcttggctcgggcttgattccctgttctattctttctctctctcctctttgatcggttttcaccttcttcaaggcactgcaattgggtatctgtttgaaggggaaatttgcgattttccagccgctcgaagtttttccgccgtcttctcgtgtgctctgagagtgttgttgattcactatgacggtggaggacggagggaatgaccggtttccggtgggcatgcgggtacttgccgtcgatgacgacccaacttgcctgaaagtgttggagaatctgctcagaagctgccaatatcaggttaccaccacaaatcaggcaatcatggccttgaaaatgttaagggagaaccgggacaaatttgacctggttatcagtgatgtgaacatgcctgacatggatggtttcaagctactggaactcgtggggcttgaaatggatttgcccgtgatcatgttgtcagcttatggcgatcccaagcttgtgatgaaggggatcactcatggtgcttgtgactatctgttgaaaccggtgagaatggaagagctcaagaacatatggcaacatgttatcagaagaaagacgtcaaactcaaagaaccaaagtcagttgccgaatcaagataaggacaacggtgaatctggacagggtgcacaaggagcccaaacaactgcaaatccagatgggaaactcaacaagagaagaaaggatcaaaatgaagaagaagaagaagaagatggtgaagacaatgagaatgagaatgaggatccctcgagccaaaagaagcctcgagttgtttggtctgtggatctgcacaggaaatttgtttcagctgttaatcagcttggccttgaaaaggcggttccgaaaaagatcctagacctgatgaatgttgaggggctaacgagggagaatgtggcgagccatctgcagaaatacaggctctacttgaaaagaatcagcaatgttcagcaagctaacatggttgctgcatttggggcgaaagatccatcctatatgcgcatgactgcactgaacggttttggagactttcgaaccttggctgggtcaggaagattttctggtacttctttgtatccacagggcataatgctaggcagacttaactcgcctgtaggtttaggtttgcaagggattgcagcttcagggccaattcagccaagtcatttgcagaatgtcagcaaatcaatcaactctcttggaaagctgcagcccaatccaccacctgcgaaccaaaatacaagcttgcttcagccaaatcatggcaagccaggtcctcatataagagacatcactaaattcgacaatcccacagcccttaaagtttccccaatcgcagataaccgggtgacggccagcagttctagcaacctcagccagagcgtccctagcagccatttgctcttacaaggaaacccacagcaaagtcgcagtggggatgaattcggaatacagtcttcctttggagcagtttctttgcaatcagaaaccctcaatgttggtgctattggtggatgtaactttatcgataaaagtagatgcaatgaaaattggcatggtgcagttcagttaccccagcttccttcagcaaatcctactccactaacagtgccctttaactgcagtcaggtggctcccacgaatatgactgagaagttcactttgccctctccttttatccataatggcccaaataatatctcttctagtcccgttccatcggctctaggagactctagaggagacatgcaatgtcaagctgggctactgggaaacgtaattcaaaatgtggacttcacatcatcgaaatcaaagtgggaagatcataaccaaaattaccaacaccagtttaatcatggttttggtacttttgactctgtagtacctgccaatggtgacatggaaccgttaatccagaacatgggatcggcaagttcattgcgtggtggaagtgtggatgctccttttgctgtccaatcaaattctggcaatgcacctctctatcagcaagcagaagttggcaaatcagcatccatggaggcaaacatgagatcctttgaaaactacctcttggggcaaacaaagtttccggatggcttcatgccaaatggtttcgagtccctcgatgagctaatggatggaatgatcaaacaggaacataatgaggctgtgctcacgaatggagatttcagcttgggcacctatcctgttggatcatgcatgtaatgctattgctgccccatcagaaagggagatgcccacagcgcctcttctagaagtttgagtccacttgtaatttttcagtgttttctgtctagatttaatcatcttctccaactttgctgtatgctgttagtattcactagttttaacactcttctttcttccttttaactctgttgcattcatgcttagttagaagtttttggcaaatttctgccaaaaaaaaaa

SEQ ID NO: 1712 - DNA, 2603 bp, Eucalyptus sp.
aaaaagatatcagcgcagatagttttctctctctctctctcttgtctgttcgtcgcctgcctcctctgcgaaaagacccaaaagtctctctctcccggctgcgctaacttgcgccttggcccctccggcgatcgtcgatccgcctccgatctccgatctccgggcggctccgggattgagccgcagccgccgtcagagttccgcttcggagtttttcctctctctgtagattcgagctcgtatccggcgacgccgcgctcccgaaccgccgtcgagctggtcggagcgttgctgcttttcggcgttgctacggattttgctttttgtcgctacttttggttactgatgtgtgtatgaactgacagtaggtgttggatttcggcatgttcgatgaagggattttccgtgagtagattcgggggagatgttgtgcgaaccagagtgtcgagaactgtaaccctaagtttagtttcggtcggggctgtgcggaggagagtttccatggaagtgctttagcatcgcccgaggttttttcggccttgtcctctgttgtccccctgagtgaaacgaggaagcgtttttcgggttagccagcgggagagcctcttagctggagctatggattgtttggaactgaatctgaacaaagagattggcgatggcacctccggcggcggcggcgttgggggaagtgttgggaagaatgctaataagagtggtggtggggaaggattcattgacaggagcaaagtgaggatcttgttgtgcgataacgacacgaagagttcggaagaggtccttacgcttcttttgaaatgctcttatcaggtgatgtcagcacaggatgaggtctcaattgttgtcaaatgcttgagattgggagcagcggactatcttgtgaagccattgcgcaccaatgagttgttgaacttgtggactcacatgtggagaaggcgacgcatgcttggactggtagagaagaacattttgagctatgactttgatctgattggttccgaccctagtgataataatacgaatagtactactttgctttctgatgatactgatgataagtcccggaagaacaccaatcctgagattgggctgtctgcaactcatgaagacgagtctgctgctgttgctgagcccccacttagaggtgcagtaaattgtcgccccaatgtgccaggaatcagtgatcgtcgaaccggaccatgttcctctggtcctaagaagagtgaactaaaagttggagagtcgtctgccttctttacatacgtcaaatcgacaattgtcaagaatactccttcaacagctggacaagttgatggttgtgcttctgtaaattatcggatggaagagaagaatcaggcagaggatgagcaggcagtttatgatcctcaagcacatgaaaatggagaggtctgggagaaatcttccctaggtgatgaatttccaagtgggagtagtgttccagattctctgtctttggaacggtcctgtacgccgccagggtcagctgactttcctcaacaaaggaacttcatggaagaacgggcacctcagatgcctatacatgcgacaaatgagcctcgtgttgacctccctggattgcctgcgcaaagcacatatccatactatgtgcccggagttgttaatccagttatggtgcattcatcagcacaagcgtaccagaataatctgcatgacttgcaaaaccatcctacttcagccatgttgccccagtacagtcatcttcctcattttcccacccatgtaaatgggatggcgtcatttccctattacccagttggcttatgcttacaacaaggtctcatgtcttcacctcattcatggccatcctttggaggttcatctatatctgaagcaaaaacgaataaagtagataggcgagaggcagccctactcaagtttaggcagaaaaggaaagagcggtgctttgacaagaagattaggtatgttaacaggaaacgacttgccgaaaggaggccccgagtgcgcggccaatttgtgaggaaagtaaatggtgtaaatgtggatttaaatggccaacctgagtctgctgattatgacgaggatgaagcagagtatgaggatgaggatctggcttcgaggggttccactcccgatgctgaaatttctggaacatgaaggtcatttttatcagctgaacccatgaggatacgaaagctgagttgcttgcatctcaattcggcaaagatcatatgcagcatcagctctgattatggatgccaatatcagattttggcacgggaaaggtgacgcagattgtacgaaagcagctcaccgctgtgttcctcttccaatccaggcctgaactgtgcaccgtgggaacttcgtccttggccttaattattcatcaaacaaaatgatgccacgtgatatcggttccccatttgatcttttcgtagtttgttggaacagatacgttaaagtttggtttcccgcttgcacaattcggaagctggaagcaaatatttttcagatgaaaagaaacgcctatcagttgtgccgatttgggaaccaagtccagccggtttctttcctgtgggatttgt

SEQ ID NO: 1713 - DNA, 2902 bp, Eucalyptus sp.
catttcttctcctcctcctcctccttcttcttctccatcatcatcttcaacgccaaatactcgaaggtcctccttttttcccccaaatatctcgcgcgaaaccctagctcgatcacgatggcctgaagaagagcgcgcgagctccgttcttgttgagtcgaacaggcgaaaattttttgaggtcgccataatttcgggttcttcatacagacgagaacgggatgtgcagtcttattacttaacttgaggaggtttctttgcgcactaaatccagtattattgttgggctttttgaatctggttgatgccgattgttcagatgaccaataatagacctgggactgaggggcttgcagaacaaaatcaccacaaaaatgacgataacaaggatataagggatggagtcagaggcgatggtcaggaactggcagaggaagatgagttacagatctacggggatgtggaaggtgcatcagataggaaggtcgaagcaacagaaccacaggattttgtgcatgcgcattctgttattccaaggtcacagcagcagtcagaagagccatcggttcactgggaaaggtttctaccattgaggtctctgaaggtactgctggtggaaaatgatgattcaactagacaagtcgttggtgcactacttcgaaattgtggttacgaagttacagctgcagccaatggtctacaggcatggaaaatcttggaagatctgaccaatcgcatagaccttgttttgactgaggttgtaatgccttgtgtaaccggcattggacttctatgcaagattatgagtcacaaaacctggaaaaacgttcctgtgattatgatgtcatctcatgattccatgaatatagtcttccaatgtttatcgaagggtgcagttgatttcttagtgaagcctataagaaagaatgagctcaaaaatctctggcagcatgtttggagaaaatgccacagctctagtggtagcggaagtgaaagtggtataaggactcaaaagtctaccaagtcaaaaagttgtgaggactctgacaacaacatgggcagcaatgatgaggatgatagtgagagcatcggtgttagggatggaagtgacaatggaagtggcactcagagctcttggacgaaaagggcagtggaaattgacagtcctcggaaagcgtcctcttgggagcagttggctgatcctccagatagcacctgtgcacaagttatccacgcaaggcctgatacgcgcagcagtaactgggtgcctatgactgcaatgaggaatgctaagggaaaatatgatgaacttgataaagacatgatgggcaaagacttggagataggagcacctgatctgcagattgaagaaccaagtaaaaatgataaaattaccgcagatcctactgccaacgaaatcgctgagattgagtaccaaaaaaatgatgagcaattgggggataaacagttggagctcaacggtgagaaactaaatgccaaaacaggtgctgtcactagtagtagcaaccctccaatggaaagagtcaattttgatatcgccaatggctcatccaaaatgtctgacatgaaagataaggctgcatatgatatcaaggagatgccgtctcttgagctcagtttgaagaggatgaaagatgatgttgagagcaaatcccatgacaaaaaaattctgagacattctgacctctcagctttctcaaggtacaactcttctactcccaatcaaactccaaccggaaatgtcagtagctgttccccagctgacaatagctcagaggtagacaaaacagagtatgtgcagaatttccagtccaattcgagcagccctcagctgaatcaaggttccaatggaagcagtaactataatgatgtgggttcgaccactaacaatgctttcatgaagctagaaaatgtcactgacaaaccaccttctaagtctattttaaaatatctccatcaatcttctgctttccaaccagtgcaacatggtggtgcatgtcctcagcctacagtacagggtaaagtagacccagcaatggctcacgtgattatgacacaagctaggggtgtgaagcatcgtgttcaagtgcagcaccaccaccaccattaccatctccaccaccaccaccatgcgcagaatgtaactcaaatgcaggaaccagctgaggatcatgacaatgcttcaaaaagcacagcagctgctgctccacagtgtgggtcatccaacatcttgagtacaccatatgaaggcattgttaccaataacagctgcaatgggagtgcctctggcagtaatcatgcaagcaatgggcagaatggggggaacttccccacaaatgatcaagaaacaaacgtggatggagacaatacgataccatgtgaaagtggagccaatggtgggattggatatacgaacaggaatggagttgaacaaagtcggaatgcccaaagagaagctgctctgaacaaatttcggcaaaaaagaaaagaaaggtgttttgagaaaaaggttcgataccacagcaggaagaaactggcagaacagagaccgcgtgttcgtggacaatttgtgcggcaggctgtcaatgagatcaaagatgaggaggcagattcctgacctattatcctgatgaagatataggatttcgtggtcgatctgatctgctcattgctcacaacatttattatgtgaattgaagacattcagaagacactgcgttactatatttatattgtggactcatgttgctactggtatgctactaggagatggtatgctggggccctaatctaggtcacctctaaagacattgtgtgctgtttgtttctgtaagacattctgcacaaataaatgctagaagtctgatcttcaaaaaaaaaa

SEQ ID NO: 1714 - DNA, 1763 bp, Eucalyptus sp.
cgatcgtttccccttcctactctcctctctcgcgaaagctcgaaaccctagaaatcgaaacctccgcggatctcctacagttccgatccctctcctccgtcgcgccggctcgagacgctgccccggcccgatcgagtggagaaacgggcgaggaagtgaagatgagcgaatccgacgacctccgccacggccgcggcggcggcagtggagatggcgagctggacggcgaggactcggtcgccgagtgggagttcggcctcccgagttgcgatgacctggcgccgttgtctcaggcgttgattccgcccgatctggcgtccgcgttcagcatcgcgctgcggccctcgagaaccgccggcgacgtcaatcgcgcgtcccggagcacgttgacgggattgcgccgctgcggcagcaccgcgtcttcgcagggtttttccaccaacgataatttcaagtccttcgttgatgatcgtcagagcatggaggtggaggtggaggaggaggagaaggaggaagaggaggaggaggaggaggaggatggtgccgataaatcggattccaggaaatcgaggaggattgagacggccgaagaagtggattccactccgaggatggatgattcgcaggaggatccgtcggagaagacatcaaagaggccacggctggtttggacacctcaattgcacaagaggtttgtcgacgtggttgcccatttagggatcaagaatgcggttccaaagactataatgcagttgatgaatgttgagggattgacaagggaaaatgtggcgagtcatctgcagaagtatagggtttacttgaggaggatgcaggggatgtcaagtgaaggactttcgtcatccgatcaattgtttacctcgactccggtggtgcatagcttgaattatgttgcaggcagcactggtcatggtgatgggcaaatgcccatgccgacaccggtgccctatggagaacagccgcctatgatgcctatgccagtttatgcaatggggcatggttatggacacatgagaatgcaaattggtgatttatctgggtttgagtcaaaccaatacgtgacgcaacagagagattggtccagtaataagtatggttcggttgcttcttaccaacagaccgcttcaaacgagaaacgattctagcggaatttattgacgataaagaaaggttaacttcttggtcttgtaagatactcttcatgatgattcattcgtccatggttgcttcagacgttgtggtggttttgataatttgcctttcacgggtgacttttggtgactttacaacagcgtcagatcctcatttttaaatttatagttgatctgcgagtaagctgagcaaaatattgtgcctcccagttctggaggcatccttagcagaaactttaactgctcaaaatagtcctagccagcgggtgttatggtactgctgtcgctttatcaacagagggatgcaagacaagtttaccaaattttgtgttctgggtgatccatttgaacggatacatcacgtgtacatttgaaggtacctggcaggcggtattgggctgtggttcagaaacctgcataaggtctaaagccagaagtagaaatataggcgcacatttacatagtttccttgtggataaatgtgtatgagaaataattgttgaatgttctgaaccatgtcttgcaggtggtttcatcccttttggaaattcagaagttgaatgtacagtgctttcgttttgcttaaaaaaaaaa

SEQ ID NO: 1715 - DNA, 2240 bp, Eucalyptus sp.
ccacccacagttctttcccacttcagactctctctctctctacatctgcctctggataattttccgttttccacagaaagggtccttttgtttcttgtccctagttgttcatacatataggtttgtatctctgggaagcagagatttctggaggatcttttgttggccttcacttttgattgatgatggagagcagcaaaggcttctcttctcctcggagcaacgggttccccgccggattgcgcgtccttgtggtcgatgacgaccccacttggttgaagatcctcgaaaagatgctcaagaaatgttcttatgaagttaccacatgtggtttagcaagagacgccctgaaactgcttcgggaaaggaagggtggatatgacattgttattagcgatgttaacatgccagacatggatggcttcaaactcctagaacttgttggcctcgagatggatcttcctgtaataatgatgtctgtggatggggagacgagcagagttaagaagggtgttcaacatggggcttgcgattatctcctcaagcccatcagaatgaaagagctccgcaacatatggcaacatgtctttcgaaagaggatccacgagataaaggacattgagagtcatgatggtcttgaagatcttcaggtaacgaaaagcgggtatgattgggtggatgatgggcatttctttagtggagaagatatgttgacaccaggaaagaaaaggaaagacctagaaaataagcacgacgagaaagacttgaccgatccttcgtcttccactaagaaagctagagtagtttggtctgttgatctccatcagaaatttgtgagagcagtgaatcagattggatatgataaagttggtcccaagaaaatactggatttgatgaatgttccatggttgacaagagaaaatgttgccagccacctgcagaagtaccggctttacttgagcaggttgcagaaggaaaatgatatgagaagttcttatggcgggatgaagcattcggatctaaacccacaagatgctgccagagcatcgagccatcagaactcgatcaatttccagcaaaatgatgctacaaatggcaactcaaaatttgctggcaacaacttgctcatccagaatttgaactccaaaaacaatgaaattgacaccagagggactataatcactgagcaatctggtccaggaatcagtcactcactccctccgctggagcaggaaatgaaattcacagcatttgatggtattaccccgagatcgtacccttggagagaagttccagaaattcaatttcaccaagaaaatgctgggaatcaaccagaagattgctttggtcacgtggctgggcctataggtggcctgcagaatcatgtccaagtagatgaactactacccatcacgtccattagttcgagagcacaactgcccaacccaatcgaaactaagcctttgaatgttgattatgcaatcaacagctttactcaggcaagtccggtgaaaacgagaatcgactcttttcccctacccacaaaaagccacatgggaaatcaacaagccattcagcccccttcaatcaacacaccaatcatggaaagtcagggctttaacccgagctgcattactgacttggaatcttcccgaaggaacttttcttcaacccccactgagtcaccttttacatctcccgatgagattctacaggtggggtggcttcaggattactccacatgccttggactccaaaacatagagtttccagattttggggacccaaccatcatacctggagtaccggtgcacttgtacactgccctgaagttcgactatgaccaaccctccgaccaatcggagttacctgtaataaatcaaggtctgttcatagcatgaccgatgctctagtaggatttgtcgcttctagattgtctgctgacccatctaaaagttttgcttcctctttaaggattgcgcttaccatcatcctaacaagctgttaggagatttaattatggaaacatgtacgatggtgaagattggcagatgctaagctaaacgaagcttgcttctccaagtttggtcgacgtgcatcagtgcattagttttgatatcgtgtgaaggatggctagcacacaggtacataggtgcgggtaatggctatgcctgcccgacactaaatcttggacactttgcaatcaaaggaaagacatttaaattatcagaaaaaaaaaa

SEQ ID NO: 1716 - DNA, 1153 bp, Eucalyptus sp.
cttaaattaattcccatctccccccccccaaaaaaaagtcaatcccgaaaatttggttttttcttcgcttttccccaaatctcgcaacgttccagtgtctctggcttcacactacctttttccgaattcgcttgtttttcccccatcgaaatctttgcagaacgagagagggacgcgcttcgttccgggttgggtgctgaccatgccgagatttcacgggcagagcaaccacgcgcctgtggacatcgtgaaccagcttcagaagcagtacgtcgattacttgagttctcttttccacgagggagttttggacgaccagtttacgcagctgcagaagctgcaggatgagagcaacccagatttcactgttgaagtggcgactctcttcttcgtggattcggacaaactaataaacaatatggccgcggctctagaaagatcacctgttgattttaaacaagtagatgctgatgttcaccagcttaagggcagtagttccagcataggtgcgatgagggtgaaaaatttgtgcattaccttcagaagtttctgtgagacgcagaattatgaagggtgcttgatatgtcttcagcaggtgaaaaatgaatgtgctgtgttgaaggacaagcttcaaaatctattcaggatggagcagcagattgtgggagctggtggttcggttcctctgatggattgacctattgccgggttctttcttgaaggaaaaaaagagaaagggggagagagaagggggggagggaatggagattggagagtacaattgaggctgatgatgggtagttctctttgtagttcatatgtgggctcatttcatggtatgaaccatttctttgggtgtgcttattgatgttgctggaggcataggtgttgcaggtattgctaataagtatctataacatttctgctggtgtcatgttgtttctatgtcgcttcttacatcttctctttggtgtgaaacgtgcacagtattcttgtgcacaaccaattatctcctgattgttactgcacatcctagtgcacattttgccatatatatatgacggacggttactgattgttactggacatatgaagttctttcatgttcaacctcttattgagctaaagttttctgacttgcttaaaaaaaaaa

SEQ ID NO: 1717 - DNA, 1531 bp, Eucalyptus sp.
ggcgtaggcaaatgtagagagagaatcgtcgcaggaaaatcgaaagtccccatcgagaagaagaggaagaagaagacgaaaggaaagggaagggaagggaagggaagggaaggaaatcttgggggagagagatggaactgagcttggatttgagcttggctcgggagcctcggccggtgtccgaattcttcagggaggtgtccgggatcccagatcgcgacgaaagattgtcgaaactcgatgactatgtggcgagattggaggaggagatggggaagatagacccttttaagcgcgagctccctctttgcatgctggtcttgaacgacgctatggaaaggttgaaggaggagcgattgcagtgcaaggaaatggaatttattcgaccgaacaggaattctgataaagataagagggcagaagtggaaaacaaggattcttgtgatcagaggaagtggatgagctctcctgatcagaatctggatcagtacgcagccgagaagaacccaattgagccgtgtagctacaagaagaaagggggggcgttcttgccatttggcctccatagagctcctccgaaggagggcaaggattcttcaccgatttctagacttaccctttcgactccgggctctatgttggcctctcctgataatgataatatcaagaagctcagttttgaggcgcccttctcgacggaccatgagaaattgcagaaaagcccacagcaggcgcagcagcaccggctgcagcagcatcaacttaggaagcaaaggcggtgctggtcacctgagctccaccgccggtttgtggaggcgttggagcagctcggtggagcgcaggtggctactccaaaacaaatcagagaactcatgcaagtggaaggcctcactaatgacgaagttaaaagccatttacagaaatatagacttcatgtcaggagaatcccatcaccatctgccgccgtggaaaatggcttatctttagtgcaagaacgaagtggcgtggaccactcagagctgaggacctcagagtctgattctccccaaggccctctccttgcctgtgcatctgctcgagcagcttctagtgctggagggggaagcgcggagatgacagatgaagaagagaactctgaaggccacagttggattactgtgctcggagagaaaatcacagcccattaaactcagcgaccaaaaccgcacacgggatcttagaacgttaaaataaaactcaggtgatgagagaaactaacgatcattttctttcttttttaactaaggcattttcggaggggagaaatttcggcggttttagtcgagagagagtagagaagccttggatttgattcctcttctccgtgttttacgaacttgttctctgtttgtattatagcttgggctccatatcatccctgggtgaagaggtttttcctggagcccttgatggattcatgaggttatgtaacactactgactttttatcgaatgtgaggttgtccaatactcccaagaagttaaaaaaaaaa

SEQ ID NO: 1718 - DNA, 2910 bp, Eucalyptus sp.
ctttttcgtccccccatttcttctcctcctccttcttcttcttcttctccatcatcatcttcaacgccaaatactcgaaggtcctccttttttcccccaaatatctcgcgaaaaaccctagctcgatcacgatggcctgaagaagagcgcgcgagctccgttcttgttgagtcgaacaggcgaaaattttttgaggtcgccataatttcgggttcttcatacagacgagaacgggatgtgcagtcttattacttaacttgaggaggtttctttgcgcactaaatccagtattattgttgggctttttgaatctggttgatgccgattgttcagatgaccaataatagacctgggactgaggggcttgcagaacaaaatcaccacaaaaatgacgataacaaggatataagggatggaatcagaggcgatggtcaggaactggcagaggaagatgagttacagatctacggggatgtggaaggtgcatcagataggaaggtcgaagcaacagaaccacaggattttgtgcatgcgcattctgttattccaaggtcacagcagcagtcagaagagccatcggttcactgggaaaggtttctaccattgaggtctctgaaggtactgctggtggaaaatgatgattcaactagacaagtcgttggtgcactacttcgaaattgtggttacgaagttacagctgcagccaacggtctacaggcatggaaaatcttggaagatctgaccaatcgcatagaccttgttttgactgaggttgtaatgccttgtgtaaccggcattggacttctatgcaagattatgagtcacaaaacctggaaaaacgttcctgtgattatgatgtcatctcatgattccatgaatatagtcttccaatgtttatcgaagggtgcagttgatttcttagtgaagcctataagaaagaatgagctcaaaaatctctggcagcatgtttggagaaaatgccacagctctagtggtagcggaagtgaaagtggtataaggactcaaaagtctaccaagtcaaaaagttgtgaggactctgacaacaacacgggcagcaatgatgaggatgatagtgagagcatcggtgttagggatggaagtgacaatggaagtggcactcagagctcttggacgaaaagggcagtggaaattgacagtcctcggaaagcgtcctcttgggagcagttggctgatcctccagatagcacctgtgcacaagttatccacgcaaggcctgatacgcgcagcagtaactgggtgcctatgactgcaatgaggaatgctaagggaaaatatgatgaacttgacatgatgggcaaagacttggagataggagcacctgatctgcagattgaagaaccaagtaaaaatgataaaattactgcagatcctactgccaacgaaatcgctgagattgagtaccaaaaaaatgatgagcaattgggggataaacagttggagctcaacagtgagaaactaaatgccaaagcaggtgctgtcactagtagtagcaaccctccaatggaaagagtcaattttgatatcgccaatggctcatccaaaatgtctgacatgaaagataaggctgcatatgatatcaaggagatgccgtctcttgagctcagtttgaagaggatgaaagatgatgttgagagcaaatcccatgacaaaaaaattctgagacattctgacctctcagctttctcaaggtacaactcttctactcccaatcaaactccaaccggaaatgtcagtagctgttccccagctgacaatagctcagaggtagacaaaacagagtatgtgcagaatttccagtccaattcgagcagccctcagctgaatcaaggttccaatggaagcagtaactataatgatgtgggttcgaccactaacaatgctttcatgaagctagaaaatgtcactgacaaaccaccttctaagtctattttaaaatatctccatcaatcttctgctttccaaccagtgcaacatggtggtgcatgtcctcagcctacagtacagggtaaagtagacccagcaatggctcacgtgattatgacacaagctaggggtgtgaagcatcgtgttcaagtgcagcaccaccaccaccattaccatctccaccaccaccaccatgcgcagaatgtaactcaaatgcaggaaccagctgaggatcatgacaatgcttcaaaaagcacagcagctgctgctccacagtgtgggtcatccaacatcttgagtacaccatatgaaggcattgttaccaataacagctgcaatgggagtgcctctggcagtaatcatgcaagcaatgggcagaacggggggaacttccccacaaatgatcaagaaacaaacgtggatggagacaatacgataccatgtgaaagtggagccaatggtgggattggatatacgaacaggaatggagttgaacaaagtcggaatgcccaaagagaagctgctctgaacaaatttcggcaaaaaagaaaagaaaggtgttttgagaaaaaggttcgataccacagcaggaagaaactggcagaacagagaccgcgtgttcgtggacaatttgtgcggcaggctgtcaatgagatcaaagatgaggaggcagattcctgacctattatcctgatgaagatataggatttcgtggtcgatctgatctgctcattgctcacaacatttattatgtgaattgaagacattcagaagacactgcgttactatatttatattgtggactcatgttgctactggtatgctactaggagatggtatgctggggccctaatctaggtcacctctaaagacattgtgtgctgtttgtttctgtaagacattctgcacaaataaatgctagaagtctgatcttcaaaaaaaaaa

SEQ ID NO: 1719 - DNA, 1185 bp, Eucalyptus sp.
ctgttgcttcaagcccagacagttgtaacgggattcgaattagagaaccctccatcaaggacgacgttgggtgaggaattttgaacacaccacgccctccataccctccaagctgagactcgcacaatccgtatacagattggcgttacagaaggaggcgaagaagaaggaggagcaaaaatggggtcttgtgggaggagtgggacagtaaggcagtacgtaaggtcgaaggtcccacggctgagatggactccggagctccaccagtgcttcgtccacgccatccaacgtctcggcggccaagacaaggcgacgccgaagctagtgcttcagctgatggacgtgagagggcttaccatctctcatgtcaagagccatctccagatgtacagaagcatgaggagcgacctaggcagatcagataggggctgcggccaacaaaagagacgggcggccgaagacgacgatcccgatcgtgacggcgggtgcgtggaggaggtgaatgacgacgaaggccctcctcatgcattcgcaaaacccgttcatcattctagattcgcatgcagttctcctccttgtaaacgatcgaggacagagaaggtggcgacgacgacgacgacgacttcagcagttgcagaacaggcgccgtacggcttcgaggtagggggcgtggatggtttcagatggcacactccatgcatgccccgagatctccacagcttcaacgatcctctcgagtgcgccgcgaaagaagaatctaaattccctttgattgcgaagcttcaagatcggatgcagatgcctcgaaaagggttaaagctcacagactggagaagcttccccttggaggagtacgaggtatcccaaggttgtgaactgtctctctcgctttcgctgcaatgtcactccattcacagaagcaatggttcctcgaccagcgagatcagcgaggccttctcgtcgtgctcgaggtccagggagtgctcgggcccatgctcggacaaaagcagcgtaaatctggatctgtccatcgctctttgtggctcctagattaaagtttcctgtgaaaatggtgtggtacaacgttttgtattcttttttgttggttttgatcagatcatccccttttatataattcatggtagtcggtagtaccacttcggctatatatatataaaaaaaaaa

SEQ ID NO: 1720 - DNA, 1353 bp, Eucalyptus sp.
acgggagtggtcctgatctgccagaacagcaaattctaacagaccctccttggagtttcaacctccttttattgttgtgcgattaactcatcagtaagacttctatatggagctaacatcagatgttgaagacacccaacagcaacagcagctaccggaaggaggaggaggagataagaagcaagaagaagaagtagggcagcatttccacgtgctagcagtggacgacagccatgtggagaggaagctcttggagaggctcctcaaggactcatcctacgaagtgacatgtgtggattctggggacaaggcgctgaggtatctgggcttgcttgatgatcacaccaatctacatgcccaggatgggtttgataattccagtgctgctgcttctgcttcttcttctctgttgcagccatcactacaagaggggacaaaagtcaacttgatcatgacagacttctgtatgcccgggatgagcggctatgatttgctgagacgagtcaagggatcttactggaaagatgtgccggttgtggtcatgtcatcagagaatgtgccttcaagaatcaacatgtgagttgctttctgctgcgaaaaagcaaaagtcgcaccgctttatacctcttttaaccttaggtcaattaaaagaatgcttctttagcatagtcgatactttacagttatgtcaaatatcttgccgatcacaggtgcttggaaggaggagccgatgagttcctgttgaaaccagtccagctgtcagatctagagaagcttcagccatacattctgaagtctctcaataacccttgtgaagacatcaaaggtgacggcatagacgacagtgaagatgatgagatcgagacgagaaattacggagaggacaacaccaataagtgcaactctaataccaataatgttgccaagaggaaggcaatgtctgctgagccaaccgatagaagacccaaaatcaaaggattggcagtggtatataataagaatcaagaactaatcggctgatcgaaagtgcgccatgtgtcctcgccgagatgtttgccagttgggaactccactagactaatagcatcacatgtccttacttgtccattacatatgttccttttattggttactgtgttcttgagaggaaagaaaaggaaggaaaagttcagttttaaaagtctccgcaatggaaagcctgatgtttctgatcagaaagagattattattttgttgttttccctactattttcattttgttgtttagattttaccaattggtaattaactcccatgtgtagactctacttaaggacatcgtttttgtttaccttagtgaaaaaaaaaaaaaaa

SEQ ID NO: 1721 - DNA, 2953 bp, Eucalyptus sp.
gctgggtgctgtaacttttctctccagcctcgtcctctctctcccccgccataaaaaaaaattccagtttcgcttcgcttcccttccgcgaagattcgcggcggcgcttattaaacatccttccccaccgacttcgcctcgccacgcctcgcctcgcctcctcgccctccgcccgtccctcagggcttagaatcgtaggaactctccgaagaagaccgtgttcgatcggggatttccaggtctgtgacccgagttggaatcgttttccttgagctcgtgcgggccgagaaatgtttatggatcctcagtacgcgggatattccgggccgttcagcggcttcaatttccacgaccagactctcgcgcccttctcgaatccatacgaggagctggcgaaccacttgctgctggacgatcccgaatcggacctttcggttcacttcccttccttcgcttccgatcccgaaccctgcaactccgctgtatctcctagttttagcgtggatggggatttcctttccgactatggcgacacctcggatcccacgttgaaatacataaatcagatgctcatggaggaggacatagatgacaaaccctgtatgtttcatgatcctttagctctccaagctgcagagaaatccttatacgatgctctctgtccgaaggaccgtccctcacaaaaccagtcgcctctctacatggacagccctgatgacaattgctcgggtagcagcaacggctactgcggcagtagtactatcacttcgagcactgctagcggtggcaattctgtcgactttccagggactggtgattattgtgagagccgaccctctatatttcagcctcacatcccagagaactttgtgttccaggcgactgcaattcccagtcgccaatcagggcatgaatttcggaaaaatgtcattaccaaagctaaggggatgttgggctcaggctctgcaatgggtgagtttatgcttccgaacctttttgcggatagcaattccatgttgttcttccagaaggggtttgaggaagctagtagatttattccgaagggtaatccattgtcgattgatacagagaagaggatgccccatctggtgtcgaagagggagactgcaagggcagcagtcaaggcggagaacagtgagcctgaactctcgtatttatatgaaatcaagggaaataagaagcatgagcgtgaggacgcggaatttgaatatcagaggagcacaaagcagccagcagtttgcgtggaggagaatgagttagctgacattttcgatagggttctactttgtgctccgacgggaaataagcctgattctaaatctcctggttctagatttgaggatgcctcaaataatggggcaagccagaatgtacagaaaaatctgcaatcacctgcactttcagccgaacagctctgtgtcaaaaaaccaatgagtgataagaaggaagtcgtggatctgaggaaccttctgtgttcttgtgcacaagcagttgccgtggaggatcgtaaaaatgctaatcaatatctgaagcagattaggcagcactcctccccttttggtgatgggtctcagaggttggcccactcttttgccgaagcccttaaggcacgcatggattgcacaggagcgcaagtctatacggagttaggctccaaaaggaaatctgctactgaaatgttgaaagcttaccgagcttatctctcagttttcccatttcagaggtttgcgatcatctattctaaccatatgattttaagcatatctgagaaagcgacgaaactgcatattatcgattttggtatcctttatggttttcaatggcccgccctcattcattgcctcgcaaggagacctggtggccccccaaagttgcgcatcacggggatcgagctgccccaaagtggtttccgtccagcagaaagagttcaagagactggtcggcgccttgcaaagtactgtgagcgtttcaaggttccatttgagtacaatgctatcgcgcagaagtgggaaaccattaggattgaggacctcaagatttctaaagacgaggtggttgccgtgaattgcctctttcgattcaagaatttacttgatgagactgttataattaatagcccgagggatcaggtactaaagctagtacatcgaatcaggccaagaatttttgtccactcgatccttaatggatccttcaatgcctgtttttttgtgtcgaggtttcgggaggttcttttccactactcggccttgtttgatgcatttgatgctaaattacctcgtgaacatccaatgaggctggtatttgaacgagagtttttcagccgcgaagctctgaatgtcatcgcatgtgagggcacggagagagttgagaggcctgagacatataagcagtggcaaatccgcaacacgagggcgggttttaagcccctccccctggatcccgtaattatgaagaagctgaagtcgaaattgaaagaggggtaccttgatgatttcgtggttgacaaagatggtcaatggatgctccaaggatggaaaggtcggattctttatgcttcctcctgttgggaacctgtgtagaatttctccaagtctttatatgcttgtccttttggtgtgagccggggatagtttatgacgaccaaggaggaagctgttggctgattcgtggcaagtaaggcatctttctagctttcggaaataggtgtcatatcaccttgctttcactttacgattgtatgctgctgtaggcttctctctttttggctggtgatctttctgtttagactgatatctaggaaatgcttgccctcccttggctgtgcatactgtataggatagctactatttatctgtggtactgtctagacagtattcctggaccttaataaatttgagcactgatgtagtttttctggttaaaaaaaaaa

SEQ ID NO: 1722 - DNA, 2383 bp, Eucalyptus sp.
agagagagagcattaggagacaggcggtagagagagagagagagaagcagaatgtcgtctggcttctccggcgggagcggcggcgggggcccggagttctacaccgccgccggtgggatgagcgccagatctatcgccagcgccatgagctccgtcaacggcaacgccgcctcgcagtcccccttccgatcgcagccgcagttcggcgccggaatcttcctggagcctaactcccagatggcgccgcagccggcgcagccgcagccgggcctcgtcggcaagcggacgcttatggagtttcaggcgcagcagcagcagcagcagcatcagcatcagcatcagcataaccaggctctgagcaacctcatcttgcggtccgtgaggtcgaaaatctctccgcggtcctcgccgatttcgcacctggacttctccgctgccgtttcttcccccgacgtaatgtctagcttatcggcgctgtcttcgccggcgggcttctccgcgcaaaggtacggccttcctatccttcaacagctcaggccacagcccatacatctcggtaacggcgcgatccacgtgagcaatcaggctctggggggagtttcgttcgcgaacgtgctccaaaacagagcgaatcctcaccaagcggagccggagaacaagatgatgaatcgtctgcaggagctcgaaaagcagctcttggatgacgacgaggagggcgacggggacgccgtctccgtgattactaacgctaacagcgagtggtccgagacaattcagagtctcataagtcccggtcagaagcagatatctccgtcgccgacctcgtcttcttcgtcgtcctcgccttcgtcttcattgtccgtgccgtcgccggtacccatctgctcgaggcagtcgctaatggaggccgcgacggcgatatacgagggcagggtggacgttgcttcggagatcctgacgcgcttgtctgccgtgccgaaccccaaaggtaattcagagccgaaactgatggaatacatgttgtccgcgcttaaatcgcgcgtgagccctgccgataacccccctcccgtggcggagttgttcaccaaggaccatgtgtcgtcgactcagtcgctttacgagctgtctccttgcttcaagctcggtttcatggctgccaatctcatgattttagaagctgcatcggagcaaccctccaccaacaagctccatgtaattgatttcgatgttggtcaggaaggacagtacatcaatctcctccacgcgctgtccacgcgtcagccgggcattccatccatcctcaagatcacgacgctcgccgatggcttcaacggggaggagaggctcaggatggttagggatcggctgagcgaactcgcggcccagataggagttaggttagtattcaacatcgtgagccagaaggtgagcgagctgagccgcgactcgctggggtgcgagcctgacgaggtgctggcggtgaacctggcgttcaagctgtaccgaatgccggacgagagcgtgtccatggagaacccgcgcgacgagctcctccggcgcgtgaagggcctggcgccgcgggtggtgacgctggtggagcaggagatgaacgggaacacggcgcccttcgcgacgcgcgcgggggaggcgctggggtactacggggccctgctcgagtcgctcgagtccacggtgccgcgggacagctcggatcgggggagggcggaggaggggctgagtcggaaattggggaactcggttgcttgcgaaggtagggaccgggtcgaaagatgcgaggtgttcgggaagtggagggcccgcatggggatggctgggttcgagctgaagccactgggtcaacacgtggccgaatcaatgaaggcgaggctcgaaagtgggaaccgggtcaacccgggattcacggtgaaagaagagaatggtggggtttgcttcggctggctcggccgaacactcaccgtcgcatccgcctggcgttaagctccactcgctccccctctctcccccctgtgcacccactttcccgaaaaagtattaaccaaattgatatacgtatgttgtatgttatgttgctatggatggtgatggtgatggcgaaggtgatggatgatgatcatgacgaagacgacgacgacgacgaccacgacgtgatatcttataatgtattgttttcaagatgtttttttttttttcttttcttttcctgagaaaaatgggaaaaagaagaagagaatcccattcccccacccaagcaattgagtaataaaagaaagatgtttggatttgaggaaaaaaaaaaaggaattcccgtgcattgcattcacttcttgcgttattcgttttggttgtgtattgaaaaaaaaaa

SEQ ID NO: 1723 - DNA, 2308 bp, Eucalyptus sp.
attctcgttcgtggcaggacaaattccaagtcgcatcgcgtgaaaaacacagggacggaagagcaatcccagtcggacttcgctacggaggagtaggaagggggggggggtcagagttcctccatttttgactccagaggcgtcgtgtgcaccgagggggttatatttattcatcttgagccactgttaaaactctactagctattggaaagcccaggggatgcatgtcctattgcaatctattacgggctaattgagagttttctgataagaaagcttatggtactgctaaagcatggaatcacacccactatacagatacagtgagacaggtgctggcttatctttcacatcttctcatccaactgttccatctcttcccaacaggttatttgggcattcgaagtttgaaatcagggaatctcctatctcacccttttcgacaaactttgattgcgagacactcaccgtgttaagtgataatcaggagcagtacagttctacagacaattattcaggagttagctcttcttacaactcttcacttgagaccaccagtggtttccaaaggtcaagcccgtcacaagacgggtgtagagacagcttactttcatgttctggcaggcccacctcactgcaaaatgagcatcattcacagaacacagcttatactttacaggagctagaggacgtcttaatggatgatggacaagaagtgcgtgtcacagatacttctattggggaacatgtatgggatcaaaatccccgtggttcacaatttagttgtcctgaggattctgttgctttcattcagagccaatcaggtaaaagcgttcatgcagagaaacataaagaagccattgaagaattgttggttcaagatgttcctccaggtgatttgaagcagctgctgattgcctgcgcgaaatctctttctgataacgatatgcacaaatttgagaagttgattgaaaaagccaggagggctgtatccatcagtggagaacctatacagcgtcttggtgcctacatgatagaaggacttgtggccaggaaagaggaatcgggttctaacatctaccatacccttcgatgcagagagcctgaaggcaaagacttgctttcctacatgcacattctgtatgagatctgcccctacttgaagtttgggtacatggcggcgaatggagccattgccgaagcatgcaaaaatgaggatcggatacacatcatagacttccaaattgctcagggcacccagtggaccactctccttcaagcgcttgctgcaagacctagcgggcccccttatgtgcggattacagggattgatgacccggtcaacaggtacgctcgtggggccggattggaagcagttgcaggaaggttggcggtgatctctgagaaatttaagatcccggtggagttcaacggtttgccggagtttgccccagatgttactcgtgacatgcttgatgtcaggccgggggaagctctcgcagtgaacttcccactccagctacaccacacgccagacgagagtgttgacatcaccaatccaagggatgggctactaaggatggtgaaatcgctttctccgaaagtgatcacattgatcgagcaggagtcgaacacgaacactacaccgttcctgacaaggtttgtggagaccctcgactactacttggcaatgtttgagtccattgacgtgaccctgcccagagacaggaaggagaggataaacgtggagcagcactgtttggcaagggacattgtgaacatcatcgcatgtgaggggaaggaaagggtggagcggcatgagctgtttggtaagtggaagtctagattgacgatggcagggtttaggcaataccctctaagtagttatgttaattcagtcataaggaacctgctgaggtactactccgagaattatacgttggtagagaaggatggtgggatgcttctgggctggaaagacagattcctggtttctgcttctgcatggtactgagaatgggccagagtttgaatattcatggagaaaaactggaaaactgaacatctttcggtagtaataggagttattggatttacatagtatggagtcgcagatcgtcctcaccatgtgatccaatagattgccctggcgtattcatgttctaacttccagatggctattgtatcttttctgtttgttcattctttagtttagctacctgttgttcatgtgtgatctttggatccactttacttcacagtatacatcgttgtataaatgagtttcattaattctataaaaaaaaaa

SEQ ID NO: 1724 - DNA, 2057 bp, Eucalyptus sp.
aacggctggccggtcatcgtcgaacaggtgtttctccaggcgactgctgcgagttcttcttcagctaaagatagtgttggatctataagtgattggtcttgtggtctcagctaaatcattaatcatcgtgttgcatggagaacttagtgggggtattgttcttgtagaatcactggggtcatttcgcattagtcattttcgattcagtgattcgtccctgtctgcggaacacaactcttagatcgggcaagtttccatcagtattatctccagatgccaagttttcagaagcagcatagttcggcgagtgtcctcagtttttatcagcagcctccgcagatgatcgaaccgcgttatttgtccaactacgagcaaatagacggcggcatgaacaggggtttggctggccaaggattcgactcatcctttcagaactacgacgaacaaattttcaccctcgattcttccacatcagcgtccggccttgcttcctatgattctggttccaatatcagcacctcacctgatgggactccctttgtgaagtcctttcactcagatcaacatctttctgttgaaaatgtctccggatcgccactaagtgtttcttccattactgactatggcaatgatgagcttcgagacaaattgagggagttggagatgtcattgttgggaccggaatcagatatccgcgattaccagagcagctgctttaagaacagctcccacaatatttttcccacatcaatgtggcattcgagccgagtgagagatatgatgcccaaacctgacctgaaacaagtggtaatcgcctgtgcaagggcaatctctgatgccgatacttctagtgcagcagctctaatggatatgctggagcaaatggtgtcggttatgggcgacccaattcagcgtcttggtgcttacctcttggaagggcttagggcgaaattgaaattttccgggagcataatttaccgaaagctcaagtgcgaagaacctacgagctcagaattgctgactaacatgcaggttctctatcagatctgcccctactggaagtttgcatatgtgtccacaaatgtcatcatcaccaaagccatggaaaacgaacagagaattcacattgtcgatttccagattacacagggcagccagtgggtcactttcatccaggccctcgcacagaggcctggtggcccccccctcctccgcatcactggcatcgacgattctgattcagttcatgctcgtggggcgggactggagattgtagggcagaagctttcggaaatcgcagagtcatgtaacgtgccgttcgagttccatgatgcagccgtttctttatctgaggttgagctacagaatcttatgattcggcctggggacgctttggcagtgaactgtccttacatattgcatcacatacccgatgagagtgtgagcactcagaatcaccgagaccgggtgttgagactgatcaagagtttgtcgccgagagtggtgaccctcgtggagcaagaatccaacaccaacacatcctcattctttccgaggttcatcgagaccttcgactattacaaggccatgttcgagtccatcgacgtcgctcggccgaggaacgacaagcagcggatcagtgcagagcagaactgtgtggcccgggacattgtgaacatggtagcctgtgatgggcctgagaggatggaaaggcacgagcttttcggcaaatggcggtccagattccaaatggccggtttcaatcagctaccagtggacgcatcggttactcgtgctgtgctcgatatgctgaagcagtatcacgggaattacagaatcgaggagagggagggggctctatatcttggctggattaatagagccatgtcgactttatcggtctggaggtgaatcttgacatcctgtgctagctgctggctttgtaaattttgctgtcaacactgtagttgctcccgcctatatatggaggaatgttatctatatatagtttgatcgagtgctcacaattcatagtgcaccagtacacaaaaaaaaaa

SEQ ID NO: 1725 - DNA, 2890 bp, Eucalyptus sp.
ggcccgtaggaccgcgctcgttgtttctgagtcctgacgtcccgaagactgagacgccaggttgagttgaggtggtgagcttctgaaagattttgagacagtgataactatggagtccaactttactggatttactcatgctgcggatgacttcgagaccaatagcctcgctcacccagcaaattcagatcatccctcgaatctcttggatggattcgacataaataatctttacgttgatttcaactccacagaaattacctctctcctttaccaaactgaacctgcttatgacaacccatctgctgcagttaaccttgatggagactttgattttccatccacggatgtgagttccaaggatgcctcgctgcaacattctacgatctccaatggaagcccaagtcaagggggggaatctttctcccctccctctgattacagcaactcgacagatccagttctccggtacatacatcagatgcttgaggaggagaatgtggaagagcaaccctggataagtcctgatgattttgctctacaagatacagagaaatccttgtatgacttgctcagtgagaattctactttttctcctgaaccggctgtacaattcgacatcaatcagttcattgacagcccaagcagcaactcttatgaaaatagcagcgatcaaggtggtgatggcactactgacaccagaaccaactgtagccagttttctggtcctaattcaccagataatcctgaaggaaaaaaccaggctgtccttcagggcccatatcctggtaatggggtcttgccgtcgaatatgggtaccagttcccagctgcataccaatccgatgagcagcttgcagcatcaagatgagttcagtgattccttcccaagcgatctcctggttagcaatatgttcagcaacagtaattctattctgcagtttaataaaggtttggaggaggccaggaaattcctgcccagtagcatccaattaacgatcaatcaggaggattacaagtcggctccaaatgtcagagagcctggagagaatggcactgatgatgggaagagtgtgaagagtcgctcagagagtgggtcatgggggagaaagaatcacgagagagatgatgagagtttcgaagaagggcgagccaataagcaatcggcatcatatacagaagatggtgagctttctgaaatgcttgataaggtattgctcggctgcggtttagggggtcaaatgtcggggtgcacacccgagaacatgagccaatccaagggcccacctggtccaaagggtggcagggttcgccgtaagaagggaaataagagcacagcagacttgaggagtcttctgattctctgcgcccaagctgtctctgctaatgacttcaggacagcttatgaactgctaaagcaaattagacaagattcttctgcctctggtgatggctctcaaagattggcgcattactttgccaatgggctggaagcacgccttgcaggcagtgccggtgatagacaaacctttttctattcttccgaattgcagaagaggacagtagctgataagttgaaggcataccagcttcatctttcggcctgtccatttaagaaattgcccatcctcttcgcaaatgtcgttcttctcaagattgcagctacagcgaaggtgcttcatattatagactttggaatctcttttggttttcaatggccaatccttatccaggagctctcaaaaagagatggtggacctcctgagctgcgaattactggaattgagattccacaatctggctttcgtcctgccgagagaatcgaggagacaggtcgtcgtttggctaagtattgcgagcgctttaaggttcccttcgagttccatgcgataccatcaaggaactgggagtgtatcagagttgaggatctcaagatccaaagtggcgagatcgttgcagtgaattgtctctctcgatttaagaatctttatgatgagacggttgaggtggattgtccacgagatgctgtcttgaggctaatcaggagtataaaaccagacgtctttgttcatggcataagtaacggatcctataatgcgccctttttcttgactagattccgtgaggctctttttcatctgtctgcaatatatgatatgttagatgctactgtacccagtgacaatgaccaaagggtagtcgtggagagagagttctatggacgggaaattatgaacgtcgtggcatgtgaaggcttggagaggattgagaggcctgagacatataagcaatggcaagttcgcgttgccagggctggtttcacacagcttcctctagatcaggaggtcatggagatggctagaactaagatgagcagacactaccccaaggattttgtgcttgctgaagaaagcaagtggatgctgcttggttggaggggccggataattagtgcttgcacttgttgggtgcccatatagattactcccaaggcatgttttctaacttgacgactggcaattggtgagattcttgctgaactgccgggccaggagcacatgtgagagagaggctgagatcacttgaaggagcaaatacactgatgtgaaatgggctgcaaactgttgcaacaaaagaagaatatcacaagagatgaatcttaagtgattgctattttgggaggaactatgacagataaaactgttgttacaaggatctcaatcgagggattgggagcatttgtgcaattttatttctggcagtggtggtcaaaaggatttggttatctatgtagtgcagtgccaactttatacgttttcttgtttgttggtgtttgtaagttttgggcagtataattgacttatatctgctgttccagtacaaaaaaaaaa

SEQ ID NO: 1726 - DNA, 2760 bp, Eucalyptus sp.
ggaatctgaaatcgaactggctgttctctcacctgagatttacagccctctactttctcaagatcaaacttggtcggttcaaggaaaaggtcaaaatcttgcacaattccccccagttcctcgggagagagttcagaaagggaagtatttaatctcgttctgtttcaatttgaagcaaaattagcttgtactgtgtcctcaaactgcattctctgtttcattttgctgaattgcatgcaagcttggaactttagctccaagaaaaggcttcaagaattttacccagttgggcgctgggttgagtcacgatttgggaaaatcgatatatagagcgagttgaggaattctggtacaagttctctatatatttctttgagctgttgatgttctgaagcacttctgagtttagcatattatatagaaatggatcgaccaccagacaaactcgataatttcattgatgggtatgtactcgttgatggtgatgatgcggccttttcgattttacgggaggacgatcttgttagtgagctcacgatcgacgacacgttcaatgactttacctatagctgcacatgcgcgcctcatttgggtgctgaccttgggaaggaaccggctgaggactatgatttcagtgatgcagctctcaagtacattaaccagatgcttatggaggaagacatagaagagaagagcgttgcatgtcatgaagcctcggcaattgaggcagccgagaaatcattctacgaggtcattggggagaggtacccgccagctgcagatcagcatccatcacctaatcaaaccaatgagagctcatgtggtggtagcgatagtgtgattaaattggttgagtcagagccgaactatgaatcagaagaacatactgtcctcaccacggtgtctcaatccatctcatcttcagttgcccagtcattagatgatgtccgcgttggtatcagtactgctggacatgctgaatctccagtgaatgccatttctttgtctgaacttatcggaagtgagtctgttatgcagttcaagggcaacagtgaagaaacgagagagtcgctcgcttttggaaatgaaattctagttgatcctgagaggggtgaattttcctttaatgaacaaaccgaagagcctacgagtttggttccaaatgaagagacggatgagaacatgtttgccaaccttggaggaaacaggggaaagaaaaatcctttgcaggaggatgtgaacttagaagtaggaaggatgagcaagtatttatcagtttacactgaatcaactgtgaggtcagagatattcgatatggtgttgcttaatcctaaagaaagtgaagctacccttcgtgaagctcttcggaacatgatgcagaatggcaaatcgaaagtgccaaatgaggggaaggcccacggcaagaagcaaggcaggcgcaagagggatgtggtcgacttgagaactcttttgacactttgtgcacaagctgttactatggatgatcgaggaagcgcaggtgagctgctcaagcagatcagaaggcatgcgtctcccacaggggacgggatgcaaaggatggcacactattttgcgaatggtctgcaggcacgccttgccgggtcaggctctcaaatttttaaggctctcatggctaggccaagatcggctgttgatgtcttgaaggcttatcatctcctcctcacaatttgtccatttatgaagctctcacattacttctcgaacaagacaatattgaacgtggccagggaggcacccaagttgcacatcattgattttggaattctttatggtttccagtggcctggccttatagagcgtctctcatcaagccccagtggaccacctgagcttcggattactttgattgatctgccgcaacccggatttaaaccagatgaaatcgttgaggaaactggcagacgcttggtgagctacgccaaaactttcaatgtcccgttcaagtttaatactatagtgaaaggttgggatgccattaaagttgaggagctaaatatccacagtgatgagatccttgttgtgaactgcatacatagattccataacatacttgatgacacggtgctggcggagagtccacgagatgttgtactgaatctgataaaaaagatgaatcccgatgttttcattcaggcagtcgtaaatggtaaccatggtgtcccctttttcgtttcgcggtttcgggaggcactcttccatttttcagctgtctttgacattcttgaggcaaccgtacctcgtgacgacccagagaggttgttgctcgagcaagagatactcgggaagcaggcaatgaatgtcattgcttgtgaaggctcggataggattgagaggcccgagacatacaaatcatcgcacgtgcgaaacctgagggctgggtttaggcagctacccttggataaggatgtggtgagcttggcaaaggacaaactgaaatcttgctaccataaggattttgagattgaagaagatgggcagtggttattgcagggctggaaaggcaggattatctatgcgctatcgacctggaggcctgattgttgaatgtataaattgccagtcgaaagtagatcaggaatgatttttcacttccttcttctctgtttgtgcccttactgtttctatcatagtgtcaggaagcatttccagatatgaatggtaaggttcgcaatcggtggttttgaaattgaatatcttagcttccctgcaaaaaaaaaa

SEQ ID NO: 1727 - DNA, 2314 bp, Eucalyptus sp.
gacactccattaacgctcgaaggtctcccccacatgatatcaaaagcaccaaaagtcttcggctcctccgtgcggagcttcctgtaaatggccattgattttgcatataaagtttgtccctgcaaagtaattccagatatgtggccaacgcctgctttgcaagctctgtattcgatacctttcttattcgtgacaagtaattgatgattaccaaatggccacccattgataaactcataggatggaattgcaccagctatttggatgtggtctgactgatgctggcttatggtgctcatcctctcaccctgcggttacatcaatatctaacaggtcattaaagtccttgaaatttgatattggaagttctccctgtttgcccttctcaagtcaagttgaaagtgaggccttacctccacctagagacattcgagagcagcagagctccgcagaaaatctttctataagtggcgcttctcgtaaccacacccttgaaaccaacagcagtctcgtttgttcaaaatccgacttttgcgttgaccctctttcagaccgccttacgtcatgctctgatttgacgtctttgtcggggagtttgaatagtagcccacggatgaaatttgccgcaaaggaattagaggccactttcaatgatgtagtaacatcgccatatgtttcttattggaagggtagtattccacttgtgcagggtcaaaaacctaacaggcggagccaagagtgctataggttgcggtctattcagcctcaagcatctgttgcttcaagacacagccaattcaacgaattggagaaatggcacaaagcaattgatgaattgttggtacgcagtcctccagaagacaagacaaggcacttgctgatcgagtgtgcaaaagccttgtcagagaacgatacagaaaaatttgataagttgatcaagaaggcttggaatgcagcatcaatacatggagggcaagtttggcatctaggcagttacctggtagaagggctcatggcgaggaggaaatctctaggaactacggttttccatgtccctaaatgtgaagagccacaaagcaaagactggctcacctacatgcatgtcttgtatgaaatctgcccttatttgaagtttggttacatggcagctaatggagctattgcagatgcttgcagagacgcggaccgcatccacataatagactttcaaattgctcagggaactcaatgggtcactctgcttcaggctcttgcggcgaggcctggtggggctccacgtgtacggatcacagggattgatgaccctgtattgagatatacccgtcgggttggatcggaggaagtcgggaggatgttggcagtagtatctgagcaattcaagattcctgtggagttcaggggactaagtgtttcttccccggatgtcactagagacatgctcgacataaggccaggggaggctctggccgtgaacttcccgctgcagctttaccgtaccccagacgagagcgtcgacacgaacaacccaagggacgggcttttgaggatggtgaagtccctttcgcccaaagtgatcactttaatagagcaagaatcaaatacaaacacgagcccattcctctccaggttcgttgagactctagattactactcggcgatgttcgagtccatagacatggcactgccaagggatggaaatgatcagatcgacccggtgcggcattgcctgaagagggatatcatcaacatcatcgcgtgcgagggaaaggaaagagtggggcgccacgaactgttcggcaagtggaggtcgaggctgcagatggccgggtttagtcaatacccgctgaacgctcacgtgaactccgtgattgggaccttgttgaggcgttactcggagaattttacagcggaagagaaggaaggagccatgttgctgggttggaagcagaggagcttgatatcagtttctgcttggcactgatgaaactagttcgattcctgtatctagaccttttgaatcgactaatctttaataattgttctgagcgagagatgctgagatcggaatatgggtttgccgtattcaagatgaacgcttgaacagttaacttgatagttattggagtccagcggatggacatggattggcgtcatgccctgtcgctgctctatgactgcgtgtggtcctagtcctagaaacttagggaaatgtgcacagccacgctttgtgggaagtgcctgttactttaaaggctagtggtgtttagttacttttctacgggattgaaggctttgtatatctttaaaaaaaaaa

SEQ ID NO: 1728 - DNA, 2002 bp, Eucalyptus sp.
cacgtcagaagtttctgttgaatgaaaaaagaaatccggtggtttcagctgggaattgcagacctttgattgttgatgtgatcttgtgggcttgtttcttcgctcagaacggctaggaaagatttgaagaagacaaaaacagtgacatcttagaaatttggttgacattaatcctcaggatcggtttcaaccgcagagatacgtgtattgaagggacaaacgcatgtctttaattaggtccaccgagttatccgccactccttatgcaagttcggaaatgttaggctccaaaaagcaccagatgatgtatgtttccgaaacctacagcggagaggattatgaccctaagtatttcattgactctccatccgaagaaacgattaacccatctagctatggtatgtcaagaaatttatatcatacccagggatcctccattaacactgaaaacccattcagcacttcggaatcagaactcatggatggtcaaagtctggattgtgtagaatacactgaagacaaaatgaggttgaagcttcaagagcttgaaagagcactgctggatgatggtgctgatgaagaggaggataatatgtatgttgatggtcaatgggttgaccaactccagatcaattcacatgactcccccaaagaatcctcctcatctgattccaacctcagcagcattagcaccaacagagaagtgtcacagccgccatcacgcaccccgaaacagttgcttttggattgtgctactgcgatttctgaaggaaacattagagaagcatccattatcattgatagggtgcgacagattgtttccatacaaggggacccgcctcagagaattgcagcctacatggtcgaagggcttgctgctcgaatgggtgcttctggaaaatttctttacaaagccttaaaatgcaaagagcccccatcttctgaccggcttgcagctatgcaaattttgtttgaagtttgtccctgtttcagattcgggtttatggcggcaaatggagccattatagaagcttttaggggtgaaaagagggttcatatagttgactttgacataagccaagggagtcaatacatcactctcttacagacacttgcatctctacccggccaacggccttacctgaggttgacgggggtggacgatccggagtcggtccagcgccctattgggggtttgaaaaatattggccaaaggcttgaaaaattggcagaagcactcaacataccatttgagttccgagcggtagcttcaaggacgcctcttgtcaccccaggcatgctagacctacaacccagagaagcactagttgttaactttgcttttcagctccaccacatgcctgatgagagtgtttccatgatcaacgagcgggaccagcttctccgcatggttaagagcttaaatccaaagctcgtaactgttgttgagcaaaatgtgaacacaaacactgctcccttcttagtgaggtttggggaggcctatagttactactctgcagtctttgattctcttgatgccactttgcctagggagagccaggacagggtaaatgtggaacgacagtgtttagcacgtgatattattaacgtcgtggcatgcgagggtgaggagaggatagagagatatgaagttgcagggaagtggagagcgagaatgatgatggccggatttgcttcatgtccgatgagcaaaagcgtcacggaatctatcatcaacctcattaggcagtattctgagagatataagataaaagatgatatgggtgcgcttcattttggatgggaagagaagagcttgatcgttgcttcagcatggaggtgaaataatctttgttcatctaactaatgatagattaggagcccaggtggctggctgataaatatttgtgcttacgtgtaatgtaactttcttcgatttgggatcagatgcacccgatacatgaatttatttgattagatctgtcttgtaataaaaaaaaaa

SEQ ID NO: 1729 - DNA, 2887 bp, Eucalyptus sp.
cgcgaaacgtcaaaaggatgaggaattcaggggcggctcacgagcaagctgttcccgagtgctgctgaagtctctcgtctgtcggaggagaccaaattccaactctccctctctttccgacctccggaaatcggctcggcagtcctttttgtctttcggcgccgagggggttaggactgggcagtttttcttgacgatttctgagtaggaaaaagcagtgtgggtaccggcagatgattatggagccgcgcgtgaccagattctccggctccctgagcgccttcaagttggacgacgagaccctcttgccattttcggatcagcgcgcgaacttcgcgaatgggttcgatcgcgccggcccgtctccggatcttggcttcgcgcacaaacccttctttccttccgaccccaggtactgtgattccgctccgtcttcgctcgtgagcgcggaggcggacttaccgtccgacgatagcgacttctccgagaccgtgttcaggtacataaatcatatgcttttggaggaggacatggaggagaatccctctacgtttcatgaccctttggctctccaggcggctgagaagtcgctctatgaagctctcagcgacccgtacccgtctgaagcgaactcctcccctccattcatggacagtccggacaataattattcgggaaacagtagtgactatggtaagagcagcccttctagcaataccagcggcagcaactttgctgatcatcaatggctcggtgatttaggggacggcagaaataatctgccgcgatcttctgtcacaggagacttcatttttcagtccaccgtgaatgctcatgtacaaccatccttttcctcacgaaacagcttcctgagtaatggtaataggacgaaagcatcattagggagtggccctttgttcctcaacttctcgaccgagagccaatcagtattgcagttccagagaggtgtggaggaagctagcaaatttcttccccagggtactcagttatttattgatctggagaagagcagcgtgaactcatggtttaaagaaaggaaatcactgaatgtggttaaggtggagaaggatgaaagtgaccttttgcctctcaatgggattagcggaaagaagaaccaccagagggaggattcagaatttgaagatgagaggagtaacaagcagacagcagtgtatgttgatgacaccgagctatccgagatgatggataaattgttggtctgtcatattaaaggcaagagtcgagattcaaatgctgatgaatcctctaaaaaagaagtaagtaaatctttacagcagaatagacagacacacactgctgatggtgggaagtttcataataagaaaccaaccccaaccagcaatatgacagagatggtggatctcagaactttgttgatcctttgtgcacaagctgtctcttctgacgatcgaaggactgctaatgactatctaaggcagattcggcagcatgcttccccctctggtgacggatctcagaggttggcacattacttcgccaatggcctcgaggcacgcttagaaggcactggttctcaggtctatgctgctctaggttctaaaaaaacatcagcggttgatttattgaaagcataccatgtttatcgtacggccttcccgtttcagagagtggcaaatatgtttgtgggcgatatgatcatgcatttagctgagaaagcaacaacgcttcatattatcgactttggaatctcaaacggtttccaatggccagctttcatctctcgtctctccaggaggacaggcgggccacccaaactgcgtattacagggatagagttgccccaacgaggttttcgaccggcagaaaaagttcaggagacaggacgccacttggcacagttctgcaagcgattcaatgttccatttgagtacaatgcaattgctcagaaatgggatactatcaaaatcggggatatcaaaataaggaacggcgagaccattgttgtgaataccatgtttcggtttaaaaatctccttgatgagacggttgtcttgaataatcccagggattctgttctgaatttaatcagaaaaataaggccgcatctctttgtgcaggccattgtcaatggatcttttggtgcccccttcttcgttacacggttccgtgaggctctctttcactactctgcgttgttcgatgcatttgatactaatttagggagggataaccagatgagactgctgtatgagaaagagttctttggccgagaagctataaatgtcattgcatgtgaggggacagagagggttgagaggccggagacatataagcaatggcagattcgcaatatgagggccgggttcaagcaattgccactgggaccagcagttatgaagagattgcgatctaagttggagcagttccatgatgatttcgtggttgatgaagatggccagtggatgctgcaggggtggaagggccgaattctttttgcttcatcttggtgggtacccatctaggactttgatgagcttgtttccatgagccatccaccagatggacccgactcagtactcaacgaaggcatccttatttccagaaaaagagcgtgaatttgtggagctgctgcttgtgatctttcttctgacaatactagagcagaaaacatttacggggctttcttggaggtgaggtattgattgtggcggtccttgttgagccacaatcattgcttcggtaggatataaccagctgtacttttatagctgcttgctttttctaacagttagtggcagaatctgagttcacacaattacattagggagatgtacttcttttatagacagtattcagcagattatgagatttgataaaaaaaaaa

SEQ ID NO: 1730 - DNA, 2861 bp, Eucalyptus sp.
acgagcaagctgttcccgagtgctgctgaagtctctcgtctgtcggaggagaccaaattccaactctccctctctttccgacctccggaaatcggctcggcagtcctttttgtctttcggcgccgagggggttaggactgggcagtttttcttgacgatttctgagtaggaaaaagcagtgtgggtaccggcagatgattatggagccgcgcgtgaccagattctccggctccctgagcgccttcaagttggacgacgagaccctcttgccattttcggatcagcgcgcgaacttcgcgaatgggttcgatcgcgccggcccgtctccggatcttggcttcgcgcacaaacccttctttccttccgaccccaggtactgtgattccgctccgtcttcgctcgtgagcgcggaggcggacttaccgtccgacgatagcgacttctccgagaccgtgttcaggtacataaatcatatgcttttggaggaggacatggaggagaatccctctacgtttcatgaccctttggctctccaggcggctgagaagtcgctctatgaagctctcagcgagccgtacccgtctgaagcgaactcctcccctccattcatggacagtccggacaataattattcgggaaacagtagtgactatggtaagagcagcccttctagcaataccagcggcagcaactttgctgatcatcaatggctcggtgatttaggggacggcagaaataatctgccgcgatcttctgtcacaggagacttcatttttcagtccaccgtgaatgctcatgtacaaccatccttttcctcacgaaacagcttcctgagtaatggtaataggacgaaagcatcattagggagtggccctttgttcctcaacttctcgaccgagagccaatcagtattgcagttccagagaggtgtggaggaagctagcaaatttcttccccagggtactcagttatttattgatctggagaagagcagcgtgaactcatggtttaaagaaaggaaatcactgaatgtggttaaggtggagaaggatgaaagtgaccttttgcctctcaatgggattagcggaaagaagaaccaccagagggaggattcagaatttgaagatgagaggagtaacaagcagacagcagtgtatgttgatgacaccgagctatccgagatgatggataaattgttggtctgtcatattaaaggcaagagtcgagattcaaatgctgatgaatcctctaaaaaagaagtaagtaaatctttacagcagaatagacagacacacactgctgatggtgggaagtttcataataagaaaccaaccccaaccagcaatatgacagagatggtggatctcagaactttgttgatcctttgtgcacaagctgtctcttctgacgatcgaaggactgctaatgactatctaaggcagattcggcagcatgcttccccctctggtgacggatctcagaggttggcacattacttcgccaatggcctcgaggcacgcttagaaggcactggttctcaggtctatgctgctctaggttctaaaaaaacatcagcggttgatttattgaaagcataccatgtttatcgtacggccttcccgtttcagagagtggcaaatatgtttgtgggcgatatgatcatgcatttagctgagaaagcaacaacgcttcatattatcgactttggaatctcaaacggtttccaatggccagctttcatctctcgtctctccaggaggacaggcgggccacccaaactgcgtattacagggatagagttgccccaacgaggttttcgaccggcagaaaaagttcaggagacaggacgccacttggcacagttctgcaagcgattcaatgttccatttgagtacaatgcaattgctcagaaatgggatactatcaaaatcggggatatcaaaataaggaacggcgagaccattgttgtgaataccatgtttcggtttaaaaatctccttgatgagacggttgtcttgaataatcccagggattctgttctgaatttaatcagaaaaataaggccgcatctctttgtgcaggccattgtcaatggatcttttggtgcccccttcttcgttacacggttccgtgaggctctctttcactactctgcgttgttcgatgcatttgatactaatttagggagggataaccagatgagactgctgtatgagaaagagttctttggccgagaagctataaatgtcattgcatgtgaggggacagagagggttgagaggccggagacatataagcaatggcagattcgcaatatgagggccgggttcaagcaattgccactgggaccagcagttatgaagagattgcgatctaagttgggagcagttccatgatgatttcgtggttgatgaagatggccagtggatgctgcaggggtggaagggccgaattctttttgcttcatcttggtgggtacccatctaggactttgatgagcttgtttccatgagccatccaccagatggacccgactcagtactcaacgaaggcatccttatttccagaaaaagagcgtgaatttgtggagctgctgcttgtgatctttcttctgacaatactagagcagaaaacatttacggggctttcttggaggtgaggtattgattgtggcggtccttgttgagccacaatcattgcttcggtaggatataaccagctgtacttttatagctgcttgctttttctaacagttagtggcagaatctgagttcacacaattacattagggagatgtacttcttttatagacagtattcagcagattatgagatttgatacttctttgtgtaaaaaaaaaa

SEQ ID NO: 1731 - DNA, 2131 bp, Eucalyptus sp.
atacttttagaggagagagacagagagatagagagagagagagagagagagaggggggaagttggtggtttcttgttcttgaagagttgggaagctgagctgagctgaggtgaagctgagagttctgtgacccagtggtttcagatattactacttttacgcaattggtctgaggaagcacttggctgctgttgctgctgagtatcgtattgaggaattctatggcgcggtgaaagcagatcatttgttttgagattgccatgtttgttcttatggcctgattgatgttctggattacataaaacattctgctcgaaagcttccagtattatctgcaagtcaatcacctggaatcctcctaaatgcaaacatctcacaaccgccagaattcagccagcatccatgggttgtaccatcaacccgtgcaagacatcgacccttattgttcatccaattttcagatcatggaaaacaatgttagtccagacattggcagccaagggactaatttctccattcagggttatgatgggcagtacttcaccctcgactctgctccagccgtttccagttttggttcgtacgattccccttcggctgtgagcgttgcgtctaataggagtcccttttcaactcaaggttcacactcttatgtgtctgatgcacaacattcttctgactatctttatgggtcgcccatcagcggttcttcagtggctaatggtggccctcagatgtgggacaagctgagggagttagaaaattcattgcttggacctgaatctgatatcagtgatagctgcaattgttgcctaaatagtgggagccaccaattcccgtcaactgggcagtggaatgtaaaccagatgatagagatgatccctaaattggatttgaaggacatgctgattttctgtgcacaagcagttgccgaagctgacatgcctaagacagctgctttgatggaggtgttagagaggatggtgtctgtctcaggagatccaatccaacggttgggtgcttacttattagaagggcttagagcgaggttggaatcatctgggagcataatctacagaaagctcaagtgcaaagagcccactggctcggaattgatgtcttacatgtccatcctctatcagatttgtccatactggaagtttgcctacgagtcggcaaatgttgtaattggggaagctataaagtacgagtcaagaatccacataattgacttccagatcgctcaaggaagccagtggatccctattatccagggtcttgcaggacgaacgggtgggccccctctcattcgcatcactggtgttgatgactcccagtcagctcacgcgcgtggaggggggcttgacattgtcgggaagaggctagagaaggttgccgagttgtgtggagtgccatttgagttccacgctgccgccatgtgtggaagtcaggttgaacgagaggacctcagagtgcgacctggcgaagctatagccgtgaattttccctttgttttgcatcacatgccagatgaaagcgtcagtaccgataatcaccgcgatcggctgctgcgattggttaagagtctatccccaaaggtggtcaccctcgtggagcaagagtctaaaaccaacacgtccccattctatacaaggttcatagagactttggactattataccgcaatgtttgagtcaattgatgtagcgtgccgacgggatgacaagcaaaggatcagtgcggagcagcattgtgtcgccagggacatagtcaacatgatagcttgtgaggagacggaaagggttgaaaggcatgaacttttggggaaatggaggtcaaggtttaggatggccgggtttcaacagttcccattgagttctgcagttactgatgctgtcagaaatctattaagggaatataacgagaattatagaatcgaagagaaggatggagctctttatctctggtggaggaatcgagctatggcaacttcttctgcgtggtggtgaaacttgtgggttttgacgagtctgtaaagttttgtactagttgtagttcatgtttagcttgatgattagctttaattctacttccataggatcaagggagcagtgtctagaacttccactac

SEQ ID NO: 1732 - DNA, 3210 bp, Eucalyptus sp.
aattagttggttgactttctaggagtccaaacatactggtggtttgcattaaaacatgatgttagggcagagactttgatagggtttgaggagagtatacgaccatggatcctctgttctttgattcctccgcttgtatcaaagtagatgatcgtcccatagatagccatgccttttcacctagtccagatcgatacccgagtctcacagatggtttctttttggatgaccctttcctagaccttaaatcctcagatagtgcttttctttcgaataaagtagaccctgcaaatgatctttcttcaaaatctattgacctcggtattggagatctaatgtttccctcgacaagtgggatctcagatggaggcccatttggtccatctctgagcttgagaagtgccctgcctccgttgggggacactgattcatcggatcccgttctaaagtacataagtcagatgcttttggaagagaacatggaggagcaaccatgggaatttgctgatcaggttgctctgcagaatgctgaaaagtcattgtacaatgcccttggtcagcagcattcagaggtgtctgatcagagcccctcacagcttgatttaagccattatatcaagagcccaactagcagcctttctgggagtagcagtgcttgtggaagccgtgatgccacaagcgttactgttagctctagcgattcagctgttgctaatattctttacacaatcaaagaacataaccatgctgtgcaggaaaattctgacctggacttccagtcgaatgtggattccagttcacggttgttgtctaattcttcaagcagcatcacgaattatgatgatgggtctgaggaatctttgcatgagcttcttgtcaagagcattttcagtgatagtgagtctatggttcagctcaagaaaggattagaggaggccagcaaattccttcctaccaacagtcaattaggaattaacccagaggacagcaaaccaccattggaaacagagaaaggaaccccaagaatgctcatcaatgaggagatcaacgtgaggtgcttatctgatggattcaagggattcagaaatcacgagagggatgaggacgcttttgaggaaggcagggccaataagcaaacagccttgtatacagaggagagtgaattttccgatttgttcgacagggtgttgctatgcaacgaaaatggtgaggctatgtgttctggtgataaatctgtggagacagggctgagcaaagacatacgaccacaaaggaaaaagcgtggttccaatagaggtaggggtcgtggcaagaagcagggaagtgagaatactgttgacttgagcactcttctgattctctgtgcccaagccatctctactagtgacttcaggactgctaataaattgttgaagcagattagagagaactcttctccatctggcgatgggtctcaaagactggctcattactttgccaatgggctagaggcacgattggtgggcaacgagactcaaacgcagcacttctattctagtcttgttgccaggacgacctcagcagccgatatcttgaaagcttaccaccttcacatttcgacatgtccgtttgttaagttatccatttgctttggaaattacatgattttgagattagcagagaaagccactaccttacatataatagattttggcattggatttggttttcaatggccaatcctcatacagaagctctcttctcgatcagaagggccctgtaaattgcgcatcactgggatagagcttccacaggctggttttcgcccatcagaaagactagaggagacaggttgtcgtttggagaggtattgtgagcgttttaatgtcccttttgaattcaattgcatagcatcaaagaattgggaatccatcaaactcgaggatctcaagattcaaagcaatgagacagttgctgtgaatagttcatctcggtttggcaatctccttgacgagacagttggggacaactgtccacgggatgctgtgttgaatctaatttggcaaattaaaccggatatttttgttcatgttgtatctaatggctaccacaatgcgcccttttttgtgacaagattccgtaaggcactttttcatctttccgcagtgtatgatatgtttgatgctattttagatggtgacagcaatgagaggttggttattgagagagagttccatggacgggaaattatgaatgttgtagcatgtgaaggttcggaaagggttcagaggccagaaacgtacaagcaatggcaggttcgtcatattagggctgggtttaaggcgattcctctggaccaagagctcatgacgttgtttaggggtaagatgaaagaatgttaccacaaggattttgtgtttaatgatgacggctactggatgctgcaaggttggaggggtcgaattctctacggtgcctcctgttgggtgcccacttaggatggctccaaagggaatgttttctgtcatgacctgtaaactgcagggattcttaccgagtcgacaggtcaaggattttattagagtagctcaaaatgtacctatctaccgctcttctatttgcgcatgtatctttttaattgcaaacggttttgaatctgcaatgttttcttactgtttatcaaaccttgagataggaagatacgttttgcagctctatgctgcacggcattgctgattttgctgatattgtgtcatgaattgtctattatatatctcccgagttctgcaagtaacatggcagcttgaagctgattatgggtatgggtgcgggattatcatgtacagtttatgttattcgcctgatggctctgttgtttactagtatcctacaatactgaaaactgtttagcactttgagaacttgactatcgaaggtggggctcatggaggatgatgtttccccacgtgatgcagccaaaatatgctcatgccgaagttgtttctgtcttggagggaaattaagggcaatttaacttctgggtacttcgtggcacgcagaccttttatttgtaactcggttgtctttctgtgaagaaatttggatgggtcaattgtaggtttatttacaagggagatcaagaatgtgattaaactagttattgtagatataattgaattctcatacaactcagtttgtcaataaattgtttcatttacaccaaaaaaaaaa

SEQ ID NO: 1733 - DNA, 968 bp, Eucalyptus sp.
agagcacatcttaaacactctctctctctctctctttctctctcacacacacacaaatacacaaagcacatctagaactcgcacacgcacgctctctcgctccttctctctctctctctctctctctctccctcgcaggccctaagcttacaggttccgtcatgaaaggaggcaaggcgaaggcggagacgaccagagtcgacgccagtttgaagaggaaaggcgccgggacgcagcgagctgggaagaagacggcgaagaaggagaaggctgtgaaggatcctaacaagccgaagaggcctgccagtgcattcttcatcttcatggaagatttcagggtgcagtataagcagaagcatcctaacaacaagtccgttgctgcggttggtaaagctggtggagacaagtggaaatccatgtcagaagctgagaaagctccttttgcagcaaaggcagagaaaaggaaggatgagtacaacaagaagatgaatgcttataacaaaaaatcagctgaaggaaccaatggtgccgatgatgaagagtctgacaagtcaaaatctgaagtcaatgatgaggatgatgaggatggagatgacagtgcggaggttagtgctagatgctgtagatggtttaaataggaaagttgtcattataagttgtatatatactgatttgtcttttgtttgttctggcaattttaggaggaagaggatgacgactaagtcactattaccctcgaggagtatgtgtaaactgttacgccaacaagcaacaaaagaattctgtcattttggacatgtagttgtttgccttgatgataattaggtgaacagtgattggcttgagtatcttctgaaacttaaatagcgatgtagttagttgtttatgctgattttagctgaagcttgcttctctgatctcatatatttaagcttctttgcactcaaaaaaaaaaaaaaaaaaaaaaa

SEQ ID NO: 1734 - DNA, 984 bp, Eucalyptus sp.
aaccctctctctctctctctctctctctcctcccctgttttttttttcactctttctcgttcccctgttcacgttcgatccccatcaaaagatgatattccccgcttgattcctctcgttcacgccccgatttctctccccttgaaagttgtcgcctccccggctccgtttcttgaagttttggacgaggaagaacttgtaacttggtaatgaagactacgaagggcaagggcccggccaggagctcaagggaagccttgaagcctgctgatgacagaatggttggaaagagaaaggcagcagctaggcctgaaagcaagcggaaagtcaagaaggataaacaggccaagaaagaccctaataaaccaaagaggcctcccagtgctttctttgtgtttctagaggagtttaggaaaactttcaagaaggagaatcctaacataaaggctgtatcagctgttgggaaagctggaggagagaagtggaaatccatgtctcaggcggaaaaagccccatatgaagccaaggctgcaaagaagaagaccgagtatgaaaagctgatgaatgcctacaacaagaagcaggagagcgtggatgaagatggtgatgaggaatcagagaggtccaaatccgaagtcaatgatgaagatgaagctagtgcagaggaggctcaggaggatgaggaagaagaggaggaagacgatgatgacgacgacgatgaggactgaagaaggatgttgtggaactccctggtcgaataggtcatcttgtggacaattctggaccgtaggtatacgatgcgttgagctcgcatatggcacttctggttcctgagtctaaattctgttttttgtttttttggctttggccagattcctatggcttgttgtataacatgttctggtccacagaaagtgcttgttgttgttacccaagtaacataatctatcttatgtctccgccgtttatggtctaaaaaaaaaa

SEQ ID NO: 1735 - DNA, 2921 bp, Eucalyptus sp.; identical to SEQ ID NO: 258

SEQ ID NO: 1736 - DNA, 1141 bp, Eucalyptus sp.
tttctctcttttctctcaagctctctccttcatcttcaagaacacaagaccaaatcaatctcccaccatctcctcaaatgggcatagatgatctgtgcaacacaggccttgttctgagtcttggcctcgggacgcccttcaagatcgaagcccagaggcaagccaaacagcgccttaacttcgagccctctcttacgctgtgcctctccggcacgaccaaagctacccgcgacgagcagcctccggcggaccacttgtatcgccaggcttcgccgcacagccacaacagcctcagcgcggtgtcgtcgttctcgagtccgcgggtgaagagggagagggacctcagcagcgaggaggccgaggtcgagacgcgggtgtcatcgaaggcgagcgacgaggacgacgacggcgcgaatgcgaggaagaagctccggctcactaaggaacagtctgctcttctggaagagagcttcaaacagcatagcactctcaaccctaagcaaaagcaagctctagcgaggcagttgaatctacggccccgccaagtcgaagtgtggtttcaaaacaggagagccaggacgaagctcaagcagaccgaagtggactgtgagttcctcaaaaagtgctgtgagacgctgaccgacgagaaccggcgattgcagaaggagctccaagagcttaaggccctgaaactggcccaacccttttacatgcacatgcccgcggcgaccctcaccatgtgcccctcgtgcgagcggattggtgcgggcccgagcgtcgacggcgcggcgccgacgaagggccctttttcgatgacgacaaaatcacacttatacagtcatcactttaccaatccatctgctgcttgctgattagaagttattagggttttagagatattacagagagagagagagagagagacatatatagaccccaaatcacaaccccctataatttttgcttgagggcttgtagctagttaaagatccaatgtaattatttgttagggacatatagtaaactcctgatggatcatcatctccttgttttctttcttcttttttgggcttaatctgtaaatgttttaacaatatatctgagattatcaatggaggaattactttaattaaaaaaaaaa

SEQ ID NO: 1737 - DNA, 1286 bp, Eucalyptus sp.
gtccctttcctatccgtttcgtgacccacctgggcatctccaattactctctctctctttctctctctctctagggttttcgaagacagctcctccccctcgaagctcgctagggttttggatcgtcgtctcatctcgggtcgtgtttggaatggaggaatatggccagatgaacgagaacagtagcactgggtccagagggaacaacagcttcttgtacgcatcgccggttcttgggccgagctcctccggcaatagcaattacgggaggggaaatagcagcggtggccacttctattcccagtccggcgatcactgcttccaatccgaagcgccgccgcacccggtggtgaagactgaagcaaccacctctcaccacggccatgctcagaagtttcatcactattctctggtgagagaccatcatgacccatcagcttctcaccaccaccaccaccaacaccaccagcatcagcagctacaaacagcgagcgagagctcgcgcgaggtcgatgccatgaaggccaagatcatcgctcaccctcagtattccaacctcttggaagcttacatggactgccaaaaggtcggagcgccgcctgaagtggtggcgaagctgtcggtggcgcgacaggagttcgagtcgcggcagcggtcgtcggtggcttcggcggacgggtcgaaggacccggagctggatcaattcatggaagcgtattacgacatgctggtgaagtaccgggacgagctgacgcggccgttgcaggaggccatggacttcatgcgcaggatcgaaactcagctcaatttgctcagcaacaatggcccagttcgcgtcttcaactctgatgagaagtgtgaaggggttggttcatcggaagaggatcaggataacagtggcggtgaaacagaattacctgagattgatccgcgtgctgaggatagagaactgaagaaccatctgttaaggaagtatagcgggtatttaagtagcttgaaacaagaactctccaagaagaagaagaaaggaaaactacctaaggaagcccggcagaagctgcttagctggtgggagttacactacaaatggccatatccatcggagacagaaaaggtggcattggctgaatccactggtttagaccagaaacagataaacaattggttcataaatcatgttatagagtgttgggtaaagtccatggcaacccaatgcaagaaatatttttgatgactaaggtcattcttaggtcatatctatgtatcctctctatatgtcttggttt

SEQ ID NO: 1738 - DNA, 1303 bp, Eucalyptus sp.
ggcattcaaagctctgtgctttccaccgaaaggactccagcagaaaggactcgtcgtcatgggcgagagagatgatctgggcttgagcttgagcctgagcttccctcagagtcacctgcatcagcagcagcagcagcagcagcagcagcagcggcagtccctgcagctgaacctcatgccctccttggtcccgtcctctgcttcgtctgctcaatctgggttcaatcttcagaagcgctcctgcaacgacgccttcccttcttcttcagatcggaactccgaggcgcgatcgttcctccgggggatcgacgtgaacagagagccgtcggcgggggcggcggcggactacggcgaggacgaggccggggtgtcgtcgccgaacagcatggcgtcgacggtgagcgggaagcggagcgagagggatcaccagagccagaccaacggcgacgacctcgacaacgagagggcgtcctcccgcggcggcggcagcgacgaggaggacggcgacatgtcgaggaagaagctccggctgtccaaggaccagtccgccgtcctcgaggagagcttcaaagagcacaacaccctcaatcctaagcaaaagctggcactggcgaagcagctggggctgcggcccagacaagtggaggtctggttccagaacaggcgagccaggacgaagctgaagcagacggaggtggattgcgagtacctgaagcggtgctgcgagagcctgacggaggagaaccggcggctgcagaaggaggtgcaggagctgcgggcgctcaagctctccccgcagttctacatgcacctctcccctcccaccaccctcaccatgtgcccctcctgcgagcgcgtcgccgccccgtctcccccctccgccgtcggccgccccctcgccgccgtcccggcccacccccgccccgtgcccctcatcaacccatgggcccctgcggccgccccactggcccacgccccgttcgacgccctccgctcctgttcgtgagcgtggaggggccgtcggggttgggttcggggtcatgggcattttggtcattttacgcgggacggtgtccggatcgaaggagttggagaaattgtacaaattctggagtagcgttttggtctctaaggatatggtttgtcggaaaatgagattttggagggtctacaatgttttgtaccgtgacccatcatcttttccctgaaagtttaggatttgggacaaagacgtcaaaaaatttgtaaaatccgatgttccattaatttttactaacctatgattggtggcctaaaaaaaaaa

SEQ ID NO: 1739 - DNA, 2912 bp, Eucalyptus sp.
accctcttcctcttcttccccaaaacactcctctctctctctctctcaaactcacacagacacacacatcttcctcactgtacagtctctgtaaaagaaaacccttcttttctcttttccatttctcactcaagcagaagaagctctcaagcagccccaagacatgccaaagcgatcagtctgagcttcaaccctcaaagcttctctcctcaagagtagagagccttgagggaatacaatcagcgaaaaatgttccaacccaacatgttcgacagccaccatcacttgcttgacataactggcgcgagaagctccgagagcgaagtgctgaagatgagagaaatcgaagatttcgagaccaaatctggcactgaaaccatggaacccgacccttcaggcgacgacgttcaagatcccaacaacgacgacaacagcaataacaatggtcaacgccagaaaagaaagcgttaccatcgccacactcagcgtcaaatccaagagcttgaagctttcttcaaggagtcccctcacccagatgacaaacaaagaaaggaactgagccgggagctagggttggagcctttgcaagtcaagttttggttccaaaataagcgaacccaaatgaaggctcaacatgaacgccacgagaatgcaattctgaaggctgaaaatgagaagcttcgggctgagaacatgaggtatagggaagctctcagcaccgccacctgccccaactgcggtggccctgccgcccttggggaaatgtcttttgatgagcagcatctgagaattgaaaatgctcgtttgaaagaagagatagataggatatctgtgattgcttcgaagtatgtcgggaagccgttggcttctaactaccctcatcttcctcctcacatgtcatcccgctccccagatcaattcccggcacaatcaggtcttgttggagagatgtatgggggaattgatctcagaagatcagtatcgatgccttctgaagcagataagccattgatcgtcgagcttgcggttgcggcaatggaggaactgattaggatggcacaaggaggagagccattgtggattcccgcgggcagtggccaaccatcagagatattgaatgaagatgaatattttaggatcttccctagaggaattgggccaaaacctttagggttcaaatcggaagcttcgcgagagtcagcagtggttattatgaatcacattaaccttgtcgaaatactcatggatgagcatcaatggtcaggtgttttttgtggcatcgtctcaagagcaatgaccatcgaagtcctatcaactggtgttgccgggaattacaatggggcattgcaagtgatgacagctgagttccaggtcccatcgccacttgttccttctcgagaaaattattttgtgagatattgtaagcaacacggtgatggaacttgggctgtggtcgatgtttccttggacaatatacgagggaatcccatactacggagccggagaaggccatccggctgtttgatccaagaattgcccaatggttactcaaaggtcacatgggtcgaacatgtagaggttgatgatagagctgttcatagcatatataggcccctagtgaattgtggccttgcctttggagcgaaacgttgggtggcgacactggaccggcagtgtgaacgtctcgcgagctcaatggccaataacataccatcaggagatctgttgataacaagcccagaaggaagaaggagcatgttaaagttggctgagaggatggtgcttagcttctgtagcggtgttggtgcttcaactgcacatgcttggacgacattatcagcgactggttctgataataatgtgagggtcatgacaagaaagagcatggatgagccgggcaggcctcctggaattgtgctaagtgccgcaacttccttctggcttccagttccccccaagcgggtttttgatttcctccgtgatgagaactctcgcaatgagtgggatatactttcaaatgggggacaagttcaagaaatggcacacatagcaaatggtcgcgaccctggcaacagcgtctcgttactccgcgtaaataatgcaaattcgagccagagcaacatgcttatactgcaagaaagctgcacagactctgttggtgcttatgtgatctatgctccagttgacattgtcgctatgaatgtcgtattaaatggtggtgaccccgactatgtagcgctgttaccctcaggttttgccatacttcctgatgggccagagttttgtggaggaggaggcattctcgagattggctcaggtggctcgctactgaccgtcgcatttcaaatcctagttgacacagtaccatctgctaaactctctcttgggtcggtggctacggtgaacaacctgatcaagtgcaccgttgaaagaatcaaggcatcagtgtcgtgtgacaacccatgaccaaagaaactgctattatgtggcaagagctggagagatagcaagagcgaagttattttctccaaaatattttcaggaagtcaagaacgcacctgtgcatagtctttttgatgttgcaagagagaagctgctaacacaagaagtgaagtgcatgggttcgggcattgactttgccgaacaaaaaacgagatcaagtcagaacccttttgtttgtagtcttttcttaatataatcattctgtgctgttttggtttagttttgttagtccagtacgaagttgtttcctgcaaatgtgttgtctttgtgccttgaagctagacttgatgactaactcaatgtttgtttagattcaaaccagttggttcaactggcagaactttagatgctattgttattctatggcatgattctggtctcaaaaaaaaaaaaaaaaaaaaaaaaaaaaa

SEQ ID NO: 1740 - DNA, 1668 bp, Eucalyptus sp.
aaaaagtccaccagctgttctccaaaaatcccaaggtccataagcaaaaccaaccacacaggaagaaacagatagaaatttttccttccttccttccttcctttccttccttcttataaagcagagacagcttcctcttctccgtctccaatccagtcactttccaggaagaaagaaagctccctgctcctcccgcgagaaggagaagcttcctccctcatccatggcgtccctgtcgttgctgcagtgaccgcaggaggaagaagttggtcatccccgcgaaggaaacatggcgtacaaccacggtcaaatgccgcaggagcaagtccccttccaccactactccgaccaggggggccaccaccagggcagagatggcgtgcacaagttcttctccgcctccatcctccgcccccagaacttcctccgcctcgactccgagcccagcgcccacgccgacgacgcctccgccgccgcggccgccgcctcctacaacaacgacgacggggccggggaggaggagatggtcgaggacgacgacggcgggggcggcgggggggattacgagagcgcgaggcacaaggcggagatcctgagccacccgctgtacgagcagctgctgaacgcgcacgtgtcgtgcctcaagatcgccacccccgtcgatcagctgccgaggatcgacgcgcagctgacgcagtcgcagcgagtggtggcgaagtattccgtgctggggaatggtggggtcgtggacgggaaggagctcgatcagttcatgacacattatgttctattgctctgttcctttaaagaacaattacagcaacacgttcgtgttcatgctatggaagcagtgatggcttgttgggagctggagcaagcacttcaaagcttaacaggagtatctcctggtgaagggacaggggctacaatgtccgatgatgatgaggatcaagatgatagtgatgccaaattgtttgatggaagctttgatggccacgacagtatgggatttgggcctctagttccaactgaaagtgagagatccttgatggaacgggtgaggcaagagctgaagcatgagctcaagcagggctataaggaaaagattgtggatatcagagaggagattctgcgcaagaggagagccggaaagctgccaggtgacaccacctctctattaaaagcgtggtggcaaacacactccaagtggccctacccaacagaggaagacaaagcaaggctagtacaagagacgggcttgcaattgaaacagattaataattggtttataaaccaacggaaaagaaattggcacagcaacccttcgtcttccacagttcccaagagcaaacgcaagaggtgatccggataaagagagacctatgtaaagcaacgtcaaaagccactttccatctattggtttgcaacaactgccactgtgagccctttcgagaggaaaggtctcggctgatagttaacatgggcagcgagaagacagcagtttgaagatggtatagcaaatgttacgatggatcagctatgcagatcgatatacttaaaacgatgcttaagaagagaagggtcgaaaccccccctcggcttcttgcccacctctttctaacggagaagtgtattgctgtggtactgtgtttaccttgccagaaacgt

SEQ ID NO: 1741 - DNA, 2566 bp, Eucalyptus sp.
gaaccaacttttgcgaagagagagagagagagagagagagagagagaggaagagggtcgggtcttgtgtgtggttctcaggtgtgtgaactgggtctctccaatagttcattgcaaattggagcctttctttctgctgaattctcgggaccagaggatgtctggtgtcttggaagagttttttgcccgttctgtggtataccctcaactggtataagccttcagagctctctcggtgattatgaaaggcctactcagataagcagttgcaagcagcatgtcgacttactataccagttccagtgaccaaagagatgctgcacctgttctatacttacgagaacacgcccccacatcgcacgctgaagaacctcttcttcctggcaataatatgacatatgtaacttctggtttcttctcgagtgcattgaccgggaatcctcagcagcaaagtaacggcatggatatgttgtctgttggtggtctggatactatgccgcagcaccaagctatgttttctggccttggtgggtcccaaatgagcgatcatggtttggctgggtggagagatgggaggaatgagatgctttttatgcagccaatggccagccactcaacagtccaagatggtcagaacatgcagggacagggactttcacttagtttggggacgcatattccctcaggtatccacattccttcgagtcaatatcggagtcagaacttgggtttaactgcgttcttaagtcctaattcgtcaaaatcggctgaaagcaatagtagaaatggctccactgttgatgaacaaccaagaagtgcagagttcttcccccagagtctagtaggagccaaccaagacttgaacacagggaacttttctgtaaatggaatgtcaaacatgtcaagaatgctttcgaattctagatacctaagggcagctcaacagctgcttgatgaggttgttaatgttcggaaagctttgaagcaatctgatagtgagaagattaagaagtctgaagagggagatgaggattccaagaaagacgtggtctcaaatcctcaagagtcagatggtaattccgctggcgacctttcacaggctgaaagacaagaattgcagagcaagttggccaaactttcgtcaatgttggatgaggttgatagaaggtacaaacagtattactatcagatgcagattgtagtgtcgtccttcgacgtgatagcaggacctggtgctgctaaaccatacacagcccttgcccttcagacgatatcgcgccactttaggtgcttgcgagatgcaataagcacccaaattcaagcaacccgtaagagtcttggggaacaagatgcttctggaagcagtaaaggagtgggaataccccggcttcgttttttggaccagcagctcaggcagcaacgagccctacagcagcttgggatgatgcaacagcatgcatggaggccgcaaagaggacttcctgagagttctgtttctattcttcgggcctggctatttgagcattttcttcatccttacccaaaggattctgacaaaatcctgcttgcaaggcagacaggcttgacaagaagtcaggtctcgaattggttcatcaatgcaagagtgcgtctctggaaacctatggtcgaagaaatgtacaaagaagagattggggatgcggaaatggactccaactcatcctccgacacagccaagccaaaaacaggagatatcaagtcctccatggaggaccgggtggaagaagtgcaacagagttcaacagctacacagagatgcagctcaggccagctcatggactcatcattcgaccggactccagatgtcgaaatggcaggccactctgtgggattcaactacctgaacgggagacatagagatgttgaagctgaatatggccagatgaagctaaatggagagcaagctggtgtcgacgattgcggtctcttccagaattccatggttcagtccggcagcaacaatgacaggtttatggctgctgccgctgcctatcaaatggccgagctgggaaggtttgggggagggagcggggtgtcccttactctgggactgcaacattgcgagggaggcaccttgcccgtctctactggtgcccacagcggtttcctggccatgagaggggatgacatgtacaaccaggcggcttcttccataggcaccgagacgacagaatttgaaagcatcaacatcgggaaccagcagcagaggtttggttccacgcaattgttacacgatttcgtggcgtgacaacctccacggacttatcctcatgacgagaaagcctccgagaccattccgttaaagcttgcggcagggatgttagggaaatgacttgtattgtggcaccagcacagaaaagtctgtatgataatgtttttctttttttggaagggttagcaagatctgtaaagatttaagattcacacactatttgtttaatatgtgaactggggaattgtataattagggccaagccaagcttagtacagaaataatgaaaagggaatgttggggttgaaaaaaaaaa

SEQ ID NO: 1742 - DNA, 1400 bp, Eucalyptus sp.
ttccctctctttctttctttctttctttctctctctactttttatcttcttcttcttctccgtcttcttcttcactgatcactgcaaaaaaaaaaagaaaaaaagaaaaaaaaatactcctccgcctccgcctcctcctcctcctgctccgcagccgtacgcaggcgcgcacgctcgacagcgcattcctcctcccctcgttcgcggcggcaggcaggcaggcaggcaggcaggcagacactgcgcgtgccatgagaagaaggccgtgatggaatgggagaagcaggaacagcatcacccccaccaccaccaccacccccaccatcacgcgcaccagcagcagcaccaccaccagcagcagcagccgcagcagcagcagcaagcgaaggaggctcagcagcagcaggggggagagggcatgggtaacgggacggcggccgggaacgggggcggagtgctgtacgtgaaggtgatgacggacgagcagctggagaccctccggaagcagatcgccgtctacgcctccatctgcgagcagctcgtcgagatgcacaagaacctcaccgctcagcaggatctcgcaggtgttaggctgggaaatttgtattgtgaccccttgatgacaactggtggtcacaaaataactgccaggcagcgatggactccaacacctttacaacttcaaattcttgagcgcatcttcaatgaaggaaatggtaccccaagcaaacagaaaatcaaagagattactaccgaactgagtcaacatggacaaatttcagaaacgaatgtctataactggttccagaaccggcgtgcacgatccaaaaggaaaatgcagaatgcaaccggcaacaatactgaatctgaagctgaagcagaagttgagtccccaaaggagatgaagacaaaaccggagatctttcaatctcagcagaatcctgtatcaaggaacgaagatttatgcttccaaagccctgagattagctcagatcttcattttgctgattcacagaccaaagtggagagcatggtttatccagatggcagtttgagatccaggaataggaacctaggccagctatctttctatgatgccatgatgtcaaattcaggcggtcttgcaggaaatgagcatctgggtgggaagatggaggtaccaggagcctatggtctgtatcattctgcggaagacttcggcatgagtggatgatgctgattggtgccatggatctgccccccccccccttttcttccatatagcataacttgcctgccatgctaatgctgatgctgatgtttagcttttgccgcttgcggtgtcatagcttggtcggagcctaatcttgcagagttggatgttcggtttgctttttgtgaaggaactgattttactgagg

SEQ ID NO: 1743 - DNA, 2566 bp, Eucalyptus sp.
cgaagaaacaagaaacggctacacggcaatagagagagagagaggagagagagaggtgtgcgaacgaggggtggcgcttcgagaagggctgccttagccgccgacgaggaccggcggagaaacattgtcggtcggaaacaagaagccctttgccaatctctgaggaagctctagtccttcgtcgagtctcgtcgcgcctgcccaaatcaatccgagctttcgaaaaggggtcatcatgcattccagaaagaatcttgcccaaaaagaagactttttgaaggcagaatctggatcggaggttcttgcctcgctgatattgagaaataggagaaggaaaaagcacaaacagaaactacaatcttctgtaaaagcaagaggctcaacccttgccaagaagagggccaataactccatcagaaagagactggtgcgtaggaacagctctgataaagacaaactcataaatttaaaagcttttcataataagaaaattgaaatagttcccgagaagctttcatcccctccatcttcagaaagagagctgcctattgcttctgacgaaaatgtgcaaaacaccgatgaggatgtcaaagttaacaagctgagaaggaagaggaagaagaaaatgagaaagcatttttcgaagttagatgaggcttcacgattgcagaggagaacaagataccttcttattaaaatgaagctggaacagaaccttattgatgcttactctggtgaaggctggaaaggccagagtcgggaaaagatcaagccaacaaaggaattacaaagggccaggaagcagatactgaattgcaaactcggaatacgtgatgctattcgacagctagactccattagttcagtgggcagcattgaagactctgtgattgctcctgatggttctgttcaccatgaacatatattctgtgcaaaatgcaagacaaatgaaacttcctcagataatgatatcatactctgcgatgggacatgcaattgtgcttttcatcaaaaatgtcttgatcctccactggaaactgaaagcattcccccaggagatcagggctggttttgcagactctgcgagtgtaagatggaaattatagagtcaacaaatgcacatctggggacccacttttctcttgacagcaactggcaggatatattcgaggaagaagctgcattgcctgatgggggaattcaggtgcttgacctagacgaaaagtggccttcagatgactctgaagatgatgactatgacccagaaaagatgacgaacaccggcatcaactgtgccggcaatgatgattctcaatcatacgacacaagtagctctaccagcctgagttggtcattagatggtgaaattttgtcaggaccaacaatatcaggcaaggaagggttgaactatcctgagagcattgcagggtctgatgtattaatggacacggatactgatactgtatgtggcccacgacagcgaaatgctgttgattataagcagctttataatgaaatgttcggtaaggatactcctgcctgtgaacaagccagtgaagatgaagactggggtcctaataaaagaagaagaagagaaagggaaacagatgcagccagcaccctcatgactctctgtgaaagtgagaaaaacaatccattcattgaccaagcctcagaaggtgataagaaactctctgcagaagcaagaatgagaaggcggattttcagaattcctccaactgcagttgagaagcttcgccaagtatttgcagagaatgaacttccctcaagatctgtcaaagaaaatcttgctaaagagtttggtcttgaacctgagaaggttagcaaatggttcaagaatgcacgatacatggcactcaaaacaagaaaggctgggggggctgatcaacctccaaaatccccgcaaaagcataaagaatctgaactagcaaaaatgatgaaaggggctgcgcctattttatctaaggatgcctcaacagacattgaattccattcctctctaaatactgagaaagtcatccagcaaaagagtacgaagccaatacacgggaagggttcacctatggtacctgaacatagctatatggagaattttgagttcgatgacaatatgtccttgaaacaaataaagctattgaaaggaaaaccaaaggacaggaagagggttgacttcgcagccagtgagggattacgagaaagagaagctcagttgcgggagctatgtaaaattagaagtaggctagatagtctgaggaagagaacccttacatttcagtcgagtgaatccaaggcttcagacgaattcaacacttgtagatcacgtgtagtatatgttccagtagcagaaataaaggagagagcttgattttttgcaccctcctttagttgcttgctctgtgtaaaagcattttcagtctatcatgacagggttacattgatccaactgttgccatgtattccaaatgtttagttttgctttttaagtgcataacaaccatattggttctatcctaatcttcctacaaatttctgactaaaaaaaaaa

SEQ ID NO: 1744 - DNA, 60 bp, Eucalyptus sp.
atttgggatctgttaaatcaacagtgcaacattatattcttcctgtatatataactgctg

SEQ ID NO: 1745 - DNA, 3252 bp, Eucalyptus sp.
gaataccacagaagggaaaacgatgtctgagagcttttgcatcctttcatgctctgcaactcttgagaggtatatactaaggtgtgtatgcggtgtgatccaagattgaattggggcaatagatcaagaactttcaaggtaagaagaattgtgagagagagagagagagagatcacctggtgtggctggctaagttgttgaaaagcaagcaaagatagagagagagcgacagaaagagagagagcgagagagatgatactgatatgggcatagcaacaccaccactcccaccaatctcctcccacaccaagactcaccaccatcactcaatcgcaatctccaaccccaccaagtctatgtcccaagactatcaccaccccagtatcttcgccttctcaaataacggcttcgagcgacccgacgttgccgcggcctccgctgcctcagaccaagaacagcagcaccatgtagcccagcagatctgccgtgacaagcttcgagtgcaaggctttgaccaacctccaccgccacaactggttggcatggaggaggaaccaggcgggctgcccgcgtacgagaccgctgggatgctatctgagatgttcaatttccctcccggcggtgcagccgctgccgaattgctggagcagccgatggcgtcgggttatcgggctgcccggccatcactgccaaccagtgagtggtacggctcaaaaaacccaggtgtgtataggcgaggagagagcaatatgtcacagcaacatcaccatgcgcaccatcatcatcagcaacagcagcaaaatcagatttctaacattaatgcggaatcagcagcagccatgcagcttttcctcatgaacccgcaagcgaggtcgctatcgcctcccactcctcatcaccaccatcatcatcccccaccaacctcctcttcaacccttcaaatgcttctcccaaacccatcgccccctccttccctccaaggattccatgtgtctggctcgggcagcgctgcccccaattatgggactggcatgatacccccggctcaattcacttgggtccccgacggcggcgccgcaaccgcagcccagctcaataaccctagcgagatctctggggcggcggtcgttgagggtcaaggcctgtcactgtcgctgtcgtcatcgttgcagcacttggaggctgccaaggccgaggagctgcggatgggagacagtggcttgctgttcttcaatcaagccgcaggaggtgggtcagccaactcttcagcttcagcttctgctgtcgctgcctctgttcagtaccaccaccaattcaagaacttgggagtgcataacttgcaaagccaccaccatcaagtccatgtcggctatgggtcatctccgtcttcctcgtctctcggggttgtcaacgtgctaaggaattcgaggtacctcaaggcagctcaggagctgctggaggagttttgcagtgtgggtagaggccacttcaagaagggcaagtttgggaggaacacgagctcatcaaaccctagttcaaacccaagcaataacaacactagtagcgctagcgccgtcggtggaggcgcttcttcttcgtcgtcgaaagacgtccctcctttatcggctgctgatagaatggagcaccagaggaggaaggtcaaacttttatcgatgcttgatgaggtggagagaagatacaaccattattgcgagcaaatgcagatggtggtgaacatgttcgacctcgtgatgggctacggagcagcagtcccgtacaccgccctcgctcagaaagccatgtcacggcacttccggtgcctaaaggatgcgattgccgcccaactgaagcacagctgcgagctactgggtgagaaggacggcgcgggcagctccggtataaccaagggcgagacaccacggctcaagttgctcgaccagagcctgaggcagcagagggctttccaccagatgggcatgatggagcaagaggcctggaggccgcagcggggcctgccggagcggtcggtcaacatactgcgtgcatggctcttcgagcatttcttgcatccgtatccaagtgacgctgataagcatctgttggctcgacagactggtctctccagaaaccaggtctcgaattggttcataaatgccagggtccggttgtggaaacccatggtggaggagatgtaccagcaagagtccaaagaaggggatgaggacgacgatcatcaagcagagcgatcagagagctccaggaacaacctcagcactagtggccatgcacagacaccaacgccttcctccttcacaccaccacccattaataacaacaccaacagcaacaatgcatcaacaccaacaagaagatcagaaatcaatgcccccgaaagcgacccttcacttacacccgccatcaatagacaccccttctcggagacccaggccaccaccctcctccaggccaccaccgccatgatctcctccgctgtccaggtggcgggcccggcgcacatagatgacccctgccgccgcagcatcggaggcagcacgggcttaggcggcgccacggacatcgggtccgcgctgatccggtttgggacagccgcggcagcaacgggcgacgtgtccctcaccctggggctgcgccacgccgggaatgtgccagagaagagctctttctcggttaccgacttgggcggctgttaattagtaattaaatttttgcctgtcatctagctacctttgggaaaaaaacaattttagaaaaagaaaacctttctttttcctccattatcattaatctagcttaaaaacaagatacaccaaccctcaggaaacaacgtttgtacattgtcttactagctaaataggtagtttattgaatttcagtaactttctatattgtaacagatgtatagtagctaggacatcattatttggtgtgggactatgacttctctgtgctctttgtgagctctcaaatgctctcttttcttttttcttttttgggagttaaacagtaggtgcaagagagagggaagggagagggtgggagagagacatttgatagctcctataaatggtaaaattggggaggaaagggtggtggtgatgatgatgatggttgtgtgattgtatctgttagtttaataattgactgaaaaggagcacctatatttcacatagggctgcattattgtttttacttcctgtgcaacatgtgagcttttattgtgtaaaaaaaaaa

SEQ ID NO: 1746 - DNA, 1099 bp, Eucalyptus sp.
attcaacccgttattgtggacatgtgccctatcgattcgggccgctccttcgacacgagccttagtctcggtttaggctgttatggggatcctgaagatcacgagatcaagatcaagaaaccgctcgcgaagctcagtggtaactccacgtgcctcacgataggcttgcccggcggggaggcgtgcgggctgggatccgcgagtggggacgaggtcaggaacatcccgagcaggtcggcatcgtcgttctcaaactcaagcagtgcgaagagggagaaggcggagcaaggagaggaagaagcggttgagagagggacgggctcgccgagggcgactatcaatatcgaagatgaagatgagttcagccccaggaagaagctcaggctttctaaagcacaaagttccattttggaagagagcttcaaagcgcacacaaccctcaacactaaacaaaagcacgatttggcaaatcggttgaatctccggccacggcaagtggaagtgtggttccagaataggagagccaggactaaattaaaacaaactgaagtagagtgcgagatgctgaagaaatgctgcgaaaccctaaaagaagagaacagaaggttgaagaaggagttgcaagagctcaagtcattgaagccaactgcgtcggtttataggcagattcctgcagctgctctccctctatgcccttcttgtgaaaggattgcccatccagaattcccgttctcgactgaatctcgactttggcctgctcatccatcagccgcttgttaaacataatctttaaggcgagaaccttgcatagttatactagttttggatttttcttcttctgcataaaatactcacctggcctctctgctttattaatcgggtagtggactcactgtagtgactcttttgtaagttttcattgcatagatatactttttgttaaaacaggatatgatgcgatgtgaattgttcatggaagttaatattgggtttgccaaggttcatctattaaattaggtgtgcatgtcgagggctatgcataatttcgtagtcccgtcaagcagcgtttaatccctttcttaaatcatcaaaaaaaaaa

SEQ ID NO: 1747 - DNA, 2151 bp, Eucalyptus sp.
atgcttgctctgactctctctccctctttcccttcccgacccaccagcaaaagaagttttccaagtttcaaactttcatccacattgctcggccgattctcttccccctctctctctctctctctctctctctctctctctctctttcttacaatttcacgatcgattctgtccgcaaacgtccgctaaggttggccttctttaaggatattgggtcggctcgtgatctcttcgtgaggtttttgatagggtcttgacgagtcaatctcgtcggaattggacccggaagttggttcgtgccatttcgttgctctgttacctacctcgacgcggtttgtcccgattgctttcgatctgaatccgctccgaggtgggtggtttccagtttggtgatcgggcttctcgggtgtgcgaaagtctagtgagatcatcggattcggtttcttgcgatcttggcgatccggtttgatcggagagctcgtcctgtttccggtgctttggagtcagcttcctcctctgcttccgaatattgacttctcgagaatacagctgacttctcatattcagagtccgatcttcggagctcggcgcgttcgatagggaattggctggcttcaggttcctggggtctgtgctttggatgttaagctcgtagagactgaatcgacgatggatggttcgcaaggaaaatcgaatgctccggctccgttcctggtcaagacctatgagatggtcgatgatcctcagacggacttcctggtgtcctggagcgagagcggaagcagcttcgtggtgtggagcccgcctgaattctccggggaactgctccctaaatacttcaagcacaacaacttctcgagtttcgtgaggcagctcaatacttacggctttagaaagatagatcccgatcagtgggagtttgcgaatgaagaattcataagaggggagaaacaccttttgaataacatctaccgacgcaaaccaatccatagccattcggggcagggtgctcggttatctgatacggagaaacagatgtacgaggaggaaatcaagagactgcgacacgagaagagctcgcttcagttggagcttcaaagatatcagggagataatcaggatgttgatttccagatacagttactacgtaagcaattccaaaatatggaacaaaaacagacgcacttgatcaccgtcttagctcaattaatgcagaagccagtatttgcttctctttttacgcagcagtcggatagccctaccaaaaagagaaggttggcggaactggatcatttacatgactcagatgacaagagtgggctagagagtttgaaattccagaaagaaaaattcaatggtgttcccttttctctactagatttggactccgttgagaaactggagcagtctttgcactttttagaaaatctccttcaaggagtcgataacacttcaggcgcagaacagcacgacttcggagcaatatcgttgccttggccggcgggtttcaccgagagaaaggaatctttggatgattctgacaggcatatccgcccttggtcacctgggtcacctccatctccgaaagatgttgcgttgtcaccggaactagcactaggaacagatcacctcgagagcccagagacatcatcggtgtgtctcaacatggacatcagcctcaaatcgtcagtgatcgacgtgaacatggagccggtctgtgtccccgacgtggaaaacttgaaagaacagattctcgagaaaatgcctggtgcgccgactgcggtcaacgatgtgttctgggagcagttcctcactgaagccccttgcgcgtccgactcccaggaagtggagtccgaaagaagagaaggtagcgggagcaggagccccatgaagctggctaatcgcgggaagttctggtggaactcgcatctcgggaacgactttacgaagcacgtcgggagcctcgcttcggaaggaaggagttgatattcatcggtgctgtaggaacactgtaaacacgttcttttcacctgcataggctgctgggtcattcattttccttaatggttgtatacatacaggatccctatctctctttctattgataaaacagcatctgctgctcggtattattcgttaagaaaaaaaaaa

SEQ ID NO: 1748 - DNA, 1024 bp, Eucalyptus sp.
atttttacgcattttgtcgctcagtctctctctgtttctgtctctgtattttgtctctctctctctctctctagtgcttctcgctgagagaggtgaaaaattcgatgaacccagaagaggagcggtacccgaaatctcctcccggttctcctgaccgcgggaggggtaaaggcaaggctcctgccggtgccgggtcgtctttttcggccgcgttgcagcccgaaacgccgtcgttcgtgatgggttcggaggcattgccttctgggtcgttcttcgatatggagagcattggcctctccgggtctcctttgcctctcatggagttcgaggcgttctctcctttgaacacgtcctcgtcgttcgacttgtttttcgaggtgaaaccggaacctgttctcgaaacgacccgtcctctcgggcctccgtttggtgctggtgcagtggaaacagaggaggcaggatttccggcgagaggcggtgacatggagactactgtcggtgctcctcagcctctggagcgcctacagggtacgccagtcccaccgtttctttcgaagaccttcgatttggtcgatgaccgatcgttggatccaatcatatcgtgggggtcgagcggcgagagcttcgtggtgtgggaccctgttgaatttgccaggagtgtactcccaaggaacttcaagcacggcaatttttccagttttgttcggcagctaaatacttatgtgggtatttgctggaacacggccttcattggctgctgttctctttctgtaaatgcttttttttccctctgcctctttttgcttttatattttgatgtatttctttttcattttttgctgcaccgctgtgccttttcctttgtttcctgcttgactttgttgtaaatcaggttcggcgcacgtttagttgtagttccactgcataatgggggcataatggaggcattcttgatgctgtaatctgtagcgagagcttgtaaatgactttgaaattaatgagtaatttgttcaaaaaaaaaaaa

SEQ ID NO: 1749 - DNA, 1241 bp, Eucalyptus sp.
atccattcctgcttctctctctttctctaccctcattattcaacgaaccttccagagacccattccgtccgagagcgacctccgatggctccgccgccgccgccgcccctcgagcagcgcggcgactccccggccggcgagtcgcagcggtccacgccgacgcccttcctcacgaagacctaccagctcgtcgacgacccagccgtcgacgacgtcatctcctggaacgacgacggatccgccttcgtggtgtggaaccccaccgtcttcgcgcgcgatctgctccccaagtatttcaagcacaacaacttctccagcttcgtcaggcagctcaacacctacggatttcggaaactcgtgcccgatcggtgggagttctccaacgattgcttccgcaggggcgagaagcggctcctgtgcgaaatccagcgccggaaggtctccccctcgccgacggccgcggcggtggcggtcgtcccggattccgtggcgaccctgcctacggcgatcccgacggcgatgccggtgatttcgccctcgagctcgggagatgagcaagtgatgtcgtcgcagcactcctcgccgccgtccgcctgcggccagaactgcacggccgagatcatggacgagaacgagcggctgaggaaagagaacgcgttcctcagccgcgagctgacgcagatgaagagcctgtgcaacaacatcctgtccctgatgtcgggctacgccccgaacgggcggccgcaggaggccagttcccgcccggtggcgagggcgctcgacttgatgccagtgaagcggccgacgggcggcggcggcggcggcggcggcggcgacggcgacgacgaagaggaggaggaggaggaagacgaggaagaggatggagaggggagcccgaagctgttcggcgtggcgttggggatgaagcgcgggagggaaatcagagaaggggaggtggcggtgatgtcggggtccgacgccatgctgcggctgcagcaacccggttccggcggcgtgaaattcgagccgtcggatggggatcagagggcgatctccttcccctccgggatagcttagttactgtagaagtatgattaattatcggcgtaagaacacagaatgtgtgaaagccaagaagagaatatccccccaatgttcgttagcggttagcggttagctctgtaatgtatcttgtgtactactctgcatgaatcaacttcagcaatttttcaaaaaaaaaa

SEQ ID NO: 1750 - DNA, 1623 bp, Eucalyptus sp.
tgctttggagtcagcttcctcctctgcttccgaatattgacttctcgagaatacagctgacttctcatattcagagtccgatcgtcggagctcggcgcgttcgatagggaattggctggcttcaggttcctggggtctgtgctttggatgttaagctcgtagagactgaatcgacgatggatggttcgcaaggaaaatcgaatgctccggctccgttcctggtcaagacctatgagatggtcgatgatcctcagacggacttcctggtgtcctggagcgagagcggaagcagcttcgtggtgtggagcccgcctgaattctccggggaactgctccctaaatacttcaagcacaacaacttctcgagtttcgtgaggcagctcaatacttacggctttagaaagatagatcccgatcagtgggagtttgcaaatgaagaattcataagaggggagaaacaccttttgaataacatctaccgacgcaaaccaatccatagccattcggggcagggtgctcggttatctgattcggagaaacagatgtacgaggaggaaatcaagagactgcgacacgagaagagctcgcttcagtcggagcttcaaagatatcagggagataatcaggatgttgatttccagatacagttactacgtaagcaattccaaaatatggaacaaaaacagacgcacttgatcaccgtcttagctcaattaatgcagaagccagtatttgcttctctttttacgcagcagtcggatagccctaccaaaaagagaaggttggcggaactggatcatttacatgactcagatgacaagagtgggctagagagtttgaaattccagaaagaaaaattcaatggtgttcccttttctctactagatttggactccgttgagaaactggagcagtctttgcactttttagaaaatctccttcaaggagtcgataacacttcaggcgcagaacagcacgacttcggagcaatatcgttgccttggccggcgggtttcaccgagagaaaggaatctttggatgattctgacaggcatatccgcccttggtcacctgggtcacctccatctccgaaagatgttgcgttgtcaccggaactagcactaggaacagatcacctcgagagcccagagacatcatcggtgtgtctcaacatggacatcagcctcaaatcgtcagtgatcgacgtgaacatggagccggtctgtgtccccgacgtggaaaacttgaaagaacagattctcgagaaaatgcctggtgcgccgactgcggtcaacgacgtgttctgggagcagttcctcactgaagccccttgcgcgtccgactcccaggaagtggagtccgaaagaagagaaggtagcgggagcaggagccccatgaagctggctaatcgcgggaagttctggtggaactcgcatctcgggaacgactttacgaagcacgtcgggagcctcgcttcggaaggaaggagttgatattcatcggtgctgtaggaacactgtaaacacgttcttttcacctgcataggctgctgggtcattcattttccttaatggttgtatacatacaggatccctatctctctttctattgataaaaaaaaaa

SEQ ID NO: 1751 - DNA, 1207 bp, Eucalyptus sp.
tccttcctccctccctctcgccccttctgaatagcccgagatatttaattctctctcctccgtttctctcctcctcccgctcctcctcctccatcatttcctcctgaaccttctggaatccgtcatcgtctcgccagctccgatcttgtccccctcgctgccatggccgccccgccggcggagcagagcggctcggcctccggcggcgagagccagcgctccgtccccaccccgttcctcaccaagacgtaccagctcgtcgacgaccccgccatcgacgccgtcatctcctggaacggcgacggctcctccttcatcgtctggaaccccaccgtcttcgcccgcgacctcctccccaagtacttcaagcacaacaacttctccagcttcgtccgccagctcaacacctacggatttaggaaggtcgtgcctgatcggtgggaattctccaacgactgcttcaggagaggcgagaagcggctcctccgcgaaatccatcgccgcaagatctccgcctcgccgccggccccggcgatcgtggcggcggggaggcccagggcctcgccgtcgaactccggcgacgagcagggcatctcgtcgtggtcttcgcccccgtcggcgtgcgggcgcaactgcgcgtcggagatcatggacgagaacgagcggctgcggcgcgagaacgtgctgctcagccgggagctgagccggatgaagaccctgtgcagcagcatcttcagcctcatgtcgaactacgccaacggcggcgtccgggcggaggcggcgggggagaagaagccgctcgagccgctcggcggcaacccggaggcggaggcggcggcggcggcggcggcggagagcccgaggctgttcggggtgccgatcggggcgaagcgggggagggaagaggaggtccggacggagatcaagctggagccgttggattgccagcgcaacggcggccggagccgagcagagccgtggatgaaacagtgtcaccgatccaatcaaagggtgttcaactaatcaatcatcactaaccaacacgaaaaaggcgggggtgggggcgttttagggcaatttttagaaatttttaattttagatgaaccgaaggggtgggtggggaccacccggcgggaggcacgtgcggacacggacatcacgtgattcacctgaacctcatttttggaggtgcgggggggggggggg

SEQ ID NO: 1752 - DNA, 5060 bp, Eucalyptus sp.
accggcggtatgttcatttttcttcattcgcaagctcgtaatcccgagctgcgttgcctctttcactctttgttattacaattcgagcttctcatcgttcgtgtcgtaggcgaatgtccccaattttcaaagtttttgagtagggattttgggctatagttcgtgaatgaatttgtgctggttcgcgtgggatctgaaattgagatccaacttcaatggcaattggcagatgggaacgaaacgtccgaaacctgaagacctgtcggttccgccgggtttcgcgtctctcacatccttccttctcaagagggcccaagaggcggatgctgagcctgccgtcgcacacgcctccaccaatcgcagaccttgggtgcttcaccatgagagcggaacccgtcacggtgcacgagattccgactcagcgaagcacgaggcggaggcagttgtggtacaagctggaggggattctgaaaatgcaataacttgtatctttgaggaggctcctgttttccgaccgactaaagaggaattcggcgacccccttgcgtacctgacaagcttacaccagagagcagaagcgtatgggatctgtcgtgttgttcctcccccttcttggaagcctctgtgccaatcaaccgagaaaaacatatggggaagtgctagattcaggactcaagtacaacgactagatttgctgctaaatacccatttgccaagggaaacagttaaatgtaatggaaatgctgactgtaaagaccaaaatatcttcacaaggcacccttgtgaagatgggcgcctttgtaccgaaggcattcaatgggaatgtggtccggaatatactcttgaaactttcaagaaatatgccgatgattttcaggaaaactatttcctgaaaaaggattatgatatgaagtcagatgatgatgtgcagaatattgagtgtgaatatagacagatctgtgagaatcctaccaataaaattgaggtgttatgcagcgatgctttggattctagaacttttggcagtggattctcttctacctttaattctgggtggaacctgaatgatttaccaaggctttctggttctcttctttcttttgagagcttcagtacatgtagtattttggcacctaagctacatgtgggtatgtgctttgcaacaagtctctggaaatgtgaagaacactgcttatattcagtatgctatacgcatattggtgctccaacaatttggtactgcatcccaggcagatatcgtgctaagtttgaggctattgttaagaaatattccatggagttgctatccgtacagcatgggttaaacgtgttttctcatatatccccatcaaccctgaaaagccagggtatacctgtctaccgttgtgctcagaatccaggagagttggttgttatttttccaggggcgtataaatcaggatttagctgtggatttaactgtgtggaatccgttaatgttgctcctcttgattggttatctcatggacagaatattgttgaactttatcgtgagaaaaggagaaagacaatgatttcccatgataagctgttgcttggaggagctagggaagctgcaagggcgcaatgggaacttttactgttgaaaaaggagactgcagataacttaaggtggaaacatgcatgtggaaaagatgggatcctggtcaaagcactcaagtcacgagtaaaatgggagagtctaaggagaaaatatctttgcaactcttcacagtcaaagaaaatggaccagaactttgatgcttcaagtaagagagaatgcggcatatgtcattttgatttgcatctttctgcagtgtcttgcaaatgttcgagggacaaatattcatgtctagatcatgctacacaaatttgctcttgtgcttggaccaataaagttttcctgttccgctatgaggttggtgagctgaacctccttattgaagctttggaagggaagctcagcgctgtgtacaaatgggccaaagctcttgggcttgcttttaagacttccacagaagatctactggtgagttctgttcttgtaagcaagtccacctcagatgctgaaccaactgattcgggtcaaaaggttagcacaagtgcaagcatcacctctagagctcacatcaaggctgaactgaaagaagatttgattaaaaaaatgtcttcagatggattgaggggtgaagtaaacaatgattttggaaaagcagaaagctcatcgcattcacacagacatatcatcggtgttctatctgaaagtgcaagtgtatcagtctcctcggactctgaagatgagataactaattttgtatcccattctggggtgaaagctgcagaatcaaataatgatatggcatcaaccaaacaaagcattgtcgacagtcctacttcaactgtgaagaaagcaccttcttttggcaaactggcacctgggaaactaatggcaaaggatgctagatcttgttcaccactcaatgtcattgtgttaagtgatgatgacaatgactaacacatctttggtcgatcaactgtgctcttccagaagtatacatggtctgcatctaaatgttgtgtgttatagtaaactcttttgttataccagtgttgggtatagatcatgccaaaagaagtcttgcaagaaatgtttccgctagtcttgtttatagtctgcaactaagtgcaaatctgtaagtataaaatgcttgagattttttttttctagagtttttatattgtcactctataatcctggaagaatgcttatgccttacttttttcttcttttgtcttgaatactcatgctttagttatatactacgtctgtagtaggcaccttttggtaatagcttactcccagctttgtcttattgttgacaagtacctttaattgtgtattctaaatttctggtaacttccaccatcttattgcactatgttcatcaaattatatggttgatatcatacttgggttgtggtttttgacacaggaattctagatatgataaaggttgaggaagttcatgccaagaaactcctactacacctaccaatttaattgctgcgatattggatgatttgcatgtgaagattcgctcatgaacctttggagaagcatatcaaaaggtatgagatgttatggaagtaaagtgaggaagaaattattatgaaattgatgaaggaagatgagatggtgtattattgaggagtgcttaataaagtggagaattaaaaatttgacgatagatagaattgctcagatctgtccaagaatcgctaagagtatggcatgagagatggtaccttacaaatggaaaaggtttggttgagtagtctgacatttaatttggacccgacaggtttcatgcttaaacagaacatctcttaataaatgtaatcttagataccctgtgatgataggagtcttaactgatgaacaggacagggaggcttcatgcattgatggaattagtttagtcaaaagtgtggttatcccatgtgataaaaagttggtaccctgggattacaggatatagtgttcgaagttatgccaatcattgaagtttcttgaatttggtcagtatttctggctatccattattgcacatcaatcgcttatacaattaataagttcaaattgccttttctttggcagcatgaattgcagtagttactaagttttttgcttcaactatatcaagaaattattgcattaactatttaggctatcctactttagtttggttactgatgggccactttcagattgtgtggctgtttttcccataatccttctctctgtcactgcttcatcacactaatgaataactgatatgtttctttggcccaagaatttctcctattttggcaacatgacccagagttattttcttttgtgaagaattttcttctcttgtagtcagttcttcataggatgctttagagaatgcatgaattgaaatcttcattgaattttatttttctctcatgctctgtgttaccttatgatgtacaggagtagctgtgatattgaatgttcaagaatcagtcctacatgtacaaatactgactgaagtaatggttttgcaaattattattattattatcagtagtttattttaatttttttccgtttgcttagcagcttctgttagtctttactctcatctcaaatcaagtttgggttggctggtctgcatgtgcatagtgatgcagccaacaaaatcattgatgattttttttcaaatattgctgtttctaccaatatcgttttgtttatgataagactttgcaactcaaataatagccctagaaggattaaaattctttttcaagtttaactagtaaacttatgaacttgggtttgagaattattagtattttgctaaactttttgaagtttgagaagtaggagatcgtgtaacggggagtacgatttagaagagtcgataaatattgtcataattctctctccaaaaagttgaaaaaatgccaaattttgcaagtatttgctttgggatcgtgtgatgcaatttttcttttcatgtgatgcttaggaaactttgggtgtgaagcctcattattctttatcaggcgactcagcggtcctacatcataaaatatccggctaatccacagaacacttgcttcttcattttggttttgctcaacattctagcatctcattctcaattcttctggtatatataaattctgctgaagcctgttttaagtttgcttcaatgatgcagattatgttcttctctccccaaattagcttggaccgttgctcctctttgcctcttatggtgcattcggaaggattataatacaagactctttgatggattcaaaccttctcttgactccatccttgctaattaagtgttaatgaccttcatgttccaatcctttgggaatagggttagccttattactttttcttactgttcttgtatattcctgacgtactcaaaacagtttttttctctcaatagaaaaattatcactttaccaaagaaacaagagcaaaaaaaaaa

SEQ ID NO: 1753 - DNA, 4053 bp, Eucalyptus sp.
gcagagcagaaggcacgaaagagagagagagagagctgtgagctctgcgaagaagacgactctctctctctctaccccccctctctctctctagaatctcgtctcgagtctcgagtaatcctccatcgctgtccaggccgaagctcgatcaatcgaagcagcggcagcgtgctcgcgcttcgctcggctcgagctgtgtctcgcacagtacagtaggtcgtcgagcattgcccgtcgcggcctgtccggaaaccctagaccgaggtcgccttccgctgttccgccgccgtcgccgccgccgccgccgcgatttttgatgtccgaatcgtgtcccctctgttccctcttgttctgggatttgcttgtccatgatactctcctcctgagatgagtgaaaggcgagctatgcagccctgtggattgatctcataagcagtgggtttttgcaagtttatttggggtttaagatcatcagaaagttttaatggatcattcacgtttagcctccggcaatgcggaggacaatgttggtatccctgatgacatgcgatgcaagaggtctgatgggaagcaatggagatgcaacgcaatgtgcatgccagataaaacagtgtgtgagaagcattattatcaggcaaagaagagggctgctaattccgctttaagagctagtatgaagaaggccaagaggaaatcaatagctgaaagtgatatatacttggaaagcaagaatgatgattttgacatgccattgataaacatgaaaactgcagatcatcctcttccgacttcagggaagaaaagtaagaataaggtgtctaagaatcgggttcagcattcgccagaaacaactcctccgcagagctcctcccgcaatttcagaaggtctgtggataattcacaaagagagttgacagaatttgaagagaattggaggccttataagacaccgacagggaattcgtccaggaacaggtcacaaaggagctatgatactagtcctatgacggaatactctgaaagaagcacggattcctctgaagatacaggtggacatatctgtcatcactgccggaggaattccagagacaaagttatttggtgcctgaaatgtgatcggcggggttactgtgacagttgtatatctcaatggtactcagacatttctttggaagatcttcagaaggcttgtcctgcatgtcgtggtgcttgtagttgcaaggtgtgcttgcgtggagagcatctgataaagatgagaatacgggagattcctgtcctagataagttgcagtatctttactgccttttgtctgctgtgcttcctgtaattcgtcagatccattatgaacagtgctctgagattgaattggagaaaaggttgcgggggcctgacatagatcttcccagggttaaattgagtgcagatgagcaaatgtgctgcaatatatgtaggattcccattgttgattaccacaggcactgcacaaattgtccgtttgatatgtgtcttcattgctgtcaagatcttcgtgaagcatccagagacagagcaagagaaacatcagcgaatgatcagattggtgggagtactcaggacaaagaatctgtagattatgtaaaaggacccaaagtaagattaaagtttacagataattttcctgattggcgagctggcagtgatgatagtattccatgcccccctaagaagtacggtggctgtggttatccttctctaaatctaacgcgcattttcaagatgaactgggttgcaaagcttgttaaaaatgtggaagaattggtcagtggctgcaaagttaataattctgccaatcagcaaaatgatgggtcgagccagtccaatttcggccaggaagcttccattcctataaaggagggtaaaaagggtagcttgtattgccccacatctcatgatattagagcacaagggatcagtgagttcagaaaacactggtttaagggtgaacctgtccttgttaagcaggtttgggaccattcatgcatttcaagctgggatcctgttctcatcaggagggggatccaggatatggctgatgagaaaatgaaatatgagaacaaaaaagtgagggctgtagactgcttgaaatcttcagagattgatattgatcttgatcaatttatcaagggatactcggagggacatattcacgagaatggattgccaaaaatgttgagattgaaggattggccttctcctggtgcttctgaagaatttttgttgtatcagaggacagaatttatcagcaaactgcctttgcttgaatacattcattctaagtggggaattcttaacctggcggcgaaagtgcctcactactccctgcaaaatgatgtaggccctaaaatttatatttcttatgggactaaagaggaacttggtaaaggtgattcagtgaccaacctgcatttcaacatgcgtgacctggtatatctgctggcacatacatgtgaaatgaagtgtaaaagttgggataagacaaaattagggaagaatcggaggtccactgggcaatctatcctgaaacagatgcatgggaatctagattcaggtggggatggaagacatttacctgatcaacatgccgggagatacaatattctagaagatcatggtgcccatttggttacaaatgccgacgagagaattgaggatcaagagatgggaatgccctctttggtggaagagaaaaatgccaatctagaactcttgaatagagatgatgaaggtggctgtggtaataatacttctggtgtccattgggacatattccagaggcaggatgtacccaaattaataaactatatgcagaaacactggaaggagttggggatgccagggagtttagatgatatagcgacctatcctctttttgacgatgtgatattccttgacacgcagcacatgagaaaattgagagaagagtttggtaagggcatatctgtccttcttcatttcatgctcttttagagtttaaaacaaagtgaacttatttgtttatccagttaaataaaattttaaaaaggaaaatgaataatgtgagcaacactttttgttctgctttatgcagttcctaaggcaatctgttaacatatgagtggtactgtggagaggattttattaatttggtagattgtggtatttttataattttttatagtttttcagcaaattcaacttttcaagcctgacaaaaatgctgcaatgtttttgaaagtaattttgggtattgctatgttggatgatgagcaatactgtgtgttgactgtccatggatccctatagtcaatgactggtttagcctgataagaagcttcacatttgaaccagcctccagcatatgactgctcaaatcattgtcaactttgtatacttactgggttctctgagttgcacatcttaagtcaaggaaatctttttcgacctttctcaggagtggagccttggtcatttgtacagcatctaggacaagctgtttttgtcccagctggatgccctttccagttgagaaatctccagtctaatgtacagctaggcctggattttgtgtctcctgaaagcttgggagaagctgtcagactagctgaagaaattcgctgtcttccaaatgatcatgaatcaaaacttcagattctggaggttggaaaaatatcgttatacgcagcaagttcagctatcaaagaagtccaaaagttggttcttgatccaaaattcggggcagagcttgggtttgaggatcctaatcttacatcagaggtgtcggcaaacttggagaagataactaagcgaaagcaggttgcgtgttcttaaatcttgtacagcacttgtttgtacagataattatattttggcattcaaaggggagctatttttgcttggttaaattgtaccatatgtattttattggcggtagggatttatttgcttgttgtagatgctaaacaagcttcatttcaatgaatcggattatatgtcgtcgatttaaatgtatacccgtttgtgtgttaaaaaaaaaa

SEQ ID NO: 1754 - DNA, 2084 bp, Eucalyptus sp.
ccgtcctgcagtatgtgagaatcggtgtcgtgggttctgtttcgtttggcgatcggcagagggtcgagttcggcgatcggcgcgagcgcttgcggcctctgttccgtgagaatggtagctgccgtgttccccaaacaccggcagctcagtcattatgccggtaatgccaacctgaacatcccgagatcctcaaaggccgagaagcttgcgacaagcagaagattcccaaggagctcattggatggaatggatagtaggacgttggaagataaggggaagcctattatggtgacacatgcgaagagaactgaagttgtgtcacaggataaaggaatgaagaagagaaagttggatggaattgatgagtgtttaaatggtaagaatattgcaaagaagtataggagcgcgaccggaaagagaagttcggtgaatgggtcgtcccggactagatgggaaagctttgaccaagtaaagtcctcgttcaagatgcagaaattgagcaagtctgaaaagcctcaagcaggcagcagaaccagaaagttccgaacttacaagccacagagggacagtagcgagggactttctgatgttgagtccatggacaatggatccagtgaagattcggaagaagcacgtatagtcaaaatgagaacccgcaggagaagagaaaacaagtttgatctgatgaatgattcactgcatgattcctcttcggcatcgccatcctcctctggctcctttcattcaactctgaaaattgattacactggggatactggctgctcgaagggaaagtatgaggctcaaggaaaacagcgattgagatgtcatcaatgcatgaagaaagaaagaaggatcgtagtcccatgtaccagctgtaagcagaagctatattgtatccagtgcatcaagcaatggtaccctcagatgtcagaaatagacatcgcagaactttgcccattttgccgtggaaattgcaattgcagctgttgcttgcactctagaggcatcataaaggcgtcaaaaatgagcatgtctgatgatgaaaaggtccagcacctgaagtacataataaaagcactgcatccatttttaaggcaaatttgcaaagagcaaattcaggagacacgaattgaagctaacatacaaggaatgccgtttgatgagattgaagtgccaatgtctctttgtcacaattgggagcgtgtctactgcgacaattgtgctacttcaattgtggacttccacagaagctgtccagaatgctcttttgaactgtgtctcaattgctgccaagatattcgccggggaaaagtcccttcccgtgccgaggtgaagcttcagtttgaggacagaggcaatgagtatatccatggtggagatcctgcgccaattcttgtgccaaatacagaaatttttcgaagtaatgttgctcaatccattgaatggaaggccaacactgatgggagcatcaactgtgcttcaaaagagatgggtggatgtggtaatcataagttagagctcaaacgcatacttgataaagattggattcgcaggctggagttgcgagcaagaaacttgctgaaaattggcaaacctgaacagaccattcaaaagcataactgctctgaaattggggatgagatgctaaggaaagccgcatccagagaagggtccactgacaattacttgtattgtccggcatcaagtgcatttttggatgaagaggagcttctatgcttccgacgtcactggattaagggtgaacctgtgattgttcaaaatgttctagagcggacccctggtttgagctgggaacccatggtaatgtggcgtgcattatgcgagaatatggattcagcatctggttcaaaattttctgaagtcagagccattgactgcctagctggttgtgaagtaaatatcattatcccacctttagttttttaaataacatgtaaagacatttttacctgtccatgtactcatggtaacggatatttggagatattgttatctcagtacttaccatacatgtgataactaaatattatttcctaagtaattttaccataaaaaaaaaa

SEQ ID NO: 1755 - DNA, 3618 bp, Eucalyptus sp.
tagaccgaggtcgccttccgctgttccgccgccgtcgccgccgccgccgccgcgatttttgatgtccgaatcgtgtcccctctgttccctcttgttctgggatttgcttgtccatgatactctcctcctgagatgagtgaaaggcgagctatgcagccctgtggattgatctcgtaagcagtgggtttttgcaagtttatttggggtttaagatcatcagaaagttttaatggatcattcacgtttagcctctggcaatgcggaggacaatgttggtatccctgatgacatgcgatgcaagaggtctgatgggaagcaatggagatgcaacgcaatgtgcatgccagataaaacagtgtgtgagaagcattattatcaggcaaagaagagggctgctaattccgctttaagagctagtatgaagaaggccaaaaggaaatcagtagctgaaagtgatatatacttggaaagcaagaatgatgattttgacatgccattgataaacatgaaaactgcagatcatcctcttccgatttcggggaagaaaagtaagaataaggtgtctaagaatcgggttcagcattcaccagaaacaactcctccgcggagctcctcccgcaatttcggaaggtctgtggataattcacaaagagagttgacagaatttgaagagaattggaggccttataagacaccgacagggaattcgtccaggaacaggtcacaaaggagctatgatactagtcctatgacggaatactctgaaagaagcacggattcctctgaagatacaggtggacatatctgccatcactgccggaggaattccagagacaaagttatttggtgcctgaaatgcgatcggcggggttactgtgacagctgtatatctcaatggtactcagacatttctttggaagatcttcagaaggcttgtcctgcatgtcgtggtgcttgtagttgcaaggtgtgcttgcgtggagagcatctgataaaggtactttattttgaggattgctgagattcgtctaggttttattctatagtttttcccatcacattcacttgtctctaagctgcagatgagaatacgggagattcctgtcctagataagttgcagtatctttactgccttttgtctgctgtgcttcctgtaattcgtcagatccattatgaacagtgctctgagtttgaattggagaaaaggttgcggggtaagacagttggatgtttcagtggcatttcacgctagaaagtttctcttatgacatattatccttagagattgctccaattcttttctacaggacctgacacagatcctcccagggttaaattgagtgcagatgagcaaatgtgctggtaacttactactgtttcaatatatgtaggattcccattgttgattaccacaggcactgcacaaattgtccgtttgatatgtgtcttcattgctgtcaagatcttcgtgaagcatccagagacagagtaagagaaacatcagcggatgatcagattggtgggagtactcaggacaaagaatctgtagattatgtaaaaggacccaaagtaagattaaagtttacagataattttcctgattggcgagctggcagtgatgatagtattccatgcccccctaagaagtacggtggctgtggttatccttctctaaatctaacgcgcattttcaagatgaactgggttgcaaagcttgttaaaaatgtggaagaattggtcggtggctgcaaagttaatgattctgccaatcagcaaaatgatgggtcgagccagtccaatttcggccaggaagcttccattcctatgaaggagggtaaaaagggtagcttgtattgccccacatctcatgatattagagcacaagggatcagtgagttcagaaaacactggtttaagggtgaacctgtccttgttaagcaggtttgggaccattcatgcatttcaagctgggatcctgttctcatcaggagggggatccaggatatggctgatgagaaaatgaaatatgagaacaaaaaagtgagggctgtagactgcttgaaatcttcagagattgatattgatcttgatcaatttatcaagggatactcggagggacatattcacgagaatggattgccaaaaatgttgaaattgaaggattggccttctcctggtgcttctgaagaatttttgttgtaccagaggacagaatttatcagcaaactgcctttgcttgaatacattcattctaagtggggaattcttaacctggcggcgaaagtgcctcactactccctgcaaaatgatgtaggccctaaaatttatatttcttatgggactaaagaggaacttggtaaaggtgattcagtgaccaacctgcatttcaacatgcgtgacctggtatatctgctggcacatacatgtgaaatgaagtgtaaaagttgggataagacaaaattagggaagaatcggaggtccactgggcaatctatcctgaaacagatgcatgggaatctagattcaggtggggatggaagacatttacctgatcaacatgccgggagatacaatattctagaagatcatggtgcccatttggttacaaatgccgacgagagaattgaggatcaagagatgggaatgccctctttggtggaagagaaaaatgccaatctagaactcttgaatagagatgatgaaggtggctgtggtgataatacttctggtgtccattgggacatatttcagaggcaggatgtacccaaattaataaactatatgcagaaacactggaaggagttggggatgccagggagtttagatgatatagcgacctatcctctttttgacgatgtgatattccttgacacgcagcacatgagaaaattgagagaagagtttggagtggagccttggtcattcgtacagcatctaggacaagctgtttttgtcccagctggatgccctttccagttgagaaatctccagtctaatgtacagctaggcctggatttcgtgtctcctgaaagcttgggagaagctgtcagactagctgaagaaattcgctgtcttccaaatgatcatgaatcaaaacttcagattctggaggttggaaaaatatcgttatacgcagcaagttcagctatcaaagaagtccaaaagttggttcttgatccaaaattgggggcagagcttgggtttgaggatcctaatcttacatcagaggtgtcggcaaacttggagaagataactaagcgaaagcaggttgcgtgttcttaaatcttgtacagcacttgtttgtacagataattatattttggcattcaaaggggagctatttttgcttggttaaattgtaccatatgtattttattggcggtagggatttatttgcttgttgtagatgctaaacaagcttcatttccatggatcggattatatgtcgtcgatttaaatgtacacccgtttgtgtgttaagaaagtgcgttttcgtcagtgactgctctatgttaagagtgtataagcaagcaattaagacttaaagggccatatgtccccaaggtttttggggctttagaaatgattgagttcaattacatattctaaaaaaaaaa

SEQ ID NO: 1756 - DNA, 908 bp, Eucalyptus sp.
gctctctctctctctctctctctctctctctctctctgtggtggctttcttctgtttttggctgtgatcagacaaacaaaaaccatctggttcggcgtctgaacaagaaaaaatttgagaagggattcaaggaagatggcgaaagagaagataaagataaagaagatagacaacttgacggcgaggcaggtgacattctcgaagaggagaagagggctgatcaagaaggccgaggagctctccgttctgtgtgatgctgacgtgtccctcatcgtcttctcagccactggcaagctctatgatttctccagctccaggcagatgaagggagaggatctggaggggttaaacgtggaggaattggaccaattagagaagaaactcgaggcgggactgagcctcgtgatcaagaataaggaagagaaaacatggaacgagatcaacaaactgcagagaaaggaagcacagttgattaaacagaacaagcaactgaaacatgaaatgaagatgattttacatcaagagaaatcagtgaccgtgaactcggagtcggttaaagacgtttacatcagccgcaatagcatgcctcctctggatggcgatagtcctaatccctcaagttagggcttcctttccgaagctgaagtctcggacaggagacagccaactggtgcattttcctgcaagcaatcaataaagtatcgaagcatgtgacttcaataataacaataaaggattgaagccggcgattgcgaataactattctatagctagttggtgatgcaacttcttatattgatgaaactgcagtaacgattttccatttaaaaaatttgtactatattttcttgctcagttgctctagacaatatcgatacaataatgtaccgttgaatccaaaaaaaaaa

SEQ ID NO: 1757 - DNA, 1043 bp, Eucalyptus sp.; identical to SEQ ID NO: 291

SEQ ID NO: 1758 - DNA, 857 bp, Eucalyptus sp.
ggataaggaagataatacgagagagaacaagagagaaagagaaggcccggaaaaagaaagatggggagagggaagatagagataaagaggatagagaactcaaacaacaggcaagttacctactccaagagaaggaacgggctcatcaagaaggccaaggagatttctgttctgtgtgatgctcaagtctctgtgatcatctttggtagctccgggaagatgcatgaatactgcagctctaacacctcattggttgatatattggaccagtatcacacacagtgtggaaagaggctttgggatgctaagcaagagaatctgagcaatgaactagataggatcaaaaaggagaacgacaacttgcagattcagctcaggcacctgaaaggagaagacataacatcactgaaccacagagagctgataatcctagaagacactcttgaaaacggcctcggatgtgtccgagaccagaaggacgaagttctgatgacgcacaggagaaatcaaaagcagctggaggaggacgctaaggagctccatttctatgcgcaacaaaaagacatgatgatggccgaaactggtagagctgggaacgacggttaccatcaaagaatgaaggctgacttcggcccttccacctaccatgtgcaaccgatccagccaaacttacagcgaaggttctaaaaactcctctcgagaagaaggtcgacattcccatgggcttgctatagtgtcaccgtgcatgaagtctcttatcttataaaatgttgatgcgaaacatagagcgcatatggaataagatatgtgtatgcattgatataattgaagcgccttggcttgaaccgactgtttgt

SEQ ID NO: 1759 - DNA, 1006 bp, Eucalyptus sp.
ggaaaaccgagagagggttccatttttaacaagagaagaatcgtggggttgcttctttttttgttcgcctttctccctgtgctgagagagagagactagagagagaatggggagagggagggtggagctgaagaggatcgagaacaagatcaacaggcaagtgacgttcgcgaagaggaggaatgggctcctcaagaaagcctacgagctctccgtgctttgcgacgccgaggtcgctctaatcatcttctcccatagaggaaagctgtacgagttctgcagcagctcaagcatgctcaaaaccttggaaaggtatcaaaaatgcaactatggagcaccggagcctagcatctctacccgggaagcacaactggagctaagcagtcagcaggaatatctgaaacttaaggcacgctatgaagccctacagcgaacgcaaaggaatcttcttggggaagaattaggccctctgagcagcaaagaactggagtctctggaaaggcagctcgattcatccttaaagcagattcgatccactcgaacacagtatatgctggaccagctcactgaccttcaacgcaaggagcagcacctcaacgaagcaaaccggaccttgaagcagcggctcatggaagggtaccaagcaactgcgctgcaaatgaacccagccgctgcggaggaaatggtttatggtggtaggcacttggctccaccacatcatggacatgatgccttctttcatcccctagactgtgaacccaccttgcaaattggatacccacaagatccttctgcatcggtagtcacagcaggtccgagttcaagtagttacatgccaggatggttgccatgacagactgtggaagctcgttttgcttatatatatatagataatcgtccttgatttgttctctgtgatgtccaatggaaaaagaacatgtgacgataaggttatgcaattatggtttcgagtttggggaatactcggaaataattaaaaaaaaaa

SEQ ID NO: 1760 - DNA, 1049 bp, Eucalyptus sp.
ctttggctttccttctccatctctctcgctctctctttgggattcgtgtgttctttcttcttttttgcaccacccgagattttccgaaagctgaagtggccggggagtgaagtttaagagagagagagccatcaccaaaagcccgaagatcatggggagaggaaagatcgagatcaagaggatcgagaacacgacgaaccgtcaggtcaccttctgcaagagaaggaacggactgttgaagaaggcctacgagctctccgtcctctgtgatgccgaagtggccctcatcgtcttctccagcagaggacgcctctacgagtactccaacaacagcataaggtcaactatagagaggtacaaaaaggctaattcagatagttcaaacacaagcactgtcacagagatcaatgcccagtattatcagcaagaatctgcaaagttgaggcagcagatccaaatgctgcaaaactccaacaggcacttgatgggtgattccttaagttcactctctgttaaggagctgaagcagctggaaaataggcttgaacgcggcatcacaaggatcaggtcaaagaagcatgagatgttattgactgagatcgagtacctgcagaaaaaagagattgagctcgaaaatgaaagtgtgttcctccgcacaaagatagccgaggtggacaggattcagcaaggaaacatggttgctggccctcaggttaatgtaatggaagcattagcttctcgcaatttcttcccttctaacatggtcgagggcggaactgtctactcacactccgacaaaaaagttctccatcttgggtaagtcattgggtggtttggattgaagatgtatgtgtgcatccaataactcggattgaacaatgactgatttacaaacttacagtaatgtatgtgtgcgtactcatttctattacgaccatactgaagcggtagtgtcgtgtcttttcgtctttggaactattacagtacctatgttgatgtgtgatcatgtcattacgttgatgaacgttatgcagatcaaaaaaaaaaaa

SEQ ID NO: 1761 - DNA, 60 bp, Eucalyptus sp.
ttacatataaccaaagttgacttgctctacaggtgtcgtgacattagcgttgtttaagga

SEQ ID NO: 1762 - DNA, 60 bp, Eucalyptus sp.
agaaatccgcgcggagtctatggatgttgagaccgagttgtttatagggccaccgaaaag

SEQ ID NO: 1763 - DNA, 1244 bp, Eucalyptus sp.
aggtaagttctgcgctgcaataactcaagcccccagccaatctcaatcccctcctccatctcttttcttgcacgtttggtaaagctgcaactgggttgtgcttgtgggggcgaatggcctgctttctttgtctgtatactctgtgatggggaggtgaaggaggaggaggaggaggagaagaaagagagagaaagacatggcgagagagaagattcagatcaagaagatcaccaatgcgacggcgaggcaagtcactttctcgaagcgacggagaggactcttcaagaaggccgaggagctgtccgtgctttgcgatgccgatgtcgcgctcatcgtcttctcttcttctggaaagctcttcgaatactgcagttccagcatgaaggaaattctcgaacgacatcattcgcactccgagaatcttgggaaactggatcaaccatcacttaagttgcagttagtagaaaacggcgactactctaggttaagcaaggaagttgcagagaaaggtcaccaattgaggcagatgagaggggaagagctccaaggactaaatattgatgaactgcagcagctagagaaatcgctcgaagctgggttgaatcgtgtaatagaaaagaagggtgaaaagatcatgaaagagatcaccgaccttcaacagaagggcgcaaaactaatggaagaaaacaagagactaaagcaacaggttactgaaatcttgggccggaaaaccactgccaccgattcagagaccatcatcaatgaggaaggcctctcgtcggagtccgtcacgaacgtctgcagctccagcagcggtcctcctcaggaggatgatagctccgacatttcccttaagctggggttaccctacaatggctgatctgctgtctaaatctacaacaatggtgggatgcatggtttgatctgtttgccaaaaaagtgttggagaaacacactcccttgtccatggtaacaaatgacgacaacgatgatttttgttaatttttgatgggaaatgccgagttcattaccgcttgttaggattgtgcattcagtgttcttttcactgtggcattactggatgcagattgtcctaaagtttgagtccgcgggtacaaatgtatttatatacagtgtgagcgagttaggccgagctgatgcaataacttcgaatgtttaaagaaaagcgtgctatagattttgatgggcacaagctttatttttaaaaaaaaaaaaaaaaaaaa

SEQ ID NO: 1764 - DNA, 60 bp, Eucalyptus sp.
ttctaaattcacgaccaaccacggtgtgtgttcacaaaatataagtattggacgctcctg

SEQ ID NO: 1765 - DNA, 60 bp, Eucalyptus sp.
acttgattagtagtgtattattagtctgtcactttattacttggcttggacaagtgtgtc

SEQ ID NO: 1766 - DNA, 1629 bp, Eucalyptus sp.
aaatatctccccagaaaaaggaaaagaaaagaaacatcaagagaaaccacaaaacccacaaatcatcactccgtgcctcaatattctgcattttctgggcattctcttcctcttcttttctgagataccaggaaaatggggagagagaagataaacataaagaagatagacaacttgatggcgaggcgagtgacattctcgaagaggagaagagggctgatcaagaaggctcgggagctctccgttctgtgtgacgctgatgtgtccctcatcatcttctcagccactggcaagctccatgaattctccagctccagtatggaggatacagtgacgaggtacgttcttcactccaatatcgttgagaagccggtccaaccatgtcttccactccagaaagacagcagcaatcttgaaatgttgcgcaaggaagtgaatgataaggcttacaaactgagacagatgaggggagaggatctggagcggttggacgtggagggattgagacaattagagaagaaactcgaggcgggactgagccttgtaatcaagactgaggaagagcgagcatcgaccaagattaacgaactgcagggaaaggaagcacagttgataaaagagaacaagcagctgaaacagaaagcagatgagggaagaggatctggagggggtgggcgtggagaaattgggacaattagagaacaaagtcggggcaggactgagcctcgtgctcaagactaaggtttcttcattaacttatattcatatggttttcataagaaccaagaaaagggtacctcatgcgcattgttctcgtttcactctttggattttccatattttggtcgttcctctctttccaggaagagcgagtgtgaaccgagattaacaaactgcagagaaaagttcatgtacactaactagacccttgtgtccatctttcattataaacattacgcggttaggtcaaccctccaaaagattttccccatgctgtgaacattacataacgttaaagtgcatattcaagtggcgtgggttgggcagatttagatttgttgaatgtaactatttgatgcaaagattctatctattgattcgaagactgtttctttccgaattttcacgaagcacgtttgattaggagaacaagcaacagcgaccgaaaatgacaacgatgatgattttgcatcaacaaaagttggtaaccatgaactcagagggcgataatgcggtcctagaggccgaagacatgttgttggagtcggtcaacggtcaacaacatttccgtcggcagcaatagcgttgcttctctggatgatgatagctctcattcctcaagttagggcttcctttccgaagctgaactatcagacagctaactggtgcgtcttctactagcaaacaataaagggtggaagcgcattatttcgatgataagaataaaggattgaagcccgtgattcaaatagttatgatcgaattagtgcttataagcaaaaaaatattttcctctttcttctcttttcattgtcttcttcgaccttcaaccatggggagggtttgaggtagtctcaccccaccctccatctcttttgattttcttcaagcttttttgtaaaaaaaaaa

SEQ ID NO: 1767 - DNA, 1192 bp, Eucalyptus sp.
acactccctcctcctctctcgctcgttcctccacttccactccctctctctccctctccctctccctctccctctccttctccctcgctctcttcgatgacacggggctagataagtttagggtttcttgagttcttgctctctctctctctctccctgtagagattttttattggagctttttttttttttggttcctggtgttcttgtcgttggtcatagcaagaaaagagagatggggagagggagggttcagctgaagaggatcgagaacaagatcagtaggcaagtgactttctcgaagcgacggactgggttgctcaagaaagcccacgagatctccgttttgtgcgacgccgacgtcgctctcatcgtcttctccaccaaagggaagcttttcgagttttcgactgactcttgcatggaaagcattttagagaggtacgagagatacacttatgcggagcgacagcaagtggccactgattcccctcaagtgcagggaagttggtcgcttgaatatcccaagctcgtggctaggatcgaagtcttgcagaggaacataagaaacttgagcggagaagagcttgatcccttgagtctgagagagctgcagtatttggagcagcagctcgatacagctcttaagcgcatcaggaccaggaaggtagtcgatttctcagctgcaaagaaggaaaaatctctacaggagcagaataacgtgctctctaaaaagatcaaagaaaatgagaaggtaatgagagagagtggacaatgggagcagcaaaccccagcaccgaccacatcctccttcatgctacaacccactttgcctcttccttccctcaccattggcaacacgttccagacaccgcatgtacttggaggagcagaacaagaggagagatctcaagcccgaccagccaacacgctcatgccgccttggatgatacgccgttcaaatgaatagagagatagagaccaacaacattctcctccacatcagcttttgattacggccaaaagccattttcacttcactgtaaggttatgttacggcgcgagtccttaactcagctgcttcctatctatgaccctctataatcggtgtaaagttattgatgtccgaactactccatcataagaaagtaattgggtatccaatccctcttgatgttgtccaaaaaaaaaa

SEQ ID NO: 1768 - DNA, 943 bp, Eucalyptus sp.
ggggcggcgacggcgacggcgacgatcatcccatctccgaccagctgatccttccgctccatcgtcgtcatgtacggacgggcggcggagtggagccgctacgaggacaaggtcttcgagcacgcgctggtggcggtggcggaggactcgcccgaccggtggcagctgatcgggaaccgcctgaaccggtccgcgtcgcaggtgttcgagcactaccagaggctggtggaggacattgacgcgatcgagtcggggcgggtcgagccgccgagctaccgcgacgaccacccggcgagctgcggccagattgccttcgagacgaagccccggatcaaggaggcggagaagaagaagggcaacccgtggaccgaggaggagcacaggttatttttgctcgggctgcagacctatggcaagggcgactggaggagcatctcgaggcactttgtcctcacaagaacaccgactcaggtggctagccatgctcagaagttctacatgcggcagatgagtttggggaagaaagagaggaagaggaatagcattcacgacatcaccacggtcgacacccccccagtcccggcatctgttaatgacagtttcaaccctcctcaagcgggcaatgcccaagatgatccgagttatgattatccaaaagccaacaactttcagcagatgcaaccttgtcaaccggcgcctttcatgaatcaattacttgatcaagggggagggtcgataggatacgaaaacttaagctatttcctgtgaaatgccgggatggaagttttgtatatagatgaaagccagtataaaggagtaattcattatagatttagtggaaaaggggtatatgtacattaggttttcactctttctttatctcagttcatgttgaaccatgttctgaatcactttttgagatgcagtaaatttaaaaaaaaaa

SEQ ID NO: 1769 - DNA, 2825 bp, Eucalyptus sp.
cttcttctcctccttcccaccgaaatattttatagtcccgtgatggcttgatcagaatcgtttccacacacacacacttgttcctctctctctccacagcgtcctcgcgtcgatcgtcagcttcgctggagcggcgttgctgctggtgctggtgctggcctgacgacatggtctgatctcccatcctttcgtcctttcgtactagctcttccccctccccaccgcgccttcctcgccgtggcggcggcttcgtttcgcctctccttcgatctccgttgtcgccatgtccgaagaaccgagagaaggtccctattttgcccgttctcactgaggatttgaagcggcgctagcgtttgaggtccggtcatggacacctactcctccggagaagacttacttattaagggtctccgcagttccctcgctctccttctctccaattatccccatatttgttcccaaagcctctactcggatcgtcctttttgctcgcagacgaggaagccttatactatcaccaagcagagagaacgatggacagaggatgagcataacagattcctagaagccttgaagctccatggacgagcttggcagcgcatcgaagaacatattggaacgaagactgcggtgcagatccggagtcatgcacagaaattcttttcaaagttggagaaggaggcaattgttaaaggagttcctgtggggcagacattggatataaaaattccacctccacggcccaaaaggaaaccaagtaatccttatcctcgaaagactggtgctattactcctacactgtcggtaggagcaaaggatggtggaattttatctgtgtcaccatcaaattgtgagaaattggactcagagacagcaccatttcttgagagagctagcggtggagagaagctagcaaattccaaagagaatcaggatgacaattgctcagaagtttttaatctgcctcaggaagctcactgttcttctatatcttcaaccaacagaagtgttgttccaacaccagtgggtatccagaattcatgcaccttcaggaagtttgttccttcgttgaaagaggataatgggccaagaaaagtttctaattcggagaactctgatcgttcgcatgagaaatcagttcaatgcagaatggatggatatgatggcccgccagcagatgagatgcaaactgctcataatttcccgaggcatgttccagtgcatgttttagatgcaaaccatacaaagtgtactcaggcccccttgcaggatgtgtcattccaggactctgcatttgacccaactggagaagtgaaagcacgccttaacctattcccaaatcaaactccatctgcagctggtgaaaatcaaaaggaagccccaagaatggatcatcaatcatttccggcttttcatcctccctttactccagttcaccataatgaagatgactatagatcattcctccacctctcatccactttttcgagtctcattgtatctacactgctacaaaaccctgctgcacatgtggcagctagctttgctgcctcactttggccgtaccctaatgtggaaaattctgtagtagattctgccgtatgtactcagggaacttttccatgtcggccgtcgagctcccctccaagcatggctgcactagctgctgctacagtggctgctgcaaccgcatggtgggcagcccatggtttgcttcctctctgtgctcctcttcacactggattcacgtgcaatcctacatctgctacagcggttcactccctgaatactagtcaaactccaggagtggaaaaagagagaagagagtgtacctttgaaaacccatgctcacaagagcatttggacccagaacattctgaagctctgcaagctcaaaactcagcttccaaatcacctttaggagcattgtcagactctgaggatagtggaggggcaaggttagatacaagatcaaaagctgctgatcatgagaaggctgcagtagagactgattcccaacaaaaccaatcaaagggaggaaaaccagttgatcgttcctcatgtggttcaaatacaccttctagcagtgaagttgagacagatgcattagaaaaacaagagaagggcaatgaaacactgaaagatcctgatccaaaccaatccattttggaatacttcaatcgtcgctgtagaagcaccagcaatgtgactgactcttggaaggaggtgtctgaagggggtcggctggcttttcaggcacttttctcaagaaatgttctgccacaaagcttttcgcctcctcgtgatatgaagaacaaagggcagcagaaggaaaatgtggaagaaggtgagcaaaataatggggaggtagataaagatgtatcaacattagacctcaacaggaacatgtgtatctcgtgttcttttcatcaaggttctgagaggtctggagttattgacgatggcgaggaagggcttctgacaattgggctgggtcaagggaagcttaggactcatcgaactggatttaagccttacaagaggtgctcagtagaggccaaggaaacccgggcggcaaatgttggcagccaaagtgaagagcaagggcccaagaggatacgcttggaaggggagccttcaatgtgacattccataatgcatgcattcaataaaggaaagctttgttgttgcatgcttattttcggtggtatctattctcgtttctctgttaatttgcagctcacgaaacttgtcgtattacgtgtgtgtactgatgtctatttccacgtagtacctatattgaacttgaactcacgcaaaaaaaa

SEQ ID NO: 1770 - DNA, 1665 bp, Eucalyptus sp.
ccacaaggaagcagccgagtcgagcaagaaactaacgaacgcccggtgtcattaggattcataatccacaagaacaaaagaaaaaaggatcatgggaagatccccatgttgcgaaggcaatggcctgaagaaagggccctggtcttctgaggaagacaagaagctccttgattttatccagcagcacggccatgggagctggatctctctccctaaacgtgcaggtcttaatagatgtggcaagagctgcagattgagatggataaactacttgcggccggacatcaagagagggagtttctccccggaagaagaacaaaccatcttgcatctccactccgtgctcggaaacaagtaagagattctggaaaccctgcacgaaaagctgaatcgatactttcgttgcgctcagacttgttttccagaatataccgttctttatattacgagttatgaccagccgtagacatcgactatctcataaacagagaaatcttagttaatgcattataattaattaatatggtttttatggtcgagtaacgcgctttttccaatgtgccagatggtcggcgatcgcaacgcgacttccaggccggaccgataacgagatcaagaactactggaacacccacctgaagaagaagctgatccgcatggggttcgacccagtgactcaccgccggaggacggacgttttctcgtcgagcttgtcgcagctcatagccctagcgaacctgagcaagctgatcgattctcggccgctggatgaatcggcactcgcgttgcagtccgatgctcttcagcttgctaacagtcttcagtacttacagggtcttctccaacctccagcttcagccacggccagcaacaacaatctattcagccaaacctcatgcattacagaggcaacccaaggttacactgcttacgatcctatcaaggaagacccggatcttaattcgttattgtcgtcaacggcgagattattctccgagggaatcgccggtttctctcaaccactccaagacaataatttcatcgctcatcatcatcttgtacccaactatttgacaaacacgccaccacaagtccctttcagcttccaaacctcgttgaataaccatgtcgacaggacggcggcgactcaatgtctctccatggtcaacgggatcgatcactgtctagactcgacagactccgccctatggggtgactacgatgacctcgatcttcttctccctccgtctctgactgaagcatctgcggtcacggaccggggggatgccagaagcggcggttcctccggaggttctccttcctcgtcgacttcaccttggagcgatattttcttcggagatctggcagggcattgagatcgatctgtctctcttataaaaattttactacagaaagcgtgatttgagcgattgtttccgggagtgcttttctcttatcacattatacgcatactgggtttgttacatagatatggttcttgtgcttttaggcatgtgtaaaaatcacaccctttgtatcagcatatacgacatacgagcacgtagggacgtgcgtttggatttgcatgtaggcctcatgcaatctgtacgtacgcatcgtgtacatattttgtggatataatcatcttttggatcaaaaaaaaaa

SEQ ID NO: 1771 - DNA, 1046 bp, Eucalyptus sp.
ttgagtttcctcttcaggagaaagcaaggagctgtagaggaattgaaaatggtgcaagaagtccgaaagggtccatggacagaccaagaagatttccaactggtgtgctttgttggactttttggagatcgccgatgggattttatagcgaaggtatcaggtttgaaggtggcgggagaaaataataggattgaatagaacaggaaaaagctgcagactacgctgggttaactacctgcatcctggcctaaaacgagggaagatgacacctcaagaagagagactggtgctcgaacttcattccaaatggggaaatagatggtcaagaattgctcgcaagctaccagggcgaacggacaatgagataaagaactattggaggactcatatgaggaaagaagctcaagaaaagaaacatgccctttcctcatcatcagcatcttcgaatatctcttcttcctcatcgaacaaccccacagtggattcattaacaactcaagagactggaaaagaaagcttctacggtacaggaggtcctggtgatatgttaacttcaactgaacagaatattgaagaacaggggaaaagtgagagtgcctgttcattcgatgacatatggaaagaaattgctttggcagacggttatggaatactacctgtttatgatggctacagtgaagaaagctgcaatttctcttgtcctcccatggcttcgccgacaatggaatacaactccgatccactgtggctgactgacgaagaagaatctaagatgtttcccatcaatcagtttattcccgattatgagcatggaggagcttacataactggttgaccaaatattcattctttatcatttgttcatatatgtactgcatccccaatgaggctgtaacatccaggaatactcttataactctagggtacttagtgacccagaaaccgctgcagccactccatgccccttgtaacgtgtgcttttacttctcaacaaaacaggaaaagaagacaaggtatctagtgacaagactagtttgtgtgtggaa

SEQ ID NO: 1772 - DNA, 1382 bp, Eucalyptus sp.
aagatgatctcataaggcaagcatacatttcttcacggagcgcacacactgacttggctctctcacctaagttcacaagaaattgtagctgcaagcaaacgttgcatcgagacaagaacctgattggaaaagaaagactgggcaagtcacaaggtcaagtctcaccgagtggcggccatggtaagagctccttgctgtgacaaggctaacgtgaagagagggccttggtcacctgaagaagatgccactctcgtgaactacataaacaagcacggaaccggtggcaattggatcgctcttcctcgcaaagccgggcttaagcgctgcggcaagagttgcaggctaaggtggctgaattacctgaggccagacataaagcatggaggtttcactgaggaggaggatcacgtcatctgcactcttttctttaccataggaagcaggtggtcggtaattgcttccaaattgccaggaaggacagataatgatgtgaagaactactggaacaccaagctgaagaagaagctaatgaagcaactggcttctctgaaaacagtgcctgaaagtaactttgactatcaggtctgcgcacagaactcggcctcaatcgatcctgagaccaagaatcgggaatatgctgctaattcaatgggattccccaagcagaacttcaatccaggaatacccacttcgaactcgagtcttctctgtcctccaagtctcactgaagtttcggattttagccatgtaccatcgtccacgccagaagtttcaagtcattctgattcgtgttctgtggtgatgaagagcgaatattcagggtctgcaaacggcagttccgaacaggaccaagtcctgttggactttgattttgatagtatgctcaatgactttggcttccaagatcagagcagctaagcacagttcatatttcccaaatgtcaccttcactcgtcaagtcatcaacataaggaaaaaagcaaaaaaagaggaaccttttaagatttttcagtcggtgataggaaattttagtgtcccaattctctcgaagcggtctgaagggtgatttattcgaagttagatgtgagatttcactgttctttgtcatgatatatattttgctgtggcctactcctcagaatctccaaggtatattctcagtttacgtcttaggatgaatcaacgtacttgaatacaaaatgcaatgagcaaagtttgcatttacatcagctgactcactcaaaactggaaaatcaattctttagtttgttactgatgtaatcgacagagcctgtcgcaaaaatttatgtaggatcctgtcttctgcaaggatgatataatacacatgctaagatcaaacaaaaaaaaaaaaaaaaaaaaaa

SEQ ID NO: 1773 - DNA, 1407 bp, Eucalyptus sp.
aaagggtctgattgcttctgacaagtccctttaaggagcctgttattatcttctttttaatatttgcagtcatcaatttgcctcaaatggggaggcactcctgctgttacaagcagaagctaaggaaaggcttgtggtctccagaagaagatgagaagcttgctaggcatatcgttaagtatggacatggttgctggagctctgtgcctaaactagctggattgcagaggtgtgggaagagttgtagattgaggtggatcaattacttgaggcctgatttgaagagaggcacattctcacaacaagaggaggacttgataattgatcttcatgctgttcttggaaacaggtggtctcaaattgcgtcacagttgccaggaagaacagacaatgagatcaagaacctgtggaactccagcatcaagaagaagctcattcaaaaaggcattgaccccaacacccacaagccgctttctgaggtcaagaacggaagagaaggggagaaaacgccgaaatccggcaattttggcaacagaacctcaggagggtttagttctatgtacaatcttgaattcgacgctcccaagtcagaggaaagaaagccaatttcacaagatgcagagccatattcactcactggttctttaagcttgaaaattcaccacccggacaccagtaagtcgatcaatcccgcacctgccagaaaattgttctcagaaaagtccgcagaccttagcgagaagatccctttcgaaccaacccgtattttccctttccagcaactaagctacggttcaagtgctgattattcatttgatccatatctgaaccacaacttcatgctttctgattcgaagtccgccctccactccacttcagcacctgccattttgccacaatctcacagttttagctcattgactgcacaaccccacgacagcttgaagccccatttcggtctcttctccaacgggaagatcaggagcagtgaatcgcagagcagccttttcccttgggacttgcacgctgagaaagaagaagacgaaacccaccagccgaatttcagtggcaacgaatcagaggatctgaaatggtcagactatctgaacatgccattcctgatagctaacccagggcaaggtcaagaaaagcaggctccaccaaatggggttgtgtcagacgcaagattcatctcagaattgtcctgtgttgaagggaataaccagcagcaagaactgccctcacagggttcagacatttactgcaagggtatcaggagattagctgcagcttttgggaattactagattcgtaattaaacttgtgtagtccatgtagttgacagatttttaatttgggggacaaatgtgaaataagaggcttctttggctgactaaaaaaaaaaaa

SEQ ID NO: 1774 - DNA, 1473 bp, Eucalyptus sp.
gaggagagagacagagagagagatgggaagagctccatgttgtgagaaagtggggttgaagagggggagatggacagcagaagaagacgaaatcttgaccaactacattcaagcccatggtgaaggctcttggagatctctccccaagaatgcaggtttactgcggtgtggcaagagttgcagactgagatggatcaactacttgaggtctgacttgaaaagggggaacatcactgctgaagaagaaaaactcatcgtccaattgcatggcactttgggtggtctctaatagccgggcacttgccggggcggaccgataatgagatcaagaactactggaactcccatttgagccggaaaatttatgtcgcacggccatccacatcaacaagggtcgagccctcgttacctacccccatgaatgccgtcaagatagctggcacaggcaagcggagaggaaggacaagcaggtcaagcatgagaaagagcagcttcacatcaatgccaccggagaggcccaaccacagtaccgttcctaaaagtgagaaaggcaaagaagcacaagcacccattaaagggcaagttgggggaagccaagtcatgagctcagagccctcatgggtcccaaacaagaaaacagcagcacaggagagcaacaaggatgttgttcacggctctcgtatcgacacggacgctggcctcaataatgaagtggcggcagaggccgaggggcttttcttgggaccatgtgagtgggtagacagggaaataatgagacttaattgtatgctgcacattgaggatgctggtgctctgaaattggagggtgagaatggggtggtgggtcgctttgaggagagcgagaacgagttcgcggtgatggagaagttgatgccggtaacggaggagacagagagcagcatttggagctcgaaatcgaatgccgagagcagtaccggggagtggtacgtttcctcttcgtcaatgaactacaataagtacaataacgactcggggttcgatgaatggttcgattgggattgggcaggcggagtcggttgcggcagtaatcagtgggaaaatgaagataaaacgttgtcctggttatgtgacagcggcaacggtgaagcagaaaatgccagtgatagtaccgcagtgatgaaaagcgagacaattatgtgaccgagtagaagaagaatgacaaggctttgctactgaaaaggtttccaggatttcacttcaaggtcaagaatgtttatgaggttcatcaccgtgatcatttagaaaattgcttagcgatcactccgaaagtctgattcctaacgtgttacttgtcaaataatgaaactgatcatacaatcttctttcctctatctattccagattaggatgatgcataggaaatgaagttgcaatctccggatgcagaggaaatgatttcaagtgtttgaaattgtatgatttgagtaattc

SEQ ID NO: 1775 - DNA, 1757 bp, Eucalyptus sp.
agaaaatccgattcgaaggaacctttttggtttttttttggcgctcgggcaccggttcgggagtttggctgcaatggctggtgaggcacagaatgaggttgcagtatcaagtgccttgttcaccgttcccaatcgtccttccaaagttgggtcacaattggaagctgtggataatctgaaagagttgcaggtcctggaaaatgaccagacacctaaggtgaggaagccttacaccatctccaagcaaagagagaaatggacggacgaagagcatgagaggttccttgaagctttgaaactgtatggccgcggttggcgtcagatagaagagcatgtaggaaccaaaactgcagttcagatacgaagtcatgcccaaaagttcttctctaaggttgctcgcggggtaagtggcagcagcgagggtgtgattaaaccaattgaaatacctcctccacggccaaagcggaagccaatgcatccatatccacgcaaatctgtcgattcaaaggaggtgaaactgtcctatcaacaagagaggtctccatctccaatctcttcggtagcagatgaaaacactggatctcctacttcagttttgtctgctcatggttcagacatgctgggatcagcatctttgcatcaacaaaacagatgctcttcaccgacttcatgtaccactgatgtaccctctattggtctagctgtaattgagaagcaacctgaaatattcaaagaagaagataaaggctgtctctcctcaactcagatgcccagtggcttgaccttgggaaatttaccttcaatgaattgtgatttaagttcaagaaacacttcttctcctgaggaaattggaggcactgaagcaccctccatcaagctctttggaaggacagttttggtcaccgaaatccaaaaaccagatcatcaagaagcgggcattaaaaaatcacctgtgcagaagactggtgaagacgattcagttactgaggatgagggactgggtaaacctctatcttcagtagaatttgacatgcagttgtctcttggactagcttgtggtaacaatggattcttgcactctggtgcccatgctgccactgccatgaaacttcagaaagaggatgttgaatcttcacggtttacttctgattgtttcttgccatggtggcctttgtaccaaggtccaccattcatctatgtgacaccatctgactcaaccttgattcaaggacctttagattctcacaaggatcgaaagatggaagtagaggaaattatcaaggaaacatccagcgaaacaaacacggtagctaagaaaacagaaggatacggtgataataatgtagaaaacaatgtggatggtgtttttcccaagtgccaaaaacacttggagcggagaactcaccctggtgactgcaagaagggttttgtgccttacaaaagatgcttagcagagagagatgtcaagtctcctgtaattgtttctgaagaacgtcaggcacaaagaaccagggtgtgttcataacactgcctactcaggtaagacacgagcttatctggtagcgtagaacctgtttataactgatccgcatgattcttggactccctctgctccgcaattgtgtaatattcctctacatacgagggggtaaggagacgaagtacgcataattatttttaacttctaagttaagcatgtccaattatttcgaaagaatgattggaagatgtacgtgctgtctgtaccaaaaaaaaaa

SEQ ID NO: 1776 - DNA, 1707 bp, Eucalyptus sp.; identical to SEQ ID NO: 371

SEQ ID NO: 1777 - DNA, 317 bp, Eucalyptus sp.
cgtgggagacttttgttctgggcttgcagcagaacgtatgatgaaagctgagatgtgcacatgtaactgttgaggtaaatcttgtagtatctctaaaactgagtcctgacattcagattcatgatggtcaagggatgcttcttgggtgttattgcaaattcagattcatgatgcaatcgagtattgtgatggcatgtgttgcagtcgtgtatttgcatgatcagccgagcggtctatttggtttgtaggggttagttctggcttccggttcaataaagttttggagctcaattgttcttgtctgcttaaaaaaaaaa

SEQ ID NO: 1778 - DNA, 1529 bp, Eucalyptus sp.
aatcaaccacacatcgccatgcaatttacccccactttctctctctaagggcactctcctctcgctctgtctctctcctcttcttgcatggtctgagaaactttgagatcccctttatctcagactcgtgctttgtttgatcggcgagtggagtggaaaggcggctggtccagaagatgtcgcggagttgctcgcagtgcgggaacaacgggcataactcgcggacctgcatggatggaggaggagcaggaggcggaggcggaggcggctgtggcggggaggggaccggcggcatcatgctgttcggggtgcgcctgacggcggatggctcggccttcaggaagagcgcgagcatgaacaacctctcgcagtacgagcacagtccggagtcctccaacgtggtcgacgccggctacgcctccgacgatgtcgttcacccctccggtcgcagccgtgaaaggaagagaggagttccatggacggaggaagagcacaggctgttcttgctgggactccagaaggtggggaagggggattggagagggatctctaggaacttcgtgaaaacgcggacgccgacacaggtggcgagccacgcccagaagtacttcctccggcggaccaaccagaaccggcgacgccggcggtccagcctcttcgacataaccaccgactcgtactttggggtttcaagctctacaatggaggagggtcatcatcaagcgcaccaagtacccagcttccctctttccttgcctccggcggtttcaccgggaaccggcgagaaactgctggaaagtctgcgactaagaaaagagggctgccagtcgaaacccaccccgtcgaagcccatccgcccggtcccgatccttcccatccctccgtcctcgaaaatggcggctctcgacctcaacaaggcgaccgcagcttcggaaccggcggagccctggcccctgtctctcaagctcgccacggcgaaaccctctgacgaccagcaggcggccgcggcaccagcgccagcaacaaccccacactcgtcgccgaccaacagcatcatcagcgtggcctgaggaatcaatggtcttgtatggtcatatccataatcaccaaatgatcgggctgcaaagttgctagagtggtgggggatctcctagagcttagatgaaagtagagattaggaattaattagaaggtttaagtaggagtcattgtttgcttttgtacataagctaagggaaacatcaagatggtggggacaggagatgcggtgtcgttttcgtggtggtggtctacgttcgtgtccagttggtcggggttagggtttgctttttcgtgggtaaatggggagagtaccaggtacctcttctggtcattggtccggcttgctttgggagcctcaacttaggaaaaggaaaatatctgtccgtgaatattcttgtctatatgtctctgttttcttcctttctttcttttcctgtttaattgaagtattttcgggcgttataatatgttgttttataaaaaaaaaa

SEQ ID NO: 1779 - DNA, 827 bp, Eucalyptus sp.
gctccctcctcctccaaacgtctccgtttctctccagctgaaacatggacaagaagccagacgacgacaatggtaagtcccaagatgtcgaggtgagaaaagggccgtggacgatggaagaggatctcatcctcatcaactacatagcgaatcacggcgaaggcagttggaactccctagccaaagctgctggtctaaaacgtaccgggaagagttgtcggctccggtggctgaactatctgcgacccgacgtccggagaggcaacatcactactgaggagcagctcctgatcatggaactgcatgccaagtggggaaacaggtggtctaaaattgcaaagcatcttcccggaaggactgacaatgagataaagaacttctggaggactagaatccaaaagcacatcaagcaagcagaggctttctctggtcagagctccgagatgagtgatcaagcaagcacaagccacatgtccagcatgccagagccgatggagacctacgactcaccgccgtcattccaaggcaacaacaacatggagcctttgccggtgaatttgtcggtcgagtcaaatgaagcctactggagcatggacgatctttggtctatgcagttactcaatggggattgatcgcggggtgacgtatggtgcagtaatcgaaatggttcgtttacaataatagctaggtttgtttacataaaatggacattagcttttatctcacatatatatctacatacatgtgctagtttagaagttatctacaaatatgtgcatgagttgtaaacgaaactaccatctgcagtttgcatccccgctatgtaa

SEQ ID NO: 1780 - DNA, 1629 bp, Eucalyptus sp.
gttcgcagttcgtccgaccccccgagaacagcgcataaatccccatcgaaacctctcctattcactggcttacagggcctgcttggtgggttaattctttttcagctgatatcgttgtccttacggttatcctcttctctccaactcctctggctctctgttccgccgaagaaatggggagacattcttgctgtgtgaagcagaagctgagaaaagggctgtggtcgcccgaggaagacgagaagctcttcaactacatcacccgattcggcgtcggctgctggagctctgtaccgaagctcgccggactccagagatgtggaaagagttgcaggttgaggtggataaactacctgaggcctgacctcaagagagggatgttctctcaagaagaggaggatctcattgtcagtctccacaaagttcttgggaacaggtgggctcagattgcggcgcaattgcccggaagaactgataacgagataaagaacttctggaactcctgcttgaagaagaagctgatgaagcaaggcatcgacccggcgacgcaccaaccgatcagcgaggtccagctgatcaaagaagagaaatgcgccaagaacgagtccttgcaagtgccacaactcaagggactcaccccagccgtatcgagttccagagcgcacgagccggcattcttaatcagcgacacttgctatgagggcggagcactaatagaaccgtccagagagtccgtcgataataataactacatgagtaggccggttttcgattctttgccttactttgaattccagtctggggtcgacatggtcggctttaattccaatctgctgagccagtaccatgatcctcctagaaccatcgatcaaagccatcttgatattagttctaactttgagttttcctcgatgccgagcctgactaattttgaccaccctggtgcgacgatgagcgggtcggagttctcgaacaattccacttcgagaatgagtccattcttcttccatgaggcgaaagaccaatgctcaactaataatagctcgagcattggcaactacacggggtttcaggtgaacagctcggtcgaaaatgctgctttctcttggtgttctagtgagaacaagttggactgcttgttccagtaccaggccaatgggacaagcaagagtgaagaattgaaaccacaaggttcatggcaagaggaccagctacacatcggtcctgttaattcatcgtcggaagatttcggtagctttcagctgacatcgctttcggacgatctaaccgcagcgaatttcgacatctttcagcagatgtaaacttgtacatccggttcatcttatttgtcttttcccggttttgctctaatcacaaaagatacacacagatgtcgatatatacaggagatcatattcccgttgagagagtggaaaggagtttaattttttttcttttttctttttttttggttggactaagtttccctttttcgtccgatgtttcggtacacggcaatacatcgcaacacgaatgttttaggaatgcagatcttgaatgatcatgatcccattttctttgctattgaaagaaataaggaaaacatttcaattcttcttaaaaaaaaaa

SEQ ID NO: 1781 - DNA, 1138 bp, Eucalyptus sp.
tgtgtggacgcgagagagggagagatagaatgggaaggaaatgctcgcactgtggattcatgggtcacaattccagaacttgcgcgtcgatccggaggagggacgcgagcttcggcggcggcgggagagtcaagctgttcggggtgcaactggaggccgcttacccttgtggcgtggcgtcgcgtcccccactgaagaagagcctgagcatggactgcctgatgccgtccgtgcgcgtcctcacgtcgtcttcgccgctgtcttccgcgaccaattcttctctctctctgcgcgctgcctgcgacgtcggagatcgtcttcttcgagatgagagtcccaacaaagcggctaacagccccagtaatgatgggtacgcctcagatggctttcttgggcgagcccaagagaggaaaaaaggcctgccgtggacggaggaggagcatcggacgttcctggtggggctagagacgctagggaagggggattggagaggcatctccaagaagttcgtcggcaccaggacgcccacccaggtcgctagccacgctcagaagtatttcctccgccagaagagcctcctccccagacggagcaagcgtcgtcccagcctcttcgatgtggggatggaaagatgcagtgctcgtcatcatggacaaatccccaagccaagtgaatctttcaccccaatatgtctgttctcgccccaatttggctcaaccgggcgagatagcagagcaagaatggtactcctagcctctcctcgtacatgttcgttccgtgatcgcgagatcccgagttcaaatctcgctaaccatgcttcgtctgtgagcgggcgtccggcttcgaatcctaacttggagctgacactcgcctccccgaatcatcagttggatcaagcctcttcgattagggtcacctaagtcacacgttgagtcgatgatggaccggtgtgatcccatgtgtaattgtataattcgatctgcctcgagacaaggatgtatgcgttcgagttcttctagaattgtgctagcaagcgctcatgcacaatgattgaccataacgtgtagttatctagttgtaattaagcaaagttcttctggcactaaatccatttttcggttttgattcaaaaaaaaaa

SEQ ID NO: 1782 - DNA, 2120 bp, Eucalyptus sp.
atcaccacagacactcttctcttctctctctctctccatcgctcgcccaaatcaaatccagttcgttctcgcaaagaacacatattcaattccaccttcttctcttcgcttcccttctctctctctctctctctctactctctctctctccccgtgtccggattggagcttcccgaccgtcctccttcgcttctcttctttcgggttttgaaggatttccgcgcacggtgctcccccccctggtccaatcgccgcttccttcagttcgcttcccgaactaaggcgtggatcgaaagtctccattttgaagtgggtggtttcctttttttgtcgttcggagctcgagaattgagccggagaagagctcgtacggacggaacgacagcgacggcggcggttcgaagggatccagatcggtcggtctttgaacggagccggtcgattcgagggcagaggaggaagcccggaagagagacgttcgtcttgactcttttcggggttggcaaaacgagatctcgcgcggtgtgcgttggtgccgatatgaccgtacaggatcaagatggcagtgcccattcgagcaatatgatcgtaggaagcaacgaaatgtcattgagtgatagcctgcactcgataaccagcatctcactaaaggagcagttttcttgtgcgaatgactatgctcccaaggtgaggaaaccttacaccatcacaaagcagagagagagatggacagaggaagagcacaaaaagttcctcgaagctcttaaattgtatggtcgagcgtggcgtcgcatagaagaacacgtgggcaccaagactgccgttcaaattcggagccatgctcagaaatttttctcaaaggtcgttaaagacccgactgatggcaaggtggaaaccattgagattcctcctccgcgcccgaaacgaaagccgatgcatccttaccctcgtaagcttttggctcacccgatcaacaaggaaagcttgcctcaggagcagccaattaggtctgggtctccaaatttctcagtctccgaacttgagaaccaatcgcctatgtctgtgttatccactttaggctcagatggtttgggttcctctggtgcaagcacacccagtggtagctcgtccccaagttcctcggggggtgcggcctgccgtgctggtctgtcactctttgaatcgccagctgaggagaatggtccgatcactagtgagaaactcgagctgcatgctagaggatgtgaggcctcaggaggtgccatggaggaagcaccttcccgaaccctcaagctgtttggcatgactgtatctgtaacagattcgcattggcaatcttcttcggccatcaagtcggagtcgaaagaaatgaaacttcaagatcccctttctcaggatactttgtccgcgacatcacctgcaaaaacaaaccgggtacttaacttagtgcagccacgggacacatccaccgatcgcatggaagctggtcctgccccttcagcgccttggttgaatctttatggcaatttgacaatctctctctcaccgattcgcaataaggtggctccgcgatctacttgcggagacatcaacaaaaatgggattccagaatccaggaacggtgtaacttccaacgagttccacagtggctttgacctaaagctcagtttcctttcgaaaccaagcagcacgtcggtggcccccgaactaatgacgaggcaagagagacgaggaagaggattcatgccttacaaaaggtgtatggcggaaaaggagacgcagccctcaggggcaaccggcctagaaagggaagtacaaagagtacgccttagcttggagtgtgcgtctagcttgtagagagcgcgtccccgttagggccttcgaatcgcattcgttagtttgatgtcctcacgtattgttctcccccaccctcaatatgtctaaaaatgtgtaggtaccctataaatgcctgtactccctgatttgcctcatgtctagttgcttccttttttgattcccgaaagttagtggtgctgttttctgcagaagataattgtataagaggaccaataattcgaatgaagaaagtactttttgcttgctttcttgtaaaaaaaaaa

SEQ ID NO: 1783 - DNA, 1460 bp, Eucalyptus sp.
ggtcctcttttgactcctgttgaactttctcctttctcctcctcctcctcctcgtctcctccttcccctcctcctcctcctccctttctcagccgtcaacatccgaacaggctcctacgattagccaagctcgttctccaccctccccttccttctctatatatacataggaaccacgcaagcagacaggcaaaagccttggctccaagcttatctcaagtctcatcggtagcaaaaatcaacgggaactactcgcgctcaagacatcgcagatagggagagagggagagatgggaagaccgccgtgctgtgacaagactggagtgaagaaagggccgtggacaccggaagaagatatcgtgctggtgtcttacattcaagagcatggacctgggaattggagatctgttcctactaacacaggtttgctcagatgcagcaagagctgcaggctcagatggactaattacctccgtcccggtatcaagcgcggtagcttcacggaccaagaggaaaagatgatcgtccaccttcaggctcttcttggtaataggtgggcggccatagcttcgtaccttcctcagaggactgacaatgatatcaagaactactggaatacccatttgaagaagaagctgaagaagcttcaaggccaagcaaatcctgatgatgatgaccataatcatcacccacaagggttcaacgcaacttcacactccaaccccaagggccagtgggagaggaagctccaaaccgacattcacacggccaaacaagccctctatgaagccttgtcattggacaaccaacatagctttttgaatgaaacgacgacagcacttggtgacggcggcggtgtttgcgacagaccgccgcaccaagaatcaagctacgcatcgagcaccaagaacatagcaagattgctcgaaggatggatgaagagctcgccgatatcagggaagatcaaagtggaaactgccgcccgctctgcaaatgtttctaacaagatggctgccgctgcaggttcgaggagcactagcgaaggcggcgttgctggcgtggcaaccccagagtgcttggactcgctctttagcttcaactcctcgaactctgacgtgtctcaatcggtgtcggcagacgaaaacaacgtcaatttgacgccggagacgagcacgattttccaagaggagagcaagccgggcttggagagtaatgataatcatcaagtgccaataaagttgcttgaaaaatggctgcttgatgatgctgcagctcaggcactacaagatgattacctcatggatatggcattagatcaggatgctttgttctaactcaactagatctcaattagggaaatgatcaattcttgcatggacaaggtccaattgaaaggaaattccaggtttaatcatgttcctgtgattgatccggatagcattggacctagtctatgcaag

SEQ ID NO: 1784 - DNA, 1013 bp, Eucalyptus sp.
ggcaagatcatcaagaattaccatacatagaataatccgcagttgctcaaatttgctggttttggcttgtgatcatgagagatgtaaaggaaaaggaagaaaaagatgatggcaagatgctgaagctaccacctggatttcggttctcgccgacagacgaagaacttgtccttcactttctgcatcccaagaagcagcaggcctctctgtctcctctctatgctcacctggttcctgatctcaagtctcaccaccatgatccttgggacctccatggaaaggcgctgtcgaatggatcccactacttctatttcagcagaatgatgaacaatcgaattacggaaaatgggtactggaaagatttagacatggaagagccagtgtttggtgaagctggagaaattataggaatgaagaaatctctgactttccacattggagaggctccaacaggtcaagagacaaactgggtgatgcaggagtatcatctcgtgtccttccatgaattggctaattcaacacaagtgagtgcaaatattcctcagaaatgttgaaagttagattgtcagttaatctatctttgaaaagcttcacgagactttgtccatcgtacaccatgtgtaaaagagtttcgcttgcaacacatttttcactcacgttgtctgattttgatttcgatatttgctgtggtaagctgtcggattttctttttgcaaccaaggcaatttgactgtaaactcggacttatttctcaagcaaagtgctaatatggaggcaacagagcatatggtccaagtagagaccaccccagcccgagatataagaaaatttttaaaggtggcatccactcggactgtacatgtcagctctacatgggtcgccatgtcgacaatttgctagaaatttcgtttttttttttttttttttttggtcggagctagaaatttcgttggattccagtcgaaatgcaacaaatataaaaagaaacgaaaatttaacgcccaaaaaaaaaa

SEQ ID NO: 1785 - DNA, 1355 bp, Eucalyptus sp.; identical to SEQ ID NO: 382

SEQ ID NO: 1786 - DNA, 1091 bp, Eucalyptus sp.
ctcaaagcttggaagcgaaaagcagggaccgcagaattgcagcagaacgcagagtcgagagagttgagaagagagagagagagagaagatgaagagggcgcagttggagttaccagcggggttcaggttccaccccacggacgacgagttggtgaacgattacctgattcgcaagtgcgcttcgcacgccatctccgttcccttcattgccgagatcgatctctacaagttcgacccttgggtcctcccagaaatggctctgtacggcgaaaaagaatggtacttcttttctccgagggaccgcaagtaccccaacggatcacggccgaaccgggcagccggaaccgggtattggaaggcaaccggagccgataagcccatcggccgccccaagacgctcggcataaaaaaggcccttgtgttttacgcggggaaagctccgagaggagtgaagaccaattggatcatgcacgagtaccgcctcgccaacatcgatcgatccgctggcaagaagaagaactcattgcagcttgatgactgggttctttgccggatacacaacaagaagggcaccatagaaaagcattcaccctccacgctcaatgaaacggcagatttccccgaaatggagatcaagccacagattgttacgccggcggcgctgaacccgtacacatctccacaatatgcggattcgccgatgactacagatcacatgtacacggactcgtcagagtttttacccaagctgcacacggattctagctgctcggagcacgcggtgtcccgggacttggcatgggagaaggaagtgcagagcgaggcgaagtgggacgattgggagaaggccctcgatttccagttcgattcggtggataacttcttggacgatgctttcgcgaatgaacagtatcagttggatcagttctcgcctcttcaggacatgtccatgtacttgcagaagtcattctgatcatgtccgttgagtaacacagaagtcggatgaccattccattcgggttgctttgcattgaaatgcaggctccattggcatggtgatcaatcaagacaatctctgtcttggacaaatt

SEQ ID NO: 1787 - DNA, 1203 bp, Eucalyptus sp.
ctctctccctctctctctctctctctgtgagacacagaaaatgagcaacataagcatggtgggggcaaagttgccaccaggattccggttccacccgaaagacgacgagctcgtctgtgattatctgatgaagaagatgacccgctcggactctctcctcatgatcgaggtcgacctcaacaagtgcgaaccttgggagattcctgaaactgcgtgtgtgggagggaaagagtggtacttctacagccaacgtgaccggaaatacgcgactgggctccgaacaaaccgtgcgacggcaagtgggtattggaaggccactgggaaggacagagcagtgcttaggaagggcacgctggtgggcatgaggaagactctggtgttttaccaagggagagcccccaaaggcagaaagaccgactgggtgatgcatgagttccgagttgagggtcctcacggccctccaaatatcaccaagatttcttccctcaaggaagattgggtgttgtgtcgggtgttcttcaagagcgtagaagtcgccaccaaaccgagcacgggaatagtcagttgctacgacaacagaggcacttcatctctcccgtcgctgatggattccttcatcaccttcgaccaagctcatcctcagcccaaccttataagcaacatcgagcaagtgccctgcttctccattttctctccgagtcaagccaatccaatccatgtggaaccaagcatgcccgccaggaccatcctcaacgcgtccgcattcggggcaatgcctgacttcagttcctgtaataatctggactcctatgcatgcgacaggaaggtgctaaaggccgtcttgaaccagctcactgagatggactcgccaagcttaggagatcaagggagttctgagagcttcttgtccgaagtggccatgcccaacaatatgtggaatcatttctgaattttggagaggcttgaaaagagagagaaaaacaaaaaagagtgacctaatttgccttcagtcttcatattaatctcgcacccttcaaaaaggatgattaatgtaaagtattagttatgcatattatgattgattatctccgtttggatgtgcatatctaggctgtggcatcgtttcatttgtcgaccttggaagtgttgtatactaactcttgattgtaatataatctttgtcaagttaggtgaaaaaaaaaa

SEQ ID NO: 1788 - DNA, 2401 bp, Eucalyptus sp.
ttgagtttgagagtgaagttgtcgagactcaaaaatgccctgcctcattcctgttgatgttttctatgaacatatagattgttttctgcctgtaggatacaggtttcgccccaccgatgaggaactcatcaatcatttcttgagacgacacatacttggatatagagatgacccctgcattattccagagaccccttttgtgcacaaattcgatccttggcatttaccccgcctatttagagaacgctcaattgtgaggtcgaaggaggcagagtggtggttcttgtctcgtcttttgttcaagactcaaaagaatagtaagtacgaccgacaaactccgtccggtcattggaaaacaaccggtcaagagaagaagatcaatgccaaaagtactaataggttgattgggaccatgaggaatttagtttttatagaaaacgagggttcaagcgccaaagagacagtatgggtaatgcatgagtattgcctacatgacaattatggagccaactttcttgaccagcagaaatttgtgctttgccgccttataaacaaaagagatgagttcatcgatgattcaacctctgttgaagctggatcaatatcattgttaatgaacttaggcaatgacaaagcatggagtaacattccagagaacattatcgaagccacgatggatcaacttgcagaggccttatgcccaccaatgaacctgaacctctcctctaatccacatctcgttgacatgggggctccttctcatgtccatattgcaaatgacaatttggatcaatctgaccagcaaggagatgtggtcgatgggattgagacggatggatctattgatgatatcttggatgctattgactggaacatggatgaaatttgccaacagcgtagtggaacagaacctgagacagataatggacaggggtgggggctgcctgcggacagaccgattgagcaaggggagcatgctgacaggctgagacaacctaccatcagacttgtggacgataggcctagggaagaaacaagtattcatgctcaagacaattcacaggaacaaaatattgctcatattttcatgattcaaccaattgaagaatatcctgagatcaactgcttgacacgtgctcctgtacccacccgagcttctagaggtcgagacagagtccaactacataatgggcatggactggcatccaaggccaaggtgactggattagtcgaaaattatggggagatcaactgcttaacacgtgagccagtaacaatccaagcttctagaggtcgagacagagtccatctacaaaataaaccatctgttagactagtatccaaggtgaaggacaaagaaagcaaaggtgaaaaggacaaagctgctgctaacatttccaagaatgtcttctctatgagagagcttaaagcatgcttggaacagactcaagaaatcgaacaaagtagcaaatcaaaatcatctgttttcccagcgagcagtgcaaaaagtcctattatggcgcctgataagtgctcgcagggttctgtttcaagtgcaaattcaaaccgaaccaaacatttcaaatcaaaatccttccaaactgaagccaagccaaaccggaaagtaaaaccctcaagcaaaaccagatagttggtttcaacttcaactggtttgttgctgagtttgtgactttgatggatgtttgctaattaatgcagtctctcttttttactcgtgccgaattcggcacgagaaaatgcagagaagaagctggagcagccatggccgcccgtagccgctcgccgtccgtcgcggtcaccgcccgtccgcgcgcgaagacccgcgcacgctcgccggcccgccgtcgcatcgtctccgcttcacctcagctcgcgtcacagctgctgcatcagctcgtgccggagccgttcggccacctccggccaccgttcgggccccgcctaggtccggttcgacccctcaaccttccccggtccttctccatctcatccaagcgccggatctaccctttcttggcctcaaactgcagcggacagcaactgcagaaaatgggtatggcagcacctatttggcccgttttggccgccttcccgagctcggatgctcggcccgccttgaggaaagtcgatcctcgcgtcatcctcgtcgttttggttcgctcggctcgttaatccggtcctcggtggacggagcggccagatagctttggttggccttgaggagttgcagaggtgaagtcataaggattggagagcgtgtccgacttgtaggtcgtaggacagttcatttttaagagccggtcttttgtagacttttggctgtaggccttcgtctgtaactccgttggtttgtgtaagtgattggttgtgaaaaaaaaaa

SEQ ID NO: 1789 - DNA, 3420 bp, Eucalyptus sp.
agatcgaagtatgtagaagaaaacaagagatggaaactaggatctatcctatgaatatactacccgcggaaaatgaactcaccaagatcgtgctatttcttcagcaggcaatagaaggcttcagattctgtccaaccgaggaggaactactcaatcacttgaagttaacagtatccggatgcagagaaagtttctgcatcattccaacactagaaaacatctacgagataaatccatgggatttaccagccaagttcagtgagaaatcgatcattccatccaaagatcaagaatggtggttcatatgtccacagacgcagagccaacggattagcaggaaaacaccatgtggttcttcttggaatatcaccggtaaacacaaagatattaaggctaaaaatgacaacaaaaagatcggttccaggataatattagttttccatgatggccagaattccaagggcactagatccaagtgggtcatgcatgagcttcatccacatcctgataatatgggttacgttctttgttgcctaaagatgaagcaacatgggaaggcagataaccaagaaccatctaaccaggtaagggagaaccaaccaaacgatgcagctatggcaatggatggagacattccatcaattcctcaatttcattgtcctgaagtttcttctagcgagcagaataaggttattgccgagttatctaaaaaaaattacagtaagagcgatagatcatgtcagaataaaacaaaatccctagccctgatacacgaagacaataaccccttctcacagagcgacggatcatatcagaataatacaaattccccagccctgatacacaaagacagtcaccccttctcacagagcgacggatcatatcagaataatacaaattccctagccctgatacaccaagacaatcaccccttctcacagagcgaaggatcatatcagaataatacaaattccctagccctgatacacgaagacaaacaccccttctcacctaatcagaagcatcttgcgtggactaaaaattcctctagtacagcaaattcatcaggaagctgccttgctgtatctgaacctagtattcatgagttacatttcccacatccttttcctaattttgatgacacgtctggaacttcaaactttaatggtgaacaagcagataagagctgttatagcatggattgtgagaacccagagcaacttccttttgcagaggtgaggaaaataaggatgttgcaaaggtcgaattttttttttctttttcaatctctagaaatatgtaattacatttgggatgtacatgtgttcttgaataacagcatccggtccaggaaatgcagaaccaattaaatgagctaatcacgaacgggagttcctctagtacggaaatatcatccggaagtcacactactattactaaagaacagagctggatcgagccttggatgtcccctccttattgtgatttatttcctagcggagaacttttcaatttatacggcctattcagtgaacctgaagcagaaataggagtaagtcagtatggccaacttggagaaagtactagctgggacaatcgtttggctaagaacaggcagccagagcctcccatacagcaggcacgtcctccattaccggaagagaaaggatctataaaacctacactcagccatcttcccggcaccgagaagatcataacagagtatgcatcttcagatgaagtgccagcaaaagcaaaggaatacaatcaccatgcctcccaaaccctaaaaaatgataaaggaaaagcaatagatacatcatctgaaatatcaccaattaaatcacaaatccaaataccttccatgacaacatggatagacattcttgaggaagaaccattagaacccatcatcacgccagcattatcccaattagctccacaatttcctgaagaaacaattatgcttcttcacacgatacaaaaatcaaagccaaagacatcgtcccaagcaattgagctaagctcaaacgtaacaccacttaccacctccggcaaccgattaaaaagaaaatatagtgagatgataaataggccgcaggcaatcctgcaaaatgaagatcaatatttttaatacaaaaaatgcctactagagaatgatactttaagatggatttttccatgaaaatccaattattttctcacaaaatatattccctaaaaattggtacaaaaatttcttgattataatgtgcaaattctaattgaaagcaaatcggtattatccaaacatttgcctttccaaaatgatcctacccctatcattcattttactggaaccattctccaaatcattccaccatccaaatgccatctcctcatacaacctaaaaattcctagccagaaaaatcactagactctcatatctgcccacatatacatgatgagactagttgtgagatcattttggttccataatagaaatacaaacactagaaatctaataaagtaaacaagctattcggctcagaatttataccattagaacaagaatagtgtttgccgattattctattcaaaagtagcaagaatttttcatgggagtaagattattatatcccccctcaaggccttaatattccaaaactcattcagatattcaaaactaaatgatgggataatttcaatctcatcaaaagtgcatccaaacaaatagtcctggcttggtttaaccaacatcacaaaccaaattaagcctctccaaatagcaaaattataagaaactgcttcatttctacagcaaaatcttgggctagtgcccaacttgctgctttgagatcacaagatgaatacatcacaatcacaaagcaaatgctagtagaactaaaagatgaatacatcacaatcacaaaacgactttacccaatcacatcatagtggtgacaccagggggacgactgctatgaaaataataaatacataataaaagaccagaaaacagaaaacaatcaatcacaggaagcagcacaccaggaatcaaggctatcaatcaatctgcagcagtacgcgggaatcctgccaccactgaaagcagattatgtatcagacagtagcaaatcattgcaaatcatcgagaaggaaacttccattgttcagccacagaagaagaaagactatgtgaaggttgaatcggagaacatatcccgttgcgaaaccagagatgattcgctttcatcgacgagatcgacagcatcaaccagtcagtgccgccgagataaatccaacactaatccaagatctcacattgctgtgttttttgcacttgtttttctggtatgtgtaatcgttgatggaatacacagaatatgtgatagagtcagagtggatacgggaccatgtgttttactggaaaaaaaaaa

SEQ ID NO: 1790 - DNA, 930 bp, Eucalyptus sp.
gcatctcgttgagttcgaccacgatcctgaggaggagtttgtgtttgcatggcaaagctgaaccagatcagagccatcggatcaatgagcaaactgcctcctggcttcgtgtttgaaccaaccgacgaagagatcttattcgagtacttgcgacgcaagatcttcgcccttcctcttcctgcctctatcatccccgaactcatcaacctctccaaccttgatccatgggacttgctcggtaattaatttatatcatcggttctgactattttgtatcagctcctcgcagtgttgatcatataaaaccaaatatcggcagtctcgcgtgcacgtaatgggtttgccttatatatcatctgaattattgtatgcggtgtgagcaatgattgacgacacaggtgatggggagcaagggagatacttcttcagtaacctcgcgggagccaacaatgctgtcatccgagcaacttcttgtggatattggaaggcacagggcgtccctaaacagatctcgccctcttcaagcgacgctcacaaccgcatgatagtggggatgaagaagactctggtgtaccacagagggcggcctccgcatgggtctaggacgtcttgggtcatgcacgaatatcgcctcgttccttcaccctccgctgctcgtggcccgcagctgaattcatgggtcagcgaactaggaaggtgggttatgtgtcgtgtctttgtgaagacaacaagcagcagcagcagccacagtgattccacaagcatggacgtgttgtcttcgtcatcatcgtcaagcggtagttgcctcacagaggactcctcatcaggcgatgaggaacagactagcgaatggttttgttcgtgagcttagtggcatgtaacagacggtgaaaggatcattggcggcttttaagatatccgagaacaaga

(The sequence listing continues in the following parts.)

What is claimed is:

1. An isolated polynucleotide comprising the nucleic acid sequence of SEQ ID NO: 332, wherein said nucleic acid sequence codes for a polypeptide that is a MYB transcription factor.

2. The isolated polynucleotide of claim 1, wherein said polypeptide is a transcription factor that functions in a plant cell.

3. The isolated polynucleotide of claim 1, wherein the polypeptide is normally expressed in a species of *Eucalyptus*.

4. The isolated polynucleotide of claim 1, wherein the polypeptide is normally expressed in an angiosperm.

5. The isolated polynucleotide of claim 1, wherein said polypeptide is capable of upregulating the expression of a gene in a plant.

6. The isolated polynucleotide of claim 5, wherein said gene encodes a polypeptide involved in lignin biosynthesis.

7. A DNA construct comprising (i) the nucleic acid sequence of SEQ ID NO: 332, (ii) an *Eucalyptus* caffeic acid 3-O-methyltransferase (COMT) promoter, and (iii) a desired nucleic acid sequence encoding a polypeptide, wherein SEQ ID NO: 332 encodes a MYB transcription factor that regulates the activity of the promoter, and wherein said promoter and said desired nucleic acid sequence are operably linked.

8. A plant cell comprising a DNA construct comprising (i) the nucleic acid sequence of SEO ID NO: 332, (ii) an *Eucalyptus* COMT promoter, and (iii) a desired nucleic acid sequence encoding a polypeptide, wherein SEO ID NO: 332 encodes a MYB transcription factor that regulates the activity of the promoter and wherein said promoter and said desired nucleic acid sequence are operably linked.

9. A method for producing a transgenic plant, comprising (a) transforming a plant cell with a DNA construct that comprises (i) the nucleic acid sequence of SEQ ID NO: 332, (ii) an *Eucalyptus* COMT promoter, and (iii) a desired nucleic acid sequence encoding a polypeptide, wherein SEQ ID NO: 332 encodes a MYB transcription factor that regulates the activity of the promoter, and wherein said promoter and said desired nucleic acid sequence are operably linked; (b) culturing said transformed plant cell under conditions that promote growth of a plant, wherein the MYB transcription factor encoded by SEQ ID NO: 332 and the product of said desired nucleic acid sequence are both expressed in the plant.

* * * * *